United States Patent 9,328,346 (POLYCOMB-ASSOCIATED NON-CODING RNAS) - sequence listing, part 51

SEQ ID NO: 9317 - RNA, 18993 nt, Mus musculus
aggcgaggucgggcggcucccuggaugcccaguaccggcgacuagacugcgcaugcgugucaguggcguuugcugcggaccgggcuggcaguuccuuccucggagggaaagauuccucugccauggaguccuacgaugugaucgccaaccagccuguugugaucgacaacgugaguagcaucuuuccuaucuuuaaagggacuguguucuccuccaggaaggauuguuuccgcgguuucagccuaggccgccagcucuuugucacuggcucggccugucaggcggguucagcugccgccgcccgcguccuccucacauccauaguuugaaggcagggcggccagccaacauccguguaauggagaauuugaggguagacaaaggaaagagcuguagcccgggaaggguccguggacccuuggcucagggggccuuaaccguucucuuagagcccgacacccgccuucgcucugguuuuccaucacucaauuggcuacucuugcugucuaucuuagccuauuggucccgccuuugggccuugccggauuagaacagcacuccgcagucauuggcuccggcgcuugucgcucuuccggucgccauaguguuucccuucuguaaggggcggugccgugcaguagagcuguagggauuggcucggcaacucagggugcggaaggcgauggcugguccaccggugaaaaaggacaguuuccuugggugugagcuggaggggcaauuuagugaacuguaucuggguggggccggacaaaccgguaccagaaauggccaugggauuucaguuauuuuugugauuauaaauuauaguuagucaagguaaagaagaaaggggggugacaaagcaggcgagaugcuuugauguuugcagugcccaggugagaggcagggggauuaucagacacagugguugucaggugcgcuagcguuuccaggacgcuuugcaccaacaugcaagucgaagccucccaaaaagugaaugguuaaggaggaaguuugccccucuuuucacaguacgaacacggaagguggaggugaccaaggucauacagcaauggugccccacaacuucaucgccuuaucuaaauggcaauccuuugcuaagcaccgcuccacacaugcaucgauaaagacaaauagaaagaacuuaaguauugcuuuuaugaggagggacauuugucuuaauuucugaguuucacucaaagguuuggucccucccacacugguuagaaucuuccuacuuucugggucccuccccugaggcaaacuaccaguucccucugaccuaggcugaccuuuucagagucacugugauguuccggcccucugggaccuggacaugccacuagguccuuuucuuugugucguagguggauagagguugcuuucuccuguuuaugcaggaacaggaggauuggggagguuuuucaaaccacccacuuuaggaguuaaggauccaagacucacaaaaaagauccaagacucacacaggaaucugguuccaaguucuucaaggaaggcgguuuuauuuguugugaauuuuuaaaagggaggcugaggcugggguguauagcccagaugguauugcuugucugacaugcgugaaauccugggcucccuccucagcacagcauaaacuuuugguguauaaucagguauagugguccgggucuggaaucccagcacuagagagguggaggcaggaaagucagaaaugcaaggucauuguuugaagccagccucuaagauguggcauuguuggaagcagggggugggagcaagguuaauuaaauguguuacuuuggggguuuguuuugguuuugguuugguuugguuugguuugguuugguuugcuuugguuuuuugucuuccucacuagccucaguagacuuuuuaacccuuguggguaaggaagugagauccuucauucuuuauuagucccucuacccacucaacacaguacccaaggcccucauaugcuccgcuucuccccccuucuccucuccuccucucucucucucucucucucucucucucucucucucucucucucauucucucugucugucuuuuguuugugugugcacacacguacaaaagcauguguguucaugccuuuagagaccagaagaggucauucaguuccuuagagcuagagcugcgggcagauaugggucauccaacauggauacgguacagaagggauccaaacccugcuccucccaaagggcuacaacuagugcucuuaacuaaugagccaucucuccagcccuccacugcucucucuacccaccucucuuuacacgguaccuaaggccugguacgacuauguacaaaauaaaaccuuauuggcuaagugggugaauagacaacuagugaucucugucaugauaacaaagauguccaguguuggggcagggguaaaggacccaaucaagauaggggacucagaaaaaaaaaaaaaaagauaggggacucagcuauguaacauuguaaaugagugauuaacacuuuuuucuuuuguuuguuugagacggggucuuuguaauauuuuguucucaauguuaauaucuagacaaaccaacuacuuaagucuuuagccaguuccuauguguuagcucuaccuuuuccuuaguuguugaaagaaaaaaaauguauagaaaaaucuaucucgagccgggcgugguggcacaugccuuuaaucccagcacucgggaggcaggggcaagcggauuucugaguucgaggccagccuggucuacagagugaguuccaggacagccagggcuacacagagaaacccugucucgggaaaaaaaaaaaaaaucuaucucagucugcagaaauggcucagcgguuaagagugcucgguacccuuccagaggaccaaagcuugguuccuggcacccacauagacagguugugaccugucacugaagcuccagaggcucagacauccucuucagucugagagcacuugcacucacauacacagacucccacacaggacauacacauauacacauaauuaaaagaaaggcuugcugggcacaugccuuuaaucccaacacuucggagacagaggcagguggauuucugaguucaaggccagccuggucuacagagugaauuccaggauagccagggcuacacagagaaacccugucuugaaaaaaaaaaaaaacaaaacaaaaaaaccccaaaaaacaaaaaacaaaaaaaaaaaccaaacaaaaaaguuuuuuuuuuuuuuuuucuuuuaaagaguuaucaguuuugcguuggcauuagcagugcagaagcagucugccccucccaccagcuccccugccuuggaucccuggagcuggaguggugguugcgagccucucagugaggaugcuaggaaccugacuccagcccuccagaagaacagcaaguacaagaacagcaaguacucugaacggccugauggaccgucucuucagccccuuguuucuguuuucuuuucugagauuuauauacaugcaccacauacaugcagugccugagaaagccaggagagggcaucggaugcccuggggcuggaauuaauaguugagaucuucugaguugauccucgggaaccuguguccuguggauaagcaacaagugccuuaauagaugagccaucucuccaguccuugacucuuuucuuaaaaaagacucucacuguguggcucuggcucccugcagacucauguagacaacacucagcuaaagguccugccuuccuguccccuacaagcugagauuacaucuguguaccaccaugccgggcuguuccaauuuuuccagaaaaguagaaagacgguuucaccugcacucucgcauuuguaagcauugccagcuaauauaaaguaugcugugauugacaaacccagguagaguggggguugcauggugcuagagggauggauacagcugauacagaagcacuguuugggggcgcagggccaauuuuugagugauuaaaaaaaaguucuucuauuaauuacaaguguguggccaaccuuggcuauauggcuacacugguuauauacaauucugacucuacuaaaaacauugaauuguacuguaccuugaauuaguaaaugauauaugugacacguaaauuuuaucucaauaaguuuuuugucuuuaaaauauuuuuggaaccaaaccaaaggcuuagaccaaaaugaaccaauuaacaaccucuguccuagaacccguggccccaccucucucagaaucuagucuuuacuuguuagauggaagaccaugagccuuuuucucggcacaucacacaaccugaaguccuuaagaauacauuuuuccgggcuggugagauggcucaguggguaagagcacccaacugcucuuccguagguccugaguucaaaucccagcaaccacaugguggcucacaaccauccuuaaugagaucugacucccucuucuggagugucugaagacagcuacagugcacuuacauauaauaaaaauaaaauaaauuuaaaaaaaagaaauguuuccccaauaauaacacacacacaaaaaaaaaaaagaauaaauuuucccaagccgcagccugcagcugcuugcugcgugcaucaggagaacggucagugggggagcugacuuuagucugcauagaucaaacauugcaugagacuccguuuucaggaaaccaccacagaguguuuguucuuuccuuugcugaaguguguaacuggguggcagugcauugucuggcgcacacacagucaguccugugugcuccgaggggcagcuugcagaacaacacaguaccucaucucaccaccuccugucugaugguugguccaugccuugucuuggcaggccugcuagggccauggggacaagcugggucugguuccucugaaagcaccccucccugagcugcucugucuucccugcaccaccucugccuggggcugcucacuggcguuccucgugcucgcucaggcucagaauuuagguuuccuccaccaucuuuuuuuuuuaacuuuuaaauuuuucuguuguuuuuugagacaugcucucacuuuguagaccagacagaccaugaacucagagauccacaugccucuucccucugagugcugagauuaaaggugugcaccaguauauccugcugucugccaacuucuuucuuucuuccuuucuuucuuucuuucuuucuuucuuuuuccuuucuaagacagggauaucccuggcuaucuugaaacuuccuuuguagaccaggcuggccuuaaacucaaaacuggccugccuuggcuccugagugcuaggauuaaagacauuugccaccaugccuggcaacuuucugccaaucuuuugcucauaaacuuaacucacaccagcuagucucuugaguguguggcaaaugaccgauacugcuaugugaagucucugaucuugaggaacuuggaaugaaguagagaaaaauaggaagcacaaauucuaacagggcagugagauccauguguugucauggugcagguaauagugagggcugggguuaccguucaagaaagcucaggauuucagcuggacucuuauacucuaacuagaaaaccagaggccaguacaugaagcuggcaucgcuucacuuggcuuugguuuugaguauuuuugaaugucuuuucaucacaugcaugcagugcaugaggaggccugaagagggcaucagauccccuuaaaacuggaguacuggccauugugagccacaguguggacgcuggaaauccaacuuggauccucugcaagaccagucagugcucuuaacugcugagccgcaucucuagccucucgcuugguuuuuuugagacagggucuugcuauguggcuugcuuaaacuguggcucuuccugcaucagccuucaauugggauugcuuacaggcaugugucacuaugaauagcugagucuaacaucauaaccugucuuguuacccagacucuugguuuugugcuaguaaacuaaaaagcagacaacuuggaaaaucaauucuuaaaaauauucagaucugagcguauguaugguagcacaugccuacaaucccagcauuaaagaaguagaggcagagaaaucagaaacucagggucacuuucugcuacagaacagguuugaggccauccugggauguaugaaauccugucucgaguaaauaaauuuaaaucugggccugagguaaagauugcaccuucguuucucaugucuugauccccugccaggagagccaucuagucuuuuggcauuccacacccugaugaagacaaugaacaauuauuaagaaacuugaacagguuccugaagaucuugcacacggugcuguucccacccacccguccaggccccgggguuugcaggagaagaauuccccuucuuucuuaggcuuugaguucauuucacaacuguaccuuccuaaucugcugccagugaguuuauacaguaucuccuguucgcucucuucugccgauagaggguuggcuguccccugcuguccccuucacauugcuuucccugcccuuccuccacuucucaccauacauagcccuguccucagacuugcgagaggcagacacccaagguuaccucaucaccuccaucaccucuccaacccucuccguagaggagcaggaggcgggaagcaagggcaagaaagccauuggcgcaaagacaauauugacuacugugaaucucuuguguauuaauugaugcuguguggccucuggaagucugcugugccccaggggaagugguugaguacagaucggcucagguagggggaggacaugggaaccagaugugguaguaguuuagaaggaagauaggaagauaaugugugguggcauaugccucuaaugccagcacucaggaggcagaggcaggugaguuugaggccagccuguguuacagagugaauucuaggagagccagggcuacacagagaaacccuguccaaaaaaaaagagagagagacuggaggaggaagaggaggaggaggaggaggaggaggaggaggaggaggaggaaggaagaagaggacuggaaagaugacuuagugguuaagagcacugacugcucuuccagagguccugaguucaauucccagcaaccacaugguggcucacaaccaucuguaaugggaucugacuguacucauauaaaaaaaaaaaaaaaaucuuuaaaaaaaaaaugaaggaggaggaggaggaggagaagaagcagcagaagcagaagcaaagaagaaugaaguguauuuccaagcaagaucaggucuugacaucuucccugcacacaguugguaucugugccuagagucuguuuacauuugguuggguccuggaagguaugagagaugcuuguuagaaaaaugguucuuuccugguacugcacucaaccaacgggacaaauauugagcaggaauuugcaucucgucuucuguccucagacaagucaucaaggccucccuguucuucauugucagaagacaaaggaguaaaaaacacuggcuuguaaaaaacucuauggcauguagugcuucugucccuucaauacgagccugagagcaugccuuugucagaaucagugcaagauacuuguagugggauguguccuagagaccuggggacagggagugcugcagccuaaggugggaaugcaggucaaaagccuccugugccaguaggaugggaaagaaugcagcucuccuaauguguaugaagcgugugacuucuagguaauugcaaucucucauccuuucuguuuuuuucucuucccuuuauucauauuuuaaauuucauuuuauuuauuauuauuguauauguguguagagagugcagguguauacauaccacagcacauacguggagaccagagagaaagucucccuucagcagacaugcauggcaagugcuuugaucugaugagccaucucccugacccuaucagcaucauauguauucauauuauuuguaucaacguuauauguaauacucagaguaaaguuuguuucauacagucaaugagaaaacuacagcgaacuugaacaguucacugaggaugcagugaaagucccgcuugcugcuucuaggcccuucucuuccugaguguguauucauuauucccaauguuccugucugcaugucuguuauaugcacaaauauaggcuuucucucuucauggaaauggaaccauauaguggcugcucucacuugucuuuguccucucuccccagggauccggugugauuaaagcuggcuuugcuggugaucagauccccaaauacugcuuuccaaacuaguaaguaauuuugaggcuugguugugauucuugagaucuugucaucuuugcccugccuuguugaggaggaagaauucucccucaaguuagccuugguacccaaaacaauagcaaggcgaugaaguuggacugagucugggauaagcaaagggguguuauuaccuggcuggcguguuugagggguacgacaaaggccucuuuuguucuuaagugagcaugagugugugugcguuggaagagguaggugcuauagcaugugucagaguuggucagagcacaacguuguggaaucaggucacuccucccagcuucaugccgucccagggaucaaacucgggucacuaacuggcacaucagaaccuucauccccucagccauauugcucauccucuuuuuaaacaucugauucuuccuggcaugauggcgcaaugccuuuaauccuagcacucaagagagaggcaggugcaucucagaguuugaagucaaugugauccacaaagcgaaauuuaggacaacugagguuacacagagaaacccugucucaaaaaaacaaaaaauugauucuaagacugggcguguggcucaugucuuuaauccagcauuugggaggccaaccaaaucuacauagaguuucaggacaacauaaagaagcccugucucagcugggcgugguggcacaagcacgccuuuaaucccagcacuugggaggcagaggcagccagaucucugaguuccaggacagcagggcuacacagcgaaacccugucucagaaaaaaaagaaaaacaaaacaaaaacaaaaaaacccaagaaaccuuuguaagauucuaucuacuaucaccaauuuuauccuugguaacucagaaccacagagcccuccaagauuuauuuuuuaaacagcgucucccuguauugccagguugaccucuguuucuugaguucagacaauccugcaccccagcuuccucaguagcaggacuguaacaggccuucuacccucagccacucucucuuugaaauccucugguccugaccagagauggcucagcagguaaagucccugcccgagccugacagcugcacuggaucccaggacccacucgguggaaagagagagcugacuccuguaaauugacacacaaauacauuuuaaaacaucuuuguaagucucucauuuuccagcacagaguuuauuuaacauuaaaccacauuugcugucuuagacugaggacucagcucuucugcaagggagagauuacagggagaagaugguguaggcuuagggaggccuuaccugggaaggaaaggggggcacugccucacagacucaggaauccugggucagggacuuaagagauuucucuccuuccuuccuuccuuccuuccuuccuuccuuccuuccuuccucccucccucccucccucccucccucccucccucccucccuuccucccucucuuucuuacuuuuuccuuuuuuguacaaacagaugaauccagagccgcaugcacugagcucuaucccagcuccucaaguuuuuuuaguucaucauuuauaagaccuuuuuuugcuugguugguugguugguuggguuuuuuuuguuuguuuguuuuguuguuuuuuguuguuuuuuuguuuuguuuuguuuuguuuuguuuuuuugagacaggguuucucuguguaguccuggcuguccuggaacucacucucucacucuauagaccaggcuagccucgaacucagaaauuugccugccuaugccucuuuuugguuuuuguuguuguuuuuuuguuuguuuguuuguuuuuguuuuuccuuuuguauuuuuaaaggcauaugccaccuugcccaaugaugccuucuugaucuuuuuccuuucuuccuuccuuucucuuucucucucuuccuuucuuccuuucuaagauuuauugaguauauuaucuacauguacaccugcaugccagaagagagcaucagaucccagaauagaggguugugagccaccuuguaguugcugugaacugaagucaggaccucuggaagagcagacaaugcucuuaacugcugagccuuuucugcagccccauuuagaauuuauuuccauuuaauauacuuuggggaaaaaaggagaacuagaaguauuauuuuuaaaaaaaaacaaaaauagauaauaugcaaguaaccucaaauaguacuuguucuuuauauaaaacacagagaacagucuaagaaaggaaauggaaauuaacugagcccuccgcucagagacaagcacaguagaacgaggggacacugguguaucuguacugugcucuuucauaucugucuugaaauauaaacauugcuuucugcugucuucuccagugugggcagacccaaacauguucgugucauggcaggagcccuggaaggugacaucuucauuggccccaaagcggagguaauuccccguccaacaggagaagucucgggcuugcagagagaccaccacagagaacauagcaaugaggaaagggguuguuuuucucccaagagcagacucugaccuuaaagaagacauaucuggaaccccacaugguggggcagagaccagucuagaaaaggacacuguuauucuguguccugucgcugucuugcagucauuagauugauuggcuuggguauguuuuuggcaagaggaauucagaggggaaauccaaucuggccuauccaagguauaaguucauuacccuagcuuuggcaaagcccucagacaggcucuaggaaacauaacuacagagccauugcugcccauuuugguuccaagaacuuagguaagagccaggacacugcgccccagaaccaggcaacaaggcgggcacacagggccugggggucaugggaaucgggaagccucugcugcuuggcugcucacucggagaguccagcagcauccuguagcauccagccuccaacuuagagagagaaugccuacacucagugagggcugggacccgggaggcugagguuccuugacccccgggagauucugccuguacccucgggcugggagggcaggaugccaggcagagccugacucugcuacagacuaugcccucuacuugcaggagcaccgggggcugcugucaauccguuaccccauggaacauggcaucgucaaggacuggaacgacauggaacgcaucuggcaauacgucuacucuaaggaccagcugcagacuuucucagaggaggugagggccuguguguaggacacuccugugcaggaugccgaguuagguagaacuccaccccagagaugacaaggaggauaagaaugacugugaugacugccaaaagcauuugaguauaaauaguccagcacugagcugucuacuuccagauacauuguaguguuaucuccguaucauuccuaccgauauauuagcacugaaguuaaguauaguaauaugcuuauagggcuagcaccuggauggcagaggcagcaggugaggaauguuugagacccaucuagggcuauauagcaagacucuuaucucaaaaaaacaaaaauaggggccggagagauggcuggcucugugguuaagaacaccuaccgugcucccagaggaccccggcuugguucccagcacccacauggcagcucacaaccauugguagcuccaguuccagucagaucugaugucuucuggcauccgagggcacccacacaugugcacacacauauacacucauaaauaaacauaagaaaugacaagaccgaaaggccuaggcagaauuaucucccccuuacaaacaagcagauaguggacuggguauggugguacacauuauaauaccaggaggcugggggcucaaggugguccuugcuaugcagccucuuuaaagccagccaggccuacgggucaaggaaguagaaaacaaacaaaaaguuagagcagcaaaauacuaaguagaaggagagaagcagcucuccaaggugaccuugaccuucacgugugcaugugugcaugcaccaaauaaaugcauguagaaagauagaaauuaaaggaaaaggaaaucagaaaaucaagugguauuuccaaaaucauuuaaugaauaaaggaguagggaugggauuugaacccauaucugucagagcccauaccuguuaacuuccaagggagcaacucucagagacaaaaggaggauguagcaguuuucagggagaggaaaugguuaggcuuucaaaacccuuccauauguacuagagagacagcgcagcaguuaagaacaaguucugcucuuccagagaaccugagcucuguucccagcgccccugcgggaugggucacaaccccauguaacuccagcuccaccucgaccugccuuuacauggauagauacacagacauaaacauaaguuaaaauaauuaaaauguaaauagcccaggcuuggugcuacacucacgccauuaaucccagcacuuggaaagcagaagcaggcgaaucucuugagccugaggccugucugguuuacauugcaaguucuaagccagccaggggcuacauacaucuuuuuuuuuuuuuuaauuaccaaaaacaaacaaacaaauaaaaacaaaacacuaaaaaaugaaaaauaaauaaauaacaaaaguaaguaaguaaauaaaagggcuagagauguagcucgaugaggagugcuugccuagcaugggaaacaauuuucauuaucacaaaaaaaucuuuuuuaaaaaaaucaauauuaaauuuaauauuuugaaguauauuuacagucuaaugacucaacaagaucuuauugacaaguagguggccacagcagacacagggaccuuugggagggcaagggguugcacucaguaaggacagaaugggacuuuaggaugugacauuggagaguaaagacacugacucaggcauggcucgugacagccucagcugacaaaggcucccuggacuauagacuuugaaggcagggucaccaggguggaaagcugcccucacugacuccuccugggccucuuuccccagcauccugugcuccuaacggaggcaccuuuaaacccucggaaaaaccgggagcgagcugcagaagucuucuucgagaccuucaaugugccggcccucuucaucuccaugcaagccgugcugagccugugaguagcagccgggcuaggguggccucacagugaccuaagccuccaccguguggccucauagugaccaagccuccacauacacccccucuccccagugaggacaagcuaagccacaaacacccacucucccccgugaggacgagcuaagguagugaggagaagaaagucuuacugaaaguagacauggaagcuccucaauuaauuguugacccaaggcaacaacuggcaggugcccggugcucucgggucugggguccaggucuguggucacacugccucggcccuuccucaagguuccuuaauguguccccaguauccacucuguugacugggugccagccguucugcugggcugcuggcauaccuguggcccagacagcaccacaccugccaugcugcucacccugccuccugccugccuccaucagcugcugagaugguacccuaugaccuacacagacuauggauuugacaaggucaaaucaugagccagcauuugcaggcugggagauuuccugggcuggggaugagcacuggccuagcauguacagaggccuaggguucggcccccagcaccuucccaaaacaaaaauaaauugaaggauuucauagccaagucuaaauuucugaccucugaacaaauggaacucucugucugauacuccugggccagcauuccuguaggacuaaauccucagcuggcaguaguugccggggcacacagguaugcaagccgacuuuaccuguugacgucugaaugcugagcccgagggaggguuugcccccauuccugagucucaugucugucauuuggauauuaaaaaugaaacaaacaaacaaaaacuaugggcugaugucagaggcagcgugggaaagacauagcucucugggaaagcuaaaagcaguuccuuuucuccuccgcuggcugcuuuucccuccucuucucuugggcguugaaacugcccuuuaguucguguccccuguucuuuaggaugccccucgcucaguacuucaaggucucccuggcgccccacccacccagagggcgcaggaggaaagugcaccaaggcucagcucucagggcucacugugagcacuaacauggauuucucuccagaggcuguggggcucagugauuguuugucccuuugccucaguuaugccacgggcagaaccacaggcgugguguuggauucuggggauggugucacccaugcagucccgauuuaugaaggcuucgccaugccucacuccaucaugcgcaucgacaucgcuggccgggaugucucacgcuuccuccgccucuaccuacggaaggagggcuaugauuuccacuccuccucugaguuugagauugucaaggccauaaaggaagugaguggugaccugggggguggggggaugggggaauagugacccugaaugaagaggggugaugcgccuaugcaaguccucaggcucuggaccugugugcaucuccuuucuucaccuucuugaaugcugccaucucgugggaaaggagcuguuuccagucccuaagcccagcaggccacuguaccugaguuuagguucacauccuuggagaaguugaaaugccuuuuucugcauaaauacauugaacccuccuaccaugcaugauuguggggagaccucugaacuggucaugggaagccagacccauagcagagguaggaggagaacaaugccugagccuggauaaacguagguagccacaggccugggagcuaaugagccaaguuccuagguuugccuaccaggaaaguagagcaagaacucagguuuuaaguguccccaggacagugugacaaaccucugucccugcuugugagugagcacuuuuaggcagucacugcagacaggcagugggacuuuugccugagagugcacuaggauuccugcaaauaugccugucguguuugauucugcagagagcuugcuaccuguccauaaacccccagaaggaugagacacuggagacagagaaggcucaguacuaccugcccgauggcagcaccauugagguagugaccacauuuuucuccuuuccccucacaccgaccauuaagcuuuggacucagcagaagguccugcaagggccugaacggcagaccuacagcaccagaagccuugugcuucucucuauaaaagggagcagcucuggaaagacccuagggagguggggguguggugcuugcugucuuuaaccauuccugaguacagaguagcaaagucacugcuccuggaacucccacugauaggacauuuccaagaguguuaaugccaaagaucucuuagcuaggaaaugcccgagcgaguggggggcaagcacuucccuccccagucccccagaacuguuccuuugcuucuugagacccuugucacagaagcuuuguuucagcuggucuccacagacaccugcuuccuaagagauaggcagaaagaccucuucugugcccaguuccaggggaccucagucccagcccaaccuccuaagcuggcucuguccccuacagauuggcccuucccgguuccgggccccugagcugcuguucaggccggacuugauuggcgaggagagugaaggcauccacgaggugcugguguuugcuauccagaagucagacauggauuuacggcguacacuguuuuccaacauuguccucucaggagguucuacccuguucaaagguuggucuuuccucucgugacccuacagggauuggaugcccaaagaauucaucugagggucucuuuucuacucuuucuuuuuuuuuuuuuuuuuuuuuuuuuuuuagguuuuggagacaggcuacugagugaagugaagaaacuagcuccaaaagacgugaagaucaggguaggguggaccggagguugggcggguacagcggggcuccagggacacggggauguaguguuccauuccccuccaggcaaugcagcacuggugccccaugguccuagcuaaggccuuucaggagaacucaguugacaguuugaccuuacugcugccaugcccucuccagacagagccccuguaaugcuugcucacccuguaaugcucagugaugaguuucauguggcccaaaagaacgaaucugguuccugccagagguguuucuccccauguagggccaggcugaccacagcuccuacgaagagccuauugcauggcaugcguccaccacaucuagcagugagacagagcaaaaaggugggcagggaugugggugggcugagaagaugguucaguggacucggcacuugcugugcaagcagagcaucagaguucagauccccagaauucaccucaaagccagguaggcauggcagccucuuauaauggcagcauuuaggagauaaagacaaaggcaagcuggcuagaacuggcaagcuccgaguucaggaagagacucuugcuucaguaaguaaaguagugugaucaaggaagacaccagaugucaacacugggccuccaugcacacauaugugugcaugcacacaugugcuuaugcuacacacacacacacacauacacacacaaauguaaaagagaggggaugacggggaggggggaggguucugggugucuuagauuccucuucccauccccuucugcagauaucugcaccccaggagagacuguauuccacauggauugggugaguagcccauguaauaagagcagaaugggaagcaagguucugaccauucuaccauccuacccugucccugggggauugaccggcugcacaguuucauuuaacuaauacugcuucuuuggguuuucuccaccccagagguucuauccuugcuucccuggacaccuuuaagaagaugugggucucuaagaaagaauaugaagaagacggugcccgauccauccacaggaaaaccuucuaacguugcaacaucaccaccucucucugaaguuaacuccacuuuaaaacucgcuuucuugaguuggaguguuugagaggaacugccugugugugugaaugaguguguggguauguaugagugugugcgacuaucgagugccguguggcccagagauccugggcccagagaggacauugaacuacccacgauggugacggccugaggccugggguugacuacuaacugaccccuuacaggaagagcucuggcagaggcccacuccuuucucagccaggccuuugucuggcugugcggaacuaugguuacuaccauagagagaccuugcugcugccgaucuaggcugggcuggccccaccccaccccuccccacccgagugcccugaggccggaggcagcugcugucuccccugcucauccuucugugcuguccaugccucuggggggcgggguuaaguucugcccgguuuuguuucaguuuggguuugggagacugaaaaagcagucuggccgugguuagagacuggguucaagagagagcaggguacacucguguccaccugggaaccagguagggauuaggaccacacugggcauuugaggacaggagauagcuucaggguuaauguacaagccccagccacauccaggggcccugagacacuguaaggacugugggcugcagguccugcuguuggcuucuccuacguccugguuucgaugccaucaucacgguuuuauuuauugacguguuuguucaguaaagggacuacagagagggcucgcugucuccuacccaccggucaccuugcuuacacuaauguuuacagcaccuaaguuucccauagcauccaggccucugucauucccugcugauggagaacugacaguauucaugggccucaggacccugugauuggaggcugcacaggaaggcaccccagccagccucuuccuuucuccuaaccccacuugcccacugcccuggaaccaacaggcugguugugguuggauuuucuaagacagaaaguagcaucucucuguggcagaggccccuugcgagggagguguguuggagaucuagacccuuuaaaacaaagcaagcugcaguuaaccauguugccuuuugccacucuaauugaccaguggacuaaauggcagggaggccccuucuggguuggucagauuggagagaaggggcugaccaaagugccaagaccuaaugggugccagccuugcucucagaagugguccaagggccuuugcgccugguacaagcuagggugagccugucuucaccggcacccucacccgugacaccaagucucgccucaguuccagauuccagacaguauucuuucuccgccauccuaugaccaaaggucccugccagauguaaagcgaagcugguguguguggaaucaguguggcaacccauggacugcagugcgcauaaccagcucaccucuuagcccaagccugucccuugcacagccucgcgaagccacuuugccugguggggcccaguguacuuaaauaaagucguuccaauagguacaucag

SEQ ID NO: 9318 - RNA, 15540 nt, Mus musculus
guguguuccagcacuccucaaggaggccauguauuuagacagcccuucucaaaccccaggauccauaaccaccacuggauuuaggaauucaaacuccuggguuuucagaucuagcccuccuuccccuucuaauccuauuaccccuucuaucccuuccagggccaaagucccaagucauuaaaggaaggagcccaguggccccucuccccagaauagggucuguuuugucucugagucugcaguccuguauagcaccuagcauauagcacgugcacacuggcaggaccucacagagaugccaggggccugugucccauugggccagguuuggaaggccuucagcaaggauuuauucaauaaaccaaaggugaaggacagauguagcuggugucugagaagugauauuuacaggucugggauugugucuagacccaggaggacagaaaucaagacaggagaguggaggcagcagacuuagagagcccugugcagaccaccgucaaaagguucuaggccugagagggccaguggggugagaggcaaggccagggcaagacugcgccaugcuuauuuagaagacuggauuucagugugugcucuagacaggaaguccaugauucagauaaagugcucccuguaggaaggugcucuaccaagauccagggaaggacugagagcuaaggcagccccucccccacugaccuccacaagggcugugcucuuguuuuuauucauuauuucuuuuauuucucuuuauuauuauuaauauuauuauuauuugcuuucgcuguggucacuaucauuggcaaaguuccuuuuuuuuuuuucuccuuuuuuuuuuuuuuuuuuuucucagcuuuucuuggacacggggcuccuggcuuugaaagauuccacuuggguuugaagaugccaaaggcugcuugagauguggccuugaacuuccggcuagaaagagggucuauagaaaucacucuugguuuaaaaaaaaaaaauugaaaacuaaaacaaagaaaacccuccacaaucucuaggucacucuuuucuccaccagugaucacacugcccagaggaaccagugaagggaggagaaacgggcagugggugcugggcugccucccagggcgagcaaagagcugccauccagggcuucuuccagccaugggggugugaagggaaggggguaggauuuguuuuuuuuuaaaaagaaaaggaaagagagcccagugccuugaguuaagauacugucccaacuccagggcuaccugcagccccugccaagggccaaggcuacuucccaccgucaccuccucauccaggagaugcauaauuaaaaaaaaaaaaaaucaaaacaagacccuaaauaaaacauaauccaaaaaaagaaaugacguggaggaauggagaagaaaggagagaggaggguggaaagggccggucucugaaugcauaauucccgagccaccggggcuggggagaaggguccccagcguccauugccugcuuggcguuagcuugucacauaguguuugguggacggcugcccauacacccuguagaaauccugguggccaggcugcugagaagcgucgagccagucucugaccgccaggccaggaagugacugagggacggaggguguggguggaagugggugugaauacuccugugagggcacuguccaggggaaguggccggaucggggguacggcugguggccaccgugguuggccacggaagagcaguaacaguuguccacagaacagacgagaaucuugcggccgccauacugggggagcauggguugcugggugguggagccguugggguacugcgaaggggggaacacgggacucgaguguacuggcuggguaccgccuggcagagccaccaagugcugcguggagcugcagggacccaggggcugcccagacugccccucgcugcuggcugugcccgcugccccguacuggccgcccacugggccugacgaagucuccaggaagcuagccucagggaaggcugucgagugcuugcgcuuuucggccccagagcuguucacaccacaaggguacagggguacgcucuguaggaagggcaccggugugcugaagggaccuguggagaguuuggaauguugccgaagcucccgacccaaacaacccggguuuccucucuugggugggcuuugaaccucuguggguccaaaugugugacaucuugguugguguuuacuauuuuuauauucuaacugaaaauaaaacaaaacaaaacugaagcucaggaaggucauguaaugaaugucacuugcccaaggucccaugccagaaguggcaaagccaggguauaagcccaggccugccuggguuaagcuauacugccucuuggagcugguacuggcuggccguuaccccugcccagaggccuuuaaccccucaccuucuagcaucuuccgcaacugcuucuccuucuuggccaccucguucaggaacagcuuggaguucagguggccgaucuuagggggagaaaggcugcugcccgugcaggucuggguccuggggggcaguggacggggcgucagcugugaggggggcgugucacccaugagcccgcccuuccuccccaccagugggcguggcccucucugcccucccucagauguguucuggaggacugggggcucucagcucaccuguccauuaggauuuucacagacuugguguucuacaagggaaggagaggacagucagucagcgggaaaggcacggcagaacagcucuggcuacugagcacagcaaggcuccuguuguucgaaacagaaccucauguaucccaggcuggcuuagaacuaagcacuaggaggacccugaacuauccuccugcuuccacuuccuugugcagaguacaagagaguauggcaacgggcauaguauacgguaccgaagagcaaucccugagcuuugugcaugccaggcaaguaccacacacccuaagcugcauucccaucaugucuucuuuguaccccuuacaugugggagagggugcuacaggccuuuugcugggucucuuuguuauguaguucuagauguccuagaauccacucuguagaccaggcugggcuggcacucugagauccacccgccuuugucuugucuuuugagugcugggacugacagugugcaccaccuaguccaacaggccuuugaaaucuggugucagaagcaugugaggagguucacgucguaucauguuacacauaugauccaaacaggacaccacaguccaacccaucaauacuuccacagcaaccuguuugaauuuucuuaucaugugaaacacagagaggccguuaacugcccaugccaguucugcccaguauuugcuauuaaaugagguagcugccaaaauuuauuucuuuuaguuuucaaaauuuaaaaaaaaaugugagccaggcgugguggcgcacaccuuuaaucccagcacuugggaggcagaggcaggcggauuucugaguucgaggccagccuagucuacagagugaguuccaggacagccaggaccacacagagaaacccugucucaaaaaacaaaacaaaacaaaaacaaaaaacaaacaaacaaacaaaagaauguggacuaaaaggauaguugguggacuaacagauaaaggauggcggacuggucaccaaggcuuaggaagcaucggugacuugcccaaggucacagaacuaggaacagcaguuggacaaagucuagcccaugcaggcuggcuccaaagacaaaggaggugagcguccugggcuagaagcaguugggagcagggcuucagucccaccuucaugaagccgacguccucugucuugucgaagagacgcugcagggagcccagcagcuucuuggccuccugcaugcgcuccccaaggugcagcgccugcgccgcguucucgcugcagaacuuggcuugcgccuuguccaggaccuccacugucugccgcaagucuucauccagcagcuggugcagcuuuucguacugcagccgcaccuccuccuucagcuggcucacuuucuccugcagagauagacaaggaucggcaggcacaugagcacugagugaccucgggcugccgucacuaccccaacuccauuucuggugcuagggucugggcucuugaggccccugccuucugaggguaaggugugacccaccaauucccccuguauagcacugggcugugugccaaccacucuugaccugugggcuccuauuccaauaggugagugauugacagguggcuccggcacagagagccucaagacccugcauccccaucaccccacuugugcucaggguucacuaccuccaccaggcgcuugucugacucgagcuuguacagcugguccucaauguccugcucucucuccuccagccgcuccugcugcuucaugagcaucuucuguagggacaguuggaauagcagugugagaauggggugcugcuccacacucaguagggcagcauaucacccucuuguucacagagucuucucagagguccucugacucaagaggaccuaaaaucucuaccagccagccucccuaccccucaagcagcaccaggaccagcaguuuucaguaaugggaaacgcgagggucuucauggguagucaagcccugagcuuucuaagggcagcccccugcuuucuaugacccaucacuucauuauauuuagaaggggguucaucuagucacccuagccauccaugagguaaguacuguacuaucaucauucacaaaggaugaaacugaggccuggagagguccgacaaccuggcuacagucauccggccaauggagcugaagagaugucucagugguuaggaaugcccacugcucucgugguagacccagagucagguuccguucccagcaccagucaggcagcucacaggcgguucaggggacucugacuccucuggccuucccaagugcucauagacacacauauacauaauuaaaaauaaauauuuaucucugaaguuguagagcuaacgagugauacaucccagguaaugggguaggaggccugugauuauucaagccaggaaccuuucccuggggcaccggcuugaguagagcacccuaagaugcagacagucaaacagccuccaaggugacacaggcuccugagcuugccuuauauuugccuuguucuauagcuuagcaacaaagccaccccuuccuuguucccgaggcuaagccccagucucagaagucacgugguucagcaccucagcaggaccaguagagagugacuccuuuuauuuuauauaugaguguuuugccugaacauaacuaugugcaccagguaccugucuggcgcuggcagaggucagaagggauuggaucccuggaaauggaauugaaugcagguucucugcaaggguuacuaaugucccuaauugucuguuuccacaauccuuuaucccaucacaaacacaccucuucagacaaagucucgcccaccuaacaugaccgccuccuuucagauaauuccccauggccaggaaccauccagccgcuaguguaagguaaguacgucuuuggcugggacaggagcgccacgccacgugccuuuagaagguccugugacugccugcuuccccaggaucuccccagcacugugcucacagggcacuucaguucuuccugucauuuccugccagcuaacagugcccgcuucuccuuuguccgcuuucugaggcccaacucugaggaacuuuccaugacccuguuuguucugaguugguacaggucuuccaauccuggucauguggucugucggcugucacauccugcccuacuggguagcaguguucuuuaguauagcagccacuuuuuacauugagauuaauacaaaauaaaguaaggcagauauggacauacgggccugcaacccuagcacugggaagcugacacaggaguuuugggagccggcgccaguacauagaaagaccuugacucaaaaaaaaaaaaaaaaaaaagagagagagagagagagaaaaauggagggcagcuucaggcucccagaugcaccagccucagcuacuguacauaaaaugcugccacucccaggaagucauguggcagcucuagccuagcaccccccccccucacuaggcuaccgcccccuacuguuacugugguguuacaacauggaggauagagcccagggccuugcacaagcuaggcaaguguucuacacagaccugcaucuucaacucacauucugauacuuuguauuucauucacaagucaugaucugauuucucuagaaauucuaacccucucucuuuuuuuuguuuguuugguuaguuuuucgagacaguguuucucuguguaacagucaguccuggcuguccaagaauucacucggacaggcccagaacucaagacauuuuaucucugccuccagaguguuuggauuaaaggcaugugcugcacacccaugcagcauucuuuucaacccucuuaagggacugagcuuuggcuugggaugguggcacacauccaaaguauuagcucuucgaaggugaagcaggaagaucaccgcaaguucaaggccagucugaaccagaaggguuagaaaaaaauaagaaaaaggcaaaagggguguugguggaaaauaagaauugguguuagcuaggcaugacggugcaagucuuaguuucuacucuggggacacugagggacaagauugaggucauucuuggcuauaaagggagacccuguauuaaaaggggggggggcuuugcagcugcagcugcccucugccuuucuucauagucauaccucaaaaaggcaggagaaccugguuguugugaauccauuuccagaaacacccaagggcuaaacacaaugcucugcaaagcagcucccagacacucaggggaaauguccaccuuggcaagggcacuucucuucugcugugggggccuuuaggcucaccacauaaccccugcucaccuucccuaagaguuccuuccucaauuauaucuaaggaaaucaagaccagcaggaaacuucaggcagaucuauucuagagagguugcuagccaagaaacaaagaagaaagaugcugagggguuaggugaagguaaggcucucuuuccaggucuagaaagccuggaguuggucccagcuggcucuucccugcagugacccggcagaccgugcccuugucagccagaguggccagauugacaauaaauauagcuuguauggcauagaaauggaggugccuaaaggacugcccagauacacaccugagcaaccugggcucugagacuccugagugcacauacauuuacacccaauuacaaguaaugacuguugggucuuuggagacccccgacaacgaaggggcugacauugaaacuuucuuagggguuuaaagaagcaguucaguagcuaagagugcuagcugcuuggguggagaggauccagguuugauuccuggcacuaacaggggcucacaaccaucuguaaauaaccucaguuccugggguuucaacaccuucuggccucugcaggcacugcgcacacacaguauacauacacacaggcaggcaaaauacucauacacacuuaaaaaaaacaagcuucacuguaaacaggaggccuccccccucuccuauaucacaggagcucaaacagcacgcuggcugccuaucaugugugugcacaggugugacucacacggaaacaagcaccccagauacaaaucaggguucaggccaccugauagcucaggcucucacuauuccaugucugccugccugagucauggaugaccagggcccugaacagagaugaggaagggaggccaggcugagucucaggagaaggaaaagacacacagacaaagguuccaaccaaccuaacuucuccugggcugggaaagagucuugcccuacaagccagugagggccccuccugcuucccgacugagguccuucaggaauuuaugacugcuauccauccuggcuccugcucagcccacucucuccucugaggcauucccaagaagcaccccuacucuaggaugcuaguguugggccucagcuucaggauucgggguuggguccagccaaggcccagugaagacaguaacccccuccucaccuaacagaccccccuuuucucagggcaggaaguagaaggaagcucaccaaugagagauucagggcuggcaaggcugggcaagccccuccccccagcuucccugcacccagggagggcagggagaggugcuacuucaagcaccagcgagacuggcaagaggcagaugccucuaccagaguuccaccaaaucaaaaaaucaaaugggcugagcacgguggugcacaccuuuaauccuggcacuugagaacugaggcagaggcaggggaaucccugugaagggaagguaaacagggguuauguggugagacuuaagguccccacagcagaagagaagugcccuugcugguggacauuuccccugagugucugggagcuacagaguggauauaucgggugccagagcuacauacauagagagagacuccaucucaacaaacaaaaaacugaaaccaaccaagcaggaagaugcuggaggaccacgggcuugggaggcgcugcccgcauccccuccccacucccagcuaccucugucuagcccaggaucuccccaccuucacggggagucaguucccaccugggaaaaacacacaugaggcuggauuccaucccccagcuugagucccagaaaggcacuccaaaacagggaguagaggcuuuuuaaacugccugugccccccgucccccuaagcuuccuggacuguggcccaacucaaguguguggaaggcggaaccaugucuagucuagaagcaaugcagggaccaaguucucuggagaagccuagaagugugggacuucaucacuguuccuuugccuuggggcuucagcauucugggccugugaacucccacaguucuucauggcuccagagugcccauguaucucagaccugcuuccaugccuugaugccccacccaaccaagaggggcagucauaagggccuaacuucugcccugccaccucaggcuccucuggagccuggccagcuaggcccuguugguauuuugcugccagacuagaccaggcaaacggguaagguuuggagaguaagggcuguguaaaaguuaauaaauaauaauaauaaacucucaagucaaccuugaagagaagggaggucaggggagaacaggaugagggccagggcagaggcaggccccagguuuguagacaaggcugagguuggcucuggcaggcucagugguaaaugugaggggacaagaaaggggccagguugaugggaaagaacacaucuccuugcuuaggucaugucagcgcugguucccugauucagcuuagaaccuuguagaacuuucuucccaagcuuccaagacuacccuuacucccauuuaauccuuuaucccaagauccaauaugaccuggcuccauggcacaagcauuuucuuguccccuucagaaagucccccuucccugccucggugccugcuuuggacuacuaugugaacccuuaagccagggaaaccacaagcccagggguaagggguggugggcacaggcgccggggcaaggagaaagcuagagacucagccauucccacaggccaccagcaugagagggcuucccagcugcagagccgaauuagcuuuugcugcgcacagagcagccucuggggcagcagaacaaagaggcgagagagaaagccccccuuugucuggguuugaaugccaggccggccagggaggaagguuuucccagagccagggaugagcuggccaggccugcuagcucagcccagggcagaggcccaaguggggcugcccacccagacucuccugacgccccagcucugcagcacccacuggggcucuguccuaacuccaacacccaccacaggcaacagcuuaccuuacaugaaucccaaccuucucucccuucccgaagagccccaggugaggaaguccuaaggccccuggcaggcucacagcccaccuauuaccuguucaagcacuuagcaagugguagucugaacaaaaucaaggacaggaaauucaguuugcggggguaaccagcgaggcccaaacagccugcccuguaccccacucccaucucaccugacacccacucuucucucacagacauaaacacaugagcaugcucucuccuucacuccacagccacacaggaaaguagugccaauuaagucagucgugcacacauccuuucuuggagauacucaugugagaaaaaaauaaaauuaguuacaauagacagacagacagacagacagacagacagacagacacccugaguccauaacugcuggcagguagaacagugggaguggaugacaggcuccuggcugucagcaggauccugggguagaggcagggggacuggaucucugccugaggcuucucuuaggucccagagaggaagccaaagcaggcuuccuucucuaaggacucagaugaucaaggaaaggacagagcucacacuacccucuuccccgcacacagagcuuccccacucugcuuuuggcagagggaagagugugggucugaacuuccugaaucagccuguaaccccagccccagcucagcagagaccucuaggccuccccucuuacacccggacggacucucuacagggcuuuuguguauccccaccccaccccaccccaucccacacagguaucggguacucucacucuaagcaacuacaacucucagcagugggacuguguucucagaaaacaccucuuuuccacaagaggguggggguaaagcacgugguucaggccaauaucuccagccugcuuccgggguccuagacaugacccagaagcacaaaagccauguaaguuccagugugcacaucugcaaagcccuucgcugcaugaccgggacuucuccuggguccuuucuauguugggagaguucauaagagugcucccaacucccaucagccuccccaugacuaagaugaacccuucaacuuagaggcuugaagggaucuugucugacagucaggauugcuaggccugagcccaccagaugucucaugccugggcccaccacccaaaggaaaaacccuccaagggcacagguaugucccagugagugagcucaaggccccaucugcuuggcacccaguccucucaaaggcagaauggggcaauguccuggccugcacgggccuaacucuugagugccaccccuuccugaugccccacccaagccacgggcucaaguacacaagaguggguacuugugaguauuuggagacagagcuacuggaaggguuaagcaggguggggugggggagagggguuguugguguugauggugguauugggucucuuguugucgcuauucuuguuuuucagagacaaggucucacuauguaauccugacuggccuugaacucagagaucugccugcaucugccuccucagagaugggauuaaaauugugggucaccacacccagcaacucaaaacacucagcagcagcguuaacuguuuccagccaacugagccagacccuaacccacugugagggcaggugagaaacaagaggcaggacauaagguuauuucugugcuuuugcucuuauaccuuggaaaauucuggugcccuuuuccacagcacuagcacaagacccuuucagggagacucccuccagcaugaggaaaccagcugaggcaaagcccuguccuccuggauagccucaagagaaggcaggguuuucuagucagcuuuuccucacggcucagcuccucccccagggugggagcucuaccucugcauucaauaagucagacuucuacuugagugauaaggggcuacugaaggguuuucaagccuggggcaccagagaaaauggacgugaggaaccuggaggaagauaagccuggggcacagaugcugagcucacagaauugcacaucuggcccuaaugcaacucgcucuuucugagcuugccccauaggcauaagagcacaugcaaacaugcacacgcgugcgugagugugcguguguuccauaagcacacacaacagacacacaccacggagcugcugacagaguaaagugucugaugaaaggaacccccagguccacucuacaagcaaaugucacccuuuccucccgaucuuaaaguaagacauacccauuugaggguaaauguaggcacacauauuaggauguccuccuaauaccaagccagguguuaaguuuucaucccuaccccaaggcaucccuagcacuuaaggggugcagacacaugggguauaccacauccucuacauucaguccuaucuucuucucuucccuucuacccacuuucuacagccaaccccaggacagagacuuggacagccgucuuuucuccagucuuucccugcacuuucccagccuccaccccuacagucuuuauuaauagcagcagccucaacccuggguaaagugugggcucugccuaaccggagucaggagaggaggaccacagggcuccuccacuuccccaggacuuggccuuucccagaugcugggaggagugacuccacuucuccaacccccacacuuccuuuaagaaaccagaggccucuccuggcacaaaaccccagagcuggcccaugcaauugcaaacuaauuauacagcaaauuuuguuauccccgcccucagccugcgguggcccuucugccuuuuguugguuguauaugugugguuuuuaauugcuaaacagugacucauuuagauugguccccuccuugucuccguccagcccccacaaccaccaaggaaacagcccgcaucuacauucuggacaggcccagcuuccuccuacugcagcagccuuguuggccuccaggggcccccacccuaaacacacacucccaguuccuaccaaacccagcccagcucccuuaucuuaagaccccuagcaagagcuuucaagauggcucagucuuagcucgacuccuucuucccggugugacucaacccagaguggcaagggacccgagaggaaccugggaggagcccccuuccagugaaagggacggaaguaugccccacuccaguucccuagccaggcccagaggccuaagagggggaaggcgguuuugacauuggcugcugcaguaggguguauacaaugggagggggugcgguucguaaucacccagccggcagcccaggggagccagcugccugaaaccagauuucaacgcggcucaaccuuaaacccacaggacucuuuuuccgucuuccccguccccucccuaaaugugggagggccguguaagagggcagggcugggaggaaagagcccagggugaagaagucacauacuuuaagguuuguucaugccaggcgcaggcagcauucaaguauagagagagcagcuuuagccuggggagcgucuacuaggacggauuagaagagccgacagucggggacuccucuggacacccaggccuugcccagcuagaugccagaguucuucucuaucuccggaagcuccccccaacccccagaguguuuccaguagagcugaaaacuaacauggcugcuuuguuuacuuccucauugguaugccagcaucauggaucaugucagccacagcagcggcaccaggacacucauuacauaaacagcagcuggagaagcaggaccggggucacugccuuggugacuucccguagagcuuacagaaacaaugcggggggcgggggggggaaacugcgcaaaacagaaaagcaacacuccaaacuacuucuaacagccuccccccaauuccauaaaugacugaaggagagaucuuaagggcgcaggugcgagaaugcauccagcagccagggccuuucccccaggaccuugccccccaaacuuuuacggaagaguuuggaagagggccucuaggcuaaugucacgagagucagcuugugcggauggguggcucccaagucgugugugugugugugugugcgugugcguguguucgcacgcguucaguguacuugcccguaucucauuccuccguaucuccacgucacacaccgagugucccugaugcgcgccgcuguaguagcagcaguacuggcacacagccaccugcucggccucgcagugguacaggcgguaggcguugugcugcgggcagcuccaggcccgcacgucguccgccuccaccaggaggugcccgcgggcgguggagggcugcugcaggugcgucugcacgugagacuggcagcagggagccucgcagcgcaggcagaccuucugugccggcagcggggggccgcggcgacagaacacgcagugcagugccgucggcggcuucuccacgugcagggcguugaacuucuccacgauguuggugagcuucagguucuucuccaggcccggcuucugauuguaggccugguugcacuccgggcagcgcacaaggccacuguccuuggcccaagccucgccgaugcagccccggcagaaguuauguuugcauggcagcugcaccgguuccacgaaaacgugcaggcagauggggcagaugagcuccuccucaaagcaguucuuccaauucuccgccauggcggcugcgggcagggggcccggguagaccucucuaaguccccaacccuggggauccgucugguacagcuggggacccaccgagcccggagcuccgguccccgccggccgcgccagucgcucagucaccagcgccuuccgcgugcccgccccccagaggagggagccuggguccucgcgccgcgcgcgccgccggcugcgucuccuccuccuggcgaguggcuagcgggaggcggcgggcugcgccagggccgcggcccgggcaccagcccuggaggagagcgcugugguccaaauuccauauaacaggccgccuccggggcagcgcggcuagggcagcggcggcccacggccugcgcucggccccgcggcugacaucggggcgcgccccgcggcgcaccgagcgggggagccgcacucuuccuuuggcggcgacaguggcuaccuucuggcuggugcgagccgcgccuuccucgccuggaucccggccgagguccgagggggcacgggaagcuaguucggccgcgccgaggcuggcuagagccggagccggcgagcaaggcgcgccagcgguccccgggccguggcgcaggcgucccccagcuggccggccggcugcggguggcagggcgcgggcgggccgacuccggggcgcugcgugcgcgcuggggcagucauucagaugaaauuccaguccccggccagagacaccagcccgccucugccuuccuccucccuucacaaauagaaacggaagggggagggagagaaguggaaaaaaaaaaaaaaaaaaaaaggcaaccagag

SEQ ID NO: 9319 - RNA, 13495 nt, Mus musculus
ugauuggucuaaauuuuguuauagcgucgugcuuuuuauuuuaaaugaaaauuacauuuucuuuagcagaugaauuuuaaauaauuuuuaaaaaaauguuuuaguuuuauagauauguaucuguguucaggcauauguaugagaaugcagguguccagggagcccagaagaggacauuagaucccuuggagcuauagucauagacaccagugagcuuucugaagcgggugaugggaacugaaccuggguccucuccaaaagcagcaaguguuuuuuaacugcugagccaucgcaccagcuucauauggucauauuuuaucuucauauggucauauuuuauaugaugcugggaguacauggaaagggucugcucuuugacagucuguggaagucacaggaauggggccacaagcaaaugccauuugcacugcugcuucuuugucccuuuguggaucauucuucacaauugaucuggacacauucuuucaaaugcuaacuuuguaaugccaugucuuuauaaggagacagacauuuuuacauugauugcacuuuaggcaucgagcugaggaggaacucuucaggucuaacucacuuuauacacgucauagucagugaugcauuucuuaauuugcccuuuuaugguugacgugacccuucaacacacuaauauguaaaacucccuagugguuuuauaucuuuuucgccuuuuuguuuuguuggagauugggucuguguaguucuuuuauguagcauuacuuaaguaucagcggguccacuugugugacuuuacugccagauuccaagggaauggaauggcuauaaaugauuacaaaaugaaccaaggucacuuaaucaagagucacagagagaaagaaagaaagaaagaaagaaagaaagaaagaaagaaagaaagaaagaaagaaagaaagaaagaagccagaaacaaaggucaaggcagagcugcagcuggccaggggggacaccacuggccugauuuucauauaagaauuuguagugagaaaggaaacaacagccauuauccuugcuccguguccacuaagugaagacucuugaaugaauaauaaacaucuuuuaaaauggaaaucauucucacaagauuacaauaagggccccucccucuauccuuuccucuucuucuuggagauagguucuuucuguguugcccuggauggucucaacuuucugggcacaagugauccuccugccucagccucccaaguaucggagacuauguguuacucagugaccaggggggggugauuuguaaucccaauaguugagaggcuacagcagggggauuaugaguucaaagccacacaagcuacacgggggcggggagggggggaagacauacaagagcgagcgcgagagggagagagagagagagagagagagagagagagagagagagagagagagagagagacauagaaucacagacaauacagcuuuuaacaagcugagguaccuuucuuuuuuuagugcuaaugauucaaccuauuuauuucaauauaaaccaacuugaagaugaguucaucaauuuaagaacugcuuccaugcucagucacuuggcuucuucuuuucacgagucuuuuuuuuuuuuuuuuuuuuuuuuuuuuguagcucuggcuguccuggaacucacucuguagaccaggcuggccuugaacucagaaaagcugggauuaaaggugugcaccaccacgccuggcuucacaagucuuuucuagaugauucucuggagaugaagauggagaccaaggccacggccugaugguuguguaggacaggcccuccuuagcaucugaugugcuacuucaguaagugacucaacugguccugcaggucaggcgacuguuccacacuagaaaucaaaacacaacaggacugucugagacgagcaggaaaagacaucucuccgugccaucuauccuuuaaugcaucagucuggucacaccuaagucagaauuuaccuccgcccaagugcuuaaacccagagucuggcacuggggcccgaguguuaaucuguuacuaggagcugaggcggagagaggaccguuuguacccaaguguuggagggcaccauggaaacacgguaagauuccgucucaaggguggggggaaagcaaacuguggagaaggucugugcagauagauggguauggggcacacaccuguaaccccaccacucaggaaguggagacaggagugugaguuucagguuagacugggcuacacagugagagaccuuacauuaaaaagaaaaaaggcuuagagaaacuucaugcaguuaggaaagugagaccauuuaguggcguuagucugucugcucuauuuaugaauaucaccuauuuaucauaagcaagggcagccucuguacccuguaucuucuagaaagagaaggcaguggccccagcucuggcucgaacugaaaauacacaguguucuuuuacacucuaaacagaccauccugcgcauggccauuuaaagguauggcaaccacuuuuucaucgauccugggcccagcagucgcucccagcaugcuucagucggccccacccaccaucucugagguccacuuacuucuucugaauagcuucuugccuaaaucaggaagggaaagaaggaaagaaacagagagaagucagcaucaacagaucacacaggcagaacaaauacaagaggcuuacacuuaguguaauccuguggggggccaaagagccacgucgugaauaugcacagcccuaaaacacagccuuaacauuagcuaucaggaccuggacucucagccauacaaucccaacaggaaggcaagcaucuuaucaacuacguaaaauaugggacaagaaaaaaauacaaucaaaggcaaauucaacuauaguuuucuucaaaacuacagugaaggcacuguguauuucaagaucugaaugauuccuguguugcugaugcuguguuagaugcaggaugccagcuacuaccccgcucuguucuucagggcaggagcaacacuggcacagaguggaguguuucccaggugccacacaguggcaacacgguccuggcaggcucugcuccuaugccuucuucccuuguagagcccugaguuaacacagggaggucaaaaaaguggccccggcucccacucuccugcagcccaacuuccccuugaaggugucuuucccuggagacugcaucgcucaucaacccuccuaccuccaauucccuccuacucccauccuccucccaccuccaucccccucccauucccaucccccucccacucccacccccucucaccuccaucccccccacucccaucccccucccacucccaucccccucccaccuccaucccccuccccucccaucccccucccaccuccaucccccucccacucccaucccccucccacucccaucccccucccaccuccaucccccucccaccuccaucccccucccaccuccaucccccucccacucccaucccccucccacucccauccuccucccaccuccauaggaaggugugcuuuagcacaaaagaaaugaccaggguaaggaugaggauugugacugcugguaaggcauacucacugguacugaagguguguuguuauuauugccaucuuccuuaaacucugcacaacacagagagagaaacagaauaguccacuuuccuauggucacacaaagcacacacacacacacacacacacacacacacacacacacacaccaugacacaaaugcuucuuacaucuuccgaguguaagauggcaucuuccuguaguaccauguuucgagcugccugccccagcagcuagaaaacaaaaauaaaacaguaaugaucaaagcucccaccucugaggcgggcccaguagugcaggcuuguaauaccagaugcuaggaaagcugggggucacgaguucaaggccugucuggacgacacaguaaggauggcuaacuuaguaagacccugucucaaaacaaggaaguacaaaaagggauggugacucagccuggcagguccuagagagaaacuccgucucgcuggcacagaggcaguucugacacagcugggcuccacaccuacacccucuuaaagaaccagggccccagagcuacugagcucaguuggaugcggcucugaugaacacagcccgcucaucagguaccgggagaagucggcaaaacugcuuuggcuggaccacuaauuucugaugcuuuaaaagcaagcuucagggagcuggagcaacggcucaggaccuaagaacaugugccucuccugcacaggacaacagcuucaguucccagcccccacaccauguaucacagcuauuccuggugcgggacuuuaaucccagcacuggggaggcagaggcagguggaucucugaguuugaggccagccuggucuacagagugaguuccaggacagccagggcaauacagagaaaccuuauggagagggggagaggggaaggaggggggagagggaaaggagagggggagggggagagggggagacggaaucugaagguuuaaggagagaaaggaggaagaaaaaaaggcaugcgaagaagcucacggacugggguuguauuggaguggugggugacuaucugaugugacaugacaaggcccugagcuuauccucaacacaaaagaaaggagaaaagagagaggagaaaagaggaggaagaagaggagaagggagaggagaaggaagaggaggaggaagagaagggggaggaaaaggaggaagaagagaaggaggagaaggaacaggagaaggagaaagaggagaagggggagggaggaggaagagaaggaagcagaggaagaggaggaggaagagaaaaggaggaagagaagagggggaggaggaaaagaagaggggaagcagcagcggccgccauuguugccacuauucaaggcuuagagcagguaaucgcgucaugggaggcagccagauggagcugagaaagagaaaaaaagaggaaaugugaaggccaacuuuugaauuuggugucagcugggcccugagaccaaaagagcaauggggaacuccgauucagcacggugaccugaccuccaagcaaagcuauagcugugugaaggcgagggagaccagugagacccagugagacugcgacugcaggcuuccugcagcuguguguggcccuggcucacaagggaaccccgcggaggcaguucugugcaucccaccaacacaucaaauucuccgggcucaccuuggcuaggaaaucucuagcagcugacgaccccaaaguagccaggacgucagcacuggcguaguucauuuugcgcucuaaaauuucaaacuuguaaaccucgugugcuucugaggccugaacacagagaagcgcccccaccucugcuccuuccugcccuguucccugccaugcggaacagguuccuuagcuuguguuuucuguccagucuuggaauguguaggugcucaagcccauuauuuacgguggagcaguauuugccuguguuuuagaccaucucuugauuacucuugaaaauucugguguggccuucuuuuguuuugcucuuguuauuguagcuuuuuguucauuuugauauggggucucucuaugaagcccugguuaucuuggaacucacuaugcagaccagacugccucaaacucaaagagaccugcuugccucugccuuccaagccucccucacuauugcuuuugcugugucuguggugugugugugugcgugugugugugugugagugugugcgugugugugugacagugugugagugugugugugugugugugugugagagugugugugugugagagagugugugugugugugugucuguggugugugugugugugugugucuguggugugugugugugugucugugguguguauguguguguguguguguguguguuguauguacaugacugugcagguucacacacccagguacguauauagggaagccaggaaagguugccauggaaaugugugguuucuuuggaaacucuguuaguuaugugauacuuugcuguggcagacaggugaaaggaugcuuugcugaggcagacaagugagaggacaugugacguuuaggaagauuacaaauaugaccccacaggcaguggcaaugguucuggcauugguuggccuugcacggauuacugaucuuagagcaacuugccaaagaaccagaaugaucuucuggcagcuucuggcggcuucuacagacccaggaggauugguagagccuagcgguucugccauuguugauucaugugcggugauugccuaauggaccggacuaccgcugcuaauucauguugguguuuggaaucaccccaaagaacuauuucuaaacaggucaacaaaccccauuuccuuuaaccuuucuuucccaccaccucugguggguagugcgcuagaagggaggccgaagcauuuacgaacccuuauuaaaguagguuuugaaaaauuuaagccaacagaaggucuugaaaugcccccuccccucucucgcucucugccugacugccugaaacagggucuuucacagaacuggaagcucccugcuuggcuaggcuggugcucuagcacacugucaggcucuaccugucuacguuuccuaagaccaagguuacaagcaugcccagccaugccaggcuuuugaaauuggugcugggaacuaagacuuggguccugguacuugcagaacgagcacuguuggccaaagaguaacuugccaaagaacuucucguaaucuucgggcagcuucuggcggcuucuggcggcuucugcagacucaggaggauuggcagagccucgcaguucugccauaggcaaguccugugucuuguuuaauaagcagggucuuacaugccucaggcuagcuuuagauucacugugcaacugagggugaucuugaacuugucuccugccuccauccugagcaagcugggaucacagguaggagguguaugauaccgugcccagccucuagaucacauguacuacucaauacaacauaagugcuguauaacuguuauacaguacccagggggaaaugagcagaaaaacacuauacauguucuguacagauguagauacugacuacauuuucagucugcaacuggcuaugaagcucagggauagccaaagccaauugcauacccacuugugguggugggaacagauauagcccucauagacuccuagguuugaaugcuuggucacagggaguggcgcuauuaggagguguggccuuguuggaggaagugugucacugugggggagggcuuugagguuauauaugcucaagcuacgugcagugugauacacagucuccuucugcugccugaggacgaugcugacggacuaaaccucuaaaacugcaagccagccucaauuaaaugucgcccuuuauaagaguuaucauggucaugaugucucuucacagcaauaaaacccuaagacagcccacaagaacuuauaagaacuuauacuuaaaccauauauagauacugcuucauaucuuguaauuuucuaguuuauaauauaaccuugaaguaaaugaauauuagcaauauaauauauacauauagauauauauguguguauauacauauauauugugugaguguguauguguguguguauguagauagauagauagauagauagauagauagauagauagauagauagauagacagacagacagggagggggaggaggagggaagggagagcgggagggggagagggagaggccaugggaagagacacuaugaccaagacaauuuaugaaagcauuucucuaguguuagaagacaauuccauggccaucauggcagagcauggcagcaggcaggcauggcgcuaggacaguagcugagagcuuacaucuuacccacaaguuggagguagaaagacucggcauggugugggcuuugaacccucaaaguccauccccagagacacaccuccuccaacaagaccacaccuccuaacugcuccuaaacaguccacccccagggaacuaaacauucaaacauaugagccuaugggggcauucaccuucaaaccagcacaagaguuuccuccaccauuccuuuacaacuccagauacacaaauacuauaccacauagacagacauccagccgaggaggccuuuacuagcacucaaccauggagcugcauccucaguaccuguagccagcuuugugugugagugagcauguguguguuugugugggggugagcuguaugagugugcaugcaucugugcuuguaugaguugugugaguguguuaugaguugugagugagguaugugugugagcugugugaauguguaguguauguauuguguguagggagaaucgacauuagguuagcuuuucucacacgcuaucugcauuuguuuuguuuuuaaugauuuauuuauuuuauguguguggguacacugucgcucucuucagacacaccgggagagggcaucggaucccauugcagauggcugugagccaccauguaguugcugagauuugaacucaggaccucugcaagagcagucagugcucuuaacugcugaucauggaucuagccccugcauuuguuuuuuaagauaaggucucuugcuaaaucugagcucaccaaucaguccagguugguuggcagggaacgucaggaaucuacuugucucuguucccacuucugcgccaaagcuagcgucacaggcaugcaggcaaauucugccguacccagcuuuuuuccucauggguucugaggaucugaaaucagauccuugcgcuugugugggagauauuucaccaaccgagucaucuccccagccccuucggccacuucuaaguagcggauucaaauucauacacaggagagaaggggaccagcaacucaauagcagaaaaggccucugucuuguccacccauuuccucauccggcaaacgcuuaccaagugcucuuuaacagccgguacuccagauaaaaguaagaauggggcugggagagguggugcacaccuuugaccccagcacucaggaagcgaaggcagguggaucucuguagguucgaggacagccuggucuacauagcagauucaaggacagccagugcuacagagagauccugucucaaaacaacaaacaaacaaagaaacaaauaaacuugagagaggaagggauagagagauaaauaauggggcucauagucuggagggguuacauaggacauaggcacuaaaaucccuuauggcaagugugggugaauggagcagccccacuguggggucccggggguagagggagugagagcggugaauccacgccagggauagguacuggggggggggggcuuccuggagaagggaauucugcugaggagcuggggucuagaauucaucucacgcaugaaguggccugagcggaucugcugcuucagagcugugguaauuacaaugggcugagcugggaggagggcagagacugguuaggaggcaggugaugaacagagguagcagugcgggguuggaaagggcguuugagaaacagaaacaaaagacuugaugggacuugugccugccuggggacacaugggugucacagugccaggggacagauguacucacagacacuuggcacuguuuguucagauaagccaaccgcacguacacucacacuuccaguuuuaccuuuuuaacauggaaugucauagaagccaucuuaguacagcgucuuucuagauuccacaaacuucccuccuguuuuuaccauugacuugcucauaauucgcucagugaguuuuucucacccacacuucaccaagugucuuauuuagguaguguucacccccccccccgcccccauuucaucaguucccauauuauuucauuauacagcugggggagcuaggggcguagcucagugaagugcuugcaaugacaaggaccugaguuugcuaccuggaggaaagccaagugggcagcucaugccagccaaucagacaaaucccaggggcucaaugguuugcauccuucacuuacuuaguaagucccacgcccaggagaccuagucuccauucuuuuuccagacagaguuuucuuguguaacagcccuggcuguccuggaacucaaucuguagaucaguguugcaaaaacauugacaauuacaaaacuacaaugacucucacuaggcacaagacucagauggaguggcuggugugcaagagaauaggcaggcagcaguguuaaggugagugacuggcuguggaagcaagcacaucuccccucacuuucggcaccagccagacugcaacccaguccuuguacacacccucaucuaaggucuuuccaguccacagcucuacccgcaacucucugcucuggcuccagauacccgcagggcucgcucuacaucucacuccucuuucugugcaaaugucacuuuccuacagacccgucccuguuuaaaguaaaccuucccacucucugcucugagaucccuacuccucacaggguuuagucugcacugaggugugguguucgcugacugauuuuccgucuccucccuucacuguaagcuuuccgcucugugcuccuuucagaccgcauaaauccacugccuuuucuuucuuucuuucuuucuuuuuuuuugguuuuucgagacagggauuuucuguagcccuggcuguccuggaacucacucugucgaccaggcuggccuugaacucagaaauccgccugccucugccucccgagugcugggauuaaaggcgugcgccaccacgcccggcuuccacugccuuuucuauauaagcuucacgacugggcuacuuagcucagugauagagcgucugccucccaccgaguaggcucuguguucaaucaucacgaccaacacuaugaccaccaaaaauaccaagcuuccccaguacuuagauuuauuugaccccuggaaacuggaacaguuccuggaacacagcagacauuugaaauuauuuguuaaaugaaagcuguaaacagagagucacuaugauacacagccaccucacaaacuaggacaggaaauggcugagguaaugugcuacaggugcuguggaagaaauccaguaaggcaaagucuggagagcugugaaaucgugggucgagccugucucagaaaucagguuaacuucaguuugguuuaauccaugcuguuuaaugggcucacacucaaacucuccgauaggagaagaugccugugugagagacacauagaacgaugaggaacgggaaggaaugggcuacuucaggggcaaccaaugguggcagugauuuuuuugguagcguguccaacuaguaccaugcaaagguaaauucauuaugauguucaauauauacuagauuuaaauauaauaccaucucuugccaggcgugguggcgcacaccuuuaaucccagcacucgggaggcagaggcaggcagauuucugaguuugaggccagccuggucuacagagugaguuucaggacagccaggcuggcuaagcuagaacucacucuguagaccaaacucacagagcucugccugcuucuuccucccaauugcggggauuaaggacaugugcuacuauacuuggcuuuaaaaaaaaaaaguuuaauugcauuuauuuacuuaaucuguggaggagagaaaaggauguguguaccauggcuuccacacuuguggaagcuugaugauaacuuuucaaaguuugguuuuuuuuuucuuuccaccauaugggucccaguuucggacagaaacuuggaugguccagcuugguagcacacacuuugucuugcugagcuauuuugcuggccccaaacccaccuuuaaaaaguuuaagccuauuuauagcauuucuucccccaauuuguuuaucuagaagaaugugugugcacauuuguaugauguaugcaacauuuuacauacacauacacuuucuacaaaagaaacagaaucuagaaauagcaaaaaaaaaaaaaaaaaaaaaaagaaaggaaagucaacuugacugccaacaaaaaacgacccaggaacucugugcaaccaugauaaagugucaaauggugaaaccaugauuugcauaauuuauaucugcaaaaaaaaaagcaauauaacaauucuuuaauuucuucaaacuuuccccugacacagauuccuaaaagcaacgugucagaugggaccacaugcaaaacaugucaccagagaucaucaggucagcaaugucaacagcuguuauacaguaagggcgagcacuucuuguaaugggauuuuuauuuuguuuugcagccacugucagugaaagccagcucuugcuacacugcagguuuaaaguaauauaagucagauguugugaacauccaugcacagauccaaaggccugagaacauagugugucauuauugcaacuacauaggaaagcaggugccguuccuaugaaaacuaaguuggaaacgguaaccacuugccgaaggguuacuaagguagggguuacuaaggaaggugaaauuggaaguuuucuaagcagucccuucuguaucccaggucucuugagagcucagacuaaggugugcccauuaggcaccgccauacguuuaauuuuccauuaguaaauacauaccaaagacgaggucauugcaucucauaugcccguuuaccuguccaugagcgugugaguugucucaugaggaaaaguguaugaacauguacgugucuuugugugggcacacgguuucucuagggcagauaacgaccucaacaagcagcguguacgugucaucaaaucauuccauucauagaaucggauggaggauggagaaagggggaggagaugguagggcaaaagaaaaagcuugucuaggaaacagugaagagcuuggccagaaauauaaagaauaaacccacaaagagagagguguaagaaaucuuggaaguugaggccaucgccaagccgagauucgaaaagcgacugauguucacuacagacgcccaugaacacaaacaggcacuguguaggagccgcagcucaucugcccgccugugcuucuccccuucccacccaucaucucuuccaacuacaagcauucaaccuaaacugaagaaacucacccagaaugcaacacgcgccugggccaaaagccuacacuccccaggaugcaaugcgccgccucucccggagccagcgcugggaggaggacugggcccggggagcccacgccccgcucaccucggagcuccgcgagccuuucagcaccugcuuggugagcgcgauuacaucggugccacagguguucaccuucuccgugagaagccccuucacggacugaccaaaucgggcuugcgaauccggcgucccagucgccaucaccucaacuagcgaucacccgcagccggacgacggcgagucc

SEQ ID NO: 9320 - RNA, 3038 nt, Mus musculus
uucacaaaaaaggaagaguauuguguuuauggaauacaaaguaagaucaggaaaaacauuuuaaaacgcgcuucaguugggaggcagaaaguucaguuugggagcuacugugcuaccgcaucuagucugaugcaauggacuugagaguccuggugagcugugcuccacaaugaaucuucuccggagcuaacagcguuugaccugugcauuucauaauaagcuuucaugggccuucucagguugcucuccccuuccuauuuccccaaauugccugggugcacguuaaaaaacaaaacaaaacaaaacaaaacaaaaccaaaaauaggguccaucucauucugugauuauagcaggacuacaggagaaucccugugaugacaaaguuugggaagcugaccacacuuugagagguuuguugagagcuagaaaacagcaaaggucguccgugagggccggcagguggcgccacaugaucgugagcagcugagggcucacagagucacggagaccgcagguccucggcguugcuagggccacccugucaccgcgaaucuccagaggaaccgcaugcagggguagugggcuggggggcuugacuaguaucccgauuugguuuuaggcuaugugcaucguaagcugucuccaguccggcucuggugcucccagggaaggagggcucagcccauucugcggcgacacggagccccguggagcccgcaagucccugcagcaaggacccgaggccucgcgccucagggcaguauugcagggcugccaagccgcgcgcgaggaucuacuacagagaccccacagggagcgccgcacccgcggaccgcucccuuucauuggccgccuggaggaagaccacgcccccaucccuacagcgcucaucuuugacuggcucuugcauccgggauggccacgccuccuccccgcgcauacacaagagucacgcgccuuucaguuggaaacuuggcaugcagaggaggacaguggcccucaucuccccgcccaccucccgugccauuggugcggcacgccgacugcgaccacgcccccauuccagcccccuggcugggaaggcgggcacccgcucuugauuggcuggcagaccugccucucgcgggagaggcuagcacgccccucccuccgcucccuccucccucgagcccggggguuccucagcuggcucaguccgaaucagugucauucagagagaaggacagcuaagggcugggcgcgaacgcgcgguugcaguccugcucgggcgccggugccugcgcucgcgccgccgggugggaaggaugaagccucagcuggagcagccacccuaugauuggcuguggcgcuugugaacccgaaguaaagauggcgggcgggcaggcagccgccgcacugcccacuuggaagauggcggcgcgccgcagccucagugcccgcggccgggggguccugcaagcagcugcgggccggcugcugccgcugcuacugcugagcugcugcuggggagcgggcggcugcacagcggccggcgagaacgaggagaccgugaucaucgggcugcggcuggaggauacgaacgacgugucguucauggaagggggugcucugcgggugagcgagcggacccgggucaagcugcggguguacgggcagaacaucaacaacgagacguggucccgcaucgccuucacugagcacgagcggcgccggcacacacccagcgagcgugggcuggggggccccgcgccuccggagccggacagcggcccccagcgcugcggcauccgcaccucagacaucaucaucuugccccacaucauucucaaucgccgcacaucgggcaucaucgagaucgagauuaaaccgcugcgcaagauggagaagagcaagucuuauuaccugugcacgucucucuccacgcccgcacuaggcgccggcggcuccgggucugcgaguggcaccgucgggggcaaggguggcgcggggguggccggacucccgccuccuccgugggccgagaccaccuggauuuaccacgacggugaggacaccaagaugauagugggcgaggagaagaaguucuugcugcccuucuggcugcaagugaucuucaucucgcugcugcugugccugucgggcauguucagcggccucaaccuggggcucauggcucuggacccgauggagcugcgcaucgugcaaaacugcggcacggagaaagagaagaauuaugccaagcgcaucgagccggugcgcaggcagggcaacuaccugcugugcucgcugcugcugggcaacguacuggucaacaccacgcucaccauccugcuggacgacauugcgggcucaggccuuguggcggugguggucuccaccauuggcaucgucaucuucggagaaaucgugccccaagccaucugcucccgacacggccuggcgguaggggccaacaccaucuuccucaccaaguuuuucaugaugaugacauuccccgcuucuuauccgguuagcaaacugcuggacugcguccugggccaggagauaggcacggucuauaaccgggaaaaacugcuggagaugcuccggguuacugaccccuauaacgaccucguuaaggaagagcugaacaucauccaaggggcgcuggagcuccgcaccaagacgguggaggacgugaugacuccccucagggacugcuucaugauaaccggcgaggcuauccuggacuucaacaccaugucggagaucauggagaguggcuacacucgaaucccgguguucgagggagaacguuccaacaucguggaccugcucuuugucaaagacuuggccuucguggauccggaugacuguacucccuugaaaaccaucaccaaguuuuacaaucacccuuugcacuucguuuucaacgacaccaaguuggacgcuaugcuggaagaauuuaagaaaggugggcaauuuugcuuuuuuuuuuuuuuuuuuuuuaaauuggcuugcucuuucugucuccguccuccucccuccuugaacccucu

SEQ ID NO: 9321 - RNA, 3038 nt, Mus musculus
agaggguucaaggagggaggaggacggagacagaaagagcaagccaauuuaaaaaaaaaaaaaaaaaaaaagcaaaauugcccaccuuucuuaaauucuuccagcauagcguccaacuuggugucguugaaaacgaagugcaaagggugauuguaaaacuuggugaugguuuucaagggaguacagucauccggauccacgaaggccaagucuuugacaaagagcagguccacgauguuggaacguucucccucgaacaccgggauucgaguguagccacucuccaugaucuccgacaugguguugaaguccaggauagccucgccgguuaucaugaagcagucccugaggggagucaucacguccuccaccgucuuggugcggagcuccagcgccccuuggaugauguucagcucuuccuuaacgaggucguuauaggggucaguaacccggagcaucuccagcaguuuuucccgguuauagaccgugccuaucuccuggcccaggacgcaguccagcaguuugcuaaccggauaagaagcggggaaugucaucaucaugaaaaacuuggugaggaagaugguguuggccccuaccgccaggccgugucgggagcagauggcuuggggcacgauuucuccgaagaugacgaugccaaugguggagaccaccaccgccacaaggccugagcccgcaaugucguccagcaggauggugagcgugguguugaccaguacguugcccagcagcagcgagcacagcagguaguugcccugccugcgcaccggcucgaugcgcuuggcauaauucuucucuuucuccgugccgcaguuuugcacgaugcgcagcuccaucggguccagagccaugagccccagguugaggccgcugaacaugcccgacaggcacagcagcagcgagaugaagaucacuugcagccagaagggcagcaagaacuucuucuccucgcccacuaucaucuugguguccucaccgucgugguaaauccagguggucucggcccacggaggaggcgggaguccggccacccccgcgccacccuugcccccgacggugccacucgcagacccggagccgccggcgccuagugcgggcguggagagagacgugcacagguaauaagacuugcucuucuccaucuugcgcagcgguuuaaucucgaucucgaugaugcccgaugugcggcgauugagaaugauguggggcaagaugaugaugucugaggugcggaugccgcagcgcugggggccgcuguccggcuccggaggcgcggggccccccagcccacgcucgcugggugugugccggcgccgcucgugcucagugaaggcgaugcgggaccacgucucguuguugauguucugcccguacacccgcagcuugacccggguccgcucgcucacccgcagagcacccccuuccaugaacgacacgucguucguauccuccagccgcagcccgaugaucacggucuccucguucucgccggccgcugugcagccgcccgcuccccagcagcagcucagcaguagcagcggcagcagccggcccgcagcugcuugcaggaccccccggccgcgggcacugaggcugcggcgcgccgccaucuuccaagugggcagugcggcggcugccugcccgcccgccaucuuuacuucggguucacaagcgccacagccaaucauaggguggcugcuccagcugaggcuucauccuucccacccggcggcgcgagcgcaggcaccggcgcccgagcaggacugcaaccgcgcguucgcgcccagcccuuagcuguccuucucucugaaugacacugauucggacugagccagcugaggaacccccgggcucgagggaggagggagcggagggaggggcgugcuagccucucccgcgagaggcaggucugccagccaaucaagagcgggugcccgccuucccagccagggggcuggaaugggggcguggucgcagucggcgugccgcaccaauggcacgggaggugggcggggagaugagggccacuguccuccucugcaugccaaguuuccaacugaaaggcgcgugacucuuguguaugcgcggggaggaggcguggccaucccggaugcaagagccagucaaagaugagcgcuguagggaugggggcguggucuuccuccaggcggccaaugaaagggagcgguccgcgggugcggcgcucccuguggggucucuguaguagauccucgcgcgcggcuuggcagcccugcaauacugcccugaggcgcgaggccucggguccuugcugcagggacuugcgggcuccacggggcuccgugucgccgcagaaugggcugagcccuccuucccugggagcaccagagccggacuggagacagcuuacgaugcacauagccuaaaaccaaaucgggauacuagucaagccccccagcccacuaccccugcaugcgguuccucuggagauucgcggugacaggguggcccuagcaacgccgaggaccugcggucuccgugacucugugagcccucagcugcucacgaucauguggcgccaccugccggcccucacggacgaccuuugcuguuuucuagcucucaacaaaccucucaaaguguggucagcuucccaaacuuugucaucacagggauucuccuguaguccugcuauaaucacagaaugagauggacccuauuuuugguuuuguuuuguuuuguuuuguuuuguuuuuuaacgugcacccaggcaauuuggggaaauaggaaggggagagcaaccugagaaggcccaugaaagcuuauuaugaaaugcacaggucaaacgcuguuagcuccggagaagauucauuguggagcacagcucaccaggacucucaaguccauugcaucagacuagaugcgguagcacaguagcucccaaacugaacuuucugccucccaacugaagcgcguuuuaaaauguuuuuccugaucuuacuuuguauuccauaaacacaauacucuuccuuuuuugugaa

SEQ ID NO: 9322 - RNA, 10648 nt, Mus musculus
cagccuugccgcaccuucgcguccucgccaggucccgccgcagccgcgcacccggccccgaccccggcaccaugagcuucggaucggagcacuauuugugcuccgccuccuccuaccgcaagguguucggggacagcucgcgccucuccgcgcgccuguccgggccgggaggcucgggcagcuuccgcucgcagucgcugucccgcagcaauguggccuccacggccgccugcuccucggccucgucccucggccugggccuggccuaccgccgccugccggccuccgacgggcuggaccugagccaggcggcggcgcgcaccaacgaguacaagaucauccgcacuaacgagaaggagcagcugcagggccucaacgaccgcuucgccguguucaucgagaaggugcaccagcuggagacgcagaaccgugcgcucgaggccgagcuggccgcgcugcgccagcgccacgccgagccgucgcgcgucggcgagcucuuccagcgcgagcugcgcgagcugcgcgcgcagcuggaggaggcgagcucggcgcgcgcgcaggcccugcuggagcgcgaugggcuggccgaggaggugcagcgacugcgggcgcgcugcgaggaggagagccgcgggcgcgaaggcgccgagcgcgcccugaaggcgcagcagcgcgacguggacggcgccacccuggcccgccuggaucuggagaagaagguggagucgcugcuggacgagcuggcuuucgugcgccagguccacgacgaggagguggccgagcuccuggccacguugcaggcgucuucgcaagccgccgccgagguggacguggccguggcuaaaccagaccugacuucggcgcugagggagauccgcgcgcaguaugagucccuggccgcuaagaaccugcaguccgccgaggagugguacaaguccaaguucgccaaccuaaacgagcaggcugcgcgcagcaccgaagccauccgagccagccgagaggagauccacgaguaccggcgccagcuccaggcacguaccauugagauagagggucugcgcggagccaaugagucccuggagaggcagaucuuggaacuggaggagcggcacagcgcugagguggccggcuaccagguaagggcugggaugcugcauaggaaagagugcccuguccuuuuccguacagagauagcuucacucccuguaaacuggugcccuaggaaaccacgggagggaaaggggagagaggggagcguugacuagaggcgucagucaacaaacaaacaaacaaauuaaaaaaaaaaccacgaagucucacgcaugcagccgcaaauguggacuguaugugccuggaagcuagcucuucaagcccuugaugucuucgcccucuauuuuggagggugggggaguuugaggcacagagcccaagucuucaugcauauacuaggcauaugcaguaacacggagccacaaccccacccccagucgcuugucugaacucuucuaacaaaggagucuuuaaucuuucuaggagucaaaaaaaaaaaaaaaaguaaccaugccuuccugucaccaagaguacagacacacuaacagaacagugccgacccaaaguguccccagagggcgcaggucauggcuucugugggcggguacuuaagaaucugguuuguuuaguugacuuugagaagucuuuucugagucuuacugagaauugauauuuacagaguaucguccgcuuuaggauugggaagaaggcucacuuucuugaguuuugcucuaaaaaaggagugggauguagcauauuuaagcuaaugacaacugccuugccccacccuugcgcgcgcgggcgcacacacacacacacacacacacacacacacacacacacacacacacacacacacacgaaacccgcgagacacacgcgcaguuuccuuguccaucuacuaaacaagcuuugagcccguucagcuugagaccggucagggcgcuguccgaggugcugaucuccuguuccucccaacgcagaaaugucuccugcuucauuauguuuccaaauugucccaguuaggaagucuaggccucaaugcaauuaacugcuucuuuuuuuuuuuuuuuuuuuuuuuuuuuuuuuuuuuugauguaacacaaucaaucuuggcuaaaugaacucaaagcucaucuuguagauagcuucaauuuuugccuccaaggauagcuuugcaguuaacaaaaaccuuuuaaucggcucgaaggcugugaggucucacuugaaaaccucuguuaccuugacaucuuuuucagcuuaugggcacauggcgaguuacagagaugguuucuuuguuauaggugacuuuuguguuucaccuuucccugcccuguaagcucugugaagguaaugauuggcucuuucgucacaacaaaggccacuguguccucaguuucacuacauugaacaugcuagcuugugaauacaaaaggcucagagacagaagacaggacaaaugaaaaauguagaaaaaaacacacacacacacaaaauuaggugguuuaaguacaaugaacaauaaaagcucuuugggauauaauaauucagaaauaauuuauucuagcuaggguugaauuuuacauuugaugaaaucaauguguuuaaggaacauuaauaagaauagaaccuagaaauggcauauuucaaaguaccguuuugucagaagcaagagaauuuauugaugugcagguauuuacuguccauuaugaauggcucccuuucauaaagggaaaagucuuauuugagaugucucucguuagucugauauuacagucuuauucaaauaaauauuccaguuuugcuacaaaaucuguacguugagcuuuucaguauguguccuaggcccuggaugaucugaauuaaucacacuuagugcaaauguugaauuagguauuccucaggacuaguauuucugcaaaacguguaacuaacccaccccaaacagcugaauugggcuuugcugcacucuccuguggcucucuuacacucuggcuuauuugcucuaaaauacaagcuuucggugcuaggaaauaguaggggugucuagacacagucugcaggaaacaagaggcaggaguaacugcaggcucugcagcuccauguuccccaucagccuuggaagccucagagggccugcugagggaguggaggaggaggccagacagcacaaagcuauuuccuaccccuagggaccgcugcugggguggggcucacacuuagaccugcaaacacuaaggccugccucuccugguuguuuccuagcaaucuuaacacuagaggugaaaagccuucucacugugaagccauugucuucuugccuuguuacccagcccccccuuccacugcaguaguaaugggagguguuccuuccuaaugguucagaggcucgaagugggcacaucuuucuuuuacaaucauucaguccucucaaagacaaagaaagugcccgucaaagucauuuucccugccccagggagcuaauagccuauuugaagacagaacacuugguauacuuucaaaaggacaaagacuaauucaagguaacacaguaagcacacaauaggaaggacuaggguuguuguguccggccaaaggcaggcacuuugcauggaaaaacaaggcuuuccuuucuggcaaaggacacucucuggucccuacauagcugggacacuggguuagaauuucaguuguuacuaaagccgugcagagacagacucagagagaacuggcuuucagaccuguguugugggcgucuuagaaagccagagcuuuccaugaaagaccuugcugaacagucaagaucacugcuggauaauguucuccagggagguaaaagccaagucugcccucuucuccaauaugagauuggagcccagccuaauuaaauagcaggaagggucuggcccaugggagauggcaguggcuacauauaaaucuauagcuugauagauccauuucugaaauuaggguggcaagggaggaaaagacaaucucauuuuuuuaaaagcuuuuccaucuggucccuaccccaccccucccccauccuaucuuacccuauuauugucaccugggccauuacaauagcuucuuuacaggaauaaauuuaaaccacugaucuaaauuccauggcauaccaagaccaaaggagcagcuuuuuaaaaagagagauuuuuuuuccccugaagaaauggauucaguauuucuuagguaggaccaggaauaugcuuuucauucuauuuugugagacaggguuucccuguggagccugaucugggauugaauuuggaacgccccugucuuggcccuucaagucugcucuauaggcuugccccaccacaccugccaggaaugugcauuuuugugaaagugcuccaccauuuguucucagacuggccgugggguguacugaccuagaccgcauuuucuaggggaguacgauuuuagagggugauuuuagagggucaaggauaaagcaaacauaggacugaaaacaaggacauguggcucuugugggugaccauccaguaaaaccucucuccagucuagcugauuauacauagcaguaguucuguguggcccgcgcuccugcuugucuggcugagggcugaggacucccccugacuccccugcaguaaggaacgggcacacuguuuuuccuucucuucacugcagaugcuggugcagcccugcucuucugucuucccagccugccuccuucugcccugggccagaugcuccaggacagaccccagcuggagcagggagugccuccucgcuccaggucuccaggcuccgcuagcagcagcugcaugguugggggagggggcaggcaggcugccgggcucugcucacauuucccacuggaggaggccaucuuugucaggccuugugaagggcagcaagacagggaggaguggagcguacagacaaagagaccagagcauaguaggccaucgguggucagcaguugagucagcuccuucuggaaggggccggguuacacuuuuuucccaacugugauccguaaaggagccacgugaaaugcguaacuuaggggcgcaagaaacucgcccaucuaaagcuagaguccccagcggccucacgaucugcaagcagcugugaaauaaaaguaguuucuaauaaaugaucaaauuaaccugcugagacgaaauggcuaccucuaaacuacacacugggaaacugaccccgcggacacccucagccugagcauucuuaacaugauucucaagaaaugguuuuuuaauuggguuuccagccugcagagccaugaggagagggugaggaggggaggcugccucagugaggugguggcagggccacuuuucaggaccaagagaagcaauaaacuacaacaggaagacaaacacugcucuucagagccauuuaggguagaaagagacaccugaauauaucuaaaagaugacagacaugaaauuagagaagaacaacaucguuuucaugacccuugauugcugagaaagacuguguuuuguuuaauguccaaugauaagugguauuugccgcuuuaaaaggcuuuauucaaaauuaucacuuugagggauguuugaaagaucgcucaaugucacucaccgccaaccgggacaaccugggccgauaccaaaccauacaccacacguauccccagaacucaccucuggcuuccgcaugucucuucugacacacucaugcccacacacauaaacaaacaaacaaauaaauaaauauaagacauuccagguggucaauuuuuuuaaaucuuguguuuugaggauuaugcaaucuccuauccaacauugacuuuuuauuguauauaggguagcagagauggcucaguaguuaaguccgugccgcucucauggaggacccacaucagguggcucguacugccuggggcuccagccccagaguaucccuuccuucuggguaccuauucucacacacagagacauauaaacacguguguacuacaucauuuuaaaaauauuuuuguuuucucuauuuuuaagaacuuuaucuuaugugcauugguguuuugucuacauguauguuugaguaaggguguugggucuccugaaaccgagcucacuaacagcugugagcugccaugugggugcugggaauugaaccagauccucugggaaagcagccagugaguguucuuaacugcugagccaucucuccagccccaaccuauauauaauuuaaaacuauaucauuuuaaaguuuuuguuaugcacuaauaauggauaugauauucauuggccuaaggagcuauugguggagucgcauauguuauucacaguaauaaaagcucuucacauuuauuggguccuuccuaugugccacgauguucaacuaacuuauuuagcacauuuuagaacucauuaucucuuaacaggcuuugaaacacuggaauggcagcacauaaccuuuaaucccagcaguugggaggcagaggcaggcagaugucugugagcucaagggcagccuggucuacauauuaaguucuaggcuguccagggcuacagagagaaaugcuaccucaaaaaccaacaaaauaggcaagaaagaggugauaaauaagcauuguuuaaaacuugggucuggagagaugacucaguggcucagagcccugguugcucuuccagaggaccugagauugauucccagcauccacaugguagcucacaaccaucuguaaccacagcuccaagagagcagacauccucuuguggacuuggagagucccugauccauacacacauacauaauuaaaaauacuuaaaaaaaaaaaagcaaagaaggagguauccaugaacccaugugucccuugguaggaguucccaacccucagcaucuacguuucccaugagucuuuaagaguaaaaauguaauugccaacgagucucuaccccagagugaacgaaccagaacccaggcuggacacagauuguaaguacucuauccguucuuacgugguuugaguguguaaucgggguugaaaucccugcuuuguacagaugucaaugagugucugcuacuuuggccuaaguguuuugaauacguacuuuccaggacagcauugggcagcuggaaagugaccugaggaacacaaaaagcgagauggcacgccaccuucgggaauaccaggacuugcucaaugucaaaauggcccuugacauugagaucgcagcuuacagguacacaagggcgcguguuuacccuagcaaaucacguaucaccuggggacagaggucuaugucagugauuccaggugguccguuucugaccagugagggaggauacuguccugauauguaguugauuaauuaauuaauuaagaaacaaacuaauuaaauacaggugagaaaguagcagcccucccuccgacucacccucaggugaguguggacaucuuaauagggaagacuucaggaacgggcacgccauccuuaugccggcccuugcuacuucucucuaucaguccaguguuugcuuaugugcugcaggagccaacacacuuuuccccucuuucucacucucacucuguauaccaccuacuucaaaagaagacccccacaguauuuaauaguauuuuaaguuagcuuuuacuuaaaaugaugauuaagaggcuggagagaugacucagugguuaagagcaccgacugcucucuuccagagguccugaguucaauucccagcaaccacaugguggcucacaaccaucuguaaugggauccgaugcccucuucuggugugucugaagagagcaacgguguacucauauacauaaaauaaacaaaaugaaucuuaaauaaaaaaauaaaagaaugauuuaaaacuauuagaguuaugagccagacaugguggugcauaccuauaauuccaaguggagguaagacagugaugaguuaaaggccagccucagcuacauacgaaggccagccugggcuaugugcgguccuaucuccaaaaaucaaagaacaaagcaacaagcaacaacaaaaacccuaccagaguuaauacgagagacgagauuagggggccacucugcucuggugcugucugauuuaggcugaguggagugucugaggugguaucccuuaacggguuugucaccauaucuaagaaaggcacagaucucaacugugggcugcaccagguggcugcucucucucuccucugugucuucucaccucacuuccuuccccuuuacaguuaagguguuaauuagggaaauuacuucucuccagagcuuuguagauucuaauugccaaagauggguguguaauguggccaagggaggguuguauguuuuccugcaggaaaucagucugugaaugggguaggcuuccuuugacaacacuuugaacaacacugaugugaggagagugagagaaccccuccaugugcacacuaaucuccagcgcagugcagcauuacuggucucagucucgugaggaaauugcaguguccuuuggagucucuaaaaugaaagagagaggacucaaggguuaaguccuuggaacaaaaccuggaaccagauuucugagagcuucucucuguugaauuugcaggaagcuccuggaaggugaagagacgcgguuuagcaccggcggguuaagcaucucggggcugaauccacugcccaaucccaguuauuugcucccucccagaauccuuagcucuacagccuccaaagucuccucugccgggcugucccugaaaaaggaggaagaagaggaggaggaagaggccucuaaggaagucaguaagaaaacauccaagguaggggaagguuucgaagagacacugggggaagcgguaauaucuacgaagaaaacuggaaagucggcuacagaagaaaguaccaguucaagccaaaaaauguaaugccgcugcuugagaaaaagucgaugccugggagggaaugcacuuggcucauucacggcacacuccugaaccacacccaccaccgcuauagaaugucugcaaggcuucagcgucauuguaccgaccccuuacguucuccaguaggaaggccacuguagacgggcgcaagcugcaguccuggagcagaggaggaguucuccaagaacacagcuuucucacccacaguucaggcuuccuggugacaggugacucaggugcagaggaagugcaaaugaaggugcuaaaucugcucaucccucacugggagcugaaacggaaaccuauguuuauccacuggaccccgccaggccccagccauagaaccuuacuguagaugccuaaaagcauacaaucacugcagaggacaagcuagugcuccagacaccgcuccccagcccccuccgauagagccgagucaccacacacgucucucaugggcacaugccuuccacucuucaaucccauaauuccuuucucgcacccaagaggaaggaacagaguuuaguguagcauccccuucuagccacgcauagaacguaugcccuuuagcuagcucuucuucacucuguggguaaaauuagcugcaugcuggccaucccugugauuuguguaacucaccccugcccauuucauguccuuucacaucuguagcuuuaaaaaaaaaaaaaagaaaaagauuaaugauaacggcagugauuaguuuuaaggauuuuccuaaaaauaaauaaauaaauaaacauaaaagggaucucuaggcuuuaggcuuucagguuguccagauccacuuaauuagaggggaaaaaauaccuuaaaugauguagcauuucacuuuaacuguagaagcacggugauaauuacccugcgcugugcuuuagcgcugaccuuagaccucguaguguaaauagaggaagaguacucucugaaggggaagaacaaggucuccucuguguuggguuccauguaguggcguagaauucgcuuucucguacccuugcccuagaaucuacauaguccccuucccauuaggauagguccucaagaggccuugcuuuuuuaaguaugcuauguauaggacauuuuaucaccagacacaaugcuaccacccaaaagugaaaaaacacacaaaaaaaagccacaucuggucaaucaacaccaccagcagauauuaaagaaagaaagaaaaaagaaacaaacuuuucuucagagucuuuccccaacaggguuacauugcuucaguuggugggugucccucccccaaaggaaaggcagaaacauucaggauccaggagggguauacacacuucucccaccucacggaggcaggcuggaaagucagcucuuucugcacccaacugcggcauccacacgaccagucugccucaugugccaaaucaggcuuugcccugucucugcucacuuccaccagagcucuggaacugucuguccuguccccgcccacuccaucgcaagcucugugcugccaaggacaugacgcaucuguugaacucacauucuagcacgugcuucaauagcucaaggaaccgaaaagacacuuugcuuuuccugacccaucccucucucccucuacccuuacuguaagacauuaguaaucuaagaaauuaaaagucauuaauccuacgug

SEQ ID NO: 9323 - RNA, 17293 nt, Mus musculus
aauuggcuaaaauaaauuuuuauuaaaugucagaagagauuuauguacaguucauaaauucuuuacaaaaacaaucgccaauuuaagucuaauuuuuuaaauuucuguacagauuuggaaauuuugcuaugaagucuauaaaauauguauuuuagaaagcaucaggaugcuaauuuuaggcaaaguaauguuuacaaugaagucucugugaaagcaagguucucaaagacucucauucuuuauccaaauggcaagaaaacagaaacauuaacauggaaccagaucauuuaagugacugaggaacaauaaggguucuguaaacuucuggucauucaccugaaauuuguugcuacuguuagaagcagugccaucauucacagccacacugagggaauuuugugacaccugacccagugucccaucagaaagaagcaccucauauuuguuuaagggauguuaguuaagaagagccauuucuaacaggagacagucucagccucagagcugaggaacagggcuuuagugguaucaguggaauuuuguuugaaguucagaauaggacaggaacuuguaaguggccaguaguuucggugcggagcgcacccgagguuuaacagacuggcucugaacucaaagcaaagcuguucugaaggaaaccacccagcccaugcagcuggagggcagagucccagcucugggaaacugacccacccaccucaaagaugggaagcaaccagcaacuuccucauauuuggaaucacaaggaauuuuaaaauucaguguuuucaguuuuuuccccugaguuaugagugcuguuuccauagucuuuaguguagcaaauacauucuauuguuucaaguuguacacacacaaugcuaggguucuggugacaacagaagccagcucuuaacagcggaaaguagucguaguuacgugcuuugugagaaucuuuggugcaaugcagauaugcagaugccuccgacuggguuucucuccucauauaccuuugcaucuucaaguuauuuucaaaggagaaaccacaagaccauaaugaagaacaagcagaccguccugaagaggggagaaggauauuuuauaguucuuugaaaauuaguuauguauaauauauaaucaaaccaaaacuggcuuaauuuucauaaucuaacaauaaugagaaauucuuuaauguaaaaauuagaagauacauauaacuucuuuuuauugacaucaccaaaaacuccuuauugaugcauuuucccccuuucccuucuuuuuguccugacagcagcacugcugccuccuccccacucucuuucauuaagacagaaucuuccuguaaggcccaggcuggccuuguacccacacagcugugagaucacagcccugcagcgccaugccucccaucuccauuuuucuuaaaacuuggaagagaagguguaaaccacccccggcccgagcuggagagcugcaggaaauuaugagcugccuagcaugggugcuauaacacaaacucucuacaagggcaguacaugcuucuaagcgcugagucaucucugcagauucuuaguuccuuuuaaguggucaagaacuucugaacugaaacaauucuuuugccccagccucuccugaacagcucaaucacaggugacccaccucaaacaggucaguguguugacucucaaauaagcauagguaacuaggggcaugcauuuauaaccaaaagcaacugagaaaagacuuuucuuuguccacagacuauuuaacaaacugacugaaaacuaagucuaccuaaaaaaagacucaguuucuauaggucauaacagaucuguucaagaaaaaaaaugcugggaugggagugguggcacacccuuugauccagcgcuugggaacuugcuaaagcagacagacagaucucugugaguuugaggccaaccuggucuacacagaguuuucuaggauagucagagcuacauaguaagacuaucucaaaacaucaaacagaaaaugggcacacaacuuuuauuucagcacuugggaggcagaggcauacagaucacugugaguucaagaccagccuggucuacagagcaaguaccaggauagccagggauauacagagaaacccugcauugaagaggggggagagggagaagggagagagacagagaaaauaggaaauguuuauuccacauaugcagcuuacuauugcaauaaaacuuugcaacuuucaccuauuugaugaaaauacauuuuauauuauuuugcuuccuccuugcagacugcuagcaaaccuuacacacaugugagacagacaguaagaaaugacaaagauugaagguaagccaaaaagcagaugccuagcugcaggaaauuaaacaucuaagauagagggcaaauggcagaccaugcugguccaugaaccaucaucacgucugcucuaaucagcauggaaaagugaaugucuauauaacacagauacaaagauuccauuaucacaguuauacgcauacaaaucacauuuuuguauuucccugccauaguucagaaaugaaauguagacuauauuaauauucauauacaaaacucaaugugaguagccgggcaugguggugcaugccuucaaucccagcacuugggaggcagaggcaggcggauuucugaguucgaggccagccuagucuacagagugaguuccaggacagccagggcuacacagagaaacccugucucgaaaaaccaaaaugaaaaagaaaaagaaaaagaaaaagaaaaaaaacaaaaaacaaaaaacaaaaaaaaccucaaaguguggcuuauaagcuuuuucaagaucucgaaauuacuccagugcacacauaagaacauaguuuagaaaacaacuccuuguaauguagauguaauuuagaugacuauauuuguauauucuauaaauagauguguaaguaucacuuaaauuuguuuccuauucauaucucuauuauaggccuauaugaugguuagccaggguuuguccuucacagguucaaaugcucaaagcuuaauuccuaguauagagaacuaaagauauggggcauaguggaagguaauuagaugaaggaucucuacuccauaaaugaaucaauucuucucaagggaacaggucuuuugagacuguauuaaaucugagacucugaguguggguuggcgccuuuuuuuuuuuuuuuuuuuuuuuuuuuuuuuuuuuuugagacagugucucaaauagcucaguacucuuggacuagcuuuaccgucaaggauggccuucuacucuggauccuccugccuucaccuccugugugauggaugguaugugugauccgccacaccaagcagaaacagcuguuauaaagcaagagcagccguuuccacuagcccucuugaguaauaaauacaaacguuuuugcuuguuuaugaaucuuuguuuuuguuugacacacucagccuaaaaccuagguccugugcaugagcaggcagcacuccuauagguucucugugcgaacaggcagcacuccuaauaccugagccauaucuucagcucucccgauacagaacuuuauaauucauuagucuauguguucagcauaggccugauaaggaccuaccugcauugcuguaucaccuauugcacgucggauuucccguagaguuugguaccgcuccaguaagugauccccacagaugauaucuaccuacggaaagcaagcaguuaucagaccacuuuccugcuucaaaacauaugaaucagcugggcagcgguggcacgcgccuuuaaucccagcacuugggaggcagaggcaggcagauuucugaguuuucugaguucgaggccagccuggucuacaaagugagugccaggacagccaggguuccccagagacacccugucucaaaaaaccaaaaaaaaaaaaaaaaaaagaaacaaacaaacaaacuugggcaauuuugcaaaauucucuuaauauaaaaauuugagggacuagaagaugacucagagauuaagagcacuugcugcucuuacaaaguaccuagacuuuuuuaauugguuguuugguguugguuuugguuuuucaagauaggcuguccuggaacucuguagacuagacuggccuuaaauugccugucucugcuuccugagugcugggauuaaagggauaugugauggccagccagaguaccuggguuuaauuccagcacucacaccauggccugcaccgaccccuaacuccaguuucaagggagccaaugcccucugcugaccuccacagacaauauggacagaaugcauaugcauagaacacauacauacacguggacaaaacauaaaaauauuaaguaucuaaauuuuuuaaauaaaugaaaauaaacuuugaaaacaccugggagacagacauuauggcacacaccagucuaagcugcauacugagaccuuaacuaacagccagccagccuuaguggcacaggcuuuacucucagcacuuggggagggcagaaguagguggcucucucuguuacaguggagagacagcucagcaguuaagggcaguaacuguucuuccagagggcccagguucacaugguagcuuauaacuaucuguaaguguccucuucuaaccucccuggguacugugugcaggcagugcacuaccgcuauaugaaggcaaaacacccagacacacauaaaaguuuuuaaaaauuaaacuuaaaacaagaaagaaggcugcagaugagcucaauagcauugccuagcaaauaugaagcccgauucugcaaaaggaaacaacugaauuguuuacucuugaccaucucuaggaucuggaacgcuuaaacaaagacacagguacauaagucuacauauuugguaaucuuuaccauuauuccaguauuuugagaaaaaugauguuauaaauauuacaaaguauguacuagcaguaaggacuauuuaccucaaacuuugcauaauagcuaaaucugaugaaugaaaaagcaaagcuaugagagcuaugagcuggagagauggcucagcguuuuugagcacugacugcucuuccagaggucuugaguucaauucucagcaaccacaugguggcucacaaccaucuguaaucggaucugaugcccucuucuggugugucugaagagagcaaugguguauuuauauauauaaaauaaaugauucaaaaaaaaaaaagaaagaaagaaaagcuauauaaagauacauuuucuuuuuuuuuucuuuuguuuuuuuucagacagggucucucuauguagcccugguuguccugaacucauucuguaguccaagauagccucgaacucagaaaucagccugcuucucucucccaagugcugggauuaaaggugugugccaccaccgccuggcaagauacauuuucgguugacccauaacuagaauuuugaguacauuuuauuuuuauuuuuuggcuuuucgagacaggguuucucuguguagcccuggcuguccuggaacucccucuguagaccaggcuggccucuaacucagagauccaccugcuucugccuccuaacugcugggaauaaaggcgugugccaccaccaagauuuauuuugauuuucaauaacaugcaaggucugacguuuucuaauuuacaaacaaucucuaguucuacuaccaacugcaaaagaacuggaauguaggccuagaaaccuguuagcauuucucacaucucuacuuuucccuaaaaucaagacaugguuaucagugcaauaagaaauggaggcuaugauugauggcuaaucuuagcuguuaacuacacuauaucuggaaucaacgaaaaccaggcaguugggcauacaugugaagaauuuucuuaauuggaucacugaggucagaaaauccacccuaaaaaugggucacagcuuccgguggcuggcagccuaucucacuggcaaguacaccuguccugcugccgaggcaucacugcacuggucucaguacacagacugaagcccagcugucuuagcccugagggcugaacauacaccagauucucggccuucuuauuaggagacagacagaguugagaccaauuggaccacagccuguaaagccuucuaauaaaccucucuuguauauauuauaugcauauuuaauucauauguuguauauguauguauguauauauacacauauauauauauauauauucaugacaucagcuuuguuccucugaagaacuggcuaauauaauggguaacccagaugugaucagaguuggaggugggacucacaaugugucaacacugaauuaacagucucagucaucuacaucauaaaaaagccgcucccacacuccagagagcacucuuucuccaucugucaaaggucauccugcaaccucaccuuccuuuuacacacauguacuguaccugacaagcuggaucaagacccauuuuucuucuaagaaauuuuucuacaugcccgauaguugcuucuccugaaacacgcacaaacuucuuuuccaauggcugcagaaacagagaagacuuuucagauuauguaaauguauacauacauaaaacguacaagcuauuuuauagagcagauuuuaaagcaaagaugauuuuaugauuuugagucaauuuguagucuaaaaaaaguagaaauucuggaaaucuuuuagauacauaccaacaaacuuuguaauagaaaggcguguuaguuaacuuuaaagcucauguaaaacaaaacacccgauacaaugggacaugccugacauccuaacccuugacagggggaggcaggaagacuguaaauucacgaucagccuaagcugacgguuggcauccuguccaagccacugcagugccugcuugucguuccaacuacuugggaaggcaacacaggaggaucucuugaguacuaacuccacagcaagguaagacaugucugcaguuucggcuagagagacugaggcaggggguuuuuacuuaagucuaagagcugagacagucuggacacuugcuuuuuaagcaaggcaugguagcucacaccugugaucccaguauuccaggggcugagagaggaaaacugcuaugagcuaaggacagccuaagccacaagccuaucuccaaagaguaaaaaggaaaagagaggaggagaggagggagaaggagggagagggagagaaguuuuucuuuuuaaauuuuaaaaugagaauaaaucuagucacagguggcuugaguuacagaguguggugcuggcaagaaugcucuggguucugccugcugagcaccuccccugcuccugcugccaucuuauaauaacuguucuaggauccucagaggcauuggaaggucuccaguaaaagggcagucgccuuagauuucuagacacagcagagccucagaagaucaccccacugugaggacaucuccagccagagaguaucaaucaucucaggaacugaacugucugucuccgcagacauuaaaacugcucugaaccaccuucaagagccagaacuaagauaaugacccaucaggucacaguuuggucaaaauuugaucauuguacauuccugcugccuccugccccagcagcucuucuauuuaaaucuaaaguugccaggcacggugacucacacauagaacauuggcacucagagacagagacugaggcaggcagacugccauggauccaaggccagaugaggauacaugaauuccagguuagccuagguuacagaaucagaaccuguuugaaaaacacaauuaaccuucaccacuacaaaaaacuaugccagugaccuaaagacaaacuugagucauggaaccucuuuaucugcuccucuuccugcuguggcaauacugauuaaaccucuuucuaauguuuuccaucaauauaucuuuuucagagucuccuguaauccacgaugacuuugaacuugacguguaucucacaagugcuggacucauagaauaugcaacacacuccauuuaugaaccuagggcuucacgcacgcuaggcaaguuaaguauugcaucaaccauucaucucucuaaaugucacacuagggugggcagcugagccuuguguguugggacuucuacagccauggguuuucccuuaaaacucucgaaaaagccaguggugguggccaacaccuuuaaucccagcacuugggaggcagaaagaggcagauuucugaguucaaggccagccuggucuacagagugaguuccaggacagccagggcuacacagagaaaccccaucucaaaacaaaacaaaacaaaaaacaaaaaaaacccaacaacaacaacaaaaaaaaaacaccaaaaaacaaacaaaaaacucuucaaauagaugccacaaacgaaacaacccugaccuuuccuuaauaaaaguaaucagagucuguaucacagagauuuuacuuucguaggugucucuagcuugcuauuuaucucaacaacugacaaaguauaauacaaaguaguucuuaccucaaaucucagugaaugcuugaagugacaaguuaaggcagguuaacuucagccaaaaauguuaaauauacaaguuuaaauucauguuaaacucuaagcaccaacuacacaaaagcacuuugaauuuuuuuuuuuuuuuuugagacuggucucacuacaauagcccaggcuggccuugaauuuuugauccucuuuuucagccucuagaguaguuauaccacaucugacucuuagaauuuuuuuaaauuaccacauuaaaaucaggccuagugggacaugcuuguagcuauagcacuuagaagguagaggcaggaggaugaagaauuccaaguaauccauggcuaauaaguucaaggccagaaggaaccugucuccaaaaacuaaaauauaaaaaaaaaauuaccaaucaauggggcauguggcuuuguaaauuacuuauuuuccuuacuucacuucuuugaaucaguaacaagucccuagucaauguuucuuacucugagaaacuacuauaguauuacuguugaauuucaguaacuugucaaacauuuauauuuuaauugaagauaauuucuacuugguugcuaaucugauucagaauuuauaccuacagaauccucuuauaaaguaaacaaaaaaugaaauaccuuaaaauguccggugucuucauuagcacuaaaaagaaaggaaaaguuaaucaaaacaauauuuuaaauuacaugcuuaaucauaaaacaaaagaaaaauaacaugaacauuucauaugcagcaauucauuuuacucagaaaaaaaauuguuugguugguuaguugguugguugguuuguguguguauguguguuuuggagacaaguuuucucuacauccuggaauccacucuguagaccaggcuggccucgaagucagauuugaacucagcuuugcaucccaagcucugugauuagagccgugugccuccuuggagggcuauaaacuuuacaucuauuuauuuacaauggcggucacgcugcugcuugcgugcguggucaggagacaacgugcaggagucacuucucuccuuccauccuaaguuccugggacccaacucaggcaggcaagcugggcagcacguacacagauuugaaaugaaguuuaagauagcaaagaaaaaaaaaagacgggcggugguggcgcaugccuuucaucucagcacuugggaggaagaggcaggcggauuucugagucggggccauccuagucuacaaagugaguuccaggacagccagggcuacacagagaaacccugucuugagaaaaaaaaaaaaaaauauauauauauauaggcgcucauguuucucaggcuuguuuggaacucauuaaauagucgaggcuaauuuugaauccugauucuccugcuuccaccucuugaaugcuggguuuuuacagcugugcuaccacaccagcaugcuauucuuuucuuuucuuguguuuugaagguguggauugagacagucucuggaguagucuggcuguucuggaacuucacagugguugugaaaccugguggccucaaacucagagaucugccugccuccgccuccgccucccaaaagcuaggcacacacuauuauaccuggccauguuuuacuuuaaaacaugguuacccaagucuuugggaagaaauauaauugucacuucugccaccuagugguaaaacaaaaccaguuuaauccaguauuuuaaccucuccauacuucauuuccuggggggugagggaguguauuuguuuaugagacugggucucacuauguagcccuagcuggcuuggaacuaaaaaaaagcgccaccaugcccagucuaauuuuaaaacuacaaaagggaagagaaaaaaggccugccuugcaacuaaucacgaacuucugacccuucaguaaccaaaugaaaaacugcaaaggaaucuuuggggagugacuacuaaagcugagggagaggaagccaucauagauauacucaaggcuucugcugcauuaauagugguuuuguuucucgguuaguuuuguucuauuaggaauggcuuuggucagauuuuccuuuugggcaaugggagagcaaaagcaggcagggccuugauauucagcugaggcuagcugucuuagucaggguuucuauuccuguacaaacaucaugaccaaggagcaguuggggaggaaaggguuuauucagcuuacacuuccacacugcuguucaucacugaaagaaaucaggacuggaacucaagcaggucagggagcaggagcugaugcggaggccauggagggauguucuuuacuggcuugcuuccccuggcuugcucagccugcuuucagauggucccacccacaaggggccuuucccccuugaucacuaauugagaaaaugccuuacagcuggaucucauggaggcacuuccccaacugaagcuccuuucucugugauaacuccagcugugucaaguugacacacaaaacuagccaguacacuagccuugaacacagugaugcuccuccaugcugggacugugugugcuacuguaggauacggaucccagcgguuacuauguuaaucuaacauuuuucucaaucuuaaguauucuauaauuuauuuauuucagaacuguuggacuuacuuuguuuauggaggccugguagcacaagcugcauucugggacacucuugggcaugaggaucuagaauuaagaugagcuagccacaaagaaauugaaagccuggcugugguggcacauaacuuuaaucuuagguaggcuagccuggucuacagaguaaguuucaggacagccagggcuacacaugcacaaaaauauccugucuugaaaaaaaccaaucagggcaugguggcacaugccuuuaaucccagcacuaaggaggcagaggcaggcagauuucugaguucgaggccagccugaucuacaaagugaguuucaggacagccaggacuauacagagaacccugucucggaaaaaaagaaaaaaaaaaaaaaaaaaaaaagacaaaaccaaaaauuccaggcaacuauggacuaaagaacugccuugagaagaaaagucacgacuuuaaagcuaaaaaacaauuuucuuucuuuaaagaaaaacaaauaauucagcaguuaaaaguacuuguugcucuuacagaggaccuggguucccagcacccaccaagcagcuaacagcugucuguaaggacaguuacaaggcauccaacacccuucucccaacuccuucaacaucaggcauuuacaucguacacgcuuauaacauacaugcaaacaaaacauucauaacacaaaaaaauaaaccuaaaaauaaaauguauuuacuuaauguguguguccugaguguaugcauccuguacaagauguugccagacccucugacacuggacuuacagacaguugugagucgugagcuguaugacaugacugggaacuaaaccaccauguccugugcaagaacagcaaauguuucuaaccacugggccaucucgauagccccaaaagguaguaagaggccagcccagcauagcauggugguuuaccaagugcauaucaaacacaagagaacgaaugugucgaguucaaggcuagccuaggcuaaauguaaaaucuuacuuugaaauuccaaaaauaagcaaaugguaaauuuuucaggucacucacccaaugaacucaaguaauaaagacauaucaaguucagguggaauacgaaacacugacucuaggaccuucuugguuuuuccuuugcuugaagggacuggcuguggagcagcuauuugagaugaaaacaaagaaccugauguaggauuaaaauuuucacaaacuugagaucuuuaaggaaugaaucacacaaguauuacaacuguugaccaaaauaucaaguccugaucaagucuccuuuuccuuaaaauuaccaauuaaucugucaaaucaguaaucuuaaagugggggaaaaagguucaguugguaacggugcuuguuaccaagugagucucucuccuaggccacacguggcaaggagagggaguccugccaaguggauaccuguguaagaaaauacaaacacgagccgggcaugguggcgcacaccuuuaauaccagcacucggaaagcagaggcagguggauuucugaguucgagaccagccuggucuacagaguaaguuccaggacagccagggcuagacagagaagcccugucgagaacccccccacacacacacacacaaaagaaaauacaaacacauguguagauacauauacaugcauacucucucuaaauauguuaaaaaaauaaauauacaauagggcugaaaguuggcucaaaggcacugcucuuccacagguccugacuucaauucccagcucaaaaccaucuauuaagagaucuggugcccucuuuuggcaugcagguguacaugcagguagaaugcuguauacauaauaaaucuuaaaaaaagagagagacagacacacacaauagggaccacuccccaguggaaggcagacaugacucauuuaucagggucacagagaguucauuaaaacaguacagcacuuauagauaacacuuuacaaauaccauguacaauuacugagguuagcaugcuacauauacucucauuuaauccuuguaaaguguauuacaucugcacuuuaaaaaaaaacugauaaagaaacugaacccuaguggaugaaacaaucugcuuaaggucacaaaguaacagaagaagcaggauuucagcccuaaucuaccugagcuccauguggcuauuacacauaaguuacuuugugcccagcguuaguaaaagugcugguaucagcagggcagugguagcacaugcacuuaacccuagcacaggggaggcagaggcagguggacaucaaugaguucgaggccagccuggucuacagagugaguuccaggacagccaaggcuacacagagaaaccacgucucaaagaaauguguuuaauaaugucauauucaucuuuauuuuagacauguuuguuaaagucaccuaaccuaauaaaguggcagcgcuaggaacaaacucacaaaaucuagcgccugagucuguucaucucucucucacucacacuuuccuuuuuuuuuagguuuuucgagacaggguuucucuguguagcccuggcuguccuggaacucacucuguagaccagguccgccugcuucugccucccaagugcuaggauuaaaggcgugcgccaccacgcccggcuuacacuuuccuuuuuuaaaugaaguguuucaucauguugcccgagcuggccuugaacucacggcaauccuccagacucagguuccugagugcugagcucacaggcuugaacuacuacacccagucaguccucuuaguucuuacaaaauguuacuuggguuacccugcagcauuaccuucaaagcacccgugaugguuguuuucauuuucauuccaauugacuuaaccaagaaucaccagggaagggucuuaaggagggacgagagcaagccugggaggacccaccccaaaagugggcgguggcauccccuggguuugagucuuagacuguaugagagagacaacuguaugagcaggcagcaagugccgucucuugguacugguucucccucacuccccggcuuucccuguagggugauguaaccugagcugugagcuaacuaaaccucuucuagcccgaguggccuccacuaggucuacuugugacaggacaggaaugaggacagcaccucaacaacaguuuguucuuuaaucugugaaugcagaacacauccaaacuuaccaggcuuggggacuucuagaccucuuucuuuauagaagucaugcauuugcuuuuuuucuccuaaaaaaaugauaaaacacagacuaaauuacuacacuuacgauguaacuaacagagacagagacuuugggauucacaacuaugaaauaaaagaaacuuacuuuccucuagauugaucacuaauuuguauacuaugucuuguaacugccgguccaaccuaauaaaaagaagaauggagaauaucucagaauccaaaaaagaauuuagguacaaaaugaauucacuauuuucucuuaggagcauugcuccuuggucuugcaugcuugguaagaacgugaacuugaugccggacugcauuuuaauugcugcguuccaucucagcugcagagacggagacgagcauuggcugcucuuccagaagaccaucugugacucucaguuccagagaauccaaccaucuccugugacuccaaaagccccaaguacacaugugguacacaugcacacauaaaaguuaaaacaaacagacugcugaagcuaggugcugugcugcacacgccuuuaaucccagacucgggacgcagaggcauguggaucugagguuaaagccagcauggucuacacacugaguuuugcuuuuaaagucuccagcagaucuagccgucugugccugauacacaguaagugcuccacacacacuucuugugcaguucccuuccuucucguuuugauagcauucaaaggauuuacccccaacugcacaaugucaagauuucagaaaaaaaaaaaaaacaaaaaacacuggcaacaaugauuuuaaauguggauacauuuuaaguguguauauucuuaccuuauauuauaaagaggcugagucugguggacaacuauguugcauuuugggcaucuguuacuauaguaaaaaugucucacaaugcagcuuuuacaaacuagugaaagagaaaaaauguuuaauuuaggaugguuuacagacaucuucacauuuuuaaaacaccauucggaaaugcgaacuaugugcuuacagguaugaagacacucuguaauggugguugcaucuaucagguaaccuuugcaaaucgaacacaggauguagggggucagcucgacaagguuuaucaggcgcuguaagugcaacaguaaccauuuuaggauacaagccuuucccuucucaaauucagaagcuagcugcaaguaggaagucuaaugccuauauuccaacuuacacaagucagcugugacaucugagcccaagaguguugguagggucuggacuccacccccacaguuacuuggcaacagccagguaugcuccuccccacaguuaccuggcaacagcuagguagguuuggcccacuauaaaagggacugcuugcccccuccucuuacuccugcuucucucccuugccucuucccucccuugcuccaucucucuccccauucccuucccgcccucucuacacguggucauggcccuccuccacuucucuacucugucucucucucucugccucuacuacccucuuaacuucccuccccaugcccugaauaaacucuauucuauacuauaucgucguguggcuggucccucagggguaagggaugccuuggcaugggcccgcuggggcacccccuucccccacaccucgccacacccccauagaacauauauuaauaccccuuuaucuuuuuaaaaucacaacaucaaacccaguccaaagccaacacuacaaggucucauuucaaaacaaguuaagccaugaucccaagauuucauuauaagcaguguaacuuaauugcacuccaacccuucaaaauauccaaucuaaagaaaacacuguaucuaagcggucccaguucucugacauauaggaaacuaacagugaaaggcaccuguucuuuuguugguuuacaaaaagcccuuaaaccugccuggucuccccacauuaccaaggaugacuuugaacuugcugccucugccucacgaauguugguaguaacaagugucuacuaccacauccaguguagacagugcugugacucgaacuccgagcguccugcagggcagagauacacuguaucaacuggccuacacccuauccccgggaugccuuucuucacacauuuguuauuuauuuuuaaugggggaggggucccaaacccucucaacauccugcagaaaaaaaagaguacaccugccaguagccuuagacaucuaacucccuccacguuacgcaaagacuuuuacagaauguaaaaaaaacaaaaacaaaaacaaacaaaaaaacgggacccagagugcccuaaaugaucugcaaggacuccacaaaauaaaugaagccggagagaggccacgccugggugggcggggauggagcgcuacacaagcgccgcgagcuccagcgacaacggcaaccacaggucugcgccccgcugggucccagaggccgcucgagcgcagccaggucuggcagggucgucgauaccuccuccucguccucggagucugcccguccggacuccagacgcagagagaaguggcucaucucuuccuccuccucuucuuccuccuccaucuccuccuccucuuccaacucuucaucguaguccucgaagcggccucucaagcggcccaggcugcgcucgggcuccaacgccgggggccgagagcgagagcagccggcagcgcccgccuggcccagggacgccgggcccuccucgccggccgcgggugccgggaugagggcgggcggagagaugggaggcggaggcgguggcgguggcggcauggcugaggcucgcuuggccucagaggcgcgcuuguuuuccguggcguccgucucagccucguccauggcggggaucagaaaucuggcgaguugagagcgaggcaaggcgagucggacggcuagcgcgcgaguugagcacgagcccccuuucgua

SEQ ID NO: 9324 - RNA, 3794 nt, Mus musculus
uagccuaaauuaggagcaaagauuuauuccagcuuagguucugaagucucaauucacaguccccuuaggcuucuauuuuggggugaaggcgccaucuuugcaggcaagauucuagguuggugcugggguugcaagugugggggucuacacccuccacccagcgugggauguagaccagcuccccauuguaagugucuggucaugauugcacuugaacuuugaguucuauggacagcuaucccguuugagcucagguuuuuaccauuggguugagccccccuuucugugcuugggacuugguuagcaggcuuuggggggaggagauuucuuuuccagaggagacuuccuggggccagcagcagaugaagggaccaguagacucuccugagaugauguuccuggcgucuccacucuuugcuugggucuaagacuauagcaaagucacuuucagcucuaggucucuggguguuagcuauggcaaggcugucaggccgucucacacagcaccauguacacucacuugagccuuccacaaugacacuaagggugugcucuauaggcacugauggccguugcucugagucaaaugcgugaugacagaacuaaagcugccccaggcacugccagcuugguccaauuaaugccaauuggauccuaacucgugcugaguggccccuggggagaggaccugcucagucaguaagcaggauacguuaagccuagguuuguguagcccaugagagccauccaaagccaggccaggcuagugaggccgauagcuuugcuuccuacuggccaguuuucucugcccagacugugaacgagaaugauuuaagccaugaucggaggggccuggccgucuuguggcugggauauagagggauuggcucuuugccuuggcuggccuggcaccugggugagaaaaagcagggucuacaccaggccuuggccucaucgcccuacagugcagagcccucucucagagagaugaacuguugcaaggaaacaugcuguuccauguguccugggcgcucagcuuugcgaagccucuuuuuccuuucugggucuuguucaggaucccugcaggcaggucuacggugugguccaugggcugccugcagccaagguucacagugaauguggccugacacaguauuguaaauuacggaaaauuuaugauuuuuuuuuuuuuuuuggauuuuucagacagcauuuuucuauguagcuguggcuguccuggaacucacuccguagaccaggcuggccucgaacucacagagaucaccugccucugcuuccccagugcugggaugacaaauguaugccaccacuguugacauucccccccccuuuuuuuuuuucuuacucaacugcguuguuuucaaugugaacguuguagagaccuucguggcugagagaucucuccucaaugcuaacugaugcaaacggggaagacggucucuagcucuguggugauuucuuuuccuguuuugagaguuucuccugcagaauggagccaggucccuguggcugggagacucaggacaccugaggagaaggacagucucucuguuagcaagucugcccaggaugcgggcucgcuuugucuggcccaccucgagcucaacucucugggccugaccaaggaaccugagaggucugaggugcuucugggaauccauuccagaugcggcccucggggaaagcccacgggccucuggaguucccugaggaacguggcggguaggacugggucaggcgaucauggcagccggcggugugagaagggagggcaggauugaguaucagccgggcugaggcacaggcgcagaagcaccuaagagacuuaccuuccacagccuggcuccuuguuugagcgaauggcuuguucguaaucaaagcacaacaaaccucagcugucugucacgcuuagacacucgccucaggccuccuuucagaucagcugcuuuggagaccaguggggcucgguuagauggccuugcuguccccccucaucacuguccuauguccccgucugugcaguaguaguaguaguagucaguaccugcuugcuugcugguggcuuuugccgccucucucacuuacugcugauggcuauccccagggcccggcgcuccgcacuccagagggcauuuaaccuguuuugaauugaauucgagaauagauugaucuagggaaagucagacuucagggcugucaguguugugugauuguuguucucuuucaccucacccuccuccccucccuccuccuccucccuuucccuccucuuuuuccucuuucuccuucucacuagggauggaacccaggguccucuguaugcuggacaagaguuccaucccugaguugcacaccgcacugccuccccccucccccaucccuacuuuguugcaaugaccuuuccugaauaccugggauucugggacugaguuacuugcugacagagcagacucuuuauggucccagccuguggagccaggguccgggcaccgggcucauguccugaccucauagggcuggcugcuauagaccacugggguggagguuaaagguuggagagaggaagaggauagacaggccaagggaagggagggagggcuacccagagacuauguuguguagcccaggcuggccuuauucuugcuguguaucugaggaugcccuugaacuucagaucgcccugccuuucuuuagcuccugaguacuggaauuacagcugucuccccacacccgauguguacagagcugaggaugagcccacaccgcauguucaucuuugugucuacugucaacugagcuauauuuucagccccucgguucaucuuuugggagagucuuauguagcucaggcuagccuggugcucacaauggagaccaggcuagucucuaaccugcagugggccuuccugcagugcuaauguugcaggauugugccaagaggcccagaugaagaacucguucugaacgaugguaacauuugguagacccagaagggcuuugccuuggcauggacugggaacugaaggaggagcugagcugucuaugacugugguagacaagucuagccacaguguggggccugaaucagaggauuccacaacugugggaaucacugguccucacucugcuguccgcacacaaguggcucuggggagguuguauggccugcauccucuccccuacccauccgcucccaccuaguguugguguauucaccucuaagauagaacagugaugugagacccaguggccaggccugggaggaauggagcagcaggccaauggggcguggcuagcuggacuggagggcaggugggcacagaaagagguggcuugcugcaaaaucaggaagucauuuuacuucaggugucucuggugaauaauuaaaugcucaccucaggcaggcuguguccacacugagggaggccgccaagguggcugggagacuaggggcaugcuggcuuguccgcuuccagcucuucucuucccugcuucccggucucugggguaaauuggguguucugugguugucugccuuccuuucuucccugcauugucucucuuucccaccuccuugaacuugcucccccucauuccuccaccucugcagucacaagggugcugcgcgccccucuccuucccccacccguugcucacugagguuaagcuucugaccugcugccuucagcaggcaccggggguccccugaacugcccaggggccuccgaggagcagcgcucacuuuuccugugucccagugcuccagacaaaca

SEQ ID NO: 9325 - RNA, 2176 nt, Mus musculus
aauagguucuguuucuccgauuuacuuaaccuucuucugccauaaugccuuuacguggcaaugauaaccucaaagaguaaguauugguuuuccaugucauaguuuuaugggaagaaacugggagacaaguguucuuucuggccuucuagaguaucaguggugccugugacaaaugguuauugucugaaagccacuccgagguuuagggagacagcuaggugggcagaagccauaaggaccugaguuugucuugauaagagugguguguuuauagucccacugcuggagacaccgcugagacaggaggcucccuggagcuuucgagccugccagcccagucuacuuggccaguuucaggccagaaaggaaccuucucaaacaaaaggguggacagugccugagaaccaccacccuagguugaccuuuggcccccuucaugcaugugcacacaugugcgcgcacauaggaaccacuccauucuaggaaguagggaaguccuagggauuagaauuuaagaaaccuuuuucuuucgugaaggaaggggcuggagauagaggagauagaggaaaucaacccaccacugcuaacaacaacauucuuuguaagacuguaaaucuuguuggcacacacugaguucuaggcuaggccaggacggagacucuuucucagaaaaauuaaacaucccucucaauagguuauaaaguucuacaaguucugcaggguuaccagaggcaguagagagagggacuugcuagcgggggagcacuuagaagcaauuagaugccuuucagguuggugucuuccagccgcaugcuuuugucuagaggguuagauucccgcgccaccuucgcuuccugccuuuguaccugagcaguaguaucuuuagugcucugguggcgcuugcugcgcgaccccugugggacggugacagucgcccugucucucgcccuccccgucgcagacagcgagcuggugcugcccgacugccugcggccgcgcuccuucaccgcgcugcggcggccgucgcugcggugcgaggcggaugaggcgcgccugucggugagccugugcgaccucaacgugccgggagccgacggcgacgacggcgcaccgccugccggcugcccgaucccgcagaacucgcucaauucucagcacagccgcgcgcugccggcgcagcucgacggcgaccugcgcuuccacgcgcuucgcgccggcgcgcacguccgcauccuggacgagcagacgguggcgcgccuggagcacgggcgcgacgagcgcgcgcucgucuucaccagccggccugugcgcguggccgagaccaucuucaucaaggucacgcgcucgggcggggggcgagcgggcgcgcuguccuucggggucaccacgugugacccuggcacgcugcggcccgccgaccugcccuucagccccgaggcccugguggaccgcaaggaguucugggcggugugucgcgugcccgggccucugcacagcggcgacauccugggccugguggucaacgcggacggagagcugcaccugagucacaacggcgcggcggccggcaugcagcugugcguggaugccucgcagccccucuggaugcucuucagccugcauggcgccaucacgcagguccgcauccucggugaguuccgggugccaucccccaguccaugaugcucuuucuaggcuuaggugaguucuggguaggguggaagcaucugguccacggaugucgggaagagaggaaugaacucagaagaacccaaaagacacacaaauuggccagagccuuacaccccagagguuguauuaaaggggcgagggcagugaacuuucugagacuugguuuccucagggcugcuuguggcucuuagggaaaauaagguuagcugguugugguggugcauaucuguuauccuagcguuuaauaagcagaggcaggaggaucucugcaaguucgaggcuaaccuggucugcauauugaguuucaggucagccagagcuucauuucugucucaaaacagaaaaacaaacaaacaaacaccucaaacaccguauuagugucuucuugggcaccugcaucagaguaggggacucccugagcagguggccuucaggaauuagauugcaguguucuagaccuuucuuuuuaggaagacgcaguuug

SEQ ID NO: 9326 - RNA, 1986 nt, Mus musculus
ugggucaaugcgucucucgaaauccuauagagagggacgguugacagagcucuccagauguguagcuguggcuuuuuuuuuuucuuuuuaaagauuuauuuuaaacucugugugugugugugugugugugugugugugugugugugucugugucuguguguguguauguaaguauaaaugcucacggagcacagaagaggguaucugaucuuccaggcgacuucuuaaagugcaugugggggauuccaagcguuagugcaguagaaccacgccuggaaagaauuagaaaguccuuuccuccuuuccucuuuuccucuuuuccuccuuuccucugacugcugcucuggcucugucuggggcuguguggcuacagcuccuuccuugggcaggaagguggguugucaguguggaaagguggcuuugcguaguggcagaagacaugagcuggggugggguggggggggcuuuucucuugggagaaggccccgugcugggcugggucccauccccuuuugauuggugcucuugcucucagggacagcccccaacucaccugugagccugcccgagucaccggugaccccaggucugggccaguggagugaugaaugcaccauuugcuaugaacacgcaguggacacagucaucuacacguguggccacaugugccugugcuacuccuguggccugcgccucaagaaggcccugcacgccugcugccccaucugccgucgccccaucaaggacaucaucaagaccuaccgcagcuccuagcccacugcagagccccaccugcacgcccacuucugcagacugcagcccagccagcaccagcugagggcaaagccaacagggucccuuccuucuacaguuugcaaacucuuccuccuuuuccauuaaacgugggaaaccaaggucccuggaggauugggcugaaagaguuucaggcagggagaugagggcacaagcagugaggggaggaggguaccccauaucucucuccucuuuacccagauuucugcaugcugaguggcugguugccaucccucgagaucucggcagaucucuagguugugcagcccggcagcccgugcggcaucuuggagagaguuagcagacauguagcuucccccccggcagcuggggaggaggccaguggaccuucucccacccugggcagcugcaaacugcaugccauguuucuuucuccuuacccaaggcagggaaacagacaggcugcagacuacagguccgagguccuugaccuugggccaaccugccauguucaggaucucccguuugccaugacuuucgccaaucaucucacuggugccguuucccagggugcccuucaguguaggcugaugugagccuuucuguugucagggucucaaaagagcagguccacagccacacuuaaggccuguccucccucaucucagugccagucuuggccugggcugauuugccauugugugcccaggagggacaggaacccucagugggguggggucucccuggccuauggacagcccuuuuccuuaauuuauuuauuugcuuuauggguuauguuccaaccuggggucuccugaaaugcuacuguugcaggguugccaggugaagggaagcaaggaguagccacuuggaaucuauccccaauacaaggcucauggcaguccugcuaaccccgaggaagaauuccaggcuggaggccucccaagaaguggauaagccucucuuaugugggaagugcccacuuccaccugugugcccuuccucccuggaugggagcccuguuacuguggcugguuccaggacauccgucucuauagagacaucagaaguucuggaaaguugucaacaugugggucagggaccagaauggagacgcuuguuagaggagggaagauagacccugaaagccagccucugguccugcuaagggggugccccuuacuuaugggcuguggccccuguauuccuacc

SEQ ID NO: 9327 - RNA, 5939 nt, Mus musculus
ggagggauguuuuauuuggguuuugguuuaaugucuuuugccuuuccauaaaccagauuguuuguuuagguuuccacuguguacacagugcccaagcauggcaccuuagcagggaguuuggaacuggguaaagccaaguccccggcucggugaaacaaaguguucagguuccugcccaagagggaaagagggcagccugcuggguggcuaaucugccuacuucugcccacuuucuccaaccugggcagaagggacccuggcugggucagcccagagcagacacugugcccuuagccugcuggcaagguacccaagaagauggaggacuuugaagccaggagccaacccuaucuuccugaggggcagcaccccccggggaacagagaagcaaaagagaguggaguggaaacaguccucugucugcuuugggucgugagucagugguugacauuucagaggggacccuccggaaagaagcccgcaguguccuuccaggacuccccucaugccaggaguggaugccauacgugccuuugacuugggacagauccugucucacagccuguggcugagcugccagcaucuccucugaccaagggcugcugguuccaacagacaugggaggaagagcgccccucaccccaccucccaggcaggucugccuucagcucccaacccuaaccuccuggauccccaagccauguuucucccacagguggaugcaacccacuagccuccucugucaaaagcccgugguggugacauuguucuauuuuccuuuucuguguucaugaguuuguuuaaaauugaaauuaguuaauuuucuucugcuggacaguauuaaauagagugggguuguugaguuaaucugcuagauugcaguacuaaugauagugguauagugucuucaugauauuauuuguacuuauuugaacaauaaugauaaagaagugguucauuauuucuucauuaaugcacuuuaagguggaauggaaagcaaccuggagagcgaagugcauuacuuaaagaugcagcauauacacuucucauuuuaaaacagcacguauuuauuaaaagaggaaaaaaguaauuuaugacuauuuaaaauaaaauuuaaaguagaguggcugucaggugagaggaccuucgacguagccgucugccagggggaggggccacagccucacuccucagaugucugcauugagccagcuccauuagugcgcccgccuggcugccaggcacagagcaucucaguuggacuggaccaccaggauccccagagccagccuuccccaccuccccuguccuugccacaucccaaagauucucucacaaucccccguguccugaaaucauagauccuuaaaagugggacagggagggugggggaccuuagaggucacuccauacuauccauuccuguuacuuuagcccaaggacaggaaaugacuuuccccaaauugucaaacuaauggcagguuccugcacugcauuaguacuguguuccuccccugccccucuaguuuauuguguggucauuguguuuacauuguaacauccagccccagggauggcugggaguugcucaggcaucugggaaaaguggggaacgucgccaccuagugucaggauguagacuugggcaaggagucauagccaaggucccucaccaccaaacccaucagggcacagcacaaacccugccagcacaaagaauacuugaaacaagaagggugcauaccaggccuucccagacauggucgagagaugccaggcgaugugucccugaauccuagcccuccccaggcgagagggcuuuuccuuagagcuaaugagcugcuuugugauauuggacagaccacagcagcugagggaagggccuggggcucugacccaccuagaggaaaaccagaucgaacuaaaaggaaaaaaaguggaaucucagaaacguccaaaccuaguuuuccauuuguuaugauugaaaaugugaaaugacauuguauugcuguauacugcaacuuuaaucagaaugagcccuucugaggucauuauugagguuuauauaaugcccgaagacgcaucaucuggugcucuguuuucuuucaguuuaaagacccuuuucuuguaucacagggguggagggaaaagucuucaaaccguauccuuugccaguagcuggccuggcuacacugccuggcuccucugugcucucacagucggggagcaggaggaagcugguagugggguguccaucagcagcagguuccuguuugcuccccccaggcucccuucacaacuaggguucugucugcaaaggccucacucucuaccccaagccuggccccaaggguuccucuuucucacuccuaauggacgaaggcauuauauagcgcccucguaggcacuuugagauguuagagaguauuuuacuggcauuuauacccuucgcuuccccugcaaggcauguuacggcgucuaucaucuaaggaaaaaagacaagggaauuucagucaaauguuauuuucauaugacuaguacuugcagaauagauguagaguuauuuaaguuguaguguucuguuuuuuaggaagggguggggaccaggugaaaucaccccgacuuuuccuggguuugacuaauauauaauuuuuuuucaggcuacucgagcccccuguucccucuaaagacuuugcauucucaauggaaaacgaaaacaaucugagacaggaaaagugcaauauuaccaagagggauuugggacaguggagacccuguugagucugucugcagaaaaugggaggaguugugggagguagccacccgaggacagcccaucaguguuguccaccuagaaggauguggcauggugcucuugaccuccugggccgguccccagagcagaaugagaacauccacucccguucuccuguuuugcagucagcugcucauagagaccggcagcccccucgccccagccuccugaugugugugggcuaugaagcuuuggaugugugcuugagucuuucuaaaacuguaaaaccucaguucagcuugugggcaggaauccuggccauaagcaaacucaucuggagggugcgugcuguaagccccacuuacccagugagagccaguuccuacaggccugcaguaggccuggagcugaguccuggccacccauucaucucagugacuugggcaaaaggcaugagccugucucuaauaacaggaacuccugaggcaggugcacacgagcauccuuucucaugcagcaaggaaaagaggcaggaaaagauggcuucuugggggcgaggagcaaguuccagaacucggcuccccaaggauagcaagcacggccuugcugguaugucccguuuauauaguacuguaggccugcugcucugacccaucuugugugaauuucuauacagauaggaagagggaccgggccccuuuuugggucucucccuuggaauagauauggcugcauagccguaauuggaauacccaugcagcucucuggaaagacaacaguccacaucacuaaccaauuaagauucccucgcuuuuuugagggcugagaauguguguguguguguguguguguguguguguguguguguguggucauuuccacgagcaugggaaguucaugagugcauauguguguguaagaagaaagagacuggugguaauucuccacuugaauagcaugggguuagagagaaugaguaccgggcaggcagucuccauugaacuaguccuuggcauugggcaggucccaagggacgcgcagcuucugacaacaugugugucauucacacgauucuggcuggagagugcaaugugucuuuaaaaauuuuuuuguaauuauuuuauuauuuaguuggaaacuucacacugguauuaacagagcgaacagaagcagcccaggcaggccauugucccgggcaccaagaugaagacauggaaaagauacuguugaguauggaagugcugaagugauuaaauuagggcacccaccuccauccucuccuuggcaugagacccccggggauucaugagcuacuggguuacgguuuguuucugaaggacaggcaggcuggcagaugaggagugagacaguagggccugcagcuguccacacagcagugccucccgucuccacagcgagccuuccgucuccacagcgaaccuuagaucgcuuccugugaguguggaaggcuccucaugaccggcugggauuuuugauaagucccguuuggggcaaucugauagucucauguccccauguuuccuaagcucggugcugagagugacguuagcacugcuagucacuucguucugugcaucuggguccccagaccacaaaguagguacauuggugcuuguagauugaaggaaagggucuuuccaaagccuugaucccaaccuggcugcaagggauuggcaggugccacccucuccccucucuaaaucucaagugaccuugacaguccgugccccuccccuauugcacuccaaugccuuagagugcccccccgcaccccccccaccccccggugcugaaggucccugccuuauucccaaaucauauucuggacaguuggcugugucuuuggaagugugagagagucauguuagugcaaacagacgugucuggcaugugggaaagcuagugggaggcauguuggcaagaggagugcgcauguuuggaguuacuggcgcuuaccguccuugcacgggguggaagcuuccagagaugucuuuuagguaggugugggaaggcugagagagagagaguuuggaacaggaaaggagucaguucuuggagguugaaaacgagagguuuccagggauuuuugcucucaccagccaagaguccagccagagaaaacuuguucacugggccccauccgggcuuccaguaucauugucuuaaggaagaggugcugcaagucauacgccaaucuuugggucugcgggcccagucccaucccggauuccccauaguuuuugcccagugcauuuugucccaugcagagcuagccugucaaaccauacaaaauagacaccacugaccauaauaggccacaccguagggacccaacaccuccauacuagacccuaaagcccaggccuaucugggaggcaggugaccucauugggacauuuauucccaaggcuccaauagaaccuacgguucugauugcugagucugccuccugccugccaguccggccaggcgagugcaccacccuccugcaugugcaucuacugaggcacacugcuucugaguuuacuucaaaggguacacaguugccauccuuagauuuacaacuugucuccugcaacagaggacaugggugucccuaccaguuacugagaggccuggaagguaacuuggaaggcagaagugagcagcuacugcuaccgugugaugagaacgagccgguggaugucacugggacuccuaaaucacagggauuuccuaguguccacucauccccggccagccuacuguggucagcaggagcccuucccccaguuucuccccuccgcuccccaccucagcagaggaacggagacaaggacauuggaugcaguagggggguccgugcaagugcuaacauaucuccaggauccucgguggugcuaaccuaucuccauguuucucauaauucuaauaguggauucuuuuuuauaagccucaucacaaacacagugucaccgggggagggacccagcccccuugaccugccccuuuccagguguccuuuaucacuuuggugggacucuuugaucuguagaaaugaccugucuuggcaugcuucuagacuucaacauuuggauuguuuuguuuccuauuuuguucguguuuacaggcaucuuguauuucccuaaagacuaaauaaaguuuuuggccuuuuuaacugaac

SEQ ID NO: 9328 - RNA, 1923 nt, Mus musculus
ugagagccugccuuuauuuauuuauuuauuuuccuucuacuucugccucccaagugcugggauuuuuaaaaagaggaaugcauuaugguucgugauuccagagacaucaguccacaacagcagggggaaaucuuggcaaagaaugacaguucacacuauggcaaccaagaaaggagcaagggaggagauacccuugcaaggaccccaccccccucgucuagugaccugcccauccccuaaguuuccaaaaccuuccuuaacagugacaacggcugaggcuuuaacacauaaaccugggaggggcacuucauuccaaaccaaaauacccaguaugaguaauauacuagcaaccgggaaaauuucauugucaucuuaagauaugcuguuccuuuucuuagauuguucccaggaaugggcucgggagaucuucuguauagcauagucacuacguuugaucauggcacaaugaauacccagaaaagacauguuguagggguagagacagagcagcaguuaagagagaagagcuuacugcucuuucagagaaccugguuggggggggggcgcugucuuuaaagaauaucagucaggcuagggagguggcucaguggguaaagcacuugcugcauagucgugagaaccugcauuuaauucacacaaagacggacaugguagugcacaucuucagucgcagugcaccugugaugaggcaggaggaggcaggggaaucccuggaagcuugaaggccaacagugaauccaacaguggaagagaucacgucucaaauaaggugaaaggugaggcuugccuucaagguuguccuauggccuccacgugcauguuauggcaugcugugcacccauagucacacacaagcgugcacaugcauguuacacacacacauacaccacugcuuuauguuuuaccacauuagugcuguugugagcacauggccaaguacuugaagcagcauguugagacgcugaaagccguaugucuauuucagcuguguaucacccgugcugacugggcucugggaugguccugaggcuaaugcuguugcaagugggugacuggccauucuuugcucuugguagaagagauggccacuguccaggacagaaccuugucuaugguauccauggugagcaucuaggugcucaauucggcucauauucaagaaauaauugcaaacaaaaacccagcaguuugcugggagugguggugcacgccuuuaaucccaguacuugggaggcagaggcaggcagauuucugaguucgaggccagccuggucuacaaagugaguuccaggaacaaaacaaacaaacaaacaaacaaacaaaaacaaacccagcaguuauucauuucugucacaaggacagugacaaaaacuacaggugccgcauugcauugugggugagcuuugagcaggucauccgucauugauggaaguuaacaguggaccagccuuuucaggggguacuuuguuaaugucuguucacuuauucauuuuuaguaugcuuuucgucucucuauagggccuaggcuggccuugaacucacaaucaaccucagccaccuguguucugggugaccagcacaggccaccagaccuggaccaguccauaugcuuaagcccuuucuccuggaagaaucuaugaagauguucccugcauacuugguugccacaguuacagacuagaaaccaacuaagugguacccaagucggggaagacugcucugcucagucagugagugcacacuggguuguuuccacuuuggguuauuaguaauucacuaugcugcuaguuuucacaucaaccugacacaggcuaggcguuugauaggaaccuuaauuaagaaaaugccuccagccgggcgguggugacgcacgccuuuaaucccagcacucaggaggcagag

SEQ ID NO: 9329 - RNA, 4654 nt, Mus musculus
gauacagauggaacucaggccgggaagguaaguacuagugacacagacagggaugccccgggggucacaacagugaggggugagauacagaucuguggagagauacugagggcaaguagcagucagaggggaugaggcaucagaagaugacgguaagccgagacuguucacuuaaaaguaaauacacagucacacgcgacagcagcggacccaagagcaguaauacaagcgacaggcuaaaccggaaaugucuuaguaaaucuuaacuuuguacuaacauagaaacagcaaacaccaaagcagugugccaggagcccucggagugcaaggcggggcuguaccgagaggaacgggaacacugcuugguccucugcacuuuccuagcuacagacaugacuggaugcagcuuggccuucacucgaauuccuacaacaggacagaugaaccuuucccaaggcaaaaggaguaagucauuaaaagcccuggcucagggaucaucuugcugaucgauacauccucuuggguagaggauaguugucuccucucaucucccugaccuacgggacaccaucucggugaguacuggcaacugcgugcugugaccucagccuaaacacuaagugcagugugaccuuguaaggggcagguucagugcauuucagauucuuaguggucagucaccuuuccagaauagaaauggcacaugcuaaaacggugaccucugcuuuuggaguccauccagugugacucugacaccagucacuuaugcaucucccuccaccccacccccagccccaccccccacauaccucccaaugugccacacuuacuugguccgagcccgugcugugggucacaggccgacuggccagagacugcaaagacuccacugucucuaacuccugcugguagaagcuuugcauuuucuucuccuggaggaauucuuuaauuuucucacucagcaaagacgugaggccagcgagauccaaauugucuuuauugcugcagggagcaaaguuuuaaaacacccugcagaaagaaaccacuacucggcuccuuuuggaguacacgaaaccaaaagcuaucugggagagccauccugcaccaugcuuguuuugauuugcuguuguguuguuuuguuuuuacaaacagggaaauccacacggugcccgcuguguagcuuuggugggaccgugucacuugcuggacacucgugguggauuauaaagcgggucgagaacagcauggaggagggccauguuugugagggagaggagaucccaccaaauaucuaggugacguucaugcucuugugugcacagaagacaggcaucuaaagggaaccaagccagcucaagcccucuggcaaccucugggcaguagugcggagaggguucccacuuucuguguuacgcauaccugcuguuugcacuguuugacuuacuggauaagcgauacauuuacauguuugaaaaguuaaagagagggccgggguacagcucagugcuagagcacuggccuagcgugaguuugguccugguucauucucuaccccggaagaaaaacugugugugacggcuguguguguguguacacgcuguacaugugcuguguguaugugugcuguguuaaguacguggucuguguaugcugucuaugugcaugaauguugugugugugugagaguguguaugugugugugcaugcauguguguaugugcucugugugugugcaugugaguguaugugcucugugugugugcaugcaugcaugcaugcagaugccagaacuugaagauacuggugcccugcuucauuucccucuaccuauucccuugagagcagaucucucauugacuuuagagauaaggaaguggacagcaagccccgcugaucgcccugcuuccauccccuuagugcacaccagccggcccagacuugccuauagccgggaucugagcuuaggugcucacgcaugggggacaugcacuuuuacccacugagcuagcucucuaaccccucugccaccaacucaauaaaaucaauaauaaggacagaauaaaaaguacccuccugugcuggcuaguuuuaugucaacuugacacaacugacauagucaucuaaggaaagggaaccucaauugagaagaugccuccagaaguccgggcagcaggcaagcugcaggagauuugcuuagugauugaugugggagggagggcccaaccuauuguggguggggccacccucaggcugguaguccugcauucuccuauaaggagaaugagcaagaccuggggagcaagugaguaagcaucuauguaugcuuaccccuccauggccuccgcgucagcuccugccuccagguuccugcccuguuugaguuucaguccugacuuccuuggaugacgacaguggacugggaguagagguuaaauaaacgcuuuccucccuaagcugcucuggccaugguuucaucacagcaguagugacccuaaguaagacacagccucauaccauccucccagcuugaagccucuagagagccacugauaagcaguuuucuuuaccucauauuuuagcaaauguguguacauuuguauuccucuugggcuuuguguccccucuguacaggagugaaacccacccuguacaggagugaaacccacccaacccgguuguuuuuguccuuguuuuauggugggggaaugcaggaucggggucacucugugauggggacugugaugugccucagugcaggcuucuucgugguucuccccuggagguuugcuaagcuucuuggaucuguguuucuaguuuuuagcuaacuugagcaaguuucagccacgacccaaauauucaucuguguucccuccacuccuucgguaacuccaaguauaauauauuacacaauacauaacaaucaucaugggcuuguguuucauucgcaacgacccuagugccucuacgcuguagucacucucgcuuugcaggagugggaacugaggccagggaggcggagcccaugguccucaggugggggauguuugaugauuuguaccccaagcuucccugcggccguauguucucagcagugacagccagggacuuacuuuagugccuccuccuccuguagggcuggguuacggaagggcuggucguacaccuucugguagagcuugggcagcucaagcauccuugcgauuugcauguuccacacuggaucguccaccuuaucuaacaacccaggaaagagaggccacaggaguaaccccgagagaacgucuucccacguccaaacuaccacuaggacaauagucuagagucacagaacagcuccagccauccccugagagagaaggcaaggcccuauaugugacagacacaucuaggguagggacaggccugucacuagcaaucuguauguuaugccgauggacuacugggacagccuuguaauuuauauauguacuuauugacagggucucccuaugagcccuggcuggccuauaacucauuauguagaccaggcuggccuugaaugcaggaagaucugucugacucugucuucuggguucugaaauuaaaggcauguaccaccaugacuggcugcuuuugagauuuuucagcugaaaaccagccagcacagugcaaagggggcgauuuggaaccacuucuaauuagcuauuuucauuacaguugucugauuagauauuuucauuccaguugaugggcuucaugguguucaagguguccccgucguuuugaacuaguagaauacucuaugcuaacagacugacauuuagaaugucaaagugcuucagaaacggugaaauuauccaaacuucccaauuuacuucuaauuaacauucuucaaaauaaaauucaaaaaagcucuuuuccuaaaaacggcacgcuaaacauaauucccccccaacgggaucaaaucuucuaugagccuuucuggagucugacuuccagcuaaacaagcauuuacugagcacacacccagaauaucagcucauuuggcagaaacuuacuguacuuacaauaaauguuggcacagaucucucgcucuucucggaacaugcgcacagagccucggacucggaugauaucuccaaucccuauccugguuuucugcucgauggucuccugcagcuucuuaagcugugaugucaugcuaagcucucucgcagugcucagaauagcugggucuggcggggccaggagaaaagagaagagguauaagcgaggguccuucuaugcuggggacacaguuugaggggcugaggaagcuagugugccugcucugauggggcguucuaguauaauagcuccugguaccuuuucaaagcaucuccccagacgcacaaaguuugugcgaugguuugcauaugcccggcccagggaguggcacuauuagaagguguggccuuguuggaguagguguggcccuguagacgugggcuacaagacccucauccuagcugccuggaagucaguauucugcuggcagccuucagaugaagauguagaacucucagcuccuccugcaccaugccugacuggaugcugccauacuccagccuugaugauaauggacugaaccucugaaccuguaagccagcccuaauuaaauguuguccuuacaaga

SEQ ID NO: 9330 - RNA, 11210 nt, Mus musculus
cuacuacuuauucaaaucuuuaauuuguaaacauugaaaaugagaaauuauucagcuagaggggaggaaaauggaaaacagcaaacggagcaaggaaaagauaaccaaacagcuggaaaggaaguacugaaaaccuaaaggauuaaggaguuggcacugaaccuguacugacugggucugagaggcaaacugaucuaagauggauuauuaggagaaaagcaugcaaacuucacaaagcuuuccauacauaagggaaccaggacucagugaaaugguaacauacacaugguucggauuuuaaguugaucagagccaauuguggaaagcuacacaaugaugcacaaagauuacaaagacaguuuuguuuuguuuuuaaaaacaaggucuaccuguaugggauucucugggcuauggcuucuauuaagaauauucuauuaagaauaaaauggggcuagagagaugguuauagugguuaagauugcuuacugcucuuauuagaugauccagguucaguucccagcauccauacaauggcucuugaucuguaacuucagcuccagggaauccaguguucucuucuggcuuccauggauuccuacacaugagcgcauacaaacucguacaggcacacacguagaaacaauacaucuuuuaagaaaagaaaacaaagaaaaauauguuuccuuugguguacaaagaaaagguaucuuucuugcuuuucuuuuuuuuuuuuuuuccuaaagaaacacaguuuuguuuuuuuuaauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagccccuuucuugcuuuucuuaaaaaauacugaaaacucuguuuucaggaauggggauggugagaauuuuuuuauguguuguuuuucaaggccuuuaguugagaguaacccuugugucagugugguguaguuggaauauucuuagacaauaaugauuaaugugaaaaugggcuuggaaacaucuggauuuaaauccugauucugccucuuacuaagcuguaagaccggaggaagccuguuaccuacugucuuaguuuggguuuuuauuucugugaagggacaccaugaccaugacagcucuuaauaagaaaaacauuuaacuggggcuggcuuacagugcagagguuuaguccauuaucgucauggcgggaagcauggcagcaugcaggcagauggguugcugaaaaagaagagagagcaacacuagaccuggcuugagcaucaaagcccaccccuagugacacacuuccuccaacaaggcugcaccuauuccaacaaggccacaauucuaauaaugccacucccuaugagucuguggaggacauucucacucauaccaccacaccuguuuguuuauuuuccuuugaaguagggguaauacaauaucaugguguuauuuuaaggauuaaaucauacuacuaauaauggcuaauacuuuugaauucuuaauauauauguaagacauuauauuaaaugccuaauuuauauaaugcauauaauuaguauguauuaucuuaguucugaaaaauugugaaguguagguaaaauucacugaugaggaaacuaaaacagggauuuaaagacauuugcuauaagcaacauagcuuagaaguggcagcuucagacucugagccccuaugagccacugagacagugggugccauccuauuccuuguaaagcuuggaagcacuuagccuucugcaaagcaagugggacuuauuuauuuuuuugaggcaggaucuugcuuuguagcuggcauggaauucucuguagaccaaacuagccucaggcuaguguugauucuccuagcucugucucccaaaugcuagaauucgaggugagaacuauuucauucagucugcauaguuaauacuuaauguuuaaguuaucuuuuaaaaauagcguauaggagaaugagaaaccauaggcugggagaaacuguuugcagaaaacaugagcugaaaguuugaaaacucuaaaacucaauaauuagaaacuaaacaaaacaauaaacaugaacaguuaucucaccaaagagaauauacagagagcaaguaaguaccaagaagaugucccaccauaugucuguugugaauuauaauuugagacuuuuagaaaucacaugggcagcauugggauguggagcaguaucaucaguaguagggaugcaaaaugacacagccaccguggaauucaguguggcaguuuccuguuuccuucaaaacuaagcccgcuguauacuccagcagcuauguuguuugcuauuaacucaguaaauugaaaauguaucuguauuauccacaugauacuucauaauucccaaaguuggaaacugucagcauauauuauuaguuaggugaaaggguaaacaaacugugguacauauagacagugggagacuauucagcacuaagaagaaaugagcugucaaaccaugaaaagaccuacaggaacuuuaaauaccuagaguuaaaugaaagccaaucugagaagucugugauuccaacuaugugccauucuggaaaaggcaaaaccaaggaggaggugaaaagaugagugaggugacuagccagaauggcuacauuuuguuagacguuugguaguucucaguguguagcaccaagacugaacacuaaugugagcugugcacagaaaugauagugguguuaguguaggcucauuggcaaaugucccagccuggugcagacugagguggggugggguggauacaaaggaaccucagcugcuucuugguguugaugagaaucuaacguuuucuuuucuuucuuuuuuaaacauuaaaauguaaaucaagcauuuaaagugugacagacauuucugauaucuucguuuuuaggcccagaauaaagagaccaauguuuuagcugcugcaaaggugauugacaccaaaucugaagaagagcuugaagauuauaugguugagauugacauauuagcaucuugugaucacccaaacaucgucaagcuucuagaugccuucuauuacgagaacaaccuuuggguauguaauuuucauuccugaaaagagaaggcaaagugauuuaauguccuaaagagguuguggaagcucauuuuguguguuaccaccccuuguauuuaguuacuugauugaggguugaucugccagugagagucauuagcaaguuucaguggauguuuagcguuagauuucagauuaugacauuuuaucauaaguauuugacacugagucuaggugggagcgcuuggucaaggauauuaacauuucuaaaguauguuuguaauuucaauuuaaguauuuuaaauauuuuuggagaguuuuuuauacuuuuuaccauaaaguuuuaugaaucauacaauacuguaagcuaugaguaaugcuaaauauuaggcucaacuucaccucuugaugaaguaguuauuaauuacauacauuuugcucauuuuuaagaaaauagacacaaguagacuaagcaguaauaucuuaauauuuaauauaauaacaauuuacuuauaccaaccuacuuuuaucaacagccuuuuuaaaaacauuuuuaaaauauugauuuguguauguggguguauagucugcaugaauguuuguucaccaugugcaugccuaguuccugugguggucagaagaggacaucauuuuuccugggacuagaguuacagauaguagugaacuugcauggaggugcuagaaccaagccuggguucucuggaagagcagcuagugagugcucuuaacugucgugccgucauucuggccuaucaagaagguuuuuuauaaaacagaguuuuagaugcauuuuuuagaaucuggcuugaaaucaagagacuuuccucuuggaucuggcugcugcugguucggagcuuagcuggguuagcucacucuugagcuuguuuauuucucagaggauaaaguuagcuuucaaauuauuuuuccgaucauguaaugauuuuuaaaauacauuguuauugguacgcauuuguuaaaauuauuguaguagccuggugugguggugcacaccuuaaucccagcacucaggaggcagaggcaacuggauuucagugaguuggaggccagcuuggucuucacaguuaguuccaggacagccaaagcuauauagaaagauccugucucaaaagacaaaaacaaaagaaaaaauuuuaagugagagggaaaacauagggaauuauacaguuugcuaaaauauuauuuuaaagaguauaguuauuauuggugucaugucuucuaaaauacuuguucaggguucuaucagaauauuucuaaauauugcaaaauaaaaacuccuaagcaguuuaagaaauagacugggggcuggagagguggcucagugguuaagagcacuggcugcucuuuuagagguccugaguucaauucccagcaaccacaugguggcucacaaccaucuguaaugggaucugaugccaucuucuggugucucugaagagagugacaguguacuugccuauauaauauaaacaaaucuuuaaaaaaagaaagaaagaaauaggccuugauacuauugcaaaauaaaaauuuaguuuacugugagggacaauauaauaggcgccauuaauauaaauuaauauaaauaaauaaauaaauaaauaaauaaauaaaaauaaucauuauaggauuauaauuguggguaugugacagugauaauugaguuugaaucuguuugucuuuuuuuuuuuaaccuaaagaaaaggacuugggggauggcuucgugcuuaagagcauguucugcucuugcagaagacccaaguuugguucucagcaccuguccuggguaguuucuagcugcuuguaacugcuuccuggggacccaacacccuucucuggccuucaagagaauauauguucacauauucuggcauagguacauacacauaggauaauuaaaaauaauuuaaaauaagccugcuuuuuucagaauuuauuuauugaaugauagacaauauauuugguuacuuaacauuguaguaguuaauugaaagaugaagguaaugagauauuucaguaauaagaucuuuaaaauguauagauaauauuacagugauugcacaauguauacuugcuaauuuuaaaaaagaaaggauauuaaaaauuguuauuuauaaaaaaugggcauaacuggguguaguaaaacaugccuaccagcuuuuaaagguagauacaggggcauugcagauuugagucuagucuggacucagaucugagucuagcccagacuguagggaaaccugacucaaaaacagaaaagaagaaaaaaggaaaggugugugugugugggggggcauacuucuauaccauuuucuccuugugaauucugagaagagcgucucuuccgaccaguagcugacgacaaggaguccuucauguuuggcaugguacugcuucuauagccuagaugaaccaguggcuuuccauuuguguguucuugcuaagugccgaaagcuggugucaucaccaacacuuuuccuuugugugcagauccucauugaauucugugcagggggagcaguggaugcugugaugcuugguaaauaucucgguuuucuguuugauucuuaaauuguucucgaauuucaacuguguguacauaaauguaauuuuagaauucaguacaguaagaaaucaacuuaauuauauuuuagauaaauguaaucaugugauguugaaagucugugacgggaaaguaauuuuuguagauauuuagcucuuuuaaaauaaaugacuucaucuuugaaagaucacaguggagggaugcgcugagaaauacuuaauuauauaaacauuuauuuuacuuucuccuuauagaacuugagagaccauuaacugaaucccaaauccaaguagucugcaagcagacauuagaggcauugaauuacuuacaugacaauaaaaucauccaccgagaucuaaaagcuggcaauauucucuuuaccuuagauggagacauuaaauuagguaaguuauuucaacauuugaaucugcgcucugagauugacaguggaauggaugacuugcugcuguuuggccuacccagacauguaaaccagggagaaggacugccagcuguccuguaagcaaugcagugguuaagcauuugccaguccuuagcgucccuaagucuaugcaucuaaugacaccuagaaagaaaguaaaagagggcguguucuguucagaagcauggauuuguaaaacacuagucaagauuuccuccuguacguuuuuugaguauagauugaacacuuguaaaugcuuuauauuuggaacauaauauaaugcuagacuaaaauuaucuuuaugacaacauaccuaauauguuuuuguuccacuuguucuacccagagccuuauauuucuuuuuuuuuaaaaauaaaguggcuuuuuuauuucuuuuuaaaaaaaaugauuuauguauuuauuuuauguauaugaguacaccguugcucucuucagacacaccagaaaagggcguuagaccccauugcaaaugguugugaaucaccaugugguugcugggaauugaacucaggaccuccagcacccaagccuuguauuucuuaagcaauugcucuaucacuaacaccccaugccguucuuauuuuauuuuaugguauacacauuaaaccaacacauaaccuuagguuugaaaguaaaauaaguguaaggauuagcauuuaauuuugucuuucauaucaaaggaauaaauggugaaugucauuuauuaguuauagauuagauacagaauuagauguagauuuuuagucaggauagcuaaguucacacguggacaugcaaggagaagauagagccuuuuaagaaguuuuucuaaacuggacaauuucaagcagugcuguccaaauuuuuuuuuggaaaaaguaaaauuauucagaagccauguugauauugguuccagugauucuacccaucucauucuacauugucacagcgugcaguuggacaugggaggugcuaaauuuuauccuuguugugccauaaagagauacagaaauccacgaggaaagcuauguaagguuuuagacaggagccuuggugaagcuugagucaugacuuaggugcagacauuagaccgggccaguccccaccccaggucuuucaugugcucaucugaccucagcccccaccccacccuuuccacauuugugaugacucccaucaccacucauuuguuucuuuaugggcucaguuaucccuuuuuuauccccaagaguuugaauuugcucauauaaauuuugacuuucuuuugacaucucuguaaauuacauauuucuucucuauuccucucuuuacauaguagcaugcauucucaucgaguuagcauuguuccaacuaagagaguaauauuugauuguuugaaggacaaaaaaggaaacaaagaaagauuaucacagugguuugugacuucuccaaaguccacagcauguacacagauacacuguguacacguggguuuaaauucccagugacuggaugguuaggagcauguuucuuaaaagacuccuugaggaggcaggagugaaaucuaaacgcugggucuggccacuagauggaggcuccccuucagccgcguuugcugauccuguggugauuucaguuccugucuguuuccuucagguagugaguucguggauaaggcaaaggcuuuugaggggcuugaugcgucucgaguuugauagaacaaguuguuuugugcugcauuauaagcaggugucagguacauuucugcuaggacucuuuucucacuacuggguccugaguccaggucucacaugugccaggaaagcgccuaccaagacgggcaccccaagcuuauuuguccucaauacccagauuuuuuuucuuuaaaagaggcuucaaaaugaauuauaucauuuuucgucuauuauuuuugauaaauuuauaauuaguuaauucauucuucauuacuguaaguuaacaguuuuauaagaagagguucucuuuaguuguguacuugggacaaaagcagaaaaauguuuuauuuaguuuuaaagauaauuaguugguucugaguucuaagguuaaaagguaggcuggaccucugaugaaauuaccauggcacuguucuuuauaacuuaaaucagaaacaguaaagcuccccauguguucuuuguaauaucauuaaggguuuuuauuuuuuaucuuuguuuguuuauuuauuuauuuuuagauaaucuuacucuguagucuagaguaacucuaaacuccuggucuugcugccugagccucugacgcacugugaucacaggugugcaccgcuacgcucaucuuuuguagugugguuuuaugaugccuuugcugucagaaaggcugcuuugguauaauuucuguuuuuuucacacuacaggaaaguaucuucacugauuuaacuguugcaugcaacauuuggcauuuguuuugaaguacauaauuguuuuaauuuagagugacaguuuuuucaauucaauucugagaaauuuaucaucgcuguuauuuguuauuugaguguguguaggugguuuucaguauaucuaugaagggaaauuuagcaaucuuuuggaaagaugcgagaaagaagaugguuaggauuagaguggucaagauagcucaguggguaaagugucuguugugguauaugagguccugauguuggacccuaagaacccauggaaaagcugggcguggugauggaugcuuauagcccaugugcugggugcuggagacaggaggaauccuagugcucccuggccaggcuggguuugccaaaauggugagcuccaagcucauuaagaaggaaugguuucaaaaguaggaugaggaggacuaggggagaagacaccggacguugaccucuggccucugugagcauguauguacacacucuacaugcauaaacgagcacauaugugcucugcacaauacacaccaaaauuaaaaaaagaauuagacuggcagagaaguucuuuguuuuuaccuuucaguaagggaggccucacugaagacuugaccugcuccccuuuaccccauugaauacaguucaucauacuuaagcugucauuaacauuauuguaugauuauuuauuucaagcggauuuuggaguaucagcuaaaaauaccaggacaauucaaaggagggauucauuuauuggcacaccauauugguagguacucauuuuuaugaauuuauacuguuaguugugucugcaguaauuacuuuguccacacauagucauuauccugacuauaguuuaaugacuauuauuuaaacaucuuaacuuucauuuuccuuucuuuauaggauggcuccugaaguagucaugugugagacaucaaaggacagaccuuaugacuacaaagcugauguuuggucccuggguauuacuuuaauagaaauggcugagauagagccaccucaucaugaguuaaauccaaugcgcgugcugcugaaaauugcaaaaucugagcccccaacauuagcacagccaucaaaauggugagcuaauuuaaaagaaguuuuguuuuuuuaaagauuuguuuauuauauguaaguucacuuagcugucuucagacacaccagaagagggcaucagaucucauuacagauagcugugagccaccauguaguugcugggauuugaacucuggaccuucagaagagcagucaguacucuuaaccacugagccaucucuccagccuuuaaagaaaguuuuuaaagaaccaaaacaugauguucuguucuuuuaguuugcuaagggucuuuaaguuuggggauguggcgcaaagacugucagugaggaaacugaugugggucuguuucuaggacuugaggaccuggggagauugcucagccauuaaguagcacuggcuacucuugcagagggucuggguucagucccagcacucacuugguagccacagcuggcuauaauuccaggggauuugaugcccucuucuggccucuaaguacuagggcaugcacuugguauauggaaugcaggugcucacaucuauacacaaaguaaaauuaaaacaccugagaaagacuuacggcuuaggagaaccauuauaauaacugacaggguuccguguggaacauuuucuguucuguaaacaguggagcccauuuacagcugauauggauuuuggaacuuaguguaacaguuuuuguugcauuucgguaacuugugaagauacagcugcaucuuagugaacaucugugugcccugucgcauguaugccuaacauauuuacagacuauguuucauaaagucuuauuagucuucuuaccuuauucaauuaauacuaaucaauacuaaagauaaugaaacuaaacacaauuuauuaaggaauuuuguuugauuuuuuaaaaaauuaauaacaaggaaguaaaauaaaauacauuuuauucugcaggucuucaaauuuuaaggacuuucuaaggaaaugcuuggaaaagaauguggaugcgcgguggaccacgucucagcuguugcaggugaagugaggacagcgugauaaccaggcagauuguuuaacagugucuuugaacgaaugcacucucagaucuguucacucuuccccuuuccacuugcgugugucuguggaaagccauuaugucgcuguuuacauugcuuaggagcacguguugucauuagcaggcauuuaguguauaaauugucucuccuguguaauuauguucuuuuuuauuguaauagcuauuuguaugcugucucuaaugacugaaagcuaguaccuuauaugcagaggcuaugagcucaugaaucuuuuuacuuuuuccucuuauuucaagaguugaggguacaguuaguaguauugacuuuaaaaagggauguggggcugaggagauggcuuauuuaguaaugugcuugcugaccaaauguggagaccuguaauaguacagguccccagaauccauguuaaaaagccaggugugguaguaccugcuuuugaucccagugcugaggaagcagagauagag

SEQ ID NO: 9331 - RNA, 3904 nt, Mus musculus
ucccaagaaacagauguucauuuuaguacaugaggaaaaugaaaacaaauuggagaaaacuguagacauuuaaguuuaauuaguugcuagauuagcaaacagauauguuaagcagaugagcauagguccauaaacuuaggaagggcaggcuacauuuaugccacuugagauuuagacauucaacauacuacuuucuaauacugaauauaaacuuuuugccccccaaaucaaugaauuaacccugguuucuagaacuauccaaacuuccuuuuaaacacaauuuuaauuuuuuuauacuuaaauauuuucuuuagcaaacauauccaaaauacuaagcuucgucuuauaauuuugucagaauaucccaaacuguucaacauuccucccucuaagccacaacagcuuagaucuuuuuuuuccccuuuaaaacauuucucuuugcauugccauucucaaagacaaucuguaaaugggccaaguguauagcucaggaacagagcacauguuuugaggcccuagguaugaucacaucacccaaagaagagagggagaaaauagccuggaaaauguaucacaccccuguaaacucuucuucacuucgauuguagugcagcaaguugucaucuaucccguagaagucgaucagcucggugagcgucagcuucucguccucguccuccgacaugauagacugcagcucacacagcagccgcugaccacacuuccuccacuucuuuauuagauucucuaacucagucacgucguucugaaacagaaaaagucagucagucaucagauguggggcucaacucacaucaucaagguagcuaaauuaauuaacuaguuccugucuaacuuuaaaggccaguaacagguauaaagggcaguacaagcucuggacaaaccuuaaccuuagaaaaguguuauuaaauucacauguuagauguaagaacaagcugaggcucucaguacaccuuuuauauaacuauacuuuuuaagauacgacguuguguugugccuuucuaaugucuccauguaccgcaaacuucuuaaagguaaaaauauucaaguuuaaaguauuuucaacauuuuauucaguuacauuuagaaaaguccuaaaaauucaaaaucacauauaagacaugcuauucugucacuuacuccaguuuugggauaaaaugagguguuaccuggguaagaacuacaaagauaauaaaugucuccuucuagacauccauguucuauuuuacucaacguguguaagcugaaaccuaaaaucuguuuucccaaauaaaaugccugacauuuaugcaggaucguuacugaaaguacagcaccuugcauucugugguccacuuuuaguucuaacaccaucgugcucugucccccugcaucuucauggaacaccucucacuucucaucuugcuacuggcuagaaauuaaggccaaaacgcuccaccugugcauuaaacaaaacccuaagcuuuuaaguuuuaccucguguugaagggguuccucagccucacucugaaccaacuacuucuauuucagucaaagcucuuguaacccggguuucugguuaucuggcugauuguuuaucaaacuaaaauguaucuccaauuuagaaacuaccgcaguuuauguaaaaaugauguaacgguucuaagauucuucucaccuuuauucuauacaucuugacuaacuuuaaccuccgaagaaggucuuccuucucuucaaccugccuaaucaaucuuauuuuuucuuguuuuaauuuuucucuaaugaucgcauucucagacuccuuugggagggcauuagaugacccaguauccgacgacuuagauucacacguguuuuucuccucugagcucuuuucuccaggcucacugucuuuguuuuucaagcuuucuugggccuuugaacaauuuucuuccuuugaagauucuccugguucugaaagggucucauuauuuucgucauucucuaccuucauacgcuucaccacacuacaaaaugaaugagaugaagaucuugcuuucuuuaaccuuucuuuagguguuccacucagaggcugaaaaagacacaaacaucaaaaauguuaaggauacauucuuguaguaagucaaucuauuaaaaauaaaggcuauaugcuucuacgauagguacaauggauggcuuucuguuuccacaaaucucaugcgagcaucaccaaugucucuaauauccagaggcuaccuauagucuuacuuuagcaagguuaacuaaaauaggacugagacacuucgccugccacuggcagcuaguauuugccugauaauacuagaaaugcuucagaacuauaaacuaaggagaagaccugcuaccaaagacuucccccuaagaaauacuguacagauucaaguuuccuugguuuggagcaucgcaguaaccucauaagaaauuaaacaaaaugaaccgauucaagaagaaaaucuuggcaguuagaaagguaugagcuacauauuaauucacacuccaguagccuuaaaacuggcacuaucagaauacucuggaacagaacagaugggggugggggauagaggacaacacagauauccauacuuguuuuccugaacuauucgaauggggugaugguggauucucccugggcugaggagcggcaggugaagucgggggugaugguggauucucccugggcugaggagcggcaggugaagucgguggugaugguggauucucccugggcugaggagcggcaggugaagucgguggugaugguggauucucccuggucugaggaacggcaggugaagucgguggugaugguggauucucacuggucugaggagcggcaggugaagucgguggugaugguggauucucacugggcugaggagcaucaggugaagucgaugcugaaucugaugaguuuuccaucuuggaagugaacuccugauuuccuuaucaaaaagaaaagacgcgaaugauaaucaaauuaucucaaaacagaccucaauuuuucugaacaaaauuuucuucagugaacuaaacaccaaaaauagucagccauuucuuccaauuacauguagcuauaauuuauucuaauucuucucauauuuuccauuuaccucuccacauggggaaguaaccaaguccuguuucuuucacgacaaauaaaccagcuaguaucucacugucuuucuuuuuuucccuucaaaacacccccaaaaauuugcguuucaggaaggggaacuauaacuagucaagaacuuuaauuuuuguuauaauuucguaaauaaaagcaauacagccugaaucuugacucuuaaaagcuuugcgccuagaaccaagaacgagucccgaggugucagaaagcagcaucugccccuuuggguuuacuauggucaaagacuccgcccuccuccccagccccguccaucuucuccacaaagccccgcccacucucccucccccuuuccccucccuccucaccacagaaagcccuccccccguccccgcaccccacucagcucccccuuuccccaccccguccccccaccacagaaagcgcgcuccccccagcucccuucucuucagcaaccccguagcccuccuccuccacuccuccgccucccucgccacagaaagcccucuaucccacagagcaggaggccgagcucccgcgacgccggagagagcuucuccgucagauacccagacacccgcaggccugccgcucaggccaaccccagggagaaagcucaguaccuuccucagccaugcucacagcggcgacacaccguacacacagccagcggagcgcccgcagcccacugaccucgccccgggggcggagccucaccggagaagagacguacgauuggcuagcuuggccggagcaggc

SEQ ID NO: 9332 - RNA, 11423 nt, Mus musculus
aaaauuuacaaaguaauuuaauuuacaaauaaucgcauacaugcccauuaauuaauccuuuaugacuccauuucuuauacccaaugaaggaauucuuaaggaucugugaaccauuuaccagccuuagcauuguaguucuguguacaagucuaaggcuccgccccuuuguuaacacacuggagauuuuaaaaacacuuuauuuauuaaaguuaaacauacaaaacugaaauuaacacacacucuaaaaauuauuuucuuccaauuaacaggaagacccuuuuuucuaccuuuguuuuggcuuaaacucaacuuggauaacuguggugcuucacuuaugccaacaaaugcuggcaacuugaucucguuaauaaaaauuacaaacucagcuacaugaacauaauauacagggaaauuauggucagauuaaugcacaagaaauacaggaaaauuuaaucaugaaacacugaguacucuuguucauuaauuuagccuuguauuuuuacaaaaauaguaucuacacuguacacagggcuguacaucagcuuuugucuucccauagaaacaguacacaucccaaaaaugguaccacuacaagugaagucaacaaaggaaaaaacaauacaaaacaccaaauaaacaccagagaaggggcgcacauccuaaacaugguuuguuugguuuuuuaauauaaauuucaaacucaaugacaaaaaauacaaagugagucaauaggcccaggaaauaaguaauucaaggaaaaaaaaacccucaaaauaaacuuugccguuuauaaauuaaccuauacuugggcuugucuggacaauggccagguuguaaaacugaagcucucuuuagcaggcuggcguuuugccuccauguuccaaugaacuguuggaauaugucaagugcaaagcaucugaaaauuccaaauuaggacuuagaaacggucuacacaacaucaguucaaugggccugacguucagaagucaucuaagugcugauuuaagcagcacuuaccuagaaaaguugccuuguucaacacacugaggaagcugugguaaguaguaaugaaguuaaaugagagcaguuaucaaaugucuucaaguuucauucuaccaaagccaaacaaugacaacaauguaucuuccuuacucagcaucuaagcaaucaguuaccuuuagaaaaauacaaggauaaaaaggagaguguaaaguaaagcccugcagagaugaaaugcagcaguuuuucagguuacugaggcaucaaaugccugacauuguacuuggauguaucuugauacugugucaugggcuugucagcaauuccacaaguuccuacuccaacuuugcccguuacacuuucuggagaagcaaaaauacuccucuuuaccuaggaacaaaaaaacauuucugaugaguuuccaaaaaucaaucucuaguauauaaucuaacaaacuuuaaaguuaacauaauucacguuucaaugcuuacaaaacuauuuugcagaaaauaucacuacauguuacuaauagaaagcuuacuugucauacagaacucuggcuguaagggaguuuauggugagaccugcugugguacacacagugauacaagcacuagucuucagcaacuguguccagugagguggacccugacgucaaugaaaagcuaaacuaugggugagcaucaggucacuguauuugaacaucugaauucuacaguuauuuucuacccaacaaugcauagcaaggacuccaaagcuuuuuaaaauagauacucagaauaaaaguauguuaaaaaaaaaaaagcagagcccaguauauuuucugaggucugaaggcaaacagucguacaauuccuuacagaaaccuguuucauugcaaaaaguaccuaaugacuauugacagggacuauauaucaagaauugcuuaaaauaauguccuuugauaaaucuacaccgccuuuuuucauuuuaaaaugauuuuaauggcagcugcauucagagcaacaaagugaggagggaugcgccaaccuggccuuucuuguucuuggaguacgcccuguuguugaacugcugccauuucaccuucugguccucucgcuccugcuccaacucuuuuauucucugugcuuuuuucaaagcuuuuuucuuuuuauauucacgcugcugggcgaucauuucuuuucugcguagaaaacauagaugugaagucaauuauuaagauuuacaagaugacuuccuuauaaacaaaaaacaaaacuuacagacuaacuuauuaacaagagcacaauugucauuaaaaaucaaugccaaaauaaaugugugguauacagcaugcugguaaccacagguggaaacgaggaggaucagaacuucaacuuccuccuugccaagcuggaggccggucuaggacacaccagaccccaucuuaaaggaagaagaacggacugaggagagauggcucagcacggaaaggcaucugccaccaagcccaugagcuaaccugaguuuaaccaugggacccacaagguggcaggagaaucaacuccuuaguuguccuacuguccacaugaaucuacacacuaaguaaauguaaaauaagccaugccacucacugaggacgauuaacacguauuuagaaaaaggcaguauaguucggggguagacuccacuuguaagcauaccaagaccauggacucuacccagaaaugacaacaaaaacuucugugcacgcacacacuaagcucuacugcaaaguaaaucaaaucuuucuaaaaauuuaaauauaacuuuugcugguuguauguuagggauauuaauauucaauacaugugaugguacacaccuauaauccuaugacuugggagauggaggaauguuuauuaggaaauuaaguuaugcuucugcuacauacagaaggccagccuaggcuacaugaaacccagucuuuaaaaaaaaaaaaaaucacccuuaauggcuggcaaaacuuuuaccaauuucuaaaaauacaguuagcaauguaauauaugccacacuuggagaaauuguaugaagugauuuaaugcauauaaaauuguuucaucgauauuggaagacagaaaccaagaccagaagaaugagugguaugaccaauauucucaagaccaacagcagaaaccuggaucgucaaaaauaggauccuaaguacaagcaaggcuuaagcuaccaauagucucugcuuacuaacagcaacugacaagauggaaggguuuuaagagaacaaaucuugauuccccugcaccaaauaaccaaccugcagccuaagugugcagguuuuuuguuuuguuuuuaauacagaaagcaagagcgaaacaagaaacuagacuaaauaagguuuuacaacgugauguucuuaaaaucaguuaaaauguuucuuuaacaagugauauauuucaaguauauuuacauaccaacuuuacauuuuggaaaaauuaccaaaaucagaaacacauuuaucagucagccuugaaacacagacacagacacacacacacacagacagacacagacagauacacacacacacgaagcacguagacucagaacuuugucuccuguuaucuguccuuaggacuuguggguccuaaguuuuuaccaaaaaaugucacuucuaaaaucagaagugccucccaugcucuuuagaggagacaguuauuaaacagucugugaacugcuacacacuucacagacgaggcggauguuaaguuuguucaacaucaaccuagagaagggucaggcaaaaaucuauuuccagccagcaucccagugcucucacuguuggcuuugcuaacucugguuuccaucauuaguuuagaugucauucuccaaaggacacucuccugggaauuauggucccucuuuugugguaacaagaauuuauacuuguuaggcaaagcuccacaccuaagcuacauccuuagcccuaaaacucuuccucaagucuguguucuuuucugguuauagauucagcaggaacaagucucaagauagucuucacuguaguuuagucuuaggaccugacuuacaaaaacacaguagauguucuuaauacuagcauccuccuuauggaacacguuaacagucuccacuuuaccuaggcauacacacugacuguucaaaacaaugucaaacaguauuauguaacugcucaacgcagacuacuucaaguacccaauggguaaagucaguuacguuagcagcuacagugagccucgcuuaucacuuuaguacuccaaagaacaagguaagaaugggaagucagcuggccuacgccauccagcgucugcgcgucugggaagcgucacucacuuugacauggguuuguugccgcuguccucuuucgccuuccuuccuucuucuacaggcuugagguucagcaauggcgucacuucggcauugccauaaacagcaaaggugauugcagcggugccauuuucuucaucuaucucuucaaucuccgcuucguaacaccuguaaagauaucauggcuguaagcaggugaguaaagauuuaguacucagccuacaagacuuauacugcauugacacaauuagcauggcucuaaaauaaacuucucaaucaaugauggcccuuuuggcaaaaauaacacgagugauuuaaaguuaggcaccugguaucaaaagcccuaauuuaaauuuuaccagaaaaaucucuuacacaucugcucacuguacuaaaucuuggagaaaagcuaauuccuaaauaauucaucucaauguaugcucuugagugcaaugacagugucagcaauucacuuuuuuuuuuuuuuuuuuuuuugguuuuuugagacaggguuucucuguguagcccuggcugugcuggaacucacucuguagaccaggcuggccuugaacucagaaauccgccugcugcugccuccccagugcugggauuaaaggugugcgccaccacacccagcuugccauucacuuuuuaauuugagaaaacaauucacaucauuugaaaacagucauucaucuuucuuuccuuucaaccacucuucuccccaaacuuaaacuaacccuaaaauuaagcuguguuaauggcaaccacccaagaauuagccucguuucauaaaccaccucaccuacacagaucacgauaggaguaguacaagcugagcaguagcaucuuaccauuguaucuuauuaacucaguacaguuagaggguggcucuacacuuacuguccgucuucacuccacacggccaugcacuuguccccuacuuuccaugaaugagugggcugaguagaagcaaaacugucugagcuugcgagcgucuccgaaggcugaguugacagaaggucuuuggucaguucuauuacuuccuaaaaaagaaaacagaagccguaacauuuguaauuuaauacugucaacuacuuucuuuugguuuuuaaugauaguucuuguaucacaaagcaguuaugcauguuacaaguacaguucuuagcgauauugagaacacuguuucucuauagagacuaaggaacaucauaacuaauagagugauugaaaccugcacaggcaucuccaaguuaacuguaaauacuauuggaaauaaaaguagacaugucucagccacaucugacuuguaaaugccuuuugugacugaauagauuucucuacagaugagaaauuaaaacugaauuugaugcaaggccacuuuuacaacuaccauuuguuauuucaugcaacuacaguuuuauagggcauuacuuagcagaaauauucaacuguguagccaauauaccucuucuacaaagacccaaacagugucaucaacacacaaaauuccuacuuauauacauuucugccaaaauacuggaaaguauaaauaaacugguaauuuuucaucccauuuaagugagaaccaucaaguuagauuuaaaauagcuuacaccuacuuaucaggcacaguagcacagcuucaucuuaaagaaaaaauaacucacacaggcagagugccucuguguguggcaguuguuucuaauucaggcuucuguguauuaguuugauucagucauuaggaacaguuuagaacuugacaaauaauguaaacaguuauuuaacuacuuaucugcuauuuucuuacucuaaugaagauguacauuguccauuaucuaauuuucaaagaacuugccuacugguuucccacaauguugcauuuaaaacaucuuauucuaugcuuggggacaaauauagcaaaauuaaauucuuaguuucuucuggcacacacugggguuuucuaaugguuguuuugguucaguagccaagaaaaguuaaauauuaccucuccuaaagauucuaaaucuuccuggcuacuuuugaaaaacuaguauuuguaccuuaaaaauaaauaaauaaauaaauaaauaaauaccugaagaagggucagcuuugugaaucaaacagaaaacaaacuagacuugaguugaaaauuuaauuuaaaaaaaaucucuaaguuuagccaaguagacaccauuucccccuuuucuaagucauaggagcuaugcauagcuuucuaucaucaguucugcaacacugaagacugaaccggggucugugcaaaccagcaaugcccgauacugucacaccuacagcccucaaauaucaaauuagacaauucuauguaaauaaagcaggagaguuuccuacaauauaauauuuuaaccaauuuuguucuguuaacuaccuucagagcaaggaauacaagcugaugggccucgaucaggagcccagucuuuuucacuaaauaucugcaucuccucccagggaccacauauuuaacacaaauaugcagucugauuuaccuuuuccuauaugacagaauauuuccccaccacauucauaacaaaacacauucaaagaaaagaguccugaaaagcugugcauaauuuuucaaagcccugugccaggguggcccuucuuguaaacaacaagauccagagaauuuucuccugauguccuauaacuaacugucaucuuacaugucccucccaguaauuuaugaagaaccuucuuaauuuuuaucuucacauguguauauggagcaaaguauuuagaagaacuacuuuacguaugaggggguucuugaagguacauaccauuaauuacuuuuccucccccaaguucugaaacugcuccuucauugacagaugggcagcaguuacaguaaucggcaauuccaggaagcaucagauguugugaucuacauaucagcaggucaaagggggugcacucaagcacucugcuuacugaaggaaggcguuucggggaugcagagagccacuguaauauaugagacaagugacuugaccccugccuccuuuagaaccaguuuauucagcaauacagcccaauaaauugacuauuuuugugauuacuauagacugcccagggaacuaaugagcuagguagccugauuuuacuauaccuacuuuccuuccuaagucaaaaagaaaaaggaaaaaaaaaaaacaagcaguuaggacuuuaaaagauuaauuuguugccuaauuuauuauucuguaugaaagacagaaacauugaaaccuuacugggaaaauaaacauaagguauagaagccauuaugaugauacccccuuuaaaaaaaaugcagaauccacaagcugaauaaucaaucuaaucagacaggauuuaaauacuaguggcauuuuuauauauguacaccuccaucuccccuacaggggcgagcaggugggugggaggugagacccacacugauacagaagucacuguucuaaaugcaaacaccuagggucaggagcacacauucaacaccuucuguaguuuuaccucaucauaagaagugauuuccaucucccaauaguuuuaaguucaagccauaccuuguaaucaaaaccaaacuucucauaaaagaguaagaguaaaccauaaggaagacuggccaauuaaaguacucuauccugccacuacuuaaggugcugugaguacugaagccuguaucugcacuguccaauauguaaucaacucuaguuacuuaaaacaaaaaacuuaaacaucagcugcucagguacccugacacugguaauuuuaauuaccuagugucugcuuacuguggcuagcgccuguggcgugaagagcaaacccagaugguguucaccguggcagaagcaagcucuaccacacacugcuguucuaacuggcuauacaagagacuuuguaaacaaugacuucaaagucauuacuggucugcuuuuuuuauugaaaccaggucucaguguccccuuggcuggccuggaagucuaaguagcccagguuggccucaaacacauagagauuugccuacuaccuccaccugauuugcguuuuuguguuuuguugacuuuauuuuucagugcugggaauugaauuauagggccuuguguaugcuaaguaguuuuaccuccggccuccagaucauuauuaacugaggcccagguaagccuuuuagguaaaaacugucuaccauaaggguuucucccuaucauacuuucaauuauagauuacauaucaagauagcuaacuccauacuccacagauaauuuacgcuggaaauguuuagaaagaccugauaguaauauuguuugaaacuaggcucccaacucccccucuaccauuucuacagagaccucucaucccacucccaggaagcacagacagcuuuuuuuucuucuucaaagaaaacaaacuugaagucggcagagguagaugagguuaguguguuucugucacuucaccuucauguccacucaugguccaggugaacaaaucaaaugagcaggcaggaaacaaacacuggguuauugcuuaugguuuacagaagaucugggugugggagaaaguuuccuaacccucucuaaugaauggcacaugcacuccauaggcugaagaacaguauuagucaaaguaaaauuauccuucauuauuuuguuuuuaacauauacuuuauuguaagucuagaacccaaguuugaaaauguccaacucauuuuaaauuacagguaagaucuuucagaaucccaaaagcauuaagcccaaaaauaaaaguuggaaaugcuuguguuuguguguccguguccuuuuugaaacaaggucuuacucuauagcccuggauggccuggcacucaagagcucugccuagcucugcguccugagggcugggauuagaggcgugcauauacagcaggcaacaucuaauguauuaauggucaucaggaagauaaagagaaugacuguuuagaugggauauagaauaagcaagaaaucaucaaaacacccugaaaacugcugaaguauggguucagaacuugaaggacauucuuaggaacaaaguuuccauguaagauauuuacaaguuauccaugguacuuuucuuaaccugguguucugagaagcaacagguauguaaauuuguccugaaaccccaguucauguccuuagauguuuuguucuuccuaaacuuggcaugaaaaagcuaaucucuuuugcacuauuucaacuucacucaacaacuacaaagcccagccuuaaagucaaauaccuauaacauccauacagaauguuauucccuaacacauucucacgaugugguuuuaauaaaaguauagaccccauuagcuuugaaaaauaaggcugaauuuaaucuucagauaauuuugugucauaagaaggaucuuagucagauuguauauuccucccuuaauaguguuaccuuuugaacuaaguuuccuugucaagucuuuuaaaacaaaagcuuauuccguugcaacgccucuucucaugaaauccuguaaguacacacaggauuuacaaaaccgaguguuuuguuccuucugauguacaccaagaggagcuaaugugagaagccucaguaccuguguacaaacaagcauauacacgugggagcgccuuccucagaugcuuugcgugccuacgagucuugaaugcauacuuugaaaaagacaaauccucuucucaaacaaccucaacuccaaguguccaccuguacuuacuugcaaauccuucuucaguuucaauagaucuucauuuucuccauuuccagaaagggcagcuucuacuugcuggaguugagcuuuguagcuagccaacuguuuugcuagauccucugacaucugaggaaaauaaaggcccauaaggcaagucaaauaucaaauuacaaaaaaacaacaacaaaaaaaaaacuuccucugaccugucuaauuuaaaucacucuugcuacaaaauucaaguuccguucaucaccauuuuaacuuuauucauauuuaacuaauccacaaacuucaaggcaauuaaauucuaaagacugcagauacggcuggucaauucuacacagaaagaguucccccggaaaaaucaugcuauuaaaaaagaaaaaaaaaaaaaaacccugcuucuucuuuaaguaucauauaucauaggaagacaguguaugucaauaaagacugcgacauacuuuucaaaagcugagaaagucaaaaaucaagagaaauuaaaauucgcacggacggguucuuccccccagucagaggaagcgguuuucgguuaacuacaccuucggcguuuccucgccuuucucuccgguggagggaaccgcucggagcgcucacucuuccuucacacggaggucauccuagaaacccgccucucgcccaacgcagcucggcgucgccagggguccagaagccccucugggcggccgcggggcaaacauacggguccucgggggacaccuccgggacauuccggcccaccggaagccuggaaccccggccgagucuucccguccgcgcgcgggcuuccccgagcccgcuggagccccgguccaccaucucccaccagggaacgcagaccuccgcguccauggaaaccgccgagccccgcacccucacagaggcuucccccagacggccacguucgccgccucgucccggaagcccccacgcaggccggggccguccacuggggggugcgagagccgcugccuccccacacugcccuggccgggcccagcucugacgccggcgcccucgcuuccggccuccgccuccaccuccacuccagcccgaggcccgaggaggccugacucucccucaggggcucguuaccuuggguggggcuggggucgggacggcgggcaggggucggggaggcgaggcgaggcgagcggcgucaggggcggcugcagccgggaaagauuuuccgccgcgacgagccucggucggaaaaggagaaaguccgccagcgagggggaggggagagaagccggccucgggcaggaggagagagagacaaggcgagcgagaucucgcgagaccuacggacucu

SEQ ID NO: 9333 - RNA, 3106 nt, Mus musculus
uugugguugcacgguacccagcaacuacccccauucuguuucugucaccuggagccuaccaaugcuuucuccaucucugcugcugcuguuauugucuucacagcaacccggggcagauacuggggagacucaaaggagaaucgccauuuugaaaacgaacaaacugcuccagagaagcaguguggcucacugcgcuaucccccaggucagaucagcuccuagcucagcuuccaaugaaucuauccagcucucuguccccaaagccuuccuaaagccacaucugcuuccuuguuccacuguuggguuuucuuggucuuuuuccaacgcccacugaacaaaggagucacagcaaaccuguccuguguccccaaacccacccuacacuguaagcacaucagaucaccugcuucucuacuccacauuuuuccugccucagugacuucccucgagccguguccaccgcuuagugugccuguucuuucucagcguguccaaaucuaacgcaagccgccaagcccagcucacaugcugccacagccucuuaaagccucugcuuuuaucuucccuggugcuucuaagccauucuaccccaaucuaguuuuuaguuuccucaggggucugggaguaccuucagaaacccagaccgauuggaaugucgaguaguucacuuuuuccuacaaccuuggggaacaacuuggacugucccacugucccugcuauaaagcugggauaucaccugcuuuucugggcugggugaggauuaagcaaaaacacccagcccuauaaugccucaaguacagacugggagacuaaugagguaaugauugugagaggcaccaagucggaccagguguggcuggaucugcugaguccaggaaacucaauguuucucauuuaucuccucuccaaaugccugacucccaccuagggaaauuaggugugugugugugugugugugugugugugggugcaugugcgcgugcgugugcgugugugugcgcgcguguguccuugccuaucuggaacuuaugaucugacucuuucuucugaguuugggauuacggguagguaccacccaugcccaguuugcuguugugcuuaaaggcugcuaagcuuuggagucauaggcaaccuguugcaccagcagccugcugggccccacccugaaccuucugaaucagauuuccgucggugagugaggccaaggaagcugcauuuaaaaaugagauagauugacuguauuuguggguaugaguacuuugucugcaagcauuuaugugcaccaugugcaugccuggugucuuaggaagucagaggaggccguuggagcuccuagaacuggacuuacaggugguugugagccuccgugugggugcuaauaguugacacggguccuuugcuaaaacaaguguuguaaucgcuggaccggcccaggaaucuucauuuuggacaaaccucgaaggagagagcuucagcaacagcucuagccacgcugggccauagggaacacagagaacaacugagauaagaacaggagggcaacacuauccccuuuguccaagagugguggaggugaacuuggagagugacaaugucaacaaaaaauuccccucuguucucucucagcuccucuuugagccuuggccucagagugcaucuagggccaaucaguagccagacaggguuaccggauucacuccuggcucuccagucauucauacucagcaaauauuuguugaagcaacucaacucccaaggggccaguucugaacagaagaagacucaauacccagccuacugcccuagauuccagcaccuguuuuucccucugggccaggguguggccacacagaaccaauaagcuugcucgaguauucacggugaggagguggacagaagaauguauagaaaggcacauugguucucagccuagggagucauguuguggagagaaagcuggguaggagugacaauaugagggacccuucuuuaucuacggcacaagcagacaccggccaucaaggauccguccaacugagaccagacgguggucuguuucugagcucugccccggucucucaaccccagccucaaauaguauaucucagguuugaaaaggguccaugcuugggccacgccccuccaaacaauggaguucagauuuuugggugauagcuaaacaucagagcccccccccccgaaacagcacaagagcuccuaguucauggccucgguuggaaaauugcuggugagcugcauucuuuuucuucuccuuuugccucugauugcuuggagccuaaagaucccagauauuuaaucauagcaaucacagcuaagaguuaggaaggaccuauacaucugccaaugaaugccccuggcuucaccaaaaagccauuggcugccgggaagauggacugggaaacaggaauuauaaugcacagcacaggaaggccugggaauagccccaccucagguccugggcguccgcaggaaagaguagauagaaguuucuggagacaccucggagucugaauggagggugggggaaaagaccggacagugggcuugagccuggggagacaugggaaggagcggggagggaguggaggggaggggggugaacucuagauagaagaaacuaagcaguuccaagcacagaggaagacaagcaggcacagaggcccaucccuaaccaagaagcuauuugcagcgacaucugccaggagaaggaagauccauucucuccaaaggacugucaguggguaugucaaccucgauccagggcaggccccaugcccagggguagcuggccagcacaaguguggacuccguauuuuuugugcacauuuuguuuugauuugcuauuuuuuuuuggcguuuuuuuggcuuuguuugcuucuaauuuguuuuccuuguggguuauuuguuguugucgucguuguuguucuuuucuuuuugagggaaagagagggagagaaaaugaaguugaauggguagcgaggugggaaggaucuaggaagaguugggggaagggaaagaguaugauuaaaaauauacuuuuugaagacaaauaaauaaauaaauaaacacauaaaaacagaugaga

SEQ ID NO: 9334 - RNA, 2366 nt, Mus musculus
ggaagggaaaaggacuccaaccugggaaugugaacgcuccaauccaggcucuaccacuaucuauguguccaagaauguccucuaacugcugucagccucacucuucucgugugcaaaacacauuguugacccguucuuucuacaaacauggcaacauccauagacacaguuguggaucaaacauggagagaggaccccugcugucuccuugcccuggcggcagccucuuacugauguguaacaguuuccucugagauuaaaacauuccauccucuaggggugcuccucaggcaaggagguaaacaauuaaaaaacagcuucaggaacucccugaaacugaccagauugaguaggcuccucccucccagaguaaacaaaguggcaagucccuuuuagaagaagcaaagccuagcagcacagaagacucacaguggaaaagagacugagaccagaccugcugccugagagaagcagaaaccagccugcuugccuggaagaaauuuaaagcgacuaaggcaccuggaagggacauucuccuagcuguuuuuacaguguaacgugcuccagguuuucuggcuuuucugagcugucacccacccugggguggacuuuggugaugcagcugucuuugagucauuucugcuccuuuaaguaaccccaauaaaacuuauugguucaucaaguuggacucuggugguaccaguacuuuggucuaucauggguucccuacuuggggugaugagacaaauguguuuccucuccucagaaaaaguuuugucacacgacacuugcauuugagcaaaucuaggcauuuccccguguugcauuaugcguuugggcacuguugugauguuuacaggggagagguaaaugucauacgcucuuugcccuaagaccccuccacacucaaagauggaacagcguucauauuucuuauaaauaggucacuacaaggaugaacugcacauggaugcugggcuauggguccggcuuucugcuaggacugcaacuguaugggaacacuuccuggcugcauguugucugaaacugacuuaaccucuccuggauaggaaugauagcuaguggcuccccucaccccguuguuggaaggugacagauggcugugugaucugaacucagccuucauggagagcccauaggcuuccugacagcguugguugugucugcuuucacuccuucccucuguccaucaccccagaaauacuuuuauuuuuuaaaaaaagaacaagaacaaauuguucuguuguuguuuuuuuuuuaaaagacuuuuuaaaaaauuauuuauaugaguacacugcagccgucuucagacacacaccagagagggcaucagaucccauuacagaugguugugagccaccauguaguugcugggaauugaacucaggaccucuggaagagcugucagugcucugaaacacugagccaucucuccagccccagaaacaguuuuuuguuuguuuuuuuugggcuuuugguuuugguuuuuuguuuuuguuuuuuguuuuuuguuuuuuguuuuuuguuuuuuugagacagaauuucucaguguagcccuggcaacucuggaauucacucuguagaccagguuauccuugaacucaaaauuugcuuaaaagcauaugcuaccacugccugacuccagaaacaguacuuuuaacuggaauguggucccugccaggagaauuggcagcaaacucgugaaguuuagcugaggaugguaguuuagccuggucauaauaguucaugccuauaauggucauaaugguucaugccuauaauuuuaacacuagggagccugaggcaggaggauugugaguucaaagugagacagggcuacccagggaaaccuuuauuuaaaaugggggauggcaguagcuuaaaaugaagagcgugaaaaggaauuucaggagcuggggaaauaacagaacuuggauuuggggugcuuucuacaucauugaaaacaauaacucuuggaaacuucagucaggggcaggagagaugggcaggugcacacuuguucacgaagaagaccuggguucuauuccaagcauccacauggugguuuacagccauccauaacuccaguuccagggcauucgaaguucucuucugacaguauguaugacagcacacucacauacacgccagcaaaacauucaugaauaauaauaacaauaacaacaacagcaauaauaauaauaaaugccagcuugaugguggugucacauggcuuuaauccuagcauuuugagucagagguagacagaucucugugaguucgagcccaggucuacagagcaaguuccaggacagccaaggcuacauagagaaacccugucuaga

SEQ ID NO: 9335 - RNA, 2593 nt, Mus musculus
cucuguccuuuuucugauuaguggauggcuucaugcgguuguccaggcuggccuugggacacauggaaguccucuugccucucucugcuaacugcuggaaucacaggugugaccgugccuggcaucuggcgucacucuugccugugggauggagggaaacuucauuaucaaagcuuugcaaccacagacagauccucgauugagaucgacucuuauuuugcccauaccccauugagugaguccuuccuugacacuagaggaaaauuugguugucucuuguucaucauucccaggacuccuguggugcuaucuaaguucuuggcagagccucucaagguguuaggacuugaacgaaucccagagaacccuugaaguagauuaugacuucuuuuauaguuugccaagagcacagcuggauuaguuaggugcuuuucacagacugggcagccaauaaauagcugcagauugauuugcucugcaagaguucuugguaccugguuacuuuccuauuucuagugcauuucuuucauguuuauccuuuuagaacauuuagcuguaacagcacagguuuccuggauccaguguggcuggaaggaaugucggugauagugucugucaucaucuauagucccaaagugguuucuugcaacacauuccaggauaucuugaagaaaaagaguucuguguuuaaauaaauagagagacauugaguuucauaggcuggccaccaaaguugccaaagaguuaggaguaaaggaaaauguaacuugguugaaagguguucuuuccaagacguggccaugaaacaguuucuccccuacauuuuuuuuucaggaugccuauuaaaguacuacaaaaauucauguacuucugaauuuuacugguaaagaaacaagucuugaggagagagugggguuguuauagagagagacuaagcagcugggacaagaacaucauuccuauuuuguccaaacuggucaaccacauacuaagguguguuugggaauuucagguaucagggugaggguggagaugguuagcagaagggauuugaauguuuuauucucuacuaggccuuuuucccccccagggagcaauuagacaauauuuucccagggggcagauuuccuaaacagacucuuuuaaagguccaagauucccuuuuaaaaaugggaguuguuuauucuuaucuccugauuuugggauaguugccuuauaaagccuggauguaguagcaugugccaagugacgcuuuagaugcuggccaugugaggaagucccgagcaagagccggugaugacuacugacuuuugggauucucugugagcucgcacaaggcguacuuauuacauggguauaauauaucuacaaagcaccucucaagcucaccauacuaagggugagugagacacggggcuugugggacaagccaggacugggacucagaugaaacaaugccgggcagaauguccucagucccugcagacuggcuggugcuccgcggaaucagguuucagaaaauggaucauacuggcaugagacuugauaaagacugagggaggcugagagacuuggauaagauguaccaggcagagaggccaucuaggagagacauuucgagaugauaugauaaaagaccuggcaagacacaagggaggaugcggagcagugagcuguccaaguggguucaggaggacggguauccagggguuagggugugcagacauagccuugaagccuauaagucgcacugugggcucuagggugucugcugagaagcaggcacuccagggaggcaguggggagcuugugaaggugugugugugugugugugugugugugugugugugugugugaagaacauuagauaacaccaggcaguaagagccgggguagaaaggcccacguuaggggauggugguugcuaucgagcaguucaguucugaaaagaccaagggaaacauucugguauugccauucagacuaaagguaaacauggccagagaaagcaggucagucacuuuccaggugcacaggaagaacauacggugcugcacauuaucucaggcgauaacauccgagacaaaaugaaggcuagagauggcagccagaaggaaacgucacagaagacagcuagagagggcugauucaauacacaaaccauagccaugguugagaaacccagcuuuggaaagaaugcaagcaccauaguggccuggcugguuagcaaagggacuucaguuuuuguaucucuuuaucugggaaaagggagcgauuuuuaucucaaagggguuaggcuuuuccugcgagaaacuuccugagcacguggacacacggcaggagccacgcgagagcaaggaccagcgggcagaaguuaaguagugguugcagauucucccagacgcccagaaauaguggggaccucaggaaauccacaaccgcccuagaauugggcugagacgcccuguagagaggacuggccggucugguccacgagccgcgccccagcccccagcccccagcccggcacagcccuccgcccgcuuucacaacccggcccucugcacuuaacccccacucuggcugguggccg

SEQ ID NO: 9336 - RNA, 2593 nt, Mus musculus
cggccaccagccagaguggggguuaagugcagagggccggguugugaaagcgggcggagggcugugccgggcugggggcugggggcuggggcgcggcucguggaccagaccggccaguccucucuacagggcgucucagcccaauucuagggcgguuguggauuuccugagguccccacuauuucugggcgucugggagaaucugcaaccacuacuuaacuucugcccgcugguccuugcucucgcguggcuccugccguguguccacgugcucaggaaguuucucgcaggaaaagccuaaccccuuugagauaaaaaucgcucccuuuucccagauaaagagauacaaaaacugaagucccuuugcuaaccagccaggccacuauggugcuugcauucuuuccaaagcuggguuucucaaccauggcuaugguuuguguauugaaucagcccucucuagcugucuucugugacguuuccuucuggcugccaucucuagccuucauuuugucucggauguuaucgccugagauaaugugcagcaccguauguucuuccugugcaccuggaaagugacugaccugcuuucucuggccauguuuaccuuuagucugaauggcaauaccagaauguuucccuuggucuuuucagaacugaacugcucgauagcaaccaccauccccuaacgugggccuuucuaccccggcucuuacugccugguguuaucuaauguucuucacacacacacacacacacacacacacacacacacacacaccuucacaagcuccccacugccucccuggagugccugcuucucagcagacacccuagagcccacagugcgacuuauaggcuucaaggcuaugucugcacacccuaaccccuggauacccguccuccugaacccacuuggacagcucacugcuccgcauccucccuugugucuugccaggucuuuuaucauaucaucucgaaaugucucuccuagauggccucucugccugguacaucuuauccaagucucucagccucccucagucuuuaucaagucucaugccaguaugauccauuuucugaaaccugauuccgcggagcaccagccagucugcagggacugaggacauucugcccggcauuguuucaucugagucccaguccuggcuugucccacaagccccgugucucacucacccuuaguauggugagcuugagaggugcuuuguagauauauuauacccauguaauaaguacgccuugugcgagcucacagagaaucccaaaagucaguagucaucaccggcucuugcucgggacuuccucacauggccagcaucuaaagcgucacuuggcacaugcuacuacauccaggcuuuauaaggcaacuaucccaaaaucaggagauaagaauaaacaacucccauuuuuaaaagggaaucuuggaccuuuaaaagagucuguuuaggaaaucugcccccugggaaaauauugucuaauugcucccugggggggaaaaaggccuaguagagaauaaaacauucaaaucccuucugcuaaccaucuccacccucacccugauaccugaaauucccaaacacaccuuaguaugugguugaccaguuuggacaaaauaggaaugauguucuugucccagcugcuuagucucucucuauaacaaccccacucucuccucaagacuuguuucuuuaccaguaaaauucagaaguacaugaauuuuuguaguacuuuaauaggcauccugaaaaaaaaauguaggggagaaacuguuucauggccacgucuuggaaagaacaccuuucaaccaaguuacauuuuccuuuacuccuaacucuuuggcaacuuugguggccagccuaugaaacucaaugucucucuauuuauuuaaacacagaacucuuuuucuucaagauauccuggaauguguugcaagaaaccacuuugggacuauagaugaugacagacacuaucaccgacauuccuuccagccacacuggauccaggaaaccugugcuguuacagcuaaauguucuaaaaggauaaacaugaaagaaaugcacuagaaauaggaaaguaaccagguaccaagaacucuugcagagcaaaucaaucugcagcuauuuauuggcugcccagucugugaaaagcaccuaacuaauccagcugugcucuuggcaaacuauaaaagaagucauaaucuacuucaaggguucucugggauucguucaaguccuaacaccuugagaggcucugccaagaacuuagauagcaccacaggaguccugggaaugaugaacaagagacaaccaaauuuuccucuagugucaaggaaggacucacucaaugggguaugggcaaaauaagagucgaucucaaucgaggaucugucugugguugcaaagcuuugauaaugaaguuucccuccaucccacaggcaagagugacgccagaugccaggcacggucacaccugugauuccagcaguuagcagagagaggcaagaggacuuccaugugucccaaggccagccuggacaaccgcaugaagccauccacuaaucagaaaaaggacagag

SEQ ID NO: 9337 - RNA, 2431 nt, Mus musculus
ucaggacuuuuauuuaaaaagaaaggaaguuaugauucuguuucuuuuaccucugaagaaguagauaauaauucauaacuugucauuacuaaaaucuuuucaagaaaaaccuguauuccuauagaauguagcagaaguguagucugggagcuccuuuagcgugaaguuggaagacauguuacaacuguaauugccagcugcaucaucugugcgagugucuggguuacagcaggaaguagcuuccauuugaugagcucagugucauagacuuugacaauggcugccauacauacaaucagagugcucccauuaacagugagcucugucucccaguggcuuauaggaccuccuuucacagggccuuggcagugcaucuucuacagcugaccuaugaaagaccaaaggacuauugcaaaugcaggggcccugcagcacuguuugucauauauugcugagugugccugucaagugacaugagcccggggaacaccagcaccuauccuuacaaucacaguuuaugucuacacauugucugcuuguguagguaaaaugacagacaaaaccgccaacgugcaggcagacaauucguaaggguaggugugagaucagucuacugcagacacuugguuuucagagcagacagacuuauuuuacauaggccauggcuagauguuuaugcugcuguagaaggugacucuuccuugaccuuaguccacagcaaacccugugcuguguucucggcgaucuugucguaucugagacucagcagggcuuucagggcaguaagggaggggccgugggaaugugcuccugggucucgcgcaccagaggagccgcuucucccgaguggaucccucucuucucucucacugucacccuccauucccuaaguggugacagguguacccugacauggacaggaucucaaguguuucagccuggaguuucuccagcgcccccccccccccaacuguuccuccuccaacuaaaagcacugcacugcugcucauucucaggcuucgaggugggaccugggcuaggugcaugcagccaccagaaggggacgcuucugucuuggcccaguuugugacuaaauguccugcucaucacuuggauugcugccucugucuuguggccucuucaaggccaaaacgguaguguugccagcaaguuaaagaauaacuuuguuucccuagucagauucuucuaauaaccucuuguguacugggccaggcccaggauucacauuaaagggucauuucagaccaaccuagggggaaagacauugccucaauagacaagcaacaacaaccaaaaaguaaacauaaaaauaaaauaaaauagccaggcucuugcucugagaucacucaccgauacaccaaggcugccacuccugacuagcucucacagagcgagcccucaugcguaucugccccuguauuguacuccaugccugagaccugauuuagcccuaaaccaccuggcauugucgugcaggagagaggagaguuccuaaggccaucagcaaggagaagauccaggcuuuaaagccagcugguuccuccgagccaacuccaggagguuccugaugacaaguucugccucagaacaguucucaguggccagugacagagggagaacaaaccggccugacgucacagcgccgaguuccacugcucugugaccuuauaugaguuccgcugcucugugaccuuauaugaguccguuucuucugugaaacaacugcacacuaaacaaauccuuugagugaugacacuuuuaacauaaauugaaaaaugaacacuugaauaaucuauguggucaacugucccucuguuccuuguggccucaacagucccuccuaguuaguggguacagugcuagcagguguaaggucuuuggccaguguagacuuaccucaccuucagaaugacucaagggcauauuuucauucuccuuuuaagaaauacaucgaagggcgugguagcacaggccuuuaaucccaguccucagggugcagauagaccucagugaguuugauggcaacgugcucuacuggcaaggugcaggccagccaagacuauauaauaagacccuggagagagagggguguggaggggaagagagacugagagaacugguugcugguugaccaguugaugaauaucagcaugcagaccugcaguaccuggaucccucuguggcccaccaguguacacagugggcagacuauauguagugguuguauuaaaagcauagaauaagccccacuagguccugcucuugggguacacuggagccccaaugugccaaaguagucucuuccuggugugcuccuggagugccuuuaggguuggagccgauuaaaaacccacagugcgcagcagaggcacccgugcucucucuucccgccagugcuuggcaaauauca

SEQ ID NO: 9338 - RNA, 2431 nt, Mus musculus
ugauauuugccaagcacuggcgggaagagagagcacgggugccucugcugcgcacuguggguuuuuaaucggcuccaacccuaaaggcacuccaggagcacaccaggaagagacuacuuuggcacauuggggcuccaguguaccccaagagcaggaccuaguggggcuuauucuaugcuuuuaauacaaccacuacauauagucugcccacuguguacacuggugggccacagagggauccagguacugcaggucugcaugcugauauucaucaacuggucaaccagcaaccaguucucucagucucucuuccccuccacaccccucucucuccagggucuuauuauauagucuuggcuggccugcaccuugccaguagagcacguugccaucaaacucacugaggucuaucugcacccugaggacugggauuaaaggccugugcuaccacgcccuucgauguauuucuuaaaaggagaaugaaaauaugcccuugagucauucugaaggugagguaagucuacacuggccaaagaccuuacaccugcuagcacuguacccacuaacuaggagggacuguugaggccacaaggaacagagggacaguugaccacauagauuauucaaguguucauuuuucaauuuauguuaaaagugucaucacucaaaggauuuguuuagugugcaguuguuucacagaagaaacggacucauauaaggucacagagcagcggaacucauauaaggucacagagcaguggaacucggcgcugugacgucaggccgguuuguucucccucugucacuggccacugagaacuguucugaggcagaacuugucaucaggaaccuccuggaguuggcucggaggaaccagcuggcuuuaaagccuggaucuucuccuugcugauggccuuaggaacucuccucucuccugcacgacaaugccaggugguuuagggcuaaaucaggucucaggcauggaguacaauacaggggcagauacgcaugagggcucgcucugugagagcuagucaggaguggcagccuugguguaucggugagugaucucagagcaagagccuggcuauuuuauuuuauuuuuauguuuacuuuuugguuguuguugcuugucuauugaggcaaugucuuucccccuagguuggucugaaaugacccuuuaaugugaauccugggccuggcccaguacacaagagguuauuagaagaaucugacuagggaaacaaaguuauucuuuaacuugcuggcaacacuaccguuuuggccuugaagaggccacaagacagaggcagcaauccaagugaugagcaggacauuuagucacaaacugggccaagacagaagcguccccuucugguggcugcaugcaccuagcccaggucccaccucgaagccugagaaugagcagcagugcagugcuuuuaguuggaggaggaacaguugggggggggggggcgcuggagaaacuccaggcugaaacacuugagauccuguccaugucaggguacaccugucaccacuuagggaauggagggugacagugagagagaagagagggauccacucgggagaagcggcuccucuggugcgcgagacccaggagcacauucccacggccccucccuuacugcccugaaagcccugcugagucucagauacgacaagaucgccgagaacacagcacaggguuugcuguggacuaaggucaaggaagagucaccuucuacagcagcauaaacaucuagccauggccuauguaaaauaagucugucugcucugaaaaccaagugucugcaguagacugaucucacaccuacccuuacgaauugucugccugcacguuggcgguuuugucugucauuuuaccuacacaagcagacaauguguagacauaaacugugauuguaaggauaggugcugguguuccccgggcucaugucacuugacaggcacacucagcaauauaugacaaacagugcugcagggccccugcauuugcaauaguccuuuggucuuucauaggucagcuguagaagaugcacugccaaggcccugugaaaggagguccuauaagccacugggagacagagcucacuguuaaugggagcacucugauuguauguauggcagccauugucaaagucuaugacacugagcucaucaaauggaagcuacuuccugcuguaacccagacacucgcacagaugaugcagcuggcaauuacaguuguaacaugucuuccaacuucacgcuaaaggagcucccagacuacacuucugcuacauucuauaggaauacagguuuuucuugaaaagauuuuaguaaugacaaguuaugaauuauuaucuacuucuucagagguaaaagaaacagaaucauaacuuccuuucuuuuuaaauaaaaguccuga

SEQ ID NO: 9339 - RNA, 863 nt, Mus musculus
gcuggugggugaaaaaugccgcagcugaacggcgguggaggagaugaccuaggcgcuaacgacgagcugaucuccuucaaagacgaaggcgagcaggaggagaagaacucggaaaacuccucggcggaaagggauuuagccgaugucaaguccucgcuggucaaugaaucagagacgaaucaaaacagcuccuccgauuccgagguaggaagagccccucgggcuggcggguggcuccagccgguuccagggccgggagagcggggcuggaaggcgagcgaggcgaggcgggucgggcuugcgggcggcgcggacgguggcccgggcugcuggcugcgaaaacuuguaaccguguuuuucugcaccccuuucuccgccgacccucccuucccgcacccccucggcgcggcuaucgccccucgcccuccccaccucgccccuccgggaaggcggaaagacggccuccgccucgcuccgaaaguuuccgagauaaaucccgggaaaguuuggaagaaggugagugcgccccgcgcgcccccaaaaccgcgcgguugcguucccccuccccggggucggccuggcgggugcccucgccccacuccccacccacccuacccgaguucccgcgccggccgggccccggggacgcgcgcgggcccucggggggacacuugcuaaaaaguuucucccgcucucucccgcgccgcgcggccgccgccguccccuccgccgccccgccauguuagcggccaagaggcaagauggagggcucuuuaaggggccaccguaucccggcuaccccuucaucaugauccccgaccugacgagccccuaccuccccaacggaucgcucucgcccaccg

SEQ ID NO: 9340 - RNA, 816 nt, Mus musculus
uagguaaauagacaaccaacuguucuucaaggcugcacucaucuauccugcccccauucaagauauucuagaaaguuccccaacccuuuccccaagcaguaguaacuauggcaacgaaccuguggaagcagagaaggcugaggcagccccaaagggaauuuuuacagccccagggagaagagugaaggugaccaacacugucagagaugucuguauggcaacagggacagacaaaguuguggagggacccacgagaaugagaacacacagcauguaccgacaugaacagauauuggccagucgcuacauacgagcacccuccuguauugucuuccaccacacccaccccaucucuggaacccggauguauucccaaaagaagauaauauaggaacaugccaagauggauggguuucuuacaguuacuaaaauucacuuccuaccacuuugcugaagaagcucaaacagaacgucaaacuuugugcgguuggacacagcgacucugccuuacacuggggcuuguggcgugugaacuaugacggagcuguucaaacuguuagugccauugcuggagucagcaccguggcugauuggggcagggaugcugagcccguuccaugcuucuguuuaugcuccaaugauuauuaucuuuggacaacuugacgcugguuaacuuaacagcaacaaguguugaagaagccacuggaggaucccaaguaguuccccuuagaggccugcuaagucagacguuuuacaguuggaguuucuuguuuauuugccuuaaaaauuuaaagaauguuaagcuugggaugaugg

SEQ ID NO: 9341 - RNA, 816 nt, Mus musculus
ccaucaucccaagcuuaacauucuuuaaauuuuuaaggcaaauaaacaagaaacuccaacuguaaaacgucugacuuagcaggccucuaaggggaacuacuugggauccuccaguggcuucuucaacacuuguugcuguuaaguuaaccagcgucaaguuguccaaagauaauaaucauuggagcauaaacagaagcauggaacgggcucagcaucccugccccaaucagccacggugcugacuccagcaauggcacuaacaguuugaacagcuccgucauaguucacacgccacaagccccaguguaaggcagagucgcuguguccaaccgcacaaaguuugacguucuguuugagcuucuucagcaaagugguaggaagugaauuuuaguaacuguaagaaacccauccaucuuggcauguuccuauauuaucuucuuuugggaauacauccggguuccagagauggggugggugugguggaagacaauacaggagggugcucguauguagcgacuggccaauaucuguucaugucgguacaugcuguguguucucauucucgugggucccuccacaacuuugucugucccuguugccauacagacaucucugacaguguuggucaccuucacucuucucccuggggcuguaaaaauucccuuuggggcugccucagccuucucugcuuccacagguucguugccauaguuacuacugcuuggggaaaggguuggggaacuuucuagaauaucuugaaugggggcaggauagaugagugcagccuugaagaacaguugguugucuauuuaccua

SEQ ID NO: 9342 - RNA, 55245 nt, Mus musculus
caguuuaagagugggacacacaaaugggcaggcuuuucuuaagucggcucuuuuaaacguguacaugguuauuugaauuuuauuugucuuggaauucccugccgggcuucaaaggcaauggguucccagcuccucuggagcgcgacccuagcagccuuccccgugucgaaucuggcgcucugaacguccaggcuucgcggcggcccggaaccuggaaggggcggggugggcaacucuggaguuuaauuacgcgccagggaagcacggcccuuuggacuuuggcguccggaggaaggcuuauuggaggcggaagcguguguggcgcagggccgggcuggccaggccccgcucugagucaagagggcggcgcacgcugguccgacccgcgcccucggccccggagcccucgggagcucgcgcaacauggcggcucccggagcgcgcggcgcgagccucucgggccugcugcccgcgcagaccucgcucgaguacgcccugcuggacgccgucacccagcaagagaaggaugaguuggucuaccaguaucugcagaagguggacggcugggagcaggaccuagcggugcccgaguuuccggaaggugaggggcuggcgucggggugggggccgcucccggguccuccccuuccucgguggcucccucccgccagcagaucggugcccugcgguccucccacagcccccgaggugcuccaggggagcagcgacacacggaggggguucugcugggcggggaccaguguuugcaucucugucuggaauccugcgugaccugacgucaguagccucaaggcuccauggguguauauugaucacuuuuuaaugugccacagacgguuugaagcacuugagagcuccuacuuaccugguacaacccaccgagacccucuuacuagucuuguuuuacaguuaaggaaacugaggcacagggaaggcuaggaaaccugcccgucuaauaaccacuagaguuggacuacauucuacaggcauagcaucugaugguuuucuaguccaaccgcguuuccacguucaaaguggugaaccuauugaucuuuaaaaucuggaaucaauuuuagcuuaguacucagguuugaauccuaguagugggaacuguugggacauagggaaacgauacucccgguaguacaguuuaaacaaaacgcucccuuaccuucuuugguugggagugucauuguuuagccugccguguuggcauguguccuggcgugugacacugaaaccacaugcauaguuaauuuguuaccugugguaggguucagguaucuuccggaaggaucuaucuguuccuccuucaucccacaacagucuuggauauuucggacccuuuugcacucgccuugagaggggcuuaccguuccccucguuauacuggauuugaaauaccguggaauugcaaaagaauuggcugcauggaggucggucccaucagagaaacuuaaaaaugacaaacacguauaugcaguguauacauaucuucugaaaacuuuguaauaaagcacgugguaaauacacuauuauaagccaguaggccaucaguuagaauuuugagaaauguuucauuuguauuuauaguaaguuuacuauauuaccaugauauuugaccacugugacugaaaucauacucauaagaaaauaaucaggcuuugucuuugacauagccugauguucugccgcagccaguuauuaacagaaaguuaaaaacagacaaagcagguuuugagauaaaacuugauuguucaaucuugauugucguuuacugaucuuagaagauacucauucuuuagaggggucgccugcagucuaauggguaauccagggugaccugaaacugaaucccugucccuuccucugucagcuuuuugauugugagcacauuacuugauuucuccaggucuugauuuucuuuuuccacuuguaaagaaaguggaaccgauauuuacuuuuuuaggguaaggaaauggagguaauucaggcaaauucuuagaaaacaagaagacucauuaaguguuggccauguauuauauucauuguaauuauugcugcuuaaaauacauuauugucauuaaaucugguaaauaccugggacaguaacuuaaauaacuuaacaaaaaaacuuaaauaaccgucucugugcccucaauaagucacccauaacaauuuauagagauagagucuuaaauaucuugcaacuggguugugaaauacaugucaucuaguagguuaauuaguagcucugugucaucaauuagauaugcagcuaauacuuaaucaaaaggaauaauuaaguguucacugaacccuaaaaccuuuagcguauuuguuugagaucaucuuuucuagaauguuguuaucauugaauaaguauagcuuuuguuguuggcaauccuugcuacguuagucuuuaugucugguuccagggaccuguaguuaaucaccuucucaaaauaugaaauggaaaguuccagaaauaagcuucauaggcguuaaaucguacauuguucuaguagcaugaugcaguccugugccuuccuccuguguccucuccaagauguccauccuccuucuauucaugacaccagucagcccuugucuauaucucagcggugugugugcugccagccgcuagucaguaguuauccuggaaccacgccccuuaagucacuuaauaaauaaauggcuccagaacucaagagugaugaugugucuguuggauaugccgaggagaaaccauaaaguuucuccuuuaagugaaaaggugacauuucuugacuguauaaaaaacaaccaugugcugugguucuaaggucgauuguaagagugaauuuuaacccuucaaauuuguaaacaaggaacaggugacugcagaguuuugcuccugcaccucgaacuucaaguggcuuaaggagggcauuauguaaagaugcagaagucuacaucugauauguguuucugacaacuauggguacacuuggauuuuuaaaaauuauucuuauuuccucuuguuuuuacuugaauguguugauuuuauucaccuccccaagacuguucaccauuucugaaaggauuuaguacugcauuuguugguuuugguagauuuguagguugccuccccagagcagaugcccauucucagcugcuuccauccuccuguccgucccucuccaggcuuuuacucuccacauaguugccuaguugaucuuuuuaugaaauccuacauacgcacguacguuguuagaaucaugaagauguucucuuauuuauuaauagaaaagagacuuggguagacuaauaaacucaacugcuacagucuaagcagugcuaucaucucuuaaaguguuugacuguuuauucuggucuuaggaacacagaaucacauuuuaauggacaguuuaguuaauucacucuuuuucuuuguuguuuccuuuaauuguuuuaauuuguuuucuguaaauuccaggcuuagaauggcugaacacggaggagccucuguccauuuacaaggaccuguguggaaaagugguuguccuugauuucuucaccuacugcugcauaaacugcauucaugugcugccugaucuccacgcccuggagcgcagauucucugauaaagguaccugcucggugauugguuucucacccuguacauaagcacgggaagagcaucuggcuccuuuacucaaaggagagugaccauugggcaagacuggcgcuucuaagugugaucugaucugugagugagcacugacuccugucccaccagguagucagcuuggccucccugccuggccucccaggugccacuaaccugccaugcuugauuuccauauacuuuuucaugagggguuaaacuuagugauaaugguuugccugagaaccagaauuuaggauucaggcuuugucugagggucagagccuaauuuacuuuugucaugaugagauguuuagaaaagucuuuuucuaucccaggcuuaacuaaauuuguucuauguaaaagugaaacaucuggccacgguuuuaugcucuucucagugugaugaugcaaaggcuuacguuucuuagcaggaaaugucauuaggcuucugacgugaaccacaguggaaugcaaaguacagcgcauacuuuuccuuugaccuuguaucauugcaagaugguucauuacaguuaauguuucuaaagcgcucuaggaaauccucuuacagcauuagagccucuggagguagggaagauuauacuuaguguuugcuguccagguaggagaauaaucagguuuuuauuuauuguugauuucuuucuaaaaauaacaggaaaguaaaugaauugauaaaaugguuucauuuaaguuugaacuaaucaauacuccuggcaucugugugagagcaguguggcuacugaucuugugacuagauguuuggguagacccugaguauacacagauggaggguaccuaggaaugugcuugaacaagacugcucauaagaucuaaaggcacaggagguuuauaugaguuuuagcuacaauauauucuauuuuaaaaauauuaaccaaaagauuuacaagugacuaaaucaccaaaacugacguguauaaauuuaagaacuguguuuuauucugcccuagguaguaugugccucuguuucucacuccagccagcacauucauugaccaugcauuaugaauauguuuuaggaaauauacgacgagucugaguaagaugcguuaagguggcagaaaccauuauuuuguaaaguuaauguauauaaaaauuuuaagucuuauagaacugucuccccagagaguaguaacucacuuugccuguggcccuuuaaagagacuuugcagugaaacagaauccaugucaacuacgcacaacuaugcaguagcacaugugacauugaaaacgggcagcaggacuuacucugcugagagagggucagugagcagucagaugccaggaggaguagcacucuugcuccacaaauaggcuuauugugaugaacaugaaaagagacaaaagagagagauggcucacaguuaagagcaaugacugcucuuccagagguucugaguucaauuuccagcaaccacaugguagcuuacaaccaucuauaauggguccuaaugcccucuucuggcaugcagguguacaugcagacagagggcucacauacauaaaauauauuaguaaucuuuaaaaacauacaaguaagccgggcaugguggcacacaccuuuaaucccagcacuugggaggcagaggcaggcggauuucugaguucgaggcuggccugaucuacagagugaguuccaggacagccagggcuacacagagaaacccugucucaaaaaacaaaaaaaaaaucauacaaguaauaaauaaaaugagacagacuaauaaguuagugcauguugugaagugcucuuuggggcauuccuaagaauucagacuuuucuuccauugaggaugugacaaaguugaagguuguuuuuuguuuuguuuuguuuuguuuuuuguuuuguguguguguguguaugugugaguuuuuugauaggagacauaauaaaauuguauuuuagaacuauguuaaaaauccuaauguugacucccuaaaugacuauguaauuagcuuaguuuguugacacuauaccuagagaaagucaguaaccucauguauauauaaacaagucuuugaaaaguguaacacuuucuaagaagaaaggguccaggaagguggaagaguaggaagcaacggaaaugcucuugcagagaugguugucuaggguggaacuuucauucuuuugaaggcagaguugcugaauauuuuuagcaaaagucacaagauaauuaaaacuaaaccaaaaagacaaggaagaauaggcuauucaaacauaaacacaacauaacauaaacaacagaaacuaucucauuaaaagauaaaaugacagguuugagacucucgaaaacaaauauuaaagaugcuuauagaacaacaggaagggguagaaaagauaaacaguacacaaggaaaaggaaagaacaguaaagagauaggagaaccucugacaacacacagaacaaacgcugggacggaagacugcaccaucugaaguggguguuuggagacagacugaagcagccagagaaaaggcucugagcuuagagcuaaggcagcagaagcugcugaauauuuuauaaaauguuugaaaggaucacaaacauuuggacaggauauggacacauagaguaccaucaaauagaacagaugcuuuguagcagggacuuuuaacaaaguaauggccaaaaccugucccaauuuaaugaaagacaugauuauaaauauccaagaaguucccugaacucuuaaguagaauuagucaaagagaaccacaccaagacugagacacaaggacagagaacucagcaauaggagagaagcagcucauuccguucagagagugugaggaguuggcagucuccucaggugguuggcugugaggaggucagaggcggaaggcagugggccaguguauucugauuccuaaaggaagacuuugugcaaaauuuugcaauugcacaaaauuucucaagugggaaagaaaggaaaacauagaagcugggaagcuccuaagaguucugcagguggacaugagcaccugccacauacuaucuuaaagccugagaagaaacaggugugagugaacacuugguaguuaguuauaaaagcuacauuguugaaacaugauguuguagcuugauuucugcaagacuuaguagacaaaugcauaguaaagauuaguaugaaagguauuggcagauuugagggacgacauugacaauucugugauaguaguugaagaauucaauacccauucuccauaaugaaugcaauuccagacagaagauagguaaggaaauaaagggcuuaaaagauacaauaagccagcuagaucuccaaccuacacagaacaccuuaacacugucaggacacacauuucuuaacccagcuagaucuacagccuacauagaacaucucaacacugucagcacacacauuuuguucaaguccacguggaucauuuucuaggacagaccauauaucaggucauaguuuuuucaguagguuuuaaaagaauauuccaaguauauauuaaaguuagaaaucaauagaaagaaagcugaggagaugaaugguuuguggaaauuaaacacauguuuaaauacccaauagaccaaaauggagguuacaagacaauuagaaaauauuuagaaacaaacaaauauuuaugcuauauuauaggaaaacauauaaacacauuaaaaaaaaaauacaagccaggcagugguggugcaugccuuuaaucccagcacuugggaggcagaggcagauggauuucugaguucgaggccagccuggucuacagagugaguuccaggacagccagggcuacacagagaaauccugucucaaaaaaaaaaaaaacaaaaacaaaaacaaaaauacacaaaccaaauuuauagcauaaagaacuagaaaaagaacuaacuuccaugaauuuagcagaaggcaccaaacagugaagguuggaguagaaaaaaacagaauagacaauaggaaaauaauugaagcuaauaauugauuucuuggcaguaucauuauaucugacaauguuagcuagaugauuacagucagaagugcaggugaagcuagcacuacucguuucauugaaauaaggauuagaagagcacauggaauugugugccagugaugaaacggagcugucugaaagcacagagccucccaagagcaaaccaugaagagacagcgagaccuuggcagaccuuuaucaacuguguuagucacugcagccgagucacagcaauagccagaccuacugcagggugaguggaaaggggaaguugacaugcgcucucuggcuccuguucacucucaugagggaaguaugauauuauacuaaguacaauaaccaaccucucucucacacacacacagagauuccacuuaagugaguuaucuagaauagucaaaaaucauagagauaggggggaaaauggcguggaaagagacuaguaaagacuuacugugcaacagacuaaguuucaggcacucuguuugagguaggcucucauucuuagcccggcugguuuagagccuacuuuuaucccaggauggccuuggcuuugugucugggauuuucagguuugcaagcugaggaggucagagauggaugguggguggagguggauguccaacaguaugguuguacuuaguucucuguuacauuaaaggauuguuacggcaguaaaguuuauagacaauaaccucucugagcacaaaacuggcggcaugugguggugcaugcuguaaugucagcacguggguaguugagguaggaaggcgcgugacaacuuggaggccugccugaaccauagagugaaaugccauuucuaaaugggggcggugggaugcuuuauucuguuuuuacuuuuaaaguuaacauuauaaagacaaauauuugcucuuugggagaaauucaguuuguuuauuagcaucaaauccuaccgacuagugagauccauuuguuagguauauagacaguuuuaugagccaaccguaaacuugaaacuggccauaggagaaguauuuauaccaugaaagucaacaaaugcuacaaaucaggaaauuuuuuuaaaaaaugcuguuuuugaucauuccaucaaaucaaaucacuaguuugcaagcauaccaugggauaucuuauucuuagacuguuugacuguagaacaauuacuaacuggugggucaugaccccuuugggggucacauauauacagauagccuucauaucagauauuuauauuacaauucaugacaguauuagaauuacaguuaugaaguagcaaugaaauaacuuuaugguuuugaggguuaccacagcaugaggcacugcauaagagccacaguauuaggaagguuaaaaaccacugcuguagaugaguaauuuguguuucugcauuugucuauuuugaauacuguuuguggaauaaauuuuuaagccuuggaaaauacuuugggaaguggucucagccuuguaauuucaaagaaauauugcugcaauaauaagcuaccacaugaaaaucuggguaacacaaaaguuucuuuauugucagaagguaauucaauucauguugaaaagauaucucggaaucaucagauggaagucgagucggcuguuagcagguuaaacuugcuugcuuacagacgccuuucaugucugagacauuugugaacauagcggagcaaugcuguucuguccugacggucagcaagcacagucuaaauccuaguucacaggaugcucagcaaagugaaggauuucucaugaauucaaacccagaguaaguaaguaaguaaguaaauauauaacagcuuucaaacucaggccugcaauaguggcccauaucauuuuuguaauagcauaugaaaaaacuauuuuaaacaaacaguaaacccugcucaguuguaaagagucacucuaacgcuuaaauaucguaaaagagauaacucugcccugaggucauuaguccauagugauucaacguguuuauauuaaauugguaacaguccaagugauuucugcuugcuacaugagaguuucuaagauuuuaacuucuuuaugcuguuaccucagaaguauauuguuauaauacucacuuaggacaguggcuguuagcacaggaaaaguauucuugauuuauaccaaagcguuuucuuagcuuugcaugugucagugucauuucuagguauauuuaaugcauaacugcaucagauuucuguuuuguuuuucaaggcaauguuucucuguguaacagcccuggcuguuuugagacuugcuuugcagaccaggcuggccuugaacuuagagagauucucuugcaucugccucuaaaguguugagaugcaccacugccuggcuugcaucagaguucucuuuuaaaggcugaauauuuuguuacugucggaugagcauuaguauauauuaugcaguaugugaggccuuaccuguuuuacacuuuaguagucugcaggacugcaccucuaacuuuacaguauaguaaaccuugaagugaguuaaguuuaauucauuuugagucaguuuccagaccacccucaauggcaguauagaggaccaaccaggugaagacucaggcuuggagucagaagauaguugccgcugaggcuccaagugauuacagggcagagcacaagcaggaucaagacaggagccagcuguucaggagcgguguggggagaccagaugcagggugccaguccucucuugguggagacaccaagcgcgcaccuccuccagcguggacagagacacauuuggcacacagucaccuagggaaccucccaccacuuaaguucaucucacauguuuuuagcagaggugcuuaugggggcagcuucuuuucuguggcauauuccagaacaucagacucccaaggacaugcuuguucagcaugaaucacaugacuuauacacaguguagccguggugagccacuccaccuguggugucucgaguggugggaaccuuuccacauccaggugccgggcgagagccuuuacacagaggcccuucagacgguagggucuccuaguuaacucuuaucuguauguaguuuacauuuucuucucuuauccuacaacccaucuaguuaucagucuguguucuuaaauaggugagcuccugugaaaauauuggucauuuuauggcauguuuucagggguuuagucugaucaagagccuaacgauuuuuuuuuucuuucuguuuugcuucuggucucugcuucaacuuaaucuuuaguggucuugauuucaguauuucuacuacuuuaaguacaaguaccuauuguccagugucuucugcccaugggacccuucuuccccuuguuucagccugccuagcuuugccccaggucaucugugguaguuuugcauggugguggcagggcgugccuggguguauguguguggaggccagagguugaccucaggaaucucccucagccucucuccucauuuguuggggcagggcucuugguaaagcuggugcucacagauuggcuggacugucuggccagagucgcuggggucagccugccuccauuucuccugcuguggcaguggagcuguugugucagccugccuccaucucucucuccuccgcuguggcuguggaccugccuccguuguguccuacuuuuuacuuggguguuagaucugaacucagaucuucugcuugaacagcaacacugccaguuuagccuuuucucauaccuuucucaugcuuuuuaauacuguaauguauacuacauguaaugugacacuguaaugucccugugccugagaugguuucucuccuuuuuauaaaguuaugcuugccacuuagggcacagguuuuacuuuuuaaaauguauucaaaaagccuucaaauaguuuuaguucacaaauuagacuauuguguggacuacugcuaaacacuuucuguugcaaugaauucaauugauuuuguauguguuuaucuuucugucuuauacuguucuauugcugugaagagacacacuaugaccaaaguaacuccuauauuuaaaaaaaaaagucauugaaugggggucuuguuuacaguuuucgagacuuuauccaugaucaccauggcaguaaacugacagguguggugcuaaagcuguagcugagggaucuacaucguaauccauaugccuccggcagaaacagagacacugagccuggugugacacaccuucuccagcaaggccccaccuccuaauccuucuagugcuucccaaacagucccauucucuggugacuaaaaauccaaauauuugagccuguggggaccauucucauagaaaccagcacacuuuucuuccaggcuuuuggaaugauuuguuuagaaguuacauguuugcuaaggcuuuggaaguugucccucuccuuuccuccuuccauugcugucuucccacuccucuuugcuuuccucuccuguuccuucuuggucuucauguucugauucuuauguuggaguugcagagggaagaaccuucucauuguacuuguuaugacccagcuaauagaaaaagcaaacuaguucaagaaaaauagguguauauucuaagacucagagcuaaaaaaugagaagagauauuugauacuugucuauauaugaaucaguauuuggacugugugauauauauagucaucuucauucugcuucuuacauacuagugcccuugaccuguaaggcguauauccaaagccuuguggauauugcucacucucuguaauaaccuaugaggcccccuuuuuuauuaguaagugcguaucagauuauggccuuaaguaauauuugcaauuugagauauaauagcaagacuagcacagguuucuuuuucugucuugauggaugaugaauaaauaugcauucuuaccauagauuuuauuuucauuccuuaagucagaaucucucaccuuuucacugaaaaaaagaaaaagaaaaaaauauauggcuucuuuauugagaaacauaaauugcuagcauuacuguuccugagcuuuagggccauacagaguguugguuacuugaacacaacuaauacaacgacuagguggcuaauguggguaguguauucaacaugaucaccuugaaagggggaugauagacacgaggugggcugcagugggcugauaucacacugcacuacucaggaggguguguggucuaaaacaugaauaauugacuucugugauuuccuauuccauaacuuuagacuaugguugauuuuagaugcuuagaaccauggaaagaugggagaagagggcuacuguaaggauauacugaggaaccgaaggaagcuacagcaccuugggagccgcaaacgauacggaguuguguggggcacugauuguggggaaauaagggggugggagaccugccucgugccagagcuuuggggcucuggguggguagaugcgggguacuacuaccaugcgcucucugugccaccagagugggugucuggcugugggaagccgguaaccccaguccccgggggguagagagggaacaguccaagaucucugggcuggcccagagacaacagguucucagucuuggacaucccagaugcuacugugugucgcagaagagcugagaacaaagugagggccccaggggcagcucggucaguccgggggccgaaaggagaagggggcagggggauaaaagggcgcugggcuguuccccuugggugagagucuuugguccagucugguggcuggaaacacuaggaggccuuccugugggagauggcucuuuaggggaaggccucuuucauuguucuaacacagagggucuuggugagcagaaauguuccaugguuugagaaagaaaaagagagaaaaagaaaaagaaaaggagaggcuggccaugaccccauggagagagaggagaagggagggagagaaagagagcggaaaaaugagaguaacagauaagagcuuaagagagagaagaggggccaagcagccccuuuuauagugggcugggcuaccuugcuguugccagguaacuggggaggagcauaccugguuauugccagguuaacuguagggguggagucuagccagaauaccaggagcucgggacauugucuacaugacugauagucaccagauuguggaguugaggacucauggugucaggcguuugugucugggaagguggcucccugucccaucucuuguagaguuuccugcugggucuccaggguaagccuccgccgaccagaacacagacugccuuuugagucccgcagagcugcugcuggaaugagacuugaucuucauauuaagaacagugaaggauuuuuugcaagauagugauacagucauaguuguguguuuuuaagaguucagucugacuuuuagggagauaacucauuauggauaagacagguguggcaaucugcaaauaccagggucagcagguaaugaugugcaugcggcaagauggaaaucagcucagcaagacuuugccgguguugguucagauucuagagucugauacuggacacuuuauuuuagacauauucaaauacagaacgguuuuaaauaaaugcuuccugguaacaacugacucaaucccacgugaacaauaaagcuuaaggcgugacugcauuagaacuguuuuguaaaguacaugugaccucuuccauaaagaugaguucuacagcuuaagggccuaggggagaaccugguguaucccagucauacagauaacaaggugguuaccaaguuauaaaguacacgugcaauagaauggguucuguugaccgaggaacaauguucacgauaaaggucuagggaggaaggaucuggggaguucguauguggccuggcccuauagguagcacagaucaccaggcugcuaacugcaucuccucccagccuucuguguagaagcaaguagacauucccccugaggagacaauccagccugucuaacaucccugcuuucccuggugcuuaucugugagcacaaggcucucaugcucucuacagauggguacagacugaacaaguuguagggguuaagaucaauagggcuuggucaugaguuaaacauggaugaugaaggcugcccauggguuauuacagagacucuguaucuugaguucuugcuuauauaguuggauguauaauaaugcaguucuauaacaaagcacgagagaaagugcagauuuggaggggaagcucaugagguuaguuugaaguaucuuugauacuugccuuucagucuccauauaacuucaauugcauguagaauaagguguaaauucugaccauggcuuugaaggccgaccauuucuggguauuuauucuuacugucucaaacuuccgucgucuuuguaugugcugguuucucucccugaaucuccuucaccacucucugccucauuuuaacuucucaucauugaggugucaccccuucaucauuucuuugggaaaauauugagauauauugauuagguggaagguaaguaggaaauagccaccaucuacuuugauuaauauuauuacaucuauauaacaugcagaaacaagugggcuuaaguuguggguuccuccuugaauuuggugacuuuugaaucauuacuguuauuuauuccaguguuugcacugucccagaucuacccagugccuugcccaccagccgccuccugugcucuugcuguuuuuggaguacuuccuucucacaccagaauauuucuaguuccuccugcgcuuucacagcccauccccaaaguuaccguuucuccaaggagcucaugauuccugagcugucuuugguuuuaguuuagucccucucaaagacuuaaacaauuauggaggcuagucuuuccaccugccucccacagaaguuacuguguucauuugaagggcagggaauucauuguugcuguuuguauuucauuuuagcacccuugccaucuuuguagccuuuuugugugugaguguaugugugccuguaugugugugugcacgcgugugugugucugugugugugugugugugugcacacgugcgugcgcgugugcgcgcacauacauccagguguguguggaguggauauauaacaacauggcuuucacagugaaauggaaagguugaucauucgugcaccuauuuauuucuuuaccugcuucugccuuguacuuuauuucauuucuuacuacuuuuucucuuaacuagaaagugguguacauuuugugcauaauaguucacaguguauauacaguguaauucaaccauuuuccuguauguuggcucuaagguuggcucaguaguuacaaugacuaauuuuguggagggauagguuuucacauaaugguggacuaauuaagggucauuuccuagaaaugagaguaaaagucauuuugcugcauauuucuaaauuccgcauucuagagccauguucacuuacauuucuacaagcacacacacagagagagagagagagagagagagagagagagagagaggcagagagacagagagacuauuccuacugcuucagagagagagagagagagagaaaggcagagagacagagagacugcuucagcacuguguuaacauuuaccuaucuaaacaucauucuauagauguaacauagcaguuuaucauacauguacccuuuuuuucuauuaaguugauaauugguuauuguuugccucuaugaaggcuauuuugaaguauuaauuuuauguucaaaguugcuaaaucuuuuuaauugaaucucaaggauuuuucuggcauacuaauuauaucacauuacaugcagguauuuguaauucuaaugucuuugaguaauucucuuguguaauuguguuugcugucucccuaucuguaccucaccucuuugucaaguaguaguagagcuagcaguuaucuuugccuugugccuuacacuuacagcauuuauauuuagcauuuauugauacuuauagcauuucuucauuaagagacucauuuuuagacuugauuacaguuauuuaaucaaccaacaaaauauggaagacuuacuuuauguaaguuauacacaugauguuaaacaaaauguaucuguguuguuuccaggccugaaggaaaauggaagccaccuguaagauuuaauuucgucaacuugauagacaggaugugggauuaucuagcagaccagucagggcacgccucagggauuauccauauuagcacaacugaagugaggaaacacuccuuaacuuugaggggcagcaucccaugaggcuggguuccccaugaauuaggguuccucaugaauuacugaauuauaaccuugcaggacaccaguauuuggugcucuuugcuucacagcuggaugccucccacuccugucagcaggauuuuccugcaguggcacacuggacccucagacugcgagccacagcaaacccuucuucaagucucuucuuguugacgauuuugucauagcaacgagaaggguaccuaauacacaugcuuuaaagucuuccccugacucccaaacaaacaaccguauuugacucugcaucucacagcaccaccagauggagcaccauggcccucacaucacguggccaucaagacauaaacuaagcucuaguuaaaggugcuccugaugcaagcugaagacagggacagaggcagcuuaaccagcaccagaagaacaagucaagugcuuggcaaacacaaaaccaacuccugguugguuugcuaguuuguuuauucgugggcuuuuuguuucauuuuguuuguuuguuuucuccuuuuuucccucuuacugcuuuucuguuuuggguguuuuguuuuuugucuauauuuugagaaagaauguaaaauugaguagguagaguggugggaguaauuagaggaagggaaaacauaauaaaaauacauugugugaaaaauguuaaagaaaaaauaaaaugcaacaguuuugaaaaaaaggaaaaaaaaaaguaggaguaauucugaagacuuagagcacaaauagguccuaguaagaaauccccaauaccaagcuuaaaauguuagcacagguuuggaugcccuaguucuagcuuaccuuaaauguucaggaaggacgaggauggaaagcguagagaagucugcuuugggacaaacaucaaauacacaagcagggugugguuccucuuagauucggccccaaagcgaaagaaggaaaugaaagggaaaguuuaggauccaguaugaaggaaggagaauuacagccagcaccuccuccaugagugguguccauaaaugaaacugcacagagagcagagcugucagaagagggagcucucaggcuaggaaccugguuuauaggaugauaagguggucauagccaugcagaacuacaggaaagagaguguguggacauccucacugagagucacagacuuaacaacuguguuccuuuuuggaguaauaucuucaaacaacacuuaagacaaaugaaaaccaaguuggaucagaaauacuaaaauuaaaaagaaaagaagaaauggguauugauugacuucaagauuguauuagaaacgaagucugaacgacaggauguagaagggaggaugacugcguguaacgauggagucgagacugcagcgaagucgagggaggcagagagcucuagugggugaggcugagccccagaagaccaacagugcagggagagagugagcgacucagaagacaagagaaggaggugcagcgugggacuacugggagaaccucaggaaaagccaaccacccaaacuaauaccugaaauuagaauagaaaaagaaaccuaaauagggaaaaaaacaaaacaaaacaacccuucacucuucaucuuaaaagggccuauaagauaccagggacuauuaacccagaaaaguccaaagaacagcuuaauaaaacuguuaaaauuacagaccaaaccaaaaacgucuuacgagcuccagacucacaaaagcaugugcauuaaacuuacuggaguugucccaauagauugaaaagccaggccacauaaagccacguuucagcacccugaagguauacaaaccagguaugguacccauucccucuccaagcaucaaggcuauagcaagcagugaggaaggugaaggauucagagggcgugugcugcacgugugcauggaugucccacaggggagcucucgucucguucuggcugaguaggaaagcugcccuggacagauaaggauguccuguguacagaucggagcugagaucaaaacuacacuguaaguagagguguauuugauggccaggguuuguucugaaaaaaauggagcugaucaaaguaacaaagaaugaggacuuacuguaggagcugacugaccagucugcaaggggcuguugcuucuguuuaguaucucaguggcagauggagccauggauacagaaagacaaaggaaagaaggacaaacuagaauccuuguaggcucugcuuuauuuaaugugacuagcaagugcucuuuauuguggagcaacacauuucuggaccauaggguagagaagcugggguucccuggggucccuucugagucugcugaggcuuuguguguccuuugugucuagccuggcuuacucccuucagcugugucucauacggaauauaauccagccuccuauaacuagaugaccccaugcaugucugcauauuuacucaugugaguaauguacuguauuauguauauagauuacaucccgcauguuucccuaugggacauaauugugaagagugauauugcuaauuucuuuugaaauuuagagguuuuuuuuuuuuuaauuuaugguuaaauugggugagaguucacuguuguacugaguacuguuaaauuccuuacacagauugucccuuaauucacuuaaccuagggagucauucaugauguuuccccaucccacaagugagaaaacugauaaaaggugagcaguuuggccaaagucucaaauccuucccacuucugcccacuccuacccuuccacuucccaggcaucuaucugcuccucaggauuuuccaagauauccuugguuguuuaguuguugcuucucagcaguuugaucgugagcugucaaggcauguuuuccucuguugggucuuagaugcuaugcuggccugaaguuacguauacuaauuccuuagcuagaaugagaacauuaggcauuaaucaauguuuguuuugcccugauuucuucucuuuuccuuuuggauucuuguaacuccuuagaugcucuaagcugaucccaaguugccugaagaagugucucuuuucacucagucucccaguguccuuucucugauguuaccucagggcuccuggccuuuuccucugccaccaguuugcuagugagcucauucaguuucuucguuucaaguagguguuuucagcucugacaucuucauuuaguuuuucuuuuauggucuuaucuguuugcuuauauuuccugucuuuucauucauuucauuuguauuuuucuuuuacuuaaugaaacaugauuuuauagcugcuucaagucucugcugauugaaauuauuuuggcaucaauaucuuguuuauuuuuccuuugaugauuaaucauauacccuucuuuaugguguuuguuuaaggcaggaucuuacugugacucugaaugacugggcacugguuucagguuauauauaagacauuguauauaguauacaguuguauacauuguauacaguaauuucagacuauauacaagauauuggaacuuugugauauguggaacuuggguucuauugaaguccugauagauaaauuuaguuuuguuuuaguagacauuuagcacgguuacuucugauuauaaguucccaucuuauagggcccaccuccagcaggaagacaggacaucaagugagggaugggguugccauuccacagucacaccucugacccauaauuguuucugucugaaagaauuacagggguggaaauggagaggaaccugaggaaaagaagguccagcaauaggcccaaagugggauccagcucaagggguggucccaaggccugacacuauuagugaggcuauggagcacucacaaaaagggaccuagcaugucugcccucugaaagacccaacaagcagcugaaagagucagauguaguuauuugcacccaaccaauggacagaaguaauaaccccuguuguugaauuagggaaggcugaaagaagcugaggagaagggagauuuuguagaaggaccagcagucuuaauuaaucuggaccccggagaucucucaaacacuggaccaccaaacagacaguauacaccaccugauacgaggcccccaacacacauacaguagagggcuuccaggucuguguucauucagagaugaaacaccaaauccucaagagacugaaggccucagggaguuuagaggucagguggagugggggugggggcauccauguggagaugggggaugggggugggggcauccauguggagaugggggaugagggugggggcauccauguggagaugggggauggggguggggaggaggugugggauguggaacaguuggaguguggauggggggaauggaauauggaguguaaaaaaugaauuacaaauaaaauuaaauuuaaaaauauauuuauuuuuaauguaugcgcauuggucguguguguguguguguguguguguguguguguguguguguguguguaugugacugugugugugugcgcgcgugugugugcgcacgcacaccacaugaaugcaaugcuuccaagacaagaagagagcacugaauacucugaaccuggaguugcagaugguugugagucaccauauaagugccagguacccaaccuauguccucuaugagagaaguaagcuccuaaccacugcaccaccccuccagccccucugcccaucuucucuacucaguaauucaguucuuagugcucagaauuugcuaugcauuguuggucuugccuuauguauguguaguuuggagacaugugaguugagacaauaguauuuucacuguuucuccacacucuggcuucccugguucucugaccagaaugcagugggguuucaguuggaguguuagccacucgaguggcuucagcugacagcagagcuuuuaccuugguaacacuggcccuaccuucuguggugcgccucccuugguugaguccuuccauuuucuuuaaaaguuuuaccugaaaauguagaguucuaauccuacccaugaaugugauccuguguuuauguuaaaaucaagauugucugagauuuagauugauuaguuuuguauauacuucuuuaaauacaauuaaauacauuaaucuaguuguuuuuuuaaucuauagguuuuuuauauuaauaagcgagcucuaguguauggauaauuauuuucagauuuuccuaaugucuaacaugcacauccccuuuucagauggccuucugauugucgguguucacucggcuaaguuucccaaugagaagguccuggacaacaucaagagugcuguccucagauacaacaucacccacccugugguuaacgaugcagaugccagccuuuggcaggagcuugaagucucuugcuggccaacacuggucauacugggaccccguggaaaccugcuguuuucuuugauuggagagggacacagagauaaacuauuuucauauacgucuauugcuuuaaaguauuacaaagacaggggacagaucagagauggaaaaauuggaauaaaacucuucaaagagucucugccaccuucaccauugcuguucccuggcaaaguagcaguggaccaugcuacuggucgacuugugguggcagacacagggcaccauaggaucuuggucauccagaagaaugggcgcauucagagcagcauuggagguaagguuugcuccugcucaugcuguuuauugaugagucugucauaucuuuccgguuuaaaaauagcucaaguguauauacaaaggcagcccgaauugcccugugacuuuaucaccgaguuauuuuguuauuuagucugugugucugaguuaaccuccccguccucuucagagcaaacaaaacccagaagcuucacgucaaaaggagaucauuauguuauaucaucucuuagguguauuugugugcuucauccuguucuucaauagaagggucacauuuauuuguucacggaaauauauaccaagauuuuaggucaaugacauuuuaaauucgaguuucauauuuucuucuauaacaaaauauguccauauaguuuucaagacaagaacucaggacagugagcaagaaaccugauauuuacacuguaaaguaaacaggcuaggguuuguacauccucuuacuucucucuuguuucacccuuaagaaccccuccccuuuccaugcaagcccaggccaucuccuuucauagcucccugccuuagaugagaacacgccucuaguuucuaucugcacgaucaguaaaaucccccaaguacagucauacuaaucugcuuaucugggcugaacugacacagcaaauuagacagagggaaagccaccccuuguauauagccaaucccacuugauagcauaggacacacuuuaccuguggaaguagauuaaacaugguccuaagcuauugcucauugugugugcugagauguucucaucucuuaugucauuguuuaugguuuuuauuagaguaugugcuguuuugugaagcuuguuuguuugggcuacuugauauuuucaguuuaacaguuaugacaguuauuauuugaaaaaugucuugaauuuaacugguuuuggcuuugugauuuugguguauauacaugcuuaugugagucugugugcugauacaugcauagaagccaccuuaccuuuugaaacggucuuucagugaaccugaagccuauugacuuggccaggcuugcuaagcacugagcuccagagauuugcuugcuuugucccucuagaugcaacacagggcguuguuguugcucuuauuaagacagggucuaacugugaaguccuagguggccuggaacucucuauguagaccagcuuggccucaacucacacagaugugccugccaggaguaaaggcaugugcugccacgcuuggcuuucuguguaugcuggcaauccuuaugauugcacaacaggcacauugccagcugagccaucuucucacccagauuucaauaugcuauaacgugcgaagugauguagguaagugcucuucuucguaacagggucuuacauauacuucugguuguccuauagcacuuuguguagcucaggcugcucuggaacucagagauagaccugccucugccucuugaacgggauuaaaagcaugugccucuguacccagcccaacaauguucuuuuuuaacaaaaaccaucagcaaaugguauucucaagugugccucuaagaauacugccaacucuuaacauacucauuaacuugaugguuuuuagacagucugucucuagcucaggcuggccuggaccucacugugucccagacucaccuugaauucacagccaucuuccugccuccaaagugcugauauuacaagaauaugccaccauagccaccuaauauuauuuguuacauuuauuuauuuguuucuuuguuuguuuguugugcguuggggaaaagaagggugcuuguguguccugggauagucagaagacaacucuuaggagucagcucuuuccuuccaucguuaagguuagagucagacuccagcugucaggauuggaaacaggcucauuuacuuguagagccaacuugcuagucuccagcuaaguuuuaaaaaagaauucuuuggucacauauuuucaggaacuccugauuucaagugacuuagcagauucagugaguggucguacagugucgucagguuucuuaggcaggcuacucugcuggcgucuuguggagauucagucgguggucguacagugucgucagguuucuuaggcaggcuacucugcuggugucuuguggagauucacgugguugcacugugcagcauuuucagaucugcaguaccagccaucaagcucgucccccacccccuauucuuucugcagaacucuuaacaucagcaacaauaaucguauuaauaguaaugguggcaagccacaucccugucuuaauucuaagcacgcugccugcaucucuuuaucuucauuccuauaauacuaugaaccgggguauuagcagauauuauucguucuauuuuucagaaguaaaacuaagacauaaagcauagacccagaucaccaacuagagaaaguagagcugggaguuaaugggacuugcguggguccccuagccacuaggauuagucccucuucucacugcguaagccagugggcgcuugcaaagcucugugaggugggaguacugacucagagccucugaggagcagcucuguggauuacugugucacacugugccugcuuggagcuaggguguucagaacuugagaggccaucuauuaggccauagucacucugccugucuucaaguacacauggcuuguugcauggcuuagugacagugagacaccgggugggaaggagugucaccccaccccggggaucuugacucaagaguucaggauggcucucgagguguagagcuauuuacagcaguucgggugugaguauuuuucuggggaaggagguauauauaauuuuguuuuauagucaaacgagucugugguccaaaauuguuuuuuaaaaaacaaucguuuuuuuuuuaaacaaucccuuucagggcuagagagauggcguagugguuacgagcccuuguucuuucagaggaccuggguuccauuccuagcacccauguggcaguucacaggcaucuguuacugcagcuccaggagcucuaaugauccucugacuucugugggagucagcacacauggugcuuaucauacauacacgcaggcaacacauacauaaaauaaaccacguuuuaaaaacuauccuuuuagcugcugaacgguuagugauauuuuaaacauucuaguauagguagccgguauuuaaaaagcuuuaaaaauuauuuucugcuauauaugcuacugaaguacacuaagaacuauuacaguauaaguccugucauuacccaauauagauagaaacagagauagaggaaaauaccaaacauuuuuauuuuaaaauuuuuaaugauuuaauauuuuuauguguaugauguuuucccugcacguaugucugugcaccauguguguauaguguaguauacacuggccccaaagcccagaagagggcaucauauccugcagggacuaguguuugugagcugccaugugggugcugggaguugaauucaguccucuaaaaaaagagccaggacucuuaacugcugagccaucugcccaccccauauuuucguuuuaaaauagaaauacugaaauacugugcuauuuauuuuuuuuaaaucccagcauuaaaugcaaggguuuuuuuguuuuguuuuguuuuguuuuguuuguuuguuuguuuuucaagacaggguuuuucuguguagcucuggcuguccuggaacucacucuguagaccaggcuggccucgaccucagaaauccgucugccucugccucccaagugcuggaauuaaaggcaugcgccaccauugcccagcaaaaugcaaauuuuaaagucauuuauuuggaagauauuauuuugaaguugcuuuuuuagugugggaaaaaaaaaaucucacgacugucuugucuuuuaggaccuaacccuggaaggaaagaugggauguuuucagagucgucuuuuaauucuccacaggguguagcuauagcagauaaugucaucuauguggccgacacugagaaccaccuuauaagaaagguaaucuucauuuuaaguuaaaguuuuaacaguuccagucaagauaccugauguuuaucaggaguccggggucauccuugguuacauacaaguuggaggcuaggcugggcuaaugagaccuguauuaaggaagaagaaaggguggaagggagggagggaaggagagagggagggaaaggaaaaaauacauuaagguuucagagaaacucucugucaauauacuccuguacaaauuuggacuucaaagacuauuucuagagaauuuuuguaaacaaauggaauuuauuaaacaguguuuuguaugcuucauuuauucuguuuuagucacagaaaugauaugacuaucauauuccauuauagauaaaccuagcuaucuuaaacauuuccuaccaauacugauuuugacuauagucuacugaucauuaaauuauugucaauuuggacaauaacuaaucaaagugcauaugaucucccguguuaaguaaucacagcauugacauuuaucuuuaucugacaaaguuaccacauaucacacauauaauagcaagugugaggcuagaguguguaacgcaaccuuaguaaaggcccugugcuuucucugcugcugagcaggaucuggcugguuagaugugcaauagauauuuguuaaggaagaauauuacaaguuuuuauauauauauauauauauauguauauguauauguauauauauauauauauauacacauacauacauauauauauacacacacacauaaacuuaaugaaacauuucuugugcaaauuuauuuuuauaaauacauuuugugauuaaagaauuaaaggggaugugggguuuuuuuguuguuucuuuguguguuuuagucuugggaacuuucuagacacuuaaauaugcugauauacucuugucaaguuagggagugcacuuauuuggucacuaagcccuauuuuaugugaacguuguuaacauggcuguguguagguuacagaaaaaugcugugguuuuaauuacugagcucuuaaaaguugguucuucugaauaauuuuuaaaauuuaacuuauuuuuuuuccuccaugagguaguauguggguaauucacuccuuccuacuaccaggaaaugagagggacagauuaaauaugugcaugacaaguccucucuagccagccuucuaugacacuguguucagauacucaguauguucuguuggaauuagucacauauugaaagcaaaaguaacaggcauugaauaaaagauguacuaaacuucuuauagauagaccuggaagcugagaaggugaccacuguggcuggugucgguauucaagggacagauacagaagggggcgaggagggagacaagcagcccaucagcuccccgugggacguugcgcuugggaccucagguauggagcugaacagaacaugcugcugaugaaaaugaggucuuuaaaacauucuuuucugcugagcagugguggcacaugccuuuaaucccacuucgaagucaaaggcaggcagauuuuuggguuugaggucagccuggucuacaaagcgaguuccaggacugccagagcuacacagagaaaccuuucuguuucaaaaacaccccaaacaaaaaaauaaacaaagcaaaaaaaaaaaaaaaaaaaaaaaagaaaucuuaucuaauucuuuaauuacaaauaaucuugaaauguuuaauuauguaguuuguuuuguauguuuguacuuauggcuuggaguuugcucauuguuuagagcaaaggcaaccauaauauauacaaauagaauacauuauaugcagcauuucauuauacuuuacaaagaaagauaaaaaugucugcuuagcuggcucacgcauggaucaguacucagugugcgcuaaacucuaaacaauuucuccugcccugcaccuuccaguugauguaguuuuacacaugugguuucaugaguuaaguaacacuuaauauuuuucuuacucuaggugaaaaagaaacaguuuucacucuuuuaaaaaaaaaaaguccaaauauggaaauaggauagcaucuuuugauuaauuaaaaaauauuacuguaaagaguuaggcagaugcugauaauaaaugagacaugcuaucuuugugccauauugcccauaugaacauacuaaaagaaacaccaguauucuuaucauugguccucaaugcugaagugguuuuaucuguaucuaauaucagacauaaaaaaaguagaguccauggggacuagaauuuggagcugagugguccaugugaucuucgugguguauucugaggacuucacauugagaauucuugcucugcugugcuagugcugucucagagagaggggaagcaaugcuuuauguguaagauucaugggaucuaagaacaaaaaagaaacacggaucacacaggcuuaaggucaaagucaggggacagggaucuauacuuuacccaccaugaggcuguggaaagcauguggauauagauaaauacagagccagaauguucaacguacagcauuucuaucaaaauuugccuggcuuaaaguuacaauguacuuuaucgagcuagauaaacauaaugaccaaggaauauuuaacguuucauccaggcgcuuucccaguuacuccucaugguguugcugguuguuuaccuuuguggugagaauacauccaucuuaccccuuaagagaaguccuaacuuuauugacaaauauugccgggugugguggcgcacgccuuuaaucucagcauuccggaggcagaggcaggaggauuucugaguucgaggccagccuggucuacagagugaguuccaggacauccagagcuacacagagaaacccugucucgaaaaaccaaaaaaaaaaaaaaaaaaagacaacuauuauuaaguucuaagucaggugauaugucuuugaagagauacaucuuuauuaacccuagcuuucaaguccugcuuuaacucagcuccugucucugcacuuaaccuaauucugugacuaucuuguugugguuugaaugaggucuucauaaaguggcaccugaaugcucaguucccuguggguagaacuguuugggaaagauuaggaggcauggccuuauuggaggaggugccaguggggauaaggcuugaggugcccuucccacuuugcacucacucugucccccgaccccaccccaccccucuuucugccuccugcuuuuggaucagaaguaaacacugaguugcugguucagcaccaugccugucugccucugcugcaccugcuaugauagcuacagacuuuaaucuucuggaacuguaauguaagccaggcccucuucuccucaguaaauucucccgcuauaaguuacuguggucauggugcgccuucacagcaauagaaaaguaaaacaggcauaucaucacuccagcaggugggcacuacguauuccugagcucaaagggugugguaugaaugccccuugaaggccugccugcucuggguggucaugcugucucuagaguuaucugggagcuaaucugggugucuguaagucuuugcuauguagacuuuacaaaauggcuacaaguugggcagugguguuucauaccuuuaaucccagcacuugggaggcagaggcagguggguuucucaguucaaggcuagccuggucuacagagugaguuccaggacagccagggcuacacagagaaacccugucucgaaaaaaaacaaaaacagaaaacaaaaaacaaaaaauaaauaaauaaauaaauaaauaaauaaauaaaauggcuauaaaguacuaaguagccccagaaaucuuauuuaacauuagggacaauuguuuggauuuuuauaagacuuucaaagugauaaguaacccaaaacaucuucguaacuaaagcuuugaauuacuuuagaguccuaaccgauauuaguguauaauucuuugacaacuggaucuaggauuagauuaauuauucuuacuaaauucuuaugugcuugaugccacuuaaaauaucucuacugaaaaauauauauaguauuuacauuuacaugugcauguuuauuucauguuacuuauaaagccaaaauacagccccauugggagacuuuuugaugcuugaguuuuuuacuuuaaaaugacaucugacuguguacuagagaauuuuuuuucuuguaaucugaauagcuaugguguuuuccuaaagaccagguuguuuacauuuuuuucagauuucauuuaggcucuggacuggauuuugacuaugauuucuauucguguuguuggauugaucccuagggaauuuagagacaauuuaucuucaacacagugugaugccacaugaccuauuuuguaauauuagggcacucacaccuuucuuuuguaaucuuacuggucuuuaacuuucuuauucuaaguuuuaugucauuaaguuugaucauuuguaaaacugaaguagauggagagccaguugagccuaauuguagaucucgcccagcaguucucaaccuuccuaacgcugcagcccuucaacacaguucccuagccauagaauuauuucauugcuacuguaauuuugcuguuguuaugaaucuuaaugaaauaucgguaggaaccaucuuucaugccauuucaguccuguuuguauuuaaguuauaagcuuaugucacuggcucaagcagauguuaggguaaauacuugaaaguuucagcaguccgggaaagugguucuucuuaagcucuuguucuaauguuucaaaauuuuuauagaacuuuguuaaauuucaucauaauucaugauagugagaagacaggauuauaggaaaaaacaugaaaaauggguugcuucguaauaucuuuaaauaguagauucuguccaguguacaacaguggaacacacuacccagaacuacaggcaagcaucaggaguguacgaaaggaaccucuguugaguuuuguguagaaguuaagauacaugaagcauuggaagaugcauccacacagauuuaaacuuagaaagaaaugaaaaagauaaaauuauacacuaguggcuucugaaaagagaggguacaagcgaucauagaggcucacuuagaguacucacucagaugcggcugcugcugcucaggcuuguacaugccugugcagauaggguuuaguuacauuacucugucacguggagaggugaguaaagcgaauggcagguuacagaggugauaaccguugacugugcacuugaccgagaaguucagcuuggggaaaaacauagacuuaaggggcuggugagguggcucagcaguuaagagcacuggcuguucuuccagagauccugaguucaaaucccagcaaucacaugguguuucaugacccucuauaaaaaagauuuggccauguagguauacaugcagacagcacucauacagaagaaaagaaauagacugaaaaaugcuuaguuauucuaaauauauuuguaauuuguaaauagguguauuuuuaaauacaccuguacauuugacuuaauuauacaauugcugcaaucaaguaaaaauaauuagcaaaguggauuuuacaaaaguaaauuucaucuuaucacuuuaaauaugauaacuucucugugagauaguggugucuaugauggauucaucuuuuaccgacuuuuuuuuuaccacguuucuaaaagguaucucucuccucucuugaugcuacugaugccagacaauagccuguaguguguuuuaucguagaggucagagccugccaguccugagugcuucagacggccccugguucagaaugaguuacagaaaggacgcugugcuuaaauccuguuaaccuuccuugacucuggagucagcauuuuccuuagauucaaacucacuuuucuuacaucaccuuuguuuguuuuuuuuuaagauuuauuuauuuguuauaugugaguacacuauagcugucuucugacacuccagaagagggagucagaucucauuacagaugguugugagccaucauguggcuacugggacuugaacucaggaccucuggaagagcagucagugcucuuaaccgcugagccaucucuccagccccucuuacaccaccuuuaaugccuggaauccagcaugaaugugcuuagcugauaguuuguugacaaaaauauauuuuuugcacuuauaugcuuagauguaucuaucacgugacaucuauaaaauaucaguagguauuuuuguuuuaaauguaauccagugaugcaggcauguuuaaagggauuuaugcauuguagccuguguacuuuuauuuugaaaaacagcuguacuuuuauaucuaaaauuugauagaagauucuuuuuauagaauaacaguauuuuauauaaaauacucugaugaugcuuucccucccccggcuucuccugcguccuccucagcaccccagcuccacucccuuucucuuccuucucuuuaaaaaaacaacaaacaaacgacacacaaucauauuaauaacccacaaaaucagaaaucauguuauagacaaaagacuaauuaaagaccaaaggagaaaaaaucccaaacaaagcaaaugagacauaagaagucuaugagguuguuuuguguugggcaucugcugcagagcauggugcccacccucaaguguaguuugcauauccaugagacuccauuggagaaaacuccuuagcuuccuuagcaaggcucaggugccgauggcuucuuagcuagggcugugagcuccaugucugcuucccccucagugcugggccccaucugguuugaaccuguacagguccuguucugcacugucccugugaauuccuaugugcaucaguccuguuggucuagaggacaguguucccuggagucacacaucccuccaucucaccucucuggcucuuacaauuuaccuucuccgcagcagaaaucccugagggcugaagggagggucucaugaagaauuccauucuggacggagugcuccacagucucuuacucugcauauuguuguggugcucuguguuaguucccaucgauugcaggaggaggcuucucugucagaauauuuuuaaacuaucuuguuucaaguuaaugagguaaaauuuagaaacagcaaauuuuauucuugcuacauagauguguguuuuuaaucaguguauacaaucauguaacugugaccacagucagggucaccccaggaaguuuccugugggucuuugcucagucuccccaugucaccacacauacucuagccacuggcagcaacaguuucguccuccucugaacagcucuuugugccugacuucuuccacugaggcuggugcucugacgucuuccacugaggcuggugcuuucaccauccuguugggcuuugcugucucucguugaccacguggagcucaucucaguucauucagugucucuaguugcuaaaagcuguaaauacaguaccacucccacuaacauuucugguuucugcuugugguaauaauucacucgcuucucuuggguaaaugccuagggaugaagcugacagccauguuuccccagucccagcaugugcuugaaaucauuguucugccauaggcgugguucacguuuccuuuaaaccaauugucuuaguuuggguuuuacuacuguguagagacaccaaaaucaaagcaacucuuauaagggacagcauuuaauuggggcugucuuauaguuucagagguugaguccauuaucaucauggcaggaagcauggcagugugcaggcagucaugaugcuggaagagccaagagcccugcaucuugauccacaggcagucaaaaggaaacuggcuucucaguacugggcagagcuugagcacuaggagaagcccucaaagcucgccuacacagugacauacuuccuccaacaagggcacaccucccaguaguaccacucccugggccgagcauauuuaaaccaccacaccaguuaugcugauuucuugucuuuuucugagcugggaaaauguuugaaccuuccuuucagaagacacauugacuucacagguaaucuuggauugauaccugguuuuugagcaguuugcucauguugcuuuugaucuuuucuauguaaaguacgcuuuuccuaugguugcuuucaagccuuucuuugccuuugguuucagccuuuuggcugugaauccugagucaccccaccuggauggacugcugugguuugaugucuuccuuguucuguaguuggguguccuucauuguuuucagggauuccucuggcaucuccucucauccuuacuuuuuguuccugucuuucuggaccaccagauacugaguucgccuuccucaguguuugucccagagccuuggcacauuucccuccuugccuuggcuucccuuccucguugcaguagcuccucuugaccugccuccuucuuuccuuggcugugucugucagcugaugacccuguuuugaaggauucuucauuuucaguaucaagccuugaaagaaaaaugguguuucuacuuugcucuugguuuuagguucugucucuacagaaguuucccauccauuaggaacgcuggcucccucuucuuuguccuuagcagacuaagucagagucugagcccaauauucugaauuuuguucuuuaaaaaugaguguuguccacaucuccucuucuccucuuuuugcuuucauguuugucuucuccucacuaauuaugucauuaaucuugaauuaaaggcugauauaaguaauacuucugucaugauggagaacucagucaguuuggauggaagcugugcuuagcuggguucuguuauuguuaagauuacugugugcuuaggagccuuccaguucucuuaguugggcugguugaguggcuccagugugggcagugggguguagcugccugagggucuucuugguggcauucuuuauccuugggguucuguucugucaucccaguacacagagccauaucuugguugucucuguaugcuugucucuagaacagaccuuugcucuucacuguccuuggcacuccacagucuugggaagaccuugcauccugccuccccagcagaagcccucccuucacacagcguggagcuucucugcugccuucccucccgcagcugcaguccgucuuucccugugcuuugggugacacaucacugcuuuucccuggaggcacaggcggcuuuaugagagccuucaggaugguggaaaccaguguuuacacugcagauuucacaggggucagcaggagggugcuggucagcuuuuuucaaagcuggacugggcguuuuucaaaucucuuuuauugaauuuauuccuuuuuuuuuuuuuaaagaaaucuuuguugguaauuauacuuuaccuuugaagaacuucucagacauuagugggagugagccaguuucucaccugggaguaggaagcugcaguuccauccgagcaucucaagucaugucacagagacuuuaguagucaugaaagcuuuaggccuuagcuggcuaccucucagcuagcuuguauaauugaaauuaaccugcuuauauuaaucugcauucugucacguggccuguuaccucuccuucagucucagcaccucugccuuuguccaugucuggcuggcaaauccccugugcggauucuuucccagaguuccuaucucugcccagaacuccuacccauccucuccuacuuagcuauuggcuguucaacucuuuacugaaccaaucagaaggugucuuagguaggagaggaaggacagagugugugugugugugugugugugugugugugugugugagugugaguauugcuuuuguuccacaagguaggaccuucauguggugcuguauagagguaaugguaggucuuuuaucucauuucuguuggcaggagcauguuauguuuauacuguuucaucauuaaauaugaugguugcuaucaauuaccuugaaaguguuccuuaucaaauucauaaauagguuaucugugggucuuaguuugcucaguuuuuaugauuagaaacauuaagaagcccugaaaggcugcauuuucauauguaacucgagaauucucagcccuguuagauuccaagcccaaccccauuguaaauuaucugaaaaaucaaaguaaaauccacagaaauauaauccaguuacacuuagauaucuuuaaaauaugaaaaauaaauagaaguaauuaguaauaaaauaaggguucguucugggaugaccuugguacugucucucucacgagcagagcugauuuuggugagguuugcuccccucgguggugauuuuggaggauaaugguacagguuugccaugcuggguagggaagcaagagucugaacagagcuacaagcuggggacugccagugcgaguccuaggagaagggagagggagcauucuugguguaggaacugagagccugcagguacugucuaggacccagcacucaccaguacuguguggugcuuagcuucccaagccuggacucauccccuuggcuaucuuuaaggcuggacagucagccucacuuggcaggugaagaaacugcagccaggauucagacccugaacuauuuggcuccucgaucauagaaaggaugcuuugaguccucuugugucaaaggccaucaucacaccaggugcuuaauuuaauuccauugagagcaaauuaggagagccuaguagugggcuucaaacuguaauugucuacaguucucuguguauuagucuaaacacguuaugggauaaauauaggcuuuggaauaucgugagugggaaacauuccagacguuguaaaaguacgacccauucgugccuuuguuuauuucgcuuacugaagcuuuucuguuacucuguuguucauuuccuugguuaauaauaccuuuaucuaaucaggaacuugaacucauucccaugguuugauaugaucaucguagguuguuucuguugaacuggcauguacuggguccuagacaguaccuuuauaaucuucgauuugugaugguuuuaacacaaguaagcaguuguaaacauugugcauuguggauacuguguguuguaguacaguaguagucagugcuuauuaucgaauuaacaaacgugagggagacauuguguccuacucuuuacccucagugccaucugcuccaggcuguugaguuuguagaucuauuaugcuugccuaaugcaacaugcucuaaagguaagauccagauucaugaaauaaugaucauggcugacauuugaguacugcugccuguaagcaguucucaucugaaugucauuauaucugaaauaauggaauauuuuauuagcuuagaugacauagucauuuuagcagucccagagaguagcccuagaauaacugaugaagugauguguguuaaaaauuaauugugcaggccuuuugaucuccuuuuaaagugauaaagcagagacugaguccccagaacaugggcagcagaauccccguugguagcacuuacaucugcaggcacgguugugugaaggaagcacacugagguacuuccugcugcagagcaguugagaacagagagcggaucagcacaccaugacugaggcguuguugcucucagccuggcuugggcccagaguucaguuccuuccuuugcuggcuaguugaccuggcaugcuagcuucccugugcuugggcacucaucuggagugggacuugcuaacaguaccuaucucaggggccuuuccaaagucgggaauggguuuuggaaagcgcucagagauauaguauccuugauaacuugagaaccgucaucauuguacguuguuucuguuguuacuaaauuaaaagacaucugaaacuuauuacuaauuaggaacgaauacccuucucaucacaaaauacuugaaauuuaaaaaauuacaaauaaaauaauucuguaagauaaugucuuaccagacuacuuuaguuaaagcgucucaguuacuucagagugccuccuaauuaaauauguuaacagaauaaaucugaggagcagagcuuuuccccuuauaauaagugugacaucauucagauuuagacaaaaauaagaugguaaaauucaugguaguaaacagcauauuauaauauacuguacccuuggucugcuaaacuccuugaaggauuuuaaaccaggcccgagagguggcucauuugcugaagggcuugccgugcagcaugaggaucugaacucagucuugagcacccacauaaaaagcucggccugccucagagcccugggggcugagauggaggauccuuggacuuucccaguagccagccaguccagccagaucagugaacucuagguacacagagaaccugucuaguaaguacauaaagcagagccugacugaaggagacacaacauugaccuccagccuccacacacacaugugcacacuccuacagacacaaccccguaaguauuagaggcuacuagauagugcauuugcaaaugacugaucuacuuugugucugaauaucaaaucccaugccuuugguaauaaaaagacacauuccuuuagcuucuuuuuauuguuauuuuguuuuaacacagggucucuacuuuguaacccaggcuggccuggaacuugcuauguagucuaacaggcuuccaacuugggcuucuccugccucugccucugccucucugccucucucugccucucucugccucucugccccucugccccucugccccucugccccucugccccucugccucugcaguacaggaaugggccaccacacuccucugaaaucugccucuuagccucugggacuacaggaguaugcuuccacacugcucuuaaaagcaucacuucuuuuguggaaauugccagaguuuucuuagagaauaucagcccauuuuugugucacauaaaaaauguuuuaaucgguguuuaaaaacauuguuuccagagaugcagauugacauacugcuauuaagaauguguggauuugguuuaaggaaauggaaaugcuaauugauuuaauuuugucauugcacauuguaaacauguauugaauuaucacccuguacugcauuuaauuaaaaaaaauaugacagcuuuggguucucaugaaacuguugcaggugagguggaagguuucuaguaacacaucuucccugaggaaccguguucugaaacagcugauuuauaaaaacuaguaucaucuauggauuucaauuccuaaaaaguaucauaguaaccagauauguauauaauacaugcuacuuauuuucauaaagguucagagguccaaagaaaugacauccuguggauagccauggcagggacucaucagauaugggcacuccuccuagacucuggcacacugccaaagaaaagguaaguggcuguguccugggacagccguccuccuuaguccccagcuucccugcccaggucaccgugccagggugcgcacacucagccacauggcccaacaggcuucuugcucucucgaguggcuucacuggggagcauuggucugcuccccaggccgaggaggcagcugcugucaggagcucugccagcccuucuggcagagauagagaggaggagguggugagucacuagcugguucucaaagcugcugcucagaggugacauaacgucacuuccacuuguauuucaucagccuuaguuaagccuguggcugcaucuaauuucuaagagccugggaggagccauucuucugagugccuagagagagaaccagaaauguuagguggggcuuuaauccuucacaacauaaacacaguuccugugucugcagucacuccuucaggugcuucagagugcugcauggcaguccuagcucuccuuacuguggaagcacaggagagugagugagccccuuuaccucugucauuuuccaucauuguauguguuugugucaccuaggggauugcugugugaagaguuaggauagcauuggcaccaggcgggcacgugaguguggggagcaguacuucuccugacucccccuccucccucagccucaggcggggcuggcugcacuccccuuugcuccucucuucucugucucuuggcucaugccugauuauaacuguuucuuccuacuagacuaccucuuaaagaaaugagccugguuccauuuacucaguguacucggcccugugcuguaucuguuagauaacagcccaguaagagccuauauguagaauaaguaagugacugaaagucuguccugugccugcggaaggcacugagccaggccacuggagcugcacacuggcuugcccauuugcggucucacaaaccuaggaccacuuguucagggugguaccacccaaagugggcggggcccuuucaugucaaucaucagugaccacaaguuuguccacaggucagucugauggacacauucucuguugacguucccucuucucagacgacuccaguuugugucaaguugaccaaaagcugaccagaacacagucacagaccacaaaguuguuauguaguaauaggaaguagguacaagcuuacaagcuaucacaauuaucuuugguugcuuuuagcuuuuuaugcaguauuucucuguguagcucuggcuauccuagaauucacucuguacucuagacuagcgucaagcucagauccaccugccucuaccuccugagugcugaaauuaaaagugugcaccaucaccgcccagcccacuacacucaucuuuauuuguagaaagggacagcugucuagcaaguucaagaccuccgguguccaggcacagguguggaacgcagcuguguagugguuuaugacagucacgcaucugaaacagcaguucucaaucugugggcugugaucccuuugagacugaaugacccuucauaggggucaccuaagaccaucagaaaacacagauauuuucauuaugauuuaccuuaguaauaauuacaguuauaaaauaacaacaaaaauaaguauaugguugggagucaccacaacgugaagaacuguauucaagggucgcagcauuagggagguugaggaccacugacauaaaauguucguugguuccuuucacuaggcacuguguuggacacuagggaugcaguuagaugaccucuguguuagaaguaaaaggaagacaugcccauccucagaagaaucagaucggcaaacagugacaguagagagugcuugugucagcagcaucugcgcuccuucaugccgagauccuuagccaagggauuugaagugucauggaggacuucuguagagaggucuuccaagcugagcugaugcugcuggugucaguaacaucaggucuugccacaccuugaguccuuuuaagagaucuggacauuccaaauguuguuauagaaaguuuuaaucuaggagugaacugauuugauguguucuuggaagaacccuuccagcacuuagaguggagcaagaccauucaggacacucuagcugucaucuaggcaagaggcaguagugacgugagcaguuggguuaccaguggugcaugaggugugaguacagcagcagccacaggucacagcagcugggauguccuggcagggcugccuaagucuccuugucagaaggcucgucgauauuuauaguaggaaaaugauugcucaaguuacaucagucugcauuuuaauuuugugggugcauugcuacaaagauagugucuaauacagacuugcaggcagugcuggccccuagugcuuagugucagcucacuguugcaccucuccuucccacgggacucuucucugacgugcuuagaccucuucccucgcaguaaguguugcacgugcuucagcaguguguuacucauccuguguccucgcccuuacccgccuuugugccccguagcagucgcgggugcuacucgcacuggaccucuguguggugugccagugcaaggcggugaucucauggccucgcccucucccucucucuuggcgccuugucuuccuuauaaucauuuuggcauaaauuuaaaaaucaaggugucaacuucucuguguuacaaaagaaauuaguagggguccuuuucagcaucuugagacagagcccucugcaguugcaguugcagcugcccagaacuuguuacaguugugugccgcucugugcugcaguacuucagggagguguuuccuggugcauguaaaaaugggucuuguauaacuauucauuuaaugcggucacuacgucauuuccuuaaaauguucauacugagagaccuggcuuccuucaaucugcucacugcuuuauagaagacauagacauuuuaaacgaccaaaacuagauauucucuuuauuaguaguucucuucuagaaccugauauuguaugaaaguaagaaguuaaaaugagaauaaaaucaucucauuauuaucucauaaucugaucauuauuguaguaacgucagggauuucuuaccggguauuagaaagugauuucaguaguugguuauuaugcuaaagagaagagagggcccccuacuuaguagcucucucucaccaagagagagccuggacagccgcagcagugggcaggcaguccgucacugguucuguggaucuguguaacugcugucauagucaaguugguuauuuaugccccuuuagugacucaugaacucaccuaugagcuugucuuucagugaccuaaaaaaaggaaccugcauucguuuugcuggaaguggaaaugaagagaaccgaaacaacgcauauccucacaaggcaggcuuugcccagccgucaggccucgcucucgccucagaagagcccuggagcugccucuuuguggcugacagugagagcagcaccgugcggaccgucucgcugagagacggagcugugaagcaccucguaggcggagagcgagaccccaugguaaagaaccugucugugcgcacaucccugagugagccauccauggagugcagggguucauuucuggccugucuguaauaacaugcagucaaagcagagagaguguggcuauaaauacagagcugggcagugguggcgcaugacuuuaaucccagcacuugggaggcagaggcaggcagauuucugaguccgaggccagccuggucuacagagagaguuccaggacagccagggcuacacaaaagaaauacaaguaaagcccucccucugagaaaggcgcccaccugacuacauacaagcauucaggggacgggaagagagugauugcaccggguuuguggcaguggguuagcaggagaacugcacuagaugugagccuacugugggcaagacagcauggcaguuaguagagugcagagugagccuacuguguuccccauucucuaucgcacgcuggaacuacugggaaaagucagagcuucccagcuuuagaaacacuggaaucuuaguuuucacuuuaccuccuaacaaagcacugaaaauuuuaauaacugcuguuucuuucucuuuaaaaaaaaauaaaagaauuuauuugcuuuuggugauguugauggagcaggcaucaaugcgaagcuucagcauccacuugggguugcaugggacgaggagaggcaagugcucuacguggccgacuccuacaaucacaaggugagucggcugaaggcccaugugccucagaccagcaccacucuagauacagaaagcaucuguacccugggcguuacagcccucagcgcuacagcccuuggcgcugcacagcuucuucugggcucuucuugcuguagccuuacggugucugaacugagggaaaugcuaagcuaauuccaggggcugugaccuaaauguaugaauugugacccaucaaaggugcuuaaguaacaauggcaggaaaaagggggccuuuuagggggaagcgugaaccagcuguuggaguuucguucuguugcuguaauaaaacugaccaaaagcagcuuagcaaggauuuucuuggcucauacuucaagcguaaauccuucauugagggaagucagggcagaaacuugaaggcaggucugcuugcuggcuugcucauagcccaggcuuagccagcuuucuuaugucaccagaccauucugcuacccaugggugcuacccacaguggggcaagccgccccagaugaacgaacaggacaaucccucacagacauguccacuggcagucuggccugggcagcccucucuuuucuauaacuccagauugugucagguugagaguugaaagcuaacuagggcuagcagaugaagaguuugaguuguugcaguuguagugacaaagagcaaauaugucugucuucaguaccauugccaugucugucuagauguuuccacucauacuguagaguucugugcacugugaugagcaaccaugagcuuagugugcuugagacauaaccagcagggcuuacaguuaacaaaagaaacaguccuuagacagugcucucaagaagucagcauaacuguggacguguguccacaaugggaaaaaagcuauuuuuagucccagggaaaaaaaaaaaaacagaaauggauuuacaacaaaacacaguauugcuaagauuuuaaaaucugaaugaaauuucugaugaaaugauguaaaugaaucaaauacugggauuuuuaggaaaaucuggaacuggcugcucuucuaagacuuaauugagaauauuaauggcaguuggaguccucugguugcccuggcacugcuguaaacaggaaugacggcaggggaaauguuuguucuuuuuuccuuuagauuaaaguuguggauccaaaaacaaaaggcuguacaacguuagcagggacuggggacgccagugaugccaguuccaguuuugcggagucagccuuuaaugagcccggaggcuuguguaucggugagaguggucggcuguuauauguagcagacacuaauaaucaccaaauuaaagugauggauuuagaagcaagaacaguuucugugguaaguuaucauagaacauagaggauguggguucaagaacaaugcugagccuugacgcaguuuuguuuugucugucucugguauugcuuggcacauggagaaagggagucggaaguagguaccccuguugcauucugggauaacuagaccagaaggcuugcuuugaggaucuccuguuagucuuagaauauauguuccaucuguuuugagcauuugaggaaaaugcugaaauuuggagagaauuggaugaaccuuuaauaaaaacagagaccucaggucugcuuuuaaaugugcagaagucaugaugcacacuguaucugugcgccauggggacugguuguuuuaguuggugauccuagaucguugucuccugucugguuccugugguuaauauagcaccaaauugucuucaaaaaucccagcuccccaaacucugaaaaucugaugggcugcagaaaacuuggccaaguucaaaacaguuuucaaggagaaagucuuuugcccacuaucuuuaauguaucuaccugguaaugaagguggugugugugugugugugugugugugucagggguggcuuuuuuuuucuaaguaguguuugcaagguaauuacuuuaaaauccacagaauaguaucaaaaaauguuaucuauugaauagauuucucuugguagugaaaguugugacccuguauccuaaccacuguccuuaaauucaaagaguugcuuuaauuuccuacuauuuacaaaccauggggcaguuaguuuucuccugaguccucaggugucugacugcugaggcaggcuguuugucuguacuuggggaaauagucuuuagacuaaauggcaucugaugucacugauagaucuaaggcuaagcucccucgcuuugguccugaaagugcucugcuuuaacaacauguccucuggcccuccagcucccagucugcaagucugacagugcugugguagauggcuccuucccuagagagaaacagaagacagugcccaaggugccgaagucugccgcacacaucggccuccccccugugacggugcauccgggccaggcucugcagcuuaggcucaagcuccagcucccgccaggagcaaagcugaccgaaggcgcgcccagcugcugguuccuggaagcugaaggugcgagcccagcgcuacagagagagucaugaaucgcuuggguucaggcugaugguuucuguucacuguguauuucucuguguguuugggcaggguuugagggaccuggugugaagcgugacucuagcucucaucugcuuugauguguuugcucuucccucuucccucauauccugggauuguguggccugugagagccccccggcagcucugagcagcauggccuuuggaaaugaggcuugccugcaugugcgccccauucugucuucuucacaucauguccaaaaagagcuacugacaguuaaagccccaucugugaucccagcacucaggagacugagcuagaagaaccagaauuuugaggcuagccugagcuacauagugauuuccaggccaucuguguuacagagugaaagccugcccaaaaaacccaaaauuaaaguaauaacaaauuaaaggucugaugaggagagaugguggagcuuccuguuuaguaucucuuucugaaacuuccuucucagcccugugugcacaaguccuccucucacugcggacagucaggauccgugcucugcuugcugcuguuagugcuuagacaugagaaccgcuguaccacagugggaagcaagcaaggcuaaagugaagugcugggguccagaacucucaaagcaggacuuggugucucagaugcgcuuccuccguccugucucccacgcucuuucccacgcugucacucaaucuuccauuuccucaguuccuucucucccacacccucucacacacuuuuuuuuuuuuguacauuaccccaaucuuggccucaggccuacuuaccuucauacauucucaggacagaagcugcuggucuguaacugucagggugccguccagaacaaggggacccuuuauguggacuugcuaguuacaguuugaacuggcuccaaggacacucccugagccuguccaggcaaauccaggcacccccaagccccuuucugggcuccggaaggcccuagacauaugaaagcagccccuuaguugaagaccacauauuuaauaucucucuauguaauuauagaccuguauaauuuuuuuuaaaauaagauacugacaaccuuuuuaaugcugcauucuuaacauccagauugagugcugagucguugcccugcaaagugaggaggaguugaagugaaggccauauacuuagaugcucacugucugucuagaauaucggcucuguuuuuacuauccagggcaagugagguuuuaggcaggggucauaguaauuuaaagauucuaaaagcauuacagaacccaugucuacacuuagagauagaccucucuuuggggcuaguuuuuuagaaauaguuaaagugcuuagaguuugugacaauuuuaaagaacuacuucauaagucauacaugugaugaguaugaaaacauaaaaaaauaaaauaguuggugaauagcaguuuauuguugucuugccuggauuuagaaaucacugcagaguugcguagacauuuguauucucuaaaguucauuuuguacuuuuuagacagggucccugaaagucauuaucccuuuggugagaacuggucuccugucgcacgggucuuauguguauuuauucagcaguagaccuuccuuugagccgggggugugaugcccuaaagagccaggccugugaugcucagcuucaguuuaggagauuccacagagggcaggagcugcaguaaugaagugcagagguccucugggaugcucucuucucccagacacugucagagcagagugugcacucgggcucgcaccaaacgugcgcugauguaggcucuuucccuuagaaguuuccuaccugugucuuuucaauauauguguauguauuaugcaugugaguguguccacauguaugagcacacauguauguauacauggacauucacauguuugagcaugcaugugguuaaugccaugugucuucuuugaucucucuccaccuaaaauacggagaaaugaugucucaguaaccccgagcucacugcucugaauacuuugacagcuguggggauucccugucccaacucccguguggggauuucagaugggcgucacauagacccagcacuuacgugaguucuaggugucugaauucugucucucacacuuugcccaucgcugugccucggccucuuguauuuuuuuuuuuuauagucuuaauauucucuccuguuuucuaggcaaugaauggcuacuucaagaacagaccccaucuggagacauagagaauauuuccaaucagccggcgauuucccugcagauuccuacccauugcuugucacuggaagcuguggugucugucgucguguuucuuuauuacugcagugcagacagcagcgcauguaugaugaagggagucguguucaggcagccuuugcagauaaccagcacccagccagcuugugcagcuccuguagagcucgcauacgcauucuagaaggcuggccagcagcccucagcacaggcccuguccauccugccauucgucgcuuagggaaaaagcauuauaguaacccauugcucaguuguaacaacugauaccaaaauaaagcugugcuccuuauuaguauuuuaauucuaaacaaauuucuucauuuuagcugugugcuagccaagucauugaccaucauuuuaccacggcacuguaagcuuugcuguuauuuguuuuaaaagcaacaguccaugcuauaucagagaguauuauauuuguagucaaaacuaaucaugccagauaguuuaaauaaccugccuuuaucaguagugguuauccauucguguguaaauuuccaguaacuugagaugggccuaagcugugcgccuuugugucaggauaccugcuguuuagugucuaaggucugcuuaaagccagaacagaaaguauucacucggcacaaacucagcguguaugaguaguuacuuaccuccggugauuuuucucacuugagguauuuuuaaaagagaguuuuaaucuauuuuuauuauaaauuauuuguuuuaacauucuauuauuaaugccuuauaacuuuauauaaaaaagaaaaauauagaauuucuaaaggcaugcagaccuaccuuuaacuguauuuaaugagcauaauuccuagcaggcaaugccuggcucccagaggcaugcugaccuggguguggguggagacugcuguguugcugugugugauggguuauuguaguggcuaggcuggcugucaugagcaucaugcuauuuuggaaauuuagaugucaguuuuaagaguuaaguaacagaauuguuggguuugagauuuuuguuacuguuuugguucccauauuuagaauuuaaauuaugaucauuaauucugauauuuugaaaaaucacauguaaaccuucaauuugcuauuuucaggguauaguuauacuaauacacuuucauuuaaaauauuagggcugaaacacacagugauuuacugauacuguuuugguauguguuuucuuuaaccccguaagaaacagcacuggaagggauccuggagagguuugguuuucauuguuaacuugaauuaucauagauuaucaucauaacuguuuaagagccuugcucuucuaaaacugaguggacauguguuuuacuaagacuacaagguuucagaagcauugucugagccccaccuauaaauuuaauaagcauuuaagcauagucuaccuauuuauuaguuaauuuuugcaguaguuuuugauagguaacauuugcuuguuuuauuguucaguuaacuaaaaaaaaaaaaaaaucugaagugaaaacuugcugacuuccguuauuaacuuagaaaugcuguuucucaggagcaaggcgaacgugaaagggagggguccuguuuagaguugcccgugguuaccucagaaaccuuugcaccuagaaccagccaaggcagcggcucugcagcuccagccuggagcugguggucuguggagggccucagagcgccgcagcccucguugauuuguuggauuccucguuuauuuccaguuggacgggaugagaauauuuugguucagucauuuccuguuugaggacauaaacaguuucacucucuaaaacaggguauauacaguuuagcuuguguggaaauuauuuuucacucugaaaauacaagcauguauucuguaguuugauguaccuuaaaaaucccaaaauauucuuuaacucccuugauuuucccuuugccuggguaggaucuuacuugagucuucagugacugcggggaucucgguggcugcacaccccacccaccugccucucugcacugcuggucacagcagaauguuaguggggauggacggagaaggugcucagugagcagagugcgcuuuccuagggucaggacugacacagugucugccaggaggaaaccuuggucacagcacuucuggagcugcagcgucuccuguccucucugagagccuuguaguuguccugagacaacucugucugccuuggggcucacaccacugagauagguuaugugggccucuguuuugcagugugggaaaucuaggacuuaaugaacauguguaaccaugguuucuccacauacgcggaacugacugucuuucuccauccagggaaaagucuucagcuucugccuuugccucuggcuuggcaaagaucagaguuguuaacucauuuggaagaugguucuuugccgugcgcagaggcccuggguucaguccucaggaggaaaaugaaaucacgaaaagcuauguuuuguagugaacaguaacauaaagccacgugcaggggccgugucaccuaagcucuaaaugagcaagcccgugcugucucacugaaauucuaccucugagaauacucaauggccaguacuuuagagaguaaucuaaucuucucaaagauacuaaaauaaucugaauuguaagcacuaauaauuuuucuaaagccacuucuguuaccaaagaugggggucuauuuagaguccuuucauuuaccaguuuccuuuaaaauuguaguuggugaggacagggauaauuacgguguuuuauuguuuagcaugguauaguggcaggaguauagacucuagcagugucuugcccugcagagcugggcugcuggaccaagccugggcuugccgccaggcuucaguaaaaugcucccacggcauuuagcagggaguaauuuaugaacugcuacuuaucaguuuaguucuaauaaugacaauaauuuauggccacagacaugggcuugacuuuuuuuuuuuuuuacaacuccaguuucuaaagcaaaaucuuucuccaccauuugacauguuagcagucccaguagaaucugggcucgagaagaaaaagaacacuuuaugguagaauguauuaccauuucauaaacaauauuguuuauaaagaagcaccucucuacuguauugaaguauuuaaaaaggccuucuggagcuuuaaugaauacggcuuuuccauagaggauccagacauagcuggagacacaccacacucuuaacagcuuguacaagaaucuucagauuauaaccugcgugcccuggugggugcucucacccuggggcggugcccucugcagucuucaaaguacuugagaauaacguuacagacuaggugugaauguuccagagaaggaagcugcuucggcauguuggguacgaagcuccugggguagcguccagugccuagaacaggaccuaguaugugggugcuggcugacagcagcagagcuuaaccgaggcucccuacaguguggaaaguggggaccuaccccccggccuucagacgagggcagaaggaggcuuaccuucauugaguucucgcucccugcugggaguuucccuucugugugcugaccacacgcaauccucacaacagccuuaggauagagucccuccuccuugaacagucacaucagcacuaagaguguacacagaggaaguggacagcugucugccccacugccuacucugucgucucccaaacuugcaaggucacauauuucauuccuucauguaguaacuuaucaguccagaggauuccaggagcccugggaaugcguguuuguaaaauucauuuaaauucauuaaagucauucaacuuacaugacuucucauagauucuuaucaucugggccuuggaauggucuauauaaucauugguucccagaggauuuucugugcccuuaauuucagugacuauccacaguuuuuucuuggcaggaguauguguagacaucccaguuagcucaacaggacugucccagcagccaguccaccauaacgagcauggcuggugcaggccuggagacgucuacccauaucggacacaguguguuuugugaaccaagugagguguagaggaauaaaguccucugccuuccugcagccuuaauggucugcugugcaggcucccuggugacucaggaguuguuccugaaaucagcguggcagugugagacaagauguccugcgugugccaguggugguuuuuaggggcaucccagugcagcgucuguccauugugaaguaguguggucgugaagcaguacuaugguucagugagcagcgcacuacaugggucagaaaugacagugugacagagucacauaccuugaggcagaccugcgugauaaucaccaagauugcuuuuuccacccguguuucaaagccgacaugaagaaugagcccucgccugagucacuguuuuaaccuggcuuaauagaauuuccuuuuuccaguuucuuugcguuaggguaauagacagaauggucguuaaaguuagaggcuugguaaucaagcgagguggcauucuguggcuaaucagccuugucuccugccugugccggcuuguguaggcuggcgccuuggcucucggguggccgcuaugagcacacaggcuggcccagaauaggacacagcccugccugcaggcucugcuaggauagcuuucgccauggcguggugcuuugguuuaaucauugucagaggucagaguugaaaacuaaaacccuagacgcuuguggaaugugcgucuagguguaguuacucauugugugguguguccuuugcuccccuugcacgucacuccugugugccuguggacacugcucucgacagccucccgacccaaggaaagaaccgcaaggacuuuccaguacacuuccaccuguggccgcccucagcuguggguuagaaauaaacacuggaccuacauacuagagugccuggccuggcucagacgugggcgugagcaguguugcuguuugaaagugaaaucugaagcucuaguaacucuuggguugcuuaguuucagcuuuccacauggaauaaauaaaacaaaauaaaacaaaagggaggugagguuccgcccucugagauacagacucuuuaaagaggauuuuuauuauucugaaccuaguuucaugagaaaauauguugagauaaauaagaucaaacaaucaaaugaugccaguggggaugaaagcacauacguuccuaguguagccauugggguaucuucuauuuuaaagacugcuugucucuauuuuuaguuccaccagaaacauaauuguuggcacaggguuggaauguauugucggugcaugccugugaugucaucauugcaaguuacccucaaaaacuaagccagagccccaacucagcccgugaccuccgcccucagcuacagaaacagcuguauuccugucgagccuuugcugaggagcugggcuuccacagggacucaaguggggaacguguugcagugaucauuuuucuaaaauuccuaguaauuucucaguguucuacagcagagaacaggaccccgugugacugacuucagauuggcuucucuuugaaguagggcuuccucacuguccaugggcugaugguauagcuuuaggucucucuguaagagacgccguuacugucauuacuucacgccuuaaggaaucaagaccuccaccagucuguuacuccuucaagguaugcuucauggaugaucacguuagagacuguugccaucuuguguggguaaaugaugucauuugugagcauagaggugcucugcugugaggaugucaugccuaaacaaugcaguggaaauccaguauacaaguucagauacugguauuucuagacauggcuuaguccugaaagaauuuccuugcuaugcauuuuaaaguguuuguagauggauuaauauauuuuuaugcaauguauuuuacacuuauuucuagaccaaacucuucaguggcuucuucaagugcauuauuggguggauaagagcuugacggcuucacuaacucgaggagcguggagccaagcgucugggaagcguguguguuccuacuguacuugcaaaccuaaagcucuuccaaagcuuuguacuuuuuuuccaugaaacagauuaaauauuuuucucuccaaag

SEQ ID NO: 9343 - RNA, 34711 nt, Mus musculus
cgucgccgccaucuuuguugaugugucagcuccgcagggguuuugggggaaaaccuccgcugagagcccgggaucugcaguggucuccgcgcgugacuuccucacccacuccgcgucggcuacacgccgccauggguucgucggcccuggagccggagcuccaucggccucgcuagggugcggcccggggcuggacgacggacggugaguggccgaggggcguccgggacgggcgcgcucggggagcgcuggucugcgcgcguggacgugacggggugguagccccgggcuguacgcaacuccgcgcguggacgugacggggcuggcggggcccucggggggcugugcccggaggcgcggccgcucccccgccgcaccagcgcgguaucuccggggacgcgguccgcagcguucggcuuuuccaaagaucccgauguauuuucauauauuuucaccuugguagggaaaccauuucagauuucucucuccccuucuaccuauccucaaaguagcaaucccagggaaacagcgcgcggggagaaugauggcucagcugccaacaauucguaacuuguuacaauauucacaucuugauuguuauuuagagaggagacucggguuuguacgcagaacaccuggguuagagucagaaaagacuacaguaaaaaaauaugacagcgaaccagaaaagaugucucagacccagugucacgcacgguccuuugaugucccagccuuuuccuuucuucugaagugguacacagggugcuugucugaggaaaagaugaaacaaaucaguuaugacaguguuucaaagugcacguguagccagccaucccaaggaaaaucggucuguuaaguguuagguuuauuagcguggauguggccuuugugcacuuaauugugaaggagauuaaggacccagagacaagugauacugaaacggaugcgucuuguguaucaaguccaccgugugcagcuacuuuuuagcucuucguuaauuaaugguuacacaaaugaaacaacaguaaugauuggccuacuucuuuuaugguuccuuuuuggucuucccauguucccaugugcagauuuugggcaggccauaaucuuguacuguugcaccaaggccuuccuucuccuuuguacaggguaauagguaaguaugacuuuggaaggcuaccagaagacacagggacuguguuuaguuuuuuugaaggccuuuucuaauuuaaaacaauagaaacuuaagguguuugauugagaacagguuccauggaguaagggugacauuucccagucugauuuuuuuuuuuuuuuccagacugaaauccugagugguagaagaaggggcacucauaaaccuuuaguuccuucacacaggaaccaaagacuuauucuuugaugcugugcagugcggcagcauggcugcugcugauuccuuaguguguucaguccugaaagugacugugaugaacagaacacucagcccagcucucugaggaagcugugaugguugggagcccaggcagccucacugagaaaacugucuuuccguuugacagcaucuacccugguuuacaaaagucauucaacucacuguaaagaaagaauauucaacuucaaauucugcuuuguuuguuuguuuguuuuuaauaauaaaacuaaaauuuuucuuuuauuuuuuuugucuuuaaaugacuaaggucagguuuugauuuuucucauaaacaucacuucauuuacaauaguuuuauuuaguauuuauuuuaaaagcagcaacaggauagauaauuuagaccuacaaaugcuccuguaaucuuacaccauuucaaacuuauuugaacuugcuuaauggagaguuugcauccaagaaguaaacuauuagguaaaggggcaguagacaccaagagcagaagcaaacucuaggauacugccaacugucuugagcguaguggaagcaaacucuaggauaaugguaacugucaugaguguauuucuuaaagcuugagcuggucauucauuguaggcuuauguaguaaguacuaaauagguguuguuuuuaauaaaacuuaaaucuuaccaaauuaaccaaauucaggcauaaguacaacucuuuuaguaaauguagaaauucuauuuaauugaauucauuuuucugauauuugguuuucauauuuuuuuuaaagauuuauuuuauauauauaucaguagacugucacugucuucagacacaccagaagagggcaucagaucccauuauagaugguugugagccaccaugugguugcugggaacugaacucaggaucucugcaagagcagucagugcucuuaaccgcugagccaucucuccagccccauuuucagauuuuuuugaaagaacgguuaaauaaaaguacuuacguuuuucucagacuuuauugcaguugauacauucuguacaagucgcuucaagguagaguucuguauuaauguuaugccucaauacuuuaaaagccauuuuagagucuaaaguacccaaaccaugguugccuguuucagaggugagaguguuacugcugcaagauaucagcuauccagugucucacugaagauacaguaggggaaacucaagaagacaggagcagcugugggcugugugccgucugugugaccguuagagagcugaggcaacuuaguacauucaaacuguaguugggcuugaugcugacucugaagucuuccuucuuggagaaccaguucuagagaucuuugaaacaacagucuuagcuuucuccucuuaaaguaagacugggucuaggcaagcuugccuucugugaaaccccagucccggcucuuugcauccgggaaaugugacugacuaguauuucuuacacagcuucucuucuguuucucugcuuuguuauuuuaguuuaaaagcuuaaucuagcaaagugugucagcauuuacuauuuagggauuaugaggagauacugauuggaugcuuuuugauuuuuuacuuuugacuugagaugacgggccagaauuuugcuagagcugauaggaaaggaaaggaagugacuuuaguuaugcuacuuucaaaccccuugggaaauaugcaaagacugucuuaaaguauuuauauuuucuuacaaaggacaggaaaccauuuuauugacuuaaauaagugaucucccaagccucgguugcauaugucaaugcauacuagagaagggugggucuacagcuagaauuauuggggggcggcggaguggugcaaaaucuaaaaauuauaaaaaauauuugaacuaagauuauucaacuggauuuaaagccaagccuuuauccugaaauguugguuugcuuuauacugcuacagugggaaggauucugaucuguggucucagcauuucacagcagcaaaacaaagauuuaacaggcucaguauuagucagacuguaccugaggccugcaccugagggugccuguuuuauuuugcaccauguuccaaugccuacaacagcguccauauggaaaagcugcccugugcauguuuggcaggugaacacuugggacuuuauuuuugaguugguuccucugcaugaugcucauuugaugacuuguuaccaauuaucuguagauugaauucaguuucuauuuauaguuuugugagccagccuacgguuuuguucuuauagacuaauuaugggaaaccagaaauaguacugaaagcuguuaguguuuucaguuauguaguuuuguguggaauaacuuucuagaaauccgaguguguucauuaaagaaugcaagaggcucugggauagugcuuggcauggcgccuuuuugcuggauggcugcagcugcugcacugcagucagaucgcccaguucccacugccacaggccuguacugcugugucagcgacagaaggacuauggggacagcgagggauugggaggaauuuugugauuacagguguuuuuccucagaagcaacaguuauuacaaagucagaauagcagugcaugucguaaucagugagcacacuuacuguguguaucugugugugucucugacugagguuggucuguaccagcacuugaggcaggcuugcagcucuucccuacguuuccuguuuccuccuuuuguagcuuacugguaguaggcuguuuaaucuuccauaauuuucacgacagcauuccuucuaaaaaaaacccaaauucuuggacaguauccaaauugcuguacaugagcgucgcuaacuggggaugccuguagggaacucggcugacguuccugucgccuaguuagugguggacagaugagcuucucaugaggucgauugguuucuguuugcacaguucuuacauacuccuugguguugccuugcuacauaugcaagcacagguccucuguaacauguuuuccucuggucuccugucaguauucacugggacaucaacaaacaaaugugcaguuguaaugguucucagaugccaguuuguauaaugacccuuuuacaggucaugacuuacugagagacacuguguaaguuucuugucuuuuagauuuagucuuuaauugaucagacacacaaaacaaauucuaagcuuggguaaauagcuuguuuuguuuggauuuguuaccuagaugaagcuccuguagacuguaagacagguuuguuguucugcccugucuguacacuagaagucucccuacagccugcccacuaaaugcuguccaccccacaucauuucagagagccaguggguuccucugucuuugugaagcacugaggaguauuugcaaagacgguaguaaauguugugcagagugcauuugcuagguuuaucuguuuauuacuguucuuguuugaucuuacagaaguuucaauucugaguaaauuuucuugcagucauuuaaaagguggcugucucuucagaagggucaagaaaggccguaucuucuccaugaguguaggcaguguguuccacuguacagguugcucuuguguuuguaguagggaugguuugaagaaagauagggcauuaaguccucaaacguaaucagucucuggguagacugaaaggaaaaacggggcaauccauggacagugugcgcagugggugacuugguggagcaagacauugcaguagagcagcagcacuuucugaaugugggcagagaucagguuuggaaacuuauauaacugcuuuacucaggaaucguagugauuucauuaaaagaaaauaggaaaaaaggaggggggggggcgggcggauccuauucucccugaagaaaacuugaaacucuuagccccuaacugcuugauguaucagugucugccuaacccuccucccaagagagacaggcuugugucuuuucucuggcuggccucuguagaguggagacaggcuugugucuuuucucuggcuagccucuguagaguggagacaggcuugugccuuuucucuggcuagccucuguagaguggagacaggcuugugucuuuucucuggcuagccucuguagaguggagacaggauuucauuaccugaaacuuuaaagaagggagaggcuggucugggugcaugacuugagcuggcuguuugaugacugaagaggagcuaagugugggacaguaguguagcuuccuagccugcacacuugcucucuuaccguggaggggucacuucaugacagccaggauacuacauacuucaucacuucuaaaucugcugauuugucacuucccuuagcaagccugucucacccccaugacugucacaaauaaucugcccuucuguuaucuacuuugcccuuugauuugagauuaucgaaagagaauugaaugagaucaagaaacuaaguguuccaggugugagacgaggccuaggcuggguugaagggaggggauagcaucagaaaagcaggagaacaauugcuuaauagauuaauagauuccgaaagcagcgggagcaaagggagauguuuguugaccaagcacaugaugcugugcauggguacucaguuacaaguacuagcggcaggauugaggguuagccagcuugaguuuaagacuuuggagaaagcuccaauaggagcaccucuucagguagacuaauauagcaugaagaggggauagacaauuccaugucuguaacucagggugcaggacuggaaacucucaucuaggcaucagcuaugaguuacugcuucagucagcucacuggguaacugcuaugaagggagaaagaaaugaaugagcccuggagaccaaggaagcagaaugaaaggauguggguuuuuguugacaaaucaugacacacaaauaaaacucuuaaaguuguugaucaaaugucuuuuuacuuaacggaaugcuggggagucacaaugccuuugucgucuguucucuucugaaggcacuccuuaucugccagccagcgcguacucgucugcugugaguucagccucuguugguacaacagcagcaguuaugguguuuaaagccacugcagguuuacacuuguaagauuuuaacuuuagcaguagcguaguauaucuuacauuuacuguguaucauaccacaugugguaccuuuaaagagcuucacuuugagugagcuguauauuguauaucauaucacagguuauaucuuuaaacagagucacuuugagugagcuaguuuguaaguugcucugaggcuaguguaccugccugagauucauuuuuuuuuuauuccaagauuuuggaauaaauuacugagauuuucaaguguucacugcauuuauuugucuggucuaacgucuuuacuaucaauaccagcuugcuugcgaaacguauacagcacggugguggucauuugugucauuuggaggagguaggugauacaugauuaagugauugggagccuagguucuaaaagucugcaguaaucguugucuccacaggugguccacaggaacagcaugcuugacagacaagauggccuuuucuuccuuacacuugacucuuuuccgcaguccugggauaacguucuucaagcacuagccuuacuuauuuuaugcaagcuuuaggucagcaagaauuugaggggucacugggugcugggacucauacaguaaaaucaaacgguguacaacaagucuuaggauuuauuauaauucacccuuagcaaaauccccuccugcuuagugcugaggggucuaugcagccagucaucucuucuugucucaguguacucugaucaucgccuuucuuaaagcuugaaguaagcaugugcuuuccuguuauaaaauggacucuuuuuuuucccauguguauacgucagagcagaauuccuuauuagaauugcaguuuaaucucaucucugguaacucaucugccugucugugcacuguuaaagcauggccaaagucacaggcaguuuuuucauugagaccacuagguuuuuuguuguguuuuucaagacaucguuucucugugcagcucugacuguccuggaacucgcucuguaggucaagcuggccuugaacuuagagauccaccugcuucugccuccugaguauuggcaucaaauguguacaccaugaacuacugccuggcuggauuuuuuuuuuuuuguauuaaauuuuauuuuucauuauguguauaugugugucaggguuaggggaugugcauaugagaccaguuccagaggaggcaaaaagagggcgacagauccucuggaacugaaaguacaggcaguugugaacugcccaccacaggugcugggagcugaacuugaguccuucacaggugcugggagcugaacuugaguccuucguaagagcaguaugcacucuuaacugcuguaccaucucuccagccucugguggaagauuuuguauucuguaugucagagaaaaauuugaaguugacuaauuucccauaaagaagagagaggaggaaccuuuguaaauaauguaauagcuagcgucuucucaccuagucaaaugaaauguugcucuuacugaccuagacaggguagauuugcacugaagagaaugcuuaugcuuacuuagaaacaagcaggggaacgccccaggccccugucagggggaagcugccccuggcacacacaggucaguccccgcucggucugcacugaagcagguccugguucuagguuuccuucuuggugagcuuugucaucacucgcugguguccugcucugagaccgcugccuaaugcuuuagcugcuguccuuuugcccaucuccuuaaagggcuuaaguagugugugcccacagaagggggccauucuccuuccuaaccuucccaugacaugcucugccccuuaacuagagaggccagcuggcccaugacagaaaagagggggucacuacggugaccccacugguuguguccacucuggguaucucucuucugucucuaggggaggcccuuauuagaggaauuaugaaugggacacuucaugggcaugucauggugucuuagucuaauuuuuuaaauuugauuucuuagauguaaaugaagaucaggagcagauuugaagaaaugcaaagugaauuggugccagucagcaugucagagacagaacacauagccuccauuucuucugaugcaacuacugagaaaacaucggaguugagggaugacucgugcaucucaguuucuggugacgaaagcagcagauuagaaacaggagcugaacuauugucauuggacucugacagaauuuuaugucagacuaaugaacacuguagucagaucgaaguacaggagagccauauuccagacuguggcaguggugagaauucuugugcuaacacagacacaugcccagaagauucuggacaaauagaugacuuuccugguggagacuuuacagaacaagugucaaaaaccaaggagccagaacagacaguaacacagauacuggcagaguuaaagucaucugcacccgcagaagccgcuaauccaaagacggccucagcaagccucuacgacacagacugcaccaggaaacucauuuccgagaugaagacuguuucagccucagacgauuuguugggagaaaucgaaucugagcucuuaucugcugaguuugcagagggccaccaagucccaaauggacugaauaaaggagaacaggccuuagcccuguuugagaagugugugcacagcagguacuugcagcaggagcucacuguuaaacaguaagucugcugcuacggccccccaccucgaggagaggacucuguccgccuuuguuucagaaugcagccuugcagaguuggucuacuuccccaaguaacugggcagcuuccauuugugcuugcuuacaguaguaaagcagcagugaagaguguguguucacuagggagcggugugucaaaaucaauucaaagggaaaugaaaagucacgaauuaaguucagaagcuuacaauuuagagaacgggagaauguuuugauaaguuugauuuccuucagccuguuucuaauaggauuuauucuguauuuuuauuguacauuuuauaguaaagugauauauaaguuugggcauacuguuacaaucuguuacaaagaaaaauaauacauacucucuuucacuaaacuacacacuuuuacacuacgcugaggauuacagggcacacagaccacgcccugagugcucuuuuauagguacuggcucuccuugcuuuguuguuuuccauauuauucuguuaaagccaccagauggccccaaaggugcucacucauuguguuuuucccagugaacuucaaucugcugguauucauuuucuauuuuuuuuacauuaauuuuaucuuucuuaaauuuaaauuuucuaaagaaaaaggcuguguuaugaugugaggguuuugcacaugugcaagccagaggaaacguucuggagacguuccuccugucugccuuuguguggguucuggggaaucacaugucugugaaacggcagugccuucucacgagcaccucugcucacuuagauccaacuuggaauccuguuaauacacucugugcuuccauggcucagacaucugugcucccgggccuucuaggcuugggguaacuucuucacuccccugcagucuggaucuacucccaucaccccccgcgccccccccaacacacacagugauuauuucugaugcccuuuccuacuuuccuuagauccugacagcuuauacagcacuuaaacauuuuaagauacauacauuuaauaaucucacuuacuauuaaccaugugacuggugcacacguuaacucauggaaugugcacagauagacaacacguccuacccucacucguccuuagguuuaugagguaccugaggcagauuaagaaacuuguccgggucagauggaaauaucuacagagccaagcuucugacuuguuuuaucaguuguuacaggaaaucaucuggcugcaaguugcuggacggaacuaaacaguauuaggcguaaaaacaaacacguucuuuguccacccagcagagggagcagcgggcaguagaguagggaguggcccagcagcagccuggaacuuguggagucugaguccgugcucucuccugugagagacucugcuugcccaguguuacuuuuguggauagugaggugucauauaaguguuacuguaaccugcauugaucuuuugcuuuacauauaauacuuucaauuucaaauaaaucaauuguugauucagguaagcaacuagauguuuucuuaacuuuuaucugcauuuaauuuuuuuaugaaaucacuaaguuucaguuccuuuauugaaaauuucauaaaugcauccuuuuccagauguuugauuaaauucccauuuacugaguuuuuuuuuuguuuguuuuuuccugggaaaauuguauauauugucauuuggaaaugauucuacaaucaggcuggcuacuauguuuauccucucauauagcuaguuaccuguguguuucuuaaaccuuuaagauacacucuugaaaauuuccuguuuaaaauaccguuuccuuccuccuccuucugggucugcgucuugcuguaugcccugcucucccauuucuuccccucccuuuccuucauucuuucucucaccuccucuuccucuuuuucauccucuucucccuguuuggugcuagaggaccuuaaugcuggguguguauucuacuacacccagcccuaccaccacuguguuguacauuaaauccccaggacuugucugaaccuggaacuuuguacccuguggaucuaagcuccucuaucuacuuucuggauccuggaaaauaccacuccacccuuuuuauucuguuaccucaugcaucaguaguauugcucagugacccagcuugaacucuaaaagaacaguagucuguguggaaugugugcaugacuucuaagaauaccaaauaacaaagaauaccaaagaaacaaguuaaggaugugggugugcucagugggagccuaacagggcuaauugaccagagacuuuuugguuuuuuuguuuuuguuuuuuuuuuuuuuuuuaaucugguguauaaaucaacagagugugaguaccuaggcugugacagagcugccugcucuugcccucccucucgucugcuugcuucucuuguagugacagacauagagaccguuuaccucaagcacacucagucacucgauggugaggacauggucugagaagguaucaucaggggugggggcucucauccagaugugguauuuuagaauaaaaagacuacucgagaggauugaucagugguguccaugucuaaucuguagauagauaauauuucguaucuuauuucccuuuuauauuuagguuaauuaaagaaaauaagaaucaucaggaacuuaucuuaaacauuuguucagaaaaagacaguuuaagagaagaacugagaaaaaggacagaaacagagaagcagcauaugaacacaauaaagcagguaaaaaccaggucugccacggcccggcuuacaguuagaaacuccugaaacaaacaaacaaaaaacguuucaaaugcaggaauugcuuucuaaacuauguuauaucaauuaugauaaguuuaacuguuccaaauauagcacauuuucugcccaaauaacgaaaaggcuugauuuaaguuuuuaccaauuaaaggaagaaguaguuaacaguaguaaccucgaggcuucugucuggcuuugggacacuuuggcacuugugguuuuagcaggcugcauucccaugauguggugaagucuacucugaaggucaugucagacccucucucuuuaauggcucuuuucugcauggaugcacaaguaagggcuuagguuaguaacaaagcaaaaacugcucuugguuuuuugagcugcuuuccuucuguggacagggagugaguguccugucguucgccggcauaacucagcacugguguguccugagagauguaccuugggccuuuccuccucugugugggcaucauaagaugcacuucaacugcaagugcugugagacagugggggacgcggucuuggaguagaacuacaguccaucuagaaagcugcuaaugaacgcaugcggugucagacagcucuagagucuaacaaguuaaaccaaguucucauuuccguguguuuugauacguuauuuacugcacuuuuacauauuuggaaaaagacggaguugucguaugcgguaguuaacugguuuuuauuaaacagguaaauaggcccagguguaagccggaccugugagggcucgaggaaacagucuguaggcuuacauccuucauuugcacuguguuguguguuaacuaagguaucauugcucuuacuuggugcagcuauaaaauauaaccuggaaaucauucuuuuuacaguuagaauuaagaauagaggaacugaauaaagaaauuaaagcuuccaaagaucagcuagucgcacaggaugucacagcuaaaaaugcaauucagcaaauccauaaagagauggcccagcggauggaccagguauuuccugccacuauuaauuugaucauuugguguuucauguuuauuggacuguaccacuugggugaugacaucgcuggaguuuacauaaaagcuuuucaaggaaacuaagggcuggaaggaugacucagcugugaaggcgcucccugguguccccgaaguccaguuggcuuucuagcauccagccacaagacccccaaccaccugucacuccagugccagggcucugacgcccucuuguggcuuaagaguauucauaugcaugugguccagcagacaagcacaaaaacauaaauaaaaaagacaucucaaacaguagcaagauggcaauacguaaguuuaaguacauccuaauuguaaaaaaaaaaacaaaacaaaacaaaaaauaauuuaaggaacauaugggaaauauauucaucuuuucaccugugucuccaguuuuuuuuuauaucuuuccuuguuccauagcugacauuuuguuacauauauguauacuaguaacacaugaauguguacaugaguuuuuacuagccccguuuguguuguuauaacaaaauacuugaguaucuagacucaaaaaaagaagcauuauuuaugugauaguucuaggaguucaagaguaggacugucucccagagaggaagugcuuguguuagcugagcuccagugacccagaagccaggcuucaggcuucuaagcuucugccuaccgauucugacggcugacuccugcaagugugaggucaaaggagcuuguuaaggugaaccaugauccucucucuuccuggggcccagaauggugcagaagucggcaagaaagcagauguggagaagaagggacauguauuuaaauagaaagcacagcaaccaaaguaaggaauaaggaaggacuggaaacacagcgcaaaauagauccuaacaccacggggaauaguaugcauuuguggaugcuuucauuugaaaauacacuauuauuaaugcuugguaaucuuuucuuuccaaggccaauaagaaaugugaagaggcccgucaggaaaaggaggcaaugguaaugaaguaugugagaggcgagaaggaggcucuagaccugcgaaaggaaaaagaaacccuugagaggaaacuuagagaugcaaguaaggaauuggagaaaaacacuaacaaaauuaagcagcugucucaggagaaagggcggcugcagcaacucuaugaaucgaagguauaacuugugccuaauuugagggucaugccucugcuuuccuuaguccacagugguguagaacugaagcacucagacaggcgugcucucacuagcuuacucaccugugucugggcuugucauuccugcugcuagaaagguuugcugggggaaaggcagaauauuggcaaguguuauuaguuucuuaauuuucuuaauucauaauuucuuaaucauuuuuaaacuuucuuuuagaguuuauuggaaaaauuaguuugugucucuaaaaauuauguuuugcuaagauauguccauauuggugucaguugugaauagcuuuaaaucagaaguauaguuugucuagacucuauuuugguuuuuuauuuaauacauuuucccccugcagugugagaguggauguagggcuguauaccuguggggcagugucucugcucuaggccuggccagagucucaguguagcacgguucaccagagagcacaauugauauuuuucuuauugaaaaccuauuuauucuagagcuguccuagaagguugaguaacugaagcgggagcuauucagagcacuugcuguuaucucuguuuagaaaugcuguuacuguccucagaaauuguagcagaaccaguugagucaccuuacugccaucagucaugaagaguccgaguguguuugucuuauacuguacccacgggcuaaucuaggcaguaauuauccucaugccuauggauuugauuuagggcuuuauuacucucucacuauuugagccuuaaaucaacuuuauggccugugggcgauaguaucaauuacccuggaaucacuguguuacugcacaaggggauauacaagaugcacacuugauuguuuaagugaaaagaugacaaugucuuuuuaggaaggugaaacaacuagacucaucagagaaauagagaaauuaaaggaggagaugaauucucaagucauuaaaguaaagugggcgcaaaacaaguuaaaagcugaaauggacucacacaaggugagugcggccaugcuguggguaguggugaguacuaagagcaagucggcuggcagccugugcaggacuccugcagcuuaguuugcgucaucauagaaaaacuguugguguggcuuaaaauguuccauuuuauaauucauaguuuauuguuuuaauacucaaaaguuggagggaagggaaaauacuuaauauguguuauuagaauuaaagugaaaaaaaauuaaagugucaacuauguugauucccauaacuaaaaauuaauuguuuguauuuaaauauuaauacaaauagcuuaucuauuuuuauaaaauugcuacuaugcuagcaaaaauuguguauaugcaugauacacauguguuagacacugaaccaggguucucauucacacaaggcaauuacccuauaauuaccuacugaacuacuugcugcagauaccauccuaucuaaaaauuaauagaaugggggcuggagagauggcucagcgguuaagagcacugacugcucuuccagagguccagaguuuaauucccagcaaccacaugguggcucacaaccaucuguaaugggaucugaugcccucuucugaugugucugaagacaguuacaguguauucauguaaauaaaagaaaucuuuuuuuaaaaauuaauauaaugaaauggauuuacaaaguccaaggcuggagagauggcucagccauuaaaggcuguggucucacaaccaaaaauucugaaguugauaacugauggcauaauuuaaacccagguagagcuggguuuuuggagaaauaaaagucagcagaugagagaauggaugguuaaaaucaacucugaaugugcccuaaacagaagguggugcugugguacagugugucugucaccuuccaggcuuccgaaaagaggcuuaaugaugcagggcgaaacguagugugacacacugccuuccuaagguugauuacaagucgguuauguuguuguacauugucucuggauguuuguaugcugggaucaggaaacuguagguagucuguguugagaguggucaaagguagguuagcagcauggugugcucccgucacucaagauccaucacugggugagaaaacaacaaagaacuaccagaaagcacuggggcgucccagcucagcuguucagaauucucuaugcucugagguacacagugcagaauuaaaaauugaaaugcaugaaggauaauuucuaacugccugaguugcuuuaacuucggagcagagugcucagucaucucugcugucuguggcucucuuuuucucugucucacuuccaacacagccucugugaugagggugguuugugcugcauguguuguucugcuugguugccugaagccaggaccugugcuuccugcagccuguggcuucuguuagugccaccugcagucugccgcccacauggcuugucaggucccuagcugggaucuagagcugacccaauggcaguguugccauuuuagcucacuuaauaagcugccaucugucugguccagaacuagacucaguugauaggcagagcuagucuuauccuuccaccuuagacuagcacucccaccccaaaauacagaaauugaaaauaaaacaaaaugauagcggggcagugguggcacacgccuuuaaucccagcccucgggaggcagaggcaggcggauuucugaguucgagccccgccuggucuacagagugaguuccaggacagccaggucuacacagagaaacccugucucuaaaaaccaaaaaacaaaacaacaacaacaaaaaccaaaaucauauguauacacaaagggaaaaagaaaaaccaauaaaaauaugugaagguuuucagacuugagacaaaagccagcguaggauagugaucucugagugaagugaaacagaggagguuaaugcuggguucuggcugaggugccaggagaggaaaugacacuaagcccugcaguuuucccggguugagaauguagaguucaaaguauggagaagaggaggagggcaguguuccagaaguguaaaaggaauaagggcagcucuggagcucacacaggacugacuggggagucacugugaacaccagccagaggucaagggacccucaaagagcauggcuuuggggggccucagcagaauacugcugugguguggaggccucguacacggcuuuaaaagcaagcugauuucaagugaauuaugugcuaagaugaauuauauaaauauuuaaaugauuauaaaaacuuugcuuaagcauacauuucacuguguuuggcaucuaaugaaaauuuaucagcaggcaaagaaguaggagaaugcagacuguagaacaaaggagugacuccgaguauaggaucucuaaaugacauaaaggcaaguuugccucagaggagacauggaugggauuuaaaauuaauaugaaagggaauugugcagaauuaacggaagacaagagcauggauuaaacggugguccauaggcuggaaccauggcucaguugaugagagcugagaguacgugaagcccuggauuccauucucauaugaccccagcacguaguguucaagguuaccugagcuauguagcaaguucgaggccagccuaggcugcaugaaacucuuucucaaaacaaacaaacaaacaagaaaugagcaguaacaaacuucauucaggugauucccaaauguauaacuuaagcugcguccuuucuacccaacaucggcugcauucaacugcauucuuuauaccugacauugucaauaacuuacauucgcuuaagaugaacuaauaaaguguucucccuccaccaccccccuauuugaauaaaugacaacucauucuuuuacuuugaggacaaaaggcuuggguucagccuugaucucauggguucauccuugucacacaugcagccucucaucuuacacuuuucaagccugugcacacugaagcugcuuagccuuucugcgcaagcucugaacugcccgcucucccaugcuuuguuguugcuucauuucugcuccuuaacuccugccccuagcguacugaacauccaagccuuugugugcuuccuuuguuuauuuaccucuagcaguagacugucagcuucucggggguagagaguuugguuugcuugcucagcucuuucccuugagaauagaacagugccuauaaggcugcggagaugguucagugggucagggugcucguaccaaugagaaccugagggcaaauuuccaaaaacccaugucaaaacagggguacuugugugucugugugugugugcuuaugcgcgcgcauguguacacacaugugugugcaugcuuguguguguaugugcaugcguguguguguguguguguguguguguguguguguguguguauugagaugggguccuauacaggagaaucuccagaaauuuguagacugacuagccuggugcuugcaucggcaacaagguggaagguguggccugacaacugaggucauccggugagcucuguaaguggucagcugauagguagaauauagacaguaagcauccuuaaccugacacaaugggauuuguuuucauuuauucaaauguucaguguuaucuggcacucucacuugcuggauuuaggguguugaaauggaccagaacuauauaugucaguugugucuuagucacaggagugaggaugcagaaccacgguuguuuauacuuugucuaaggcucuguggaaaaguauucugguuauuguguugcuauauuuuaagugauacuggccccugacuaucaaagaccaguaccucaagguagauaagugcuaguuauaagauguuuauuguuaaaauggcauauggaguaauguguggagccuaggugcagggcagauguugaagagacaaaggcuacgcugcccaagcauaagaacaaaagagggucacugagcugcccagagcagaggcugcugccuaggccucacaggagcccaaaggaucuccacaggagcagcaggugucagucauuacuuuccucaucgcuguaccauaaggaagggaagucuuuuugacucacaguuuugcacuagagcaggaaaggcaugacugacaguuugagggccuugaucacguugcaucugcagucaggaagcugggagagagaucaccagagagcaggaagcaagcaaggaauaauaaggaagauagacuauacaaaagaaaguguguauguuuucagugggaauuggcaagggacaguugaagagucaggcagucaggacuagagcaggugagugaaaaauaagaaugagggaaaagcaacagguuuugaugaggaaaucccuaaaaauccugcaugaagaaugccauuuagcagucucaaagcagaggccauguucaguagugucguucaguuaaaagggaguuucaaauggauaucacagccacagccagagacucucugcaaugugcaaagaaccguagaagacugcuuuucucagugcugaagucauuuagaggacucuggggaagacugcugauuaacuuacuguccaucagucucacuguuagccauuuuccccgucagaaacaagcaaacuguuagacuccugcuuaauccccuuagucuagugcuacaacaguguccuaguuaggguuuucauugcugugaagagacacuaugaccacagcagcucuuauaaaggaaaacauuuaauuggggacuacaucacucaguccauuguugucauggugggaagcaugguggacuucaggaagacguggugcuguagaaggacugagagaguacaucuggguccuuggguaucagaaagggugagcuuugaaaccucaaagcccacccacaaggucacaccuccuuguugcuguuacugaaccccacaagcggggaccucuuugcucucacuguccuccaccucgcugugccugauguugucuuugucguguugucauuguaggaaaccaaagauaaacucaaagaaacaacuacaaaacuaacccaggcaaaggaggaagcugagcaaauccggcagaacugucaggacaugauaaagaccuaucagguaggcuuccuuggugagaaguccguuaucagagcucugugcucaugcacguuccaagucugccacugugcaguguacgugcauuucugaagcacucaguuaaaauacagguuaguuccugugcuguaguaccugcaguucaaguggggagacggucuagugggcaagcauaagaaccugagcgcccacauaaaagcugaguguggcagugugaaccccuaaccuuggcuuugucagggugaagagagagguggguccaugcagcucacuggccagccagucgagccaagucaaucaaaucagcucaaguuauaugauauccugucucaaaaauaaagugaagggcacuugaggaagaggcuugguguuagcucuggcuuccaugggcacaccacaugacucaucuuaucagagacuuucccuucaaaacgucguagaaaacacuggauuaugucauacacucaaagugcacuguuccuguuucugcucuguuaacacuuaaaguccuucaauacuuucuccaguuuuggcugcauaaucuauugcacagcuaguaaacuugauagcaaagcuuuguuuauuuucaaaguaaaaguguuuuucauuguuuuuccauuaggaaucugaagaaauuaagucaaaugagcuugaugcaaagcucagaguuacaaaaggagaacuugaaaaacaaaugcaagagaaaucugaccagcuggaggugaguuuaguucuuccgcacucucuaauacauccugauuggcugggcugugacucaggaagaggaguggugcauucgugacuguccacagauaaggccuucuuaggaaaaccaggcaggauacugcuagugcgccugugucucucagcgaucugugucucuuccagaugcaucaugccaaaauaaaggagcuagaagaucuaaagaggacauuuaaggagggcauggaugagcuacggacauugagaacgaagguaagcaguuccucacuccuaacucaggugggaugaacacucuuaguuuacucugcuuuuuaagguguucagaaagcaaugcuuagaaaucuuucaaaauaaaagaacuuaggaaaagacuagcauuuucuuuagcauuugcacugccacugacucuugcugagcugagguuauguuagucacuggaagugcuugccaugcauccuugcucauggcacacuucagcaucugcaccuggaacaucugggcuuuggagcuaaggacagcagagcaguuggcagaauggguggaccuuacagcacccuuaugucguuggcagacccaaaauacuccuucugacuguauuuaauaguaguuucuaacaauguuagugaauaaucuguggucagaguaaucucccucuuaggacuuacacgcuggcuccacgugccagucgcuuaucuagaaguaggguuuugugcaggcaccaugacuugagaccacagcacaguaccgagugucugccaugucuguccuguugugucagguguucacugcaguugaacacaggggaguuguugucguugagauaaggacagcagcuuccugucuccucacagcagcuccugcagcacuugucucagguuacuccugugucugcccugucugagagaguucauauggagcacggcggucugugcuuagcuugacugugaucauuucacaggcgaaaugucuagaagaugaacgcuuaagaacggaagaugaguuaucaaaguacagggaaauuaucaaucgacagaaaucugaaauucagaauuuacuggacaaggugaaaaucacagaucaguuacaugagcagcuucaaagguaugaaaugagugguguuuaagauggugucucugaguacaauacuguaucaaacaggagcaauucucauaauucuuccaguuaacaauucuucaguuugugucuuugaacuccugucacggcuucuaaaagucaaaucaaaguuucuauuucauaagcacugacaggaaccaugcauaggugggguggauuugguuuaucuguucuguggcuucacagucucuccucaaaugggaagcgugagucugcaccuggcuccuuaacuuugugugcgagccuugaggucagagcgaaugucauucugugaugucccagcaucguuuaaacuugguucaugaugucauauaguagagccuggacucaggguuaacuucuauuguccuugcuguccaucuccaggcagccacccgagugcugcugaaaaaagguucucacccucacaaucaccguccucaguaaggacgccagagaccagccaccucuccuuucuagaccucugucuuccuggugugucucuucuggggcgaccagcguucucucugcucucaugugauuaagggcuuugagcugcugcugguuucuacaaccauucccuacugccauugugcaagaaaugcuucuagucugaauuggauuauucuuuccacgucugcugugggguccagugccuuuuuccuucuucagcuuucgugauuauuccuuuaucucuugucaguuauuuuuuuuuuuuuaaaguguguguauggauguuugccugcaaaccaaaccuggguccucugaaugaguagccagugcucuuaaccacugagccaucucuccagccuuguaaauggaaggccuuuuagagcauagguucccauugaguucugacuguggcugucuucacaaaguacaacugaggcaaagaacuccagcagugagaugcaagccuggcuuagaagccuguucugcguacugccugcccuugugugggacgguggucacucuuccugagcuuaggcacccugccugcucauucucaucacuggucacuagaggcucucagagcagggcccugccacaugagccuuucucacucacccucacagcucuucccguaacacgaagccgacgaugaugaugucauggauggaugaaugacuacaaguaaauauucccuuaagugagcauucccacaguguuaguguaaugauuuuuaauagcuuacuuaauuuuccuuaaauauaaacuuuguuuuguagugguaaacaagaaauugaacauuugaaagaagaaauggaaagccuuaauucuuugaucaaugaccuccagaaagacauugaaggcagcaggaaaagggagucugagcuccugcuuuucacagaaaagcucacgaguaagaacgcgcagcugcagucugaguccagcgcucugcagucccagguggacaaccuguccuguacugagagccagcugcaaagccagugccagcagaugggacaggcuaaccguaaucuggugaguguaggcacacauuucauucuuccuccgcuccuccuccucuuccuccuccuucuccuuccuccuuccuccuuccucccuucuccuccuuccucccuucuccuuccucccuccuucuccuccuuccucccuuccucccuucuccuccuuccucccuucuccuuccucuuccuucccuucuccuccuuccucuccuccccuuccuccuuccucccuucuccuuccucuuccuucccuucuccuccuuccucccuucuccuccuuccucccuucuccuuccucuuccuucccuucuuccuucuuuccuccucccccccuuaccccccuccucuuaauuggcauuuuguuugcauguaugucuguguaccacauagcagugcggaggccagcacagggcaucguagccuuguccccuagaagagcagccaccauuccuaacuccaauacucagauuuagucacuagaccaacauagcaagauugaauuucucuaaucaucaaaguacaagugauaauuaauuuuagauucuucuagugauaucugaucauuuuacauguuguaaaaauauaugcuuuuuguuuaauggcuguaauucuuauaauagauuuuuuuuaauuaaaugauaaagaauauuccacuuugaaaaaauaaagaacaaugauuucugucauuccugacuggagucacaacauucagagacuuagauugcagcuauauccacacacaacaucacgccauugguggucucugaccuguuugccgcugggugaagauggugggaggagcucaccggcagagccugcgaagggguuugcagaagagucuccuccauuagcuauacuuuuacguuuuuaaacugagcaaaaauuaagauuuaaaaagaaaucaacuguugguuuucuuuucaacuuuaucacacuuacuauucaggagagcaaguugcucaaagaggaagagcuucgaaaagaggaaguacagacucugcaagcugagcuuucugcugcgcagaccgaagucaaagccuugaguacccagguggaagagcugaaagaugaguuagugacgcagaggcgcaaacacgccucuaacgucaaggaccucagcaagcagcuucagcaagguacuccuguguugcuugucugucucagagcucuggugaggugcgcugcugucugucugugugccccacauaccucaggugugugccccacauaccucaggugugugcccccacauaccucaggugugugcccccacauaccucaggugugugcccccacauaccucaggugugugcccccacauaccucaggugugugcccccacauaccucaggugugugccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcccccacauaccucaggugugugcuuggcuggcuuucucuuaggcucgcucgcuugcucgcucggcuuuuguuguuauccuggaggcagagcuugcuccucacuucacacacccaguuuucugccucacccuccugccucacuguuaggaauaaaggagugugccacugugcccagccuguaugcucuuucucacuuauccacagacuagauuacuaagcuugcuaagcuugcaguugugugagugugcuucccaugcugaagccacagagugaacggcugcccucagcagcucugaacccuuuaccuuguauucugcuaccugcaaaaguuguguaagugguuuuuuuguuuuguucuguuuuaauuuuuuuuguagaauucauuuauuuuuauauuuaaaauauaaauuagguguuuuagaaaacauaagaaaggucugccuuuaaaaugcaaucuagaaaacacuucuaauguuccccucugcacgugccuaugaggugauugagucccaagcucucacuuacugaucacugcgucucgggaaacaucucagaaggacugugaacuaucggacagcuggccagcauagccacuaaucacugaaauuggaauccgauuucuccugguuaagaauucauauaaacuuacacacuguaaucacagcaggggaugaaagucaucacaguacacgguggguucaaggccggcugcucacauaggacccuugcuugcuugucuguuuuuuccagacagaguuucucuguguagcccuggcuguccuggaacucacuuuguagaccaggcuggccucgaacucagaaauccgccugccucugccucccgagugcugggauuaaaggcgugcaccaccaccgcccagcuacauaugacccuuucuuaaaaaaaaaaaaaaaaaagcugucggguguggugcuggaucccuuuaccugggagguagaaaugggaggaucucugugaguucagcucagacugguuuauagagugaguuccaggaaagacccugucgugaaaaagaaggaggaaaaaacaaaaccacaaacucauaauggcuuuugaauaucugccguauguuagugugaaaaagacagauacaucaacuuucuaucuguaugcccuacucuggguuaaauaggaaaaaauguaguaagaaaugagaccugggguuacuuaaugugacuauaguuagauauuugcuaaaacagcucacaauuuuuuuaaagaugcauuuuuaugaauguggugucuagccagcaugccugcugcacacagacuccagaggaaggugucagggccuguggaacuggagugagagaugguugugggccaccaugugggugcuaggaacugaaccugggucuucuggaagagcagucagugcucuuagccucugcuccagcccuguucuuagguguguaacugaagguguguuggggagagauuucugaaacugagaaggcacuccaugccuaaagcuccacaagcugaagucugaacauaagcucacuugaaagugcagcucuaagaaguugucuuuguuuccuauguagucuguccauuuccaaaugucauuuuauaugaauggcgccucaaguguucuaaaauguauagcaaggaccaguguccaugccacuuuugccaucuugugguccaugccauuuuugcccaaguggcauuagcaauuaaugucagacggcaugggaaauggucauuacaacugucacaaguaauugauuucuuuuuuucuuuuuaauagcucggagaaaguuagagcagacugagaauggaaaccacgauaaagacauuagcaguaugggaagucgcucgaguucaucagguaaggagggcguaguuagcaguggccauggcuaguucagaaguaguuaucugcuuuguuguguuucgaggcugacgaucagaagguacgcguagcuauaguguggagaguguacuuacugcguguuuacuuccugcuuuuugccagaguuccugucugacuugggcuaugugagacuucucacccauuuuuuaccuaccacuuuugcauucugugcagugccuggaguuuagauuuguauuuuauccauagaggccugcauguggacucacuuccauguuaaccuaaaugaugagcuagccauccauauauagcauccggugcauaucaacaauucuccuuugguuccagggcacucacuggauacuaaaauccucagguggugaagccuuucauaagauguuguggugucuguguaaucugcacaguccuccugcagacuuuaaaccaucucuaagucacaguaccugauacacugugcaugcuggggaugugcauguaaaccuguugguuuaggacacgggaaucuguacaugguuagcagagacauuuuuuuaauaaagcucuuggcagucuggaguuaguuggaccuauguacagggaacucacacauaugacgaggacaauuguguagcuguguuaguucuuucucucugccugucugccucugccucuaccucucucccuucuuucacuuucuguuaagaguagcugcacuaugcuaaucuccuagaauuguguguuacaggcaaagcaaccauggcaguuacugugguaacaguguguuaacagaaagugcaugguuugaaauuaacccuguaucuuaggucccagcuaaaaccauuuuauuuggaugguucaauuugggcuaggauauuauauuuuucaaguccaucauaugguugagaaggccuaaucuguagggugaagaggcucaaacauugaucucacagguccugguagaaagcuaacauuuacaaaguguagguguagaggugggguugggggauaaggcaaacaugcuuuguugucaucacaucuaaaugaggaugucaaugcuuugagguaagucauuguuucuagcagaagcaaccuaggcacugaggguaaaauacuguguccacaguugcacuauuuaguuaugacuacuaaguggaguaggauuugagcaggcaggcguccuacccuguccucuccccuccccuccccuccccuccccuccccuccccuccccuccccuccccucgccucgccucgccucuccucuccucuccccccccucuuccuuuugaguauccucuccuuuuuucccccucucagugguaucauuuacuuuuaagauuacuuuaggcuugcucuucuuuuuuuaguuuuuaagauuuguuucucuguugucaguuccuuaucuuauuucuguguaacauaacagacacugcucacugcugcugucuuuuaaacaagaaugguggccacacauaaccacuuacguauucuuguccauagugggcaguauugcuagaaagcaugagaugggguaagggagacggaggucacauucacugagcuuggucuucugucaucagggucacuuaaugcucgaaucagugcugaagaccgaucuccagagaauaccagcuccucgguggcuguggacaacuucccagaaguggacaaagccaugcugauugagaggauagugaggcuacagaaagcccaugcccggaagaaugagaaaauagaauucauggaggaccacaucaaacagcugguugaagaaauaagaaaaaaaaccaaguauguauuacugugguagcauggccugugucagaggccugccauuugcauggccucagaauuggaugaagagcugaucuuuuccaugggguacaucauguuguccaggcuggcccugcauuccugggcuccagggguccuucugcaucagcuucuuguguagcugggauggcagugcucugccugcuuaguaauucuucucccauccaagucuccaucuuuuuggaucaccuguuguauucuagcuuuggggauacagagaugggagaaaaccuuaacgguagauauucuccuucaagguagaauaucaggagagagugugugagugagugagagaguggaggguaguaguuuugcuuuuuuaacauacuaagauaauuuuggauuuaaaaaaaaauuacuuagccuuuaaaagugaacgacucuaaaauauauauggaguuuugaguuuuuuuuccccuacugaucagaggggugauagucagguucacccuguagaagacacucuaaggucgugggcugagcccaucaguucccugagccucuggaacgcugcaggauguguucucagucagccaagagcagcccugcccugugaggggcaggcccaacccagcucagcccagcucagcucagcccagcucagcucagcuccagacgcagcuugacugacccgaaauugugcugcaccuuguuccucucccagaugccacccuuacuuaaauaagaguuagcuucauaguugagucuugugcuaauccucuuaaacaguuacuuuaaauacuucuauaccuguagaaaauccugcuuguagauuuuaaaagaaagggcaaaauagaguuuaguaguaguuuaauagaaaauauuaacagaaaucaaaccagucaaguaaugacuaaaauauuuacauacauguauggaaagaaacagaaaagcugugccuauacuccuucaacaaaaaagggacaggguaagagacagucuaaugaauaaggaaaagacuaagcuaacuuagguuacuggccuaaccgggauauauuuuauguugaucaucuuuaugcuugagauucauugcuuccuacaaaccccaguguuuuuauucugcaagcacccagaguaucauuuuguuuugcagaauaauucagaguuacguuuuacgagaagaaucaggcacacuuuccucagaagcaucugauuuuaacaaagugcauuugaguagacgcgguggcaucauggcguccuuguacacaucccaucccgcugacagcgggcuaacacuggagcucucuuuggaaaucaaccgaaaauuacaggcuguuuuggaagauacauugcuaaaaaauauuacuuugaagguauuuguguuucuuauuuauuugccacucaguaaccagggcaggauggcgccucugccauagucucaccuagcgucaggcugguuuucuuuuuucuuuuuuuaaaauuuauuuuuuauuucuaugaauacacugucacugucuucagacacaccagaagaggacgucagaucccauuacagaugguugugagccaucacguggcugcugaggauugaacucaggaccucuggaagagcagucaguucucuuaaccgcugagccaucucugcagccccaagcuguuuuacuaguacagggugucuugguacucagagauaaagugacguaguuacugggcagaaacugaggccgauuguuugcuucacaguggaugccguuugcagaaugaguauacccaguuacaacuucaguauuacaacauuuaaguauauuuuguggcuuuuuuuuagcuguugucucugacccaacguuucugucuuugcuauguaugcauggacuugauaacuaggaauagauuuuaaaaauaguuuuaaaccaaaguaaucauuaugcacgaaaacuugcuguagcugcaguaaaaacauuauaacguggggcaggccgugguaccgcacacauuuaguccucacagaggcaagacgccuaugaguuugaagccaaccuggucuguguacagagugacuuccaggacuacauagagagagccuguuucaaaaaagaauuauaacggcaaugggcaggccuauuucgcuaaaaccuccauguuuagacuaugucaguaccaagaauaaucacucagcuucauaguuuagacaaaagugguucaaaagauauuuacuuaguacuucauuuacuuaguacuucuguuuucucuccccccacuuauuaaaggaaaaccugcaaacacuuggaacagaaauagaacgccuuauuaaacaccagcaugaacuggagcagaggacgaagaaagccuaacacaaaguucuugccuaguagacagccgagccacagagcagcaggugccacuguccaguguccucaaacagucccugcuuugugucaacuaaucaaaaauugguuuugcuucccuguguagaggugcccuuuuaugaauggguguguggugugugugccgugagcuuugugagcucagcaaagaucauuucucauuucucugugcugcagucagccaccuugucacuaacucaauauuuaauuugcuuauugcccuaaagugcuauagucauuaguacaaggguuuaaaaacaaacaaacaaacaaacaagguaaccaccguccuuuccuuagugacaucagccugugaaaagucuuccuaaagagaggcguucaucaugcaaccgcucaccauuuucgcaacacaaagagaaaucuagaggaauuauaaagguuuucgguucugaucugggcagugaucaccccugugggccuagcuacuucgaaggcuaaagaggaucucuugagcucaugaguucaaagccagccuggaaacaucuuaaaaccccaucacaaucagccgccgucacggaauagccuuggguugugguguaaggaugugugugcguacuuaaaucaguucugaguuuacugacaaauagacaggaaagcuggcuguagggaauuagcccuggcugggcacuguuugucaggucuccuuauaugacauagguauauuuuucacauuugaguuacuaauuaaaauuuuaaaaucuuuagugauguaaacuaugauuuuaaacucugaacuuaaaacuuuccuguggauuuguuauauuuuaauaugugaaauggauccagucauuggaacagaugugugaagcucuggggcugaggugcuuucugccaugccuugguuuuacugacauuguguacaggggaauguaaagggcuugggcggaggcuccugugugcccaucacaucaggagaugcucaguuuccucaagugcuguuucuguaugaucuuuaacacaguuaugucuucagccgaagggacuuuggagcugaauuguguaucuuguuggauguuuacaguguuuaagauguacguuuaaauguugccaauuguaguaucagcacuucugucauugaagguuuucucaguugguagcaucuuaccucccagaaccuaacacaccgcauccugggaggcugcuacguuuggguuuggguuuuugggguugguuuuuauuuuuuguuuuuugggggguuuuuugguuugucuuuuccucuuaaagaacuugggcuuuaggauacauagcuuuaaagaaugguaugagcucuagccuggcauggccgcucaugcccaucaucccagcccucaggaggugacggcaggagaguauuacagacgagccuugagcacagugaaaugcagaugccuuggaagccuggacuaucauagaauuuugcgggcucuaagauuacagucaugacgucagugcccuuuuacuguguuuuaacauuuccucaaaucaacaucgauuauaaauguaauacuagaugucaauauaaugucuuugugaauauuauguuauuacucaaaaaaguaucucuuagcuucagugugaaaugcauucaaaguuguuuuauuuuuaagauaguuguaaaaaguauuagucaucugucuugcucuuuuuauuauuaauaauuuauuagaauaaaaauuaagaggguaagugcaauaaacucugcauuauuucccacguauuccuaggcacacuucccuagcccugggaagggcuccagaguguaggcagccuagcuacacccccugucuccucggcugaugcugagucaugagcuagagcauuagggcuuuuuaauuccaagacacgaaaaugcauaguggagaccaaccagugaucauguccacaguauucuguaccugggcacucguaacauauaugcacauuugguauagaaugggacaaacuguguuagcacuugugccgccauggacuuggagaacuuaauaauguaauaauuuaaaaguauaauuacuaaaagccaugcguugauuauacagacuguccucccauaucuaugaagcuuaaaaagcugaaaaaguuuuauuuucuuuuucauuaggcaucuccuauguccuuucauauauggucaagacugagcaaaagcauguguaagaaaugcauuuauguccaagagaaccuccacugacuuagggcgcgcuccugggguagauuuguuucugagguucuucuccucauagaauacguggaggagagacccugagacgacaguguguauugaucauuguuaguuacaaauguaaaugacuauuuauuuaguaauauuuugguauccuugggcaagaaguuggugugcgugcauguguggguccacacacuucccuggcuuucaucugaaagugagugcuugggacuccuuuuuuuccaucccacuugagauuuuugagucuguucauuuucaaggcuugaacauggugcguuuggacacaaugaacaguugguggugguuugguuugguuucuccauaaccauuuaaagugacucacucaaucaggcuacacaggucauuuauucauuaagaaauacauuugccuaauaaacacuaauaaaccggcacgcuacgggugucaugguuaucacucuccagucccuuggcaucugugcucucaugacagcagcaggacgggucuucaggccuuacucucaggcugcccuuugucacugggcuaagaagagugcuguucugcuugcacagguagaugagccaagcgccucagccugagcucgggccuggggaaagugcuguucccauggugcucugcccaaagacuguaagaagacacuagacuuuuagcauuucguaaccgcuugacuggugccuguuccgugcuccugaaaugaguccaauccagucgggcagccuucugaagucccuuguacaggcuguugguuauuuucuaaauauuuuuacaagaaaauuuagucuuaaauuuggaagaagaaaccccccccuugaaacuaucaauacuguaaaugugacacauguugcccugguaaggauauauauaaaaugacauucaugcuuugggacuauugacucuacugaucucuuuuucaagaauuuuuuucaguucauuuucauacugauauuguuaacacuuaacaccaauugguggcacuagugacugaaaauuguuaaaggugaacaagagaaauaauugaaaaaaaagcaaacuaaacaagaacuuaguugcauauugaaauguaugcauauggcuaucauucaugccugcugcucucuucccuucccgagugcagggcugucugcguuguguagggaacccuggguugauuacacugugcauucuguaaauacucuguauaaagugaugcucuucaggggagucuguguacauucuguacuuauuaaauaagcagugccuguuuaccaa

SEQ ID NO: 9344 - RNA, 1555 nt, Mus musculus
auuuuucaauguucaguuuccuuuaaugacccccaucuccccugaaggguaggugcaggcagcuaggcgacuggcaagacuuguucacuugaagaucuugccuugauugacggcuuugcccaaaugcuggaagguccccucccaggaaaaguacucucgaaccagggucugggucuccucgcucccaggauccaguuuccgccauguauacgacucauauccaccugccaaucuggacucagaggaaaggcaagcucuuggccucggaagacccaaacaccagaaauggagcugcuguuauugguuccaaagaaggauaacacuagcaaaggcauucuuccucaguuuauccaaucgcugaaacaucccagugaugagguugcaacucaugaaggucugggugagcucuucagggaagccguacucagcauaccacagggaccagccaucuuuaucaaagugcucccaaaaauauggcagcgucagggaagcgguacucagcauaccacagggaccagccaucuuuaucaaaaugcucccaaaaauauggcagggccacagagagaguguccucauuggaguacuuacgcuuaaacucauccaacacaaagguacucuugggcaggugagcgaaaggguccuuggccuugggcucagcagccagugccugcucacacucauccaucucuuccucaggagcuggggcagcugccuuuuuucccuccuuccgcucagccugggguuucugcuucuccucucaugaacccuuuucuuuccuuggaguaucuuuuuuaggcuggcucucugcaaacuucuuagcaucaaacugagccaucuucucacacagcuucaccucccccaagauagcccugaacugaggcugguuaaugcagguaaggaaccaccgguugguauuggggaaggccuggcgaaaagaaggcucuaagaccuguuuauagagccacaacaggguacagacaacugugauaucagccagugucacucgcuugcccaccggaaaaguuggagacuucaagugaguguccagcagccccaggauuugcuucaccuccucuuuugcauuuucaguggccuguuuguuguuaugcauaaugcccaagguggggaacacacagguacuagcuggaggaacgaugucacugucagcaaagcugacccacugcaccaccugagcugcugccucuggcguacuuccucgcagcuccucuuugcuuacauaauaggcaauggcauugcucucaaacacacagaauccaucaucacccucaaaugcuggaaccuugccggcaggaaauuuucggagaaauucaggggugcgguugguuuggcuaaaguggaagugggguggugcggagagcacgcggaccugagcccugcuguacugagcagcgaugagggccuugaagacccuccaguuuucaggguauguguacaggcucccagccaccauggugaucccgcagagaaaggggguggggcugucggugcugccacaaaguaagccacaagggagacaagggaggaggaaaggagu

SEQ ID NO: 9345 - RNA, 53664 nt, Mus musculus
gcuaagcugagcgguggcggcauacgccuuuaaucucagcacuugggaggcagaggcagguggauuucugaguucgaggccagcauggucuacacagugaauuccaggacagccagggcuacacagagaaacccugucucgaaaaacaaacaaacaaacaacccccccccccaaaaaaaaccuccagcauccuccguguuauuaugccaaguagaaaccaaggacuuaggaucccacgaugugaccccuaagcaauuucuuuacuaugccacggguaccacggguuauucugugaaauugguaggcacuaaaaguaauggccugagggauggacuccggauaaugcccucagagaggaaagaagggaggaggggggcgugaacaaucugaauggagucgcuaagacaccuuccaauaugcuggcaaauucacucagcucacccacuccucccagaccucaaauaaacuucuuucucacuuaaauugaaauccccaagguaggaaaguuaguccccuucucgcgguuccgcuuggucccuucucggggcccauucucugcggaugcaggucugccggucugugcgggcuagcgauggcaaucccugaugcagucuguccucuggccggcucgggcagugucccaaccgccugugcucaggcucucugcggcgcugcccugcaggggaggcagcaacacacugagggaugcugggcggucgccacagagguauccggcaggacccacggccgccgcgggggaugggcgcggaauaacggacggccgcgccgggccccgucagcccgacuuauccaggucuccuuccguuaucucgcgcccuccggagacgacggacgcacggaucgccgcgccgccggcggcaggaaugcaggggcguggggggagcggcgcuggaagcgcgccgagaggugggaaaggacccgcguccaagcgcgccggggcgcccggcgccgggggcgcgcacgcucugacgucacgcgccgcucgcccaaugagcgcaggcucuguggggaggcgccguucccgcccucgcccgccgccgguccgccgcucgggccgcccccgggggagcgucugaggaggcgcggggccgcggcgggcuaaggcgccgccaggcagcgucggacugcggacgcucgguucgggcccagggagccgcucauccgcgaccgauguccucaagauggaggcggcgggggcgacggcgugaggaggagggcggcgcggagagcgcgggagcaggccgaggguugcggcgggggcggcgggauggggcugcugcuccugauccuggcgucggccgugcugggcucguuccucacgcugcucgcacaguuccugcuacucuaccgcagacagcccgagccgcgggcggacgaagcggcccgcgcgggcgacggcuuccgcuaccuuaagccggugccgggccugccccucagggaguaccuuuauggcggcggcgccgaggagcucgcugcuugcuccuccgaggccggcgccagcucgaccccgacccccgacagcccggccccgccgacgcuggagaccugcuacuuccucaacgccaccauccuguuccuguuccgggagcugcgggacaccgcgcucgcccgccgcugggucaccaagaagaucaagguggaguucgaggagcugcugcagaccaagacggccggccgccugcuggaggggcugagucugcgcgacguguuccugggcgacacggugcccuucaucaagaccauccggcuggugcggcccgugguggccucgggcaccggcgagcccgacgaccccgacggggacgcgcugcccgccaccugcccggaggagcuggccuuugaagcggagguggaguacaacggcgguuuccaccuggccaucgacguggaccugguguuuggcaaguccgccuaccuguucgugaagcugucucgcgugguggggaggcugcgcuucguccucacccgcgugcccuucacccacugguucuucuccuucguggaggacccgcugauugacuucgaggugcgcucccaguucgaggggcggcccaugccccagcucaccuccaucaucgucaaccagcucaagaagaucaucaagcgcaagcacacccugcccaguuacaagaucaggugagaggagggucaggggagccgaggcuacccgggggagguuagccagggaagggccaaggcagauucccagcacgacccuggccugcaguuugcuuccaccuggacugaggcccccaagcaaagaaaggcggguagugggcacuucccgugcugccaaggcagcacagggagcuggaggccugagcgccuugucccuggccagucagugagugccucuccugggucuguugagacacacuugugugugguuguugcaaccggaaggcagcggcugugucugccuuugcagcaucuccugcaccacguggaaaaguuguuccugggcacauugcagaccugaagggcgugcucacaucccggguguuucuguguggcacgggccuuggcagcucuccgggcagaggcacggguuguuguagagggaugugauuuggaggaguugaguccggugccagguggucuucucugugaauuugggguaacugucaucugcccuugggaaguaggcuccucaccacaaacagacccagacuucucaggugucuacucccgguggcuguuccuuaacccaauacuccaagucaccuuguggguaauauuuuaaagacagugauuugaaguuuuuuaaaguuccucuguaucuggcuuuaugugaugcacuucugauuaguuaaugcaugaguuuucuuuugaugaauuggaaguggaaggggaaaugaguauuuggaggauuagagguuucauaggugggacuuggaaggcuuggugcaguagaaaggcuccuguuucuuuuaaaacgaccaaaucuucaacuucucuuucuauccuccuuuaacuuuguguucaguacauagaacauuuuagguuuuguuguuuaaucugaaauaugagucuaguauugccuuacauuacuacugcucuuuaguggagauugaagaccccaaagucuguggcacaauauaaugcaggaguaguguagauuugggauggauuuuugcuuuguggagcuuguacuucacuaguuauguuuuauugagaauaaacaacaguuuaaacuuuggguggugagagaacuguuguguggagcacauauuuccauggauuuguaggggauggugaacuggucauaugcuaugcaggauuucugguucuguaaaggagauguaguuuaugaaaccuguuuuuacauggcugcauuaugaguuguagguuuuaagcagugauguauuuauagcaguguguugcuuagaaagucauaaacaaaaguuguuacaaaguuugauaaucacaacucuugaucagucagaaaccacugcagaguacaucacucaauauguaguuuuauccuccuuacuuuucucagugcucaggauucaauacugaucagaaauaaauauugccuucaccuucauaaaguuuagaguucaguaagaauugauuauuaucuacuuaauaacauuuagacccagguggaguugauggaagguugaaauuacuagaaagcugcuauuggguugguaaacggaacuagaaauguggggaugggagcacuggcugaggaagugauagcuuguguuguuugcccagcacuucuccagagguuugcuacacuagugacagugugggccugacuucagguaagagaauggauuuuauagcuucucucagacauaucaucauucucacagagagaaaguagcuaguauuaaucccguuuuauuguugaaggaaugaagcacaugguaguuaaauaaccuccuuaagucauacaagcagucaaguggugaaaaauugaggcuaccuuuuuaauuuuuuguaacuaaaggaauuuauuucaacuucacuuuuuuauuuuuggacugggaauuauccaccaguuaaugcuuauugguuuaaauuuuuugcuuuccuguuugcaaaaaacuuauaaauuauucugauuggaugaagaaaacuacacaaaaaaaguuucuuaagcuuuuagaauuaaaaauaacauuuuacacaacccaaaccuuuaaccccaaauccagaaugaagucucuuaaguacauuagaaugacuacauuuaauuaucuugauuauuaguguauauauauauauauauacacacacacacauauauauauaaaauguuccuaaagcagaaaagacuaggaaaugggagagguugucuucuuugauccugauaauuguugacaucacugugacccaugguacuggggaugaaacaguccgaauacugagcuucaccacagugcuuccauccccaacuuuuucugguucuuaaaugguuuuuuuuuuuuucaaaguauuauaacaguccaaauuaaccuagaacucugagugaacuguagagauaaaacuuccugacuuaaccuggaaacuucaagaggauuuuuuaaagcuuuuugucaggcuaaagcuuugggugugacacuauucaacauuucuuuuuuaguccuccagauuguguuuauccauuugaacaucuaaucuucuuaguaagagcuaaaauaguaaaagaaaauuauacuaagucucugggcucuuugcugcuuuaaucauuauguaacaauugucuuguuggugaacacuguuguccccucucucuaaguuccuguuuuccuuugucauauugcuaaaacgaaguagccuuuuacaacuagccagguccuaggcugugaccuagaaauaguuaggcuuccuaaggacucaugauagaugcuuaaauuuaccaaguaaagcagcuguuuacaaaacacuggauuuuaaaaaaaugaauuguaauaugcugaaacuauguucucuguuguauugaaguuaggaguuucuuuauucagccccuucauuguuuuaaucuuuuuuccccuuaaaguguguacuuaaaaauugugcauaaaguagaaauauuuuuaacacuuccaaaugagucuuuaucacuaaucucuagcacauggagagucucucuucacugugaagucuggguuaguaguuguaggguggcagggcagagauagcuuggguuuaggagucacauauuugagauucuuauuaauguaucugcuuuuagaacagugguucucaacuuccuaaggcugugaccuuuuaauacaguuccucguguuguggugaccccaaccauaaaauuauuuucauugcuaauucauaaguguaauuuugcuacuguuaugaauuguaaugcaaauaucuguguuuucugguggucuuaggugacuccuguaaaaggguauuucaacaacaacuuccccuguuuuagggugguguugucaugggaaggacaaaaucaguuugcuuguccuguacuguacugauuucccagugcuaaaaggugagagauuuuacuugaagucaacucucggcuucugauuuuuauuuccauauacaugcauuccacauaacaacaagcaaaaaaaccugcaguggcagcccuggguaaagcuguguaaggcucauucuguacuucauaguuccucacugagcugguccugauuggcucggagucacacauuugaggccuagagugguugcugauggcuuaauggcugguaauuguuuuacuuguuuuaagcuuuauuuuuuuuuuaaaaacugccauugagcaaauauaauagagucuauaguguugaauuuuaaaaagucauucugccacaaaauuauaaacaagaaucuugaaauauuucacuuggcuuguugagugguaguugaaaacagcagggucugccuuuuguuugagauuggaaaaugguuugcuugaguggauuuggucaguaauuaaacauuucuuggcuacaaaagaggaaauggucacuugauuggcauuguauuugagcuuauugaauauggaauaugugaggaaaucauaguuauucauggguauagaauaucuuuugagcauuaguuuuuacuguaauuguuuuguccugucuuuuuauuacuguaaacacucugaaauauauuuguaggaauuuuuacauauucucagugacucgaaaacaaagaagacuguacuauauuaucuauccugcuaagguugagggacagaacaauaacaccauuauauuaauguacacaccauugauuucuaagaacuaaauuaggcuuggucuguaaagccuccuacuuuauaauguaguauauacauaauuuauuucuuggucuaaugagaugaggaagagcauuuguucucaaugucaguuacauauaaauuuucccccugauuguuugaggcaaagaugauuuuaaguaaucccuucucucuuagaaacuuccaaaguaaauucacaaagaaacugacaaacuuuucugguggugugauguaucauacuuacucuuucauacuuuuuuuguguguacguagauaaccuuaaaauaguauguugucuuuaagguggcuacuaacauuccuuaguggcuauaguaauaguuugcuuuacuuacuaauaucacuagaaaauguaacgaaccuuucauacuucaagauacuagaaacaauggaauuuguguauuauucuaaaauuucuuaaaaugaauauaguaaugguuagcuuuauuuacuaauauuacuaggaaauauaucuaaccauucauacuucaagauacuagaaacaauauuaguguuuauucuagccauccugaaguaaugauguaauauaauagcuaauuuucaucugcagugcuuuuuuuucuuacauuacggcucagaggaaauauguuuucaugucuuuuuguaaauggaauuucaagaucauuuucucagagaugaaucacaaagucguuuuagaaagucauauauuuuucaguaagugcugauugcauacugcauauaucuaguucuuugcuggguaugccagugauaaaaauaguccuaagaaauaaaugcuuucaugcuauuuguuuucuagggcaaacaaauaaucaaauuaauaauaguggcauguggauauacuuaagacuucaguuugugaggaacacgaauagaucaauaucucugcuuaagcaaucacaugauuacuuauuguuauauagugucuagggaaaacacuauauauaggguuggguacuacucaauuccauaaaaccacugcaaaaaguaaagcuagaaguaaguguucucggguuuuccugaagaugcuauugcuauugaaaugcauugauaaacugcuuuagacaucugaggguagauguguaugaggaagaagcuaggcuuuaaucaauaauguauauauguauuggcuaucucagagaaccagaguuuauuccugaaauaaaguguaucauguucauguuggaggaguauccugacccaacauuuaauacugauguaaacuauuacuagcaguuuauaagaugagcuggauaguaaaauaacuuuccuaugggugucuggcaggcacucuaagcaguccacacacuugcugucucucucacaagcaagagagacaucuugcuuuuuauggauacagaaacucaggcuuagaagggauugguggcuuucucagaguccuaaauaaacaguaaacaauaaauaaauaauaggaaaaauucaggaaucccaaaguucgaugcuauuucaguagcaauaaacaaucauuacuccacguucagagggcuauguggguuagaugcuuuuagguguguaagcuucaauuguuuuuguguuuuugaauuuuaaaagaagaugauuaaacucucugcaccugaaaauacugaacucuuaacuuccuggccuucuucagaucuuuacccuggaaaaacaaagacaaaacucacaugauucuugccuaccccaaaccaaaaaaacaacaaacaaaacaaaacaaaacaaaacaaaaacaauguuucucaacuucuuaaagggucuuuugaguuuuguuuuauggaaaggcaauggggacuguggauaauuucuacagaaaaauagaaaaacagauuuuuguuuaauuucaugaaauuaauuaguuaccuuggaacauacauaggguuuuuagacaucaggcuggaaaguaaacacugacagaagacaguuuuguugcuauaaauucaacuaacacuaacaagcuagcacagagcagacacuucauagucuagcauacuucuuauaaugugcccaagaauguaugacucagacauuucuaagcaaacuucuguucucuuuccccucucccccuccccucccccuccccucccccuguuucuuugucucucugucucucucuucucucuuggugagauuucucuagcuuuuuugaggcaucugaugcaauaauaguucaacauugauaucugaaguccaaguuucuacccuucaacacaaauaaugauaucauuaacuuccuuccaccagacucauugaguaaaugcugaauuuuuuuuuacaguauuuugccagucuuuuacugguauucaaauaguguugaguaguuaaaaaucuauuccugcuauucccaguguuauuuuggaguuuacguaaauggucaagcacgugcagucauuauguacacugaauagaugccucucgguucuuucuccacuuuccucucugcaccugcccucuccuacucccuccauucuucuccuuaauaacaaagugcaguagagcugugacccacagauacauuugcaaguaacaagauaucucucccaacaguauguguggauccaacuuccucuuuaucucuuuauaaaaaaaauuaaguagucuuuaaugagauucuacuacaacugcaucuccucaguuguuuccuuguguuugcccuucuucuuuccugcuuauuuaagacuuggcuuuccucuccaggaucuccuuauccagcuuuagccuggugaugacugcauugcugggguggaugcucacauggacaguuaugccauuagccuuuucuugcuguguuugcucauguagaugacauacucuuccuauaacccuggccuuuguaauuuccucagacaaccugaacuucaucauccuuucuacuggacauagguugaacauuacacaucugucucagcucuuuggaagaggggaagacaugaucucuccuagaauguaagaaggcacauugaaaugcuguuugugguucuugccuuggucagaagucacaaagggacuaaacuacauuuugguggcucacaguccugugaugaccacaaaaggaaaaacagauuaauuacacuucacucuugauuauuaucuguuuuucuuuggauuucuuuuuguuuuuuuguuuuguuuuuuguuuuuguuuguuuguuuuuucaagacaggguuucucuguguagcccuggcuauccuggaacucacucuguagaccaggcuguccucgaacucagaaaucucccugccucugccucccaagugcugggauuaaaggcguaugccaccacgcccagcuuucuuuagauuucuuaaacagaguauauggaguauguuuagcccccccuucccuuuugaggaguguauaugugucuauaugugcaugcacaugugcgcucauaugccugugcauaugcaguccagaauuugguguuggguuucugacucaguugcuccccacuuuauuuuuagagacagguucucuuacugaacuugaagcuugcagauucagauagacuggcuggccagccggcucugggggcuguccugucucugcccccuagccucaggaucacaggcccagggucucuuauaugugguucuaggggaucgaacucauuuccccaugcuugaacaagcacuuuacugacugagcaauuguuucagcucuaacuugcuuuuuuuuuccuuaaugguuaaagauuauuguugacugauaauuuaaaaacaaauacuuuagucucuagagaugugugacuccucucccugcagauagcagucccuuacaaagacuuugaugucaauccuugccccuguauuggguacuaguuccucuuuuccacacaaugaaaagccaaaugugagugcuuuugcagccuucuuuacauuccaaaagccuugguuuuuaauuuuacauccuaaaaaagucaauauugaauaacaauaaaauauauuuucauuagucuaguguauaauugucaauuuuugcaaaaucagcagaguguuuuagaacauacuucucuuuauucuguagucagcacauugggcaccauaaauucuucaugugggaagggugaugcugauuguauggugagugggauacugaaauagcugggcucugauuugcuuuagugacagagcuggacaaccucucucuccccaacaaaauuaguucuucuuguuguauacuuaaaaauacuguggcuacuguaguaaaaauaagccaggaggcuuuauucuuuugcauuaaguacugaucucauuacuuuucuauugcuaugauaaaacaccauguccaaagacuuauaguuuuagaggguuagaguccaugaccaucuuggcaaacaguagcugagagcucacauauugguugaugcauaaccagauauacaaccacacgacccaagaacacauuuacuccaacaagaucacacuucccaaucuuucccagacaguucuacuaacuggaauucaaguauucaaaauaugagccuaagggguccauucucauugaagccaccacaaguauuuuauauauuuacuuugucauugcuaagaucauuaccaguuaaacaggcaguugugacuuaggaaugauauuaaggaaggaugcugcuccuagggucaaaucuguaauuuaucucuacacaguuaugugacuacaguuuuugcuggaaaguuuuuuuguaguaguaguaacucugucuuacacauuuacaauccuaguacuugggagauggaggaggaggaggaagaggaggaggaggagggaggcguccauccucagcuauguauugagucuuugccacaugagaccauaucucucucucucucuuuuuuuuuuuuugagaccauaucucaauaaaacaagcaaaccauagggagcaugaaugagcugaucuuuucugcuuaguagcugaaaacgagggagcgagagcaugcacaguaguaaggaccaggaaucucuaucuugaaaauuaacuugugcucuguucuuagacaauuuaugcauguagauauaaguaucuagaaaauuauacaucuaguguuuacuauaugcugauuuuuuuuuacaacuguuuucuaaauucaucuacccccugugugugugugugaguguguguuuuggaggucagaggacaauaccuagacuauucuucaccuuccacuuuguuuagagauagucucuuauuugccaagcuaacuggccuucaagcuuucaaggauucuuuuaucuguagcucccagcucaccauaggaacaugggauuauagacaggugcuacugcaucuggcuuuccaugacugcuggggaaccagacuugagucccuugccuggcaaguguuuuacacaaugagcuguuucucucucccauucccuguaggaugauuauaguugcugacuacauauagucuuaccuuagucauuugguaauguaaauaacucauucaggucuuucaguucucuguaauuugcuagaguaagguauucuuauacgguuguaugaaaauuauuuuuagaaggcacugaaagucucuuguucuuaacuguuuuugacagauacaaauuuagcaugucaauauuuggaaaguuuguuuguguauucaucuuuuuuuuuuuuuuuuugagacaggguuugucuguagcccuagcuguccugaaauucuauagaucaggcuagccuugaccucagugagaucugccuauuucuaucuccagagugcaugcuuuaccacugccuggcaacuuuuuggcuuuuaaacaggccacaguagcaaacuuuugacauggaggaauuaagcuaaauauuugcaguaaaacguuuccuucuguuuacuaauguugaugugcuaaagaguauaaaguucagaauauugggguuggggauuuagcucagugguagagugcaaggcccuggguuugguccucagcucuggggaaaaaaaaaaagacaaaauaacaaaaaguuaagaauauuuagagaugaauaaagagaaaaaaaugugaugaucuuaguuuguaauaaacuuuacuaagcacaguauaucuacguuauagccuuuuuaaaaaguaaauuacuuacuaaaaaauaucuaaauaccacuuuaaaaucugaauaaacaacugaguaaauuccuaaaaacuugaacuguuuaauaauuuuagaguuaggauuugaacucaauucugagauucuuggagguuaugagaaguuauugaaccagacucugguaauaauuguuggaacuuaggaaauaccuguguucuuaagguuuuucuugaaaaguaacuuaagcccgucucugaaauaguggcauuagcagaucggaguuuguguucugcuuuagguuauauaggacaaaucaugcugcuuauaguuucuaagaccaaauaaaagaaaaucuagauuuuuaagguugagagagaaaaagaauuauaugaauauaugauuuagcaguugcuucccuguucuguagaguaaaucuucucuuagaauagauuuuguguagauuucucaaaggauagacagagucacuaaucuuacaaguaguauuuaauugcuuacuacuugaaugugauuauuuuaaacagacauagagguauagguaauauuaaaaucauuuauacuucagaaaauauuuugcuuuuacuugagagagaacaauuaaaaagcuagacaguuauaaccuucaaguauaauuucuuccuccuuguucuauucaagucucucugccuuccuguggaguauagcuuguuuucugucuugauguggccacacagaacugccaucgucguacauuaugguuccugccuuuuccacaguugggaggugauaguuuuaccuuagguuguuuucucucccccagugcacaagaacacuuuauucaauaaaauuuaauacuuugucagggguacuguacaguccagaaauaauuugugguaaaggacuaaaucaaaauaguccccuuuuggaagugguuuuguuuuguuuuguuuuguuuuguuuuguuuuguuuuuuuaaaucuaauagugagaaacaaugugccuagguuaaguaccugucuagagcaagcaugcggaccuaaguugggaucucccgcauccacgcaaaagcugaacaugggauucaaguaccuguaauucuaguccuggucaugggauguguggacaggacaagaaaaggugcaucuuucgagcucuuuggcuaguuaaucuuacugaaucagugaguuccacaccuagugagcgagagacacugucugaaaagauaagcuggaaggacuagagagaugguucagcaguuaagaacguugucuguuuucccagaggaccuggguuugauucucagcacccucauagcagcucacaacugacuauaacucuaguuccaguggaucccucgcuggccucugcaggcauuaggcuuguacaugauguauagaccaacaugaagacaaaauacccauacacauaaaauaaaauuaaaugauuaaaaaaguaagguggaauuugauagaagacaccuagcauugaccucaggucuccccagucauguauaccuguauacaaauucuuaacacacaagagaaaaucuuuaacucauucuaaaauguaauugaggcacccuuuugacuggcucucucagaucuuuauaaggguacccuaucaauucaaaauuauacucauaguaauauaaaguauaaaaauguaauuugccuuucccauuuaguucuuuacaguggcguuuucaagaagucacaugauaaguuaugaugucauuacugacagcuaauggaauguaagcuuaauuucucauggggaauauuaauggacaucccuagaaacaacaguucuuuggaguccucaguaauugaaaaacacaugugagaucccaagaacagagugcaaaccacuaguuuaaccuaauguuuaucuucacuauauauauauaaaggaacuguucuuguuuguucuuucugagucaccuuuaaugaauauuggauauagacauuguuuucaguugcuauuuagaacuguuaguccauguugaugaugcaagacauacgggaaugagaauggaucugaugcaguuuugacuuugccauuuaucgugcaauagcaaacaagauauuugagugucucaucuuuaaucuccaccuauaaugaggcuuauuaaguuccaugcauuguuaugaguugccagaaucaaggauacaugugaacauauagugugauuuacagaaguuuuaaauuuuaauggcuaggaauacuaaaauggggagggauauugaucuuguaauugcuaauugauacacaccaugcaagguacaguuuuaaaacaguuauaggcacugaacucaaggccaccugaauucuaaaguugugggaagagaacuagccauaaauguaaaauuugagucaguggggguucugaaauguuucauuguggaggaggaggaggagggggaaggggaggaggaggaggaagaggagguuugcucuuugacaugucuacagaaggacagccuuaauacacguacacagagcuugauaugaaguauuucuagauuauaucccugugucacaugcuuuaugaaaacuacucaucuaauucuuaaaacacuuguacaagauggacacuauugcugucuuuucaaaugaaacugggccucucaaaagcugaagccugaauggucucaaaccuaauaaguauuaaagccaaagucugagaccaaguaaacaauacuacuuuaaauugccuuauuaaaaaaaaaacaaaaccaaaaaccaaaaaacgaaaaccagaaagucauggggaaaucauagaaaaucugagcaaaggaauucagaguucuauaaaggaagaaauuaugagcauuaaaauggauauagaauguauuagcaaggaguaggggccagcuaugaguagagaacuauucuucuuucgaaugaagcugacaugagaucauuaaucccaauaaaagauaucugaguuauaucuuguuuucuccuugucuuuuguuccuucuugauucuuacccucuacuucccagauaccuauccuaagaguauguuaaagguagagugcauauuauuuuguuaacacacuagucuaacagcuuuugccaaugccaccuaaggugggcaagaucuucagguucaaauacagcuuuauuuugaaagaacuagccuugggugugagugagacucugcuuuuauuggcuguaucucuguccucuuuaguuucuaauuuucuccuuuauauuauaggauauuuguacauucacauauaauguuguauuuggaaguguuuuuguuaucuucaugauacucuuugaauugaguguuacacauaauacaugcuauguuuuuaaccaguuaaaaauaaaaggaagaaaugcugucacauguauuuaagaguuaaauaaguuaauaauauagacaaagcuccuagaacaaugccucccacauaaaugcuagcuggauaagaagugggacaggccuaguuguugugauaauaguucuaaugagcuaguuguguaggcaggccauuuuauuucucagugccuuugcuucccugagaaaacaaggagguuaccacagauaauguuuaagguuuuaacaucucuccuguuuguugacugauaguguucauaguauuuuugguuaucacuuaguaagaaaauguugcuuuuaaagugugcuuucuuacagucaugcacugagaucucaguauauggguguagaagacagaccauguguccuuuauaaauauggaacauacuuuuaaacagugaggacagguacuucagaggugacauaaacacuugaagaauucuaucuuuagcagguaacauuuaugauaccuugcaguuuagaaagugguagcauuaaaaaaaagaaacaaaaacaaaacaaaacuucauuucacaaagaauacaaccuaccugacuuuuaaauaagaaacaggggaugaaaaaccugacugaaauuauaauuuuuuuuuuuuacauaauggaguugagagugcuaccuauuuauguugcuuuaaauuuuguguucuuuuccuaauacuuugccucuuuggcaaauccuccaucuaccuugccuguauauuucuagagguagaauucuugcucuguauuaaagggcuguguccuuuuaaaaacuaauuguuaguuugccuuuuacugggcuaaaaacucuaguaaauuuaucauccagaaaagaacucacaagcugauuaaagucgaguagcucuagaccucagcauauuuuuauacuggguuuguaguaaacccuuuucuaaggaucacaguguuugcaaacaguuuuccugcugccaugugauggagaugucaccagcuggcauucaggguguuucacagaacaaucuugaaaagacaucuuaaaguaaaaacauauuuuaacguuacagaagaugcugucauccaauaugaggagguuuagcuucuucuguagguguaaaauuuuaauuauacauuuuaauauauacuuaauauacuaacguaacacacauuuaaaaaccaaacuuguuucuuguccuuaaacauuaauugaagauuuaacucacuacaugaaaaguuuguaauuguaacaguuuagcucugaauauugacaagaugaacaguuguaaaagcagaaugggggccugaauucaguuccccuaaaugcacauagcaaugcuggggacgauggugugcuugugcucucggggcugggaacacgaggcgggacaggaggaccuuugggucuguccagccagggaagcauacuuaguaacuucaaggugauaggagacacucccucagaggagguggauaaucacugaggaugacacccaaggauucucugacguccacacauauguguaccugcacagcagaacacacaaguaagugcacacacagagagaaaccugucauauggcaucuauucauucugcuuggccuaaaaguaacuauuuuccugauuucugaucuuucgcacuuuuuguccuauuucucaacuuuauugaaucauauuaugugugcuuuuuuuuuuggccuagcuauuuugauuaaguguuuaugcauauggcuguaguuuuuucauuuuauuuucuguauacuauuccacuguacaaguacgccuuaguaggauaaugauggacaauugcuuagugcuguugugaaugauuuuacacuuaucuuuucaugauguacauuucuauucgauacugcuugggcuaggauuguugagucguagacugauugucuuuuuagaauuaauagagauuuucuaauuaagucuauuccagcaguuuuuacauccuauugcauuugcuccuaucuucauuuaaguuaaugcauaaaaauuaaaaauuaaacagaaggguuuaauuaggugcugagaauuuaacccaugacuuacuuuuaccauugggcuacagcauaaacagaaagguuuuaugaaaauuacuuggcugccccaagucucaagguguaggagugaccauuuguaacaguuucucuuuuuaguagcuucuaagguuaaggccauagguucuacagcuagacuucuagaucuuggcucuacuacuuucucgcugugugcauuucccuugaguaaguuauuuaacugauuugugucucaguuuccucaccuauauacaaugagugcuaauuauauaccuauccauucauauaguuacuauagaaaguaaguuaucauacaagguaaguguuaacuguaugcuuaauuaugguguugcuuccauguugcugaguaguguaacaacuauuuuuaauauugacucuaauguuaucuacuguuuaacuuuauaagauaggugauuuaacuaauaucuuuucuuaucaucuuuuugccuuuuuccaauauaucacugcuuuaaauugaugacaucuauagucuguucacucucaagagcaguuugguuuuuauuauuauuguuauuaucaucauuuucaugcuguguggaucauauuuucauguuuguuugaauuuuuguaauuuuuuuggguagaaagaacacauuucaaguuaaugcaguauaguaauucuuggaaucugguuuuuccuaccccagugcuuauaucugcuuuguuuguuuuugagacaggauuuuuuaaaugacauuuucauauaugcuuaguuuugauuuacccucucccagcucccuguccuccaccccuuaaauaaacacuuucucucucaauucuuguccuucuacugucuccucacgugagaacuuugaaacagcaguaaaguuaacuacugauuauuuguuagcaaugggaauugcuuuauaugagauuucuuaauucccauugcuaacaaauaauagccucaguaguuaucuuugcugcuguuuguguuauuaucauuauuguuuacuaaucacuaucauuuuguguccacugacaguccuuucuaaauuuugaucagauacuguaggagaugcuucucaucugguccaaagaaucugucugcauccaaagcugagggccuucuggauccucuggguuucccuuuucuguauucuaaguguccugggcuugucaguaauuaccuuccaguugugcuaagcuucacauauuaaaacacauuaauaaauguuuugagucuuuuguuaaacagguagauauucaguuuaaacuaugauuauuauucagaaauuuagacuuaucuuuacuuuuaucagguuuaagccguuuuuuccauaccaagccuugcaaggauuugaagaagaugaagaacuuauccauauucaacaaugggcacuuacugaaggccggcuuaaaguuacauuguuagaauguagcagguauguucuuuguuuucucuuuacuuauguggccaagaaaguaugauagaaauauauuaaggacuguuuauguuuauucugcucuguuaguuuauguuauauuauuuuuaccuauaaauacuuuauacauaaauuuaaugaaagcagucuuuuccaguuugcaaaaauaaaucauauuuagaaagucacuugaaagcauuuauuuuugcaauaauucccaacuuuuuagaugaauagugcugugcugacauuuuaucuuaacuuugccuauuggagagcauuccuagcauaguaguuuuuugaguuaugauuauuaaaaaugcucauuaagugacuaaaucagacuaugaacacuguuuggaaguggucuuuccuaggcucaauauuuuaccacuguaguucacacuguucauuucuugccuaacuuaacaggcagaaugaccuuuaaaaggcaauuuagccgucacucuacuucuuaaaucuuagucccuucccuuuugcucccaggacggcauccagaucuuccacugaccuaugagugucuguuuauccaucuucuuuuucacucccuucuguucagccuguaacucauaauagugugucagcgacacuggccuuccuaagagaggguuugacaagauauccuccaaaaagccagguagcaaauacggacaugguaacuuccccugcugucugccaugccuccucaucucugguguguacuacagagucacaggcagugcguaaaugaaccagcuuggcuuugaccuggaacuuggucacuuucaguuaaguuuuaugugugaugaagugguauuuugauuauuuuuuuaaccacuuaaaaauguagaauuauugauagcccauauaaaauaggcaguugccuggauuuggacuacagccugccacuuuucugccuagacaucuuaaaggacaagcuccgccugcuuucuuggcccacacugucuccugcuuuuuggaaucagccuguccuaguacucacacuacuuccuuaauaacugcuuugaguucuaaauacaguacacuguccuuagacucacuucuccgugacaguugauuauaccacugacuacuuauaacuuuucauuuuuauuccuaacucaugauauagauaaguacuugaguaguaggguuauauuuuguaccuaauacauuugagucuuugcaaauagauaacuaugaauauacggauuuuucuaauucauuuucuuaagucuuaugguaacuaauagcuaagguuuauuuugucagaaagucuugacaagagucuuauuggaaaaaaaaaaggagaccaaauaugcuguuauaucauaaaaggaaccauuguguauaauaaaacagauacaguagguacgaggcuagguauuuagacagagugacaccagaaggguaaaaagagaagaacaauaaaagugcccuuuauagaaggcccagaaaaugauaauuuuacguuuuggaaauaauacaaaggucuaacaccuuucaagauaguuuucgccauaauuauuuagugguaugagaaaguuuguagugaauagaauauucaacagucuuaaaagaaugaaaggcaauuaaaaguuucuguagaccauuugaacauagguaaaguucuaaauuggcuugcugugaugagcugagguuugcuggaguuguaguacacacacacacacacacacacacacacacacacacaccccuacuuuugaaugauacuuuaaaaauaauuuacuguuauaguuguagcuuaguauuuuuauaaauguugcuaagcuuuuagaaaucggaccuugcaucaaguugaaaaccaaaacaaaaguuaggacugaaggaagagacggcuguggagccgaggacuuuguucuuuuccagcuccugagauuuguuuccagcacucuugucaggcagcucacaacugccuaucgauuuuaaaaaaacuguucauuuugaaauaaugaaaaaguugugugugaauagaucuuaaacauuuuugcuguuauuuugaaguaauuucagauuuaaaagcaugcaugaagguuuuuuuuaaaaucaaacuguuaaaagauuuugagaguguauuuucccaaugaaauaaauaacuuguuuagauauauuuauuuuuuauguguaugaguguuuugcuugcaauaugugugugcaccaugugugugccugguaccugcagaagucagaagagaacauccaaucccuauggagccagagucacagaugguugguuguaaaacucaaguguaguuauaguaagaagauaaauaacucaaacaacucuguagagaucaauuuuuccacaccaaauaaaacuuagugaauuucuuaguuuacacuaauuuuuuaaauuuaacuuauuucuuaauugacaaaauauguuuaucaucauaaacauagucaucauuuuucuaagguucauauuauuuucugauaaaguauacauguugacuagaaaaugguuuuggcucuaaauucuaagagggauuuaucauguuaugugaaagacuuggguguuguaauggauauauugaggggcugauuuuaucaacaaauuaagaauaugaccaguaaagugggggccauaaaguuuuguuaacuagguucugugcugcaaagcagaacacagggcagucugugaugcaguacacagggcagucugugaugcaguacgcagggcagucugugaugcaguacacagggcagucugugaugcaguacgcagggcagucugugaugcaguacacaggguagucugugaugcaguacgcagggcagucugugaugcaguacacaggguagucugugaugcaguacacagggcagucugugaugcaguagauccaggguagucugugcucacuguaggugggugaugcuggugauucagaucacgucuucauugagucagauuguauuuucucagcagcuuuuagggugcuguuuuguuuuauagggaucuaaaaauacaucuuuaaaaguucuuauuuuguuuuguuuucaguguuaaauauaauacauagaaauccacagguguugacacacucaaccccaagucaucucccuuucucccacuuauuucuuguaauuguagccucaugacugcuaguuuucccagcaauuacaguacccuacugucuguaucacuuaccuuucuugcugcugugguaggaugccugacagaagcaacuucgggaaggaaggggggauuuugguucccaguuugagaguacacccauuucagugaggaagcauggcaugcaaugggcgugugaaguuaguaauaguuacauugcaucaguaggaagagcaugcagagagaagaacagaacccuugaccuguugguuggugcuacccauauuuagggugggauuuuccuuaucaguuaaccuaaccuaggaacucacgaauagguguggccagagguuuguuuccaugaugauucuaaauccuguccagucuaacagucaaaaagauuaaucaucaaaaucuacuugucagcuugucauucaaguacacuuuuaagcuauaauuuuccacuucugaccuacauaguuuccugcaaauguauucaguccaacuucaaagucccacuagucuuuaacacuuggaacacuguuuagaugugcaaagucaaauucucuucugagugauugcuaaucaagcaaaaagaugugaguuuuaauccucagcaaccacgcaaaaguugaguauggcuucaugaacuuaaaacccagcaucgcaaggcgaagacaagcaaauccugaccgucugcagacuccuuggcucagcugagacugagcuucagguucaauaagagucugguuuguggguuuguuuguuuuaaaaaagaacaauacaggacguauccauaucauccucuagccuuucacauucauguuccugagucuaagcaccugugugcucacaugugugcagcacacaagaagauagaaaauaugaaaaucccacacaaauucaccaagucucaggcgcuaaacauaugcugggcauuucuugcuuuggucagaucaucucuuauucugucugggcuccaaaaggcuuagguagcuccauccuuugaguucugauccccguacacauauaguuucucucuugggccaggucuacuccuugucugcagcuuuucucagcagaugacauguggcucuggcauuuccaacuuccuggaauguacaauuuaggcuuccccuucauaucuucaggcaguguccucuuggcagauacucuaacugccacacauugucuggccucugcaagucaccaugguauaaguuuuauacuuccccaccuuccuuaaucuugcaacuuuccuguggaucacacacugucagguuuuauauuucccugggaugaagccugguccccuuagaccacaguucaacugccuuugugucugauuggggaaaacaguuccuuaaguagagaaccccguuagcuguauauccccuuaaauucuuuucacauuaacuacacugacagagccuuugauggauggauaccuuuccucuugucccaguuuagggcaaugucucucuuuaauggugcuaguaauagcuaguuacagcugguauuaacccgccuugucuauaacuuuacauuuacuugcugucuucuuuacuaaauuguguggguuuuuuuuauguuuugcuucacuuuuuccuuuuuuuucuuaaauguaaacuuggaugagagcagaaagcaauagccaugacacaaacugaauguucuucugugaugacaucucuucuaccaaacaaaauauuccauuacuuuuuaauucagccuggcucagguucucagaaugcagccucacucuuuacuagauccuaagacacacggccucuagccugcucacugauagcagcauccuugcucucuucugaaaccuugugaucugggcuucuuuuuuuuuuuuuuucagccaaaauuuauuuauuucuugcacuugaaguauuccucgaugacauccuuggccugagauucuuugccauaguccuuaaccacuacgcaacugcaaccaaccaccuuccgugguuugcccucucgaucgauuuuacagaggccuacccauuccccuaguuucuuguugucaucaaccuuuaucagguugauuuggugcucagcacaaagugccuccaccagcuugacauacaugggcucaucacaguuggaugcgagcacacacagaugggcuuggcgcuugucuaaggcuuuggcagcuucgcguaugccacgugcuaggccaucguggaugagggcggucuucagcaccucuuguagagcaguguugacguccauuacaccuccagcagcuaugccuuccucggccauggcggugaaucacgggugacgccgaaucuugaacgcacccgagcuuccgccuccgcgcaagucggcggcggcaggggaaaaaggugaucugggcuucuaugucuacauuuuucucaguauucuggucuuccagauuccuaucagaauggcccauuuuacucugcuuauugaguucuaauguuuuucuaacccaguguuucaaacuccuccacauuccuucuauaagccaguuacaaaggccugugaaccucauagucaaguuuaucagagcaacagccccauuucuugguaccaguuuucugaauuaguuuccuggugcucugauagaauacccgacucacaguuugaggguacagugcaccaugguguagugcccauauguaaauguaacacauaaauaugaagaacuugcaagccauggguucucugguauguccaguucuagucuguccucaugaaauuguuccuuuccuugacuuuucccccguuuuauacuucaugaaucucaacagcaucaacacuuugauucauuuguuuaguuugguaauagauuucauauaguugcaggcuugcuuuauuauuauauaaacacaaaaacauaguacaaagacuuagagucacuugcaauucuccuggcacuguccaagcuugaagguaugcuguaagugcuguguuuaucaguucucucugcuggcuuacucugugccacuauuuuucugcagccauaguccugaacuagagucagguuggauggugcuuguauuagucaggauucucuagagucacagaacuuaucgaaugucucucuauauugguauaacuuagagucuacaguccaacuagcccaacaauggcugugaaugggaagucuaagaaucuaguaguugcucaguuccacaagacuagguauuucagcugaucuuauguauaagcuggaauccugaagaaguaggcuccaacagaugugcuggcaaguaagugcaaucgggugaagaaugaacccguccuuuuuccgcuguccuuauuuagaccuccagcagaagguauggcccagguuaaagguguguaccaccacgccuggauuuagaacauguucugucccaggcuagcauugaauuuaaagauaugcuuuccccagucucuugggauuaaagguguguacuaccuugucugagccuaaauuuuucauggccacugugccuuaagaucugaaucaaaagcauguguuaugccuguauuuuccagucucaggaucuggaucacagguguucccuccauucuggauugcaguucauuccaguuguaguuaaguuaacaaccaagaauagccauuacagugcucauagacuugaaaaacaaaagcuagcaaguuuuaaagauuaaucaugucaggcuugacucucauuguuuguaagauguucucacauucuuuguaccugguuuauagccacugcagcacucucacauaaagugcucguugguuuugcuguagcugcugaugcguuugcugcuguuuccugguugcauuuucugcuuuuauggggaguuuuagagucaagccaugcugccacucuuugacagcuucccacaaccaguaguugccuguuuuacuuuuuauuaauuaugugaguaaagucuuuuaaaauuguauuaccugguuuuuguuucacguguuaugggaaaccauuucuaagauaaaaauuuaguagaaaggaugugugcucuuuuuuuuuuuuuuuuuuugagacaggguuucuuugugcagcccuggcuguccuggaacucacucuguagaccaggcuggccuugaacucagaaauccgccugucucugccuuccaagugcugggauuaaaggugugcaccaccacugccccaugcaaauguuuuuuuuuauaauaaaguuuaugaaauaaguaaauguauacauaaauaugagcccauuuaucuucaaaaaauauauaaaggagaaacaauuuauucuuuggauagugucuuaggauuuccacuacugugaacagacaccuugaccaugaaaggcaacucuuauaaaggcuuacauuuaauuggggcuggcuuacaguuucagugcuucuguccauuaucaucaaggugagaagcaugaugucaugcaggcagacauggcacuggaggagccaagaguucuacaucuuacucugaagguagccaggacuagacuugucuucuucagcaggcaaccaggaagagguucuaggucauaccugagcauguaaaugagaccucaaggccccgccuccacaguuacacacuuccucuaacaaggcuacaccuccuaguagugccacuucccaugggccaaacauuaucaaaccaccacagauaguauuauauauauauuuaugguaaaauguuuauuuaguuccucauggaagccuacucauagaauuucaaaguccauuuauaagaggugcugguuuaaguguuaaaauucuauuuuguguuugugacucuuccaagacuaauaaauaggaaaaaauagcaccuuuuaugguuaaaauuuuuauuuuuaugaaugauauuaaaugcuuaugguaauaucuuucaauauuuuaaugauuugucuaugacauuuauuuuguucuguacuuuuaaauuagucuuaucuauaucagauaaagaucacuuuauauuucauugaaauuuaucuugucucaauacuaauggacacaucuuaguugacauuguuggucuuccuaugggguugucauccucuucaguucuuuugauccuuuccccaacucuuccauagggguccccaacuuaagucuaaugguuggcucuaaguaucugcaucugucuuagucaacugcugguagagccucucagaggacagccauaucagguuccugucuguaaguacaauaugguaucaggaauaguaucaagaauuggugcccacccaugggauggauccuaaguugggucggucacuaguuggccauuuguucagucucugcccauuuuugucccugcauuucuuuuagacaagagcaguuuuggguggacaguuuuguagguggguugguguccccaucucucuacuaaggguacugguccugucugacuacuggagguggucucuucaaguuccaucucccuaauguugggcauuuuggcuaaggucacucacauugaguccugggaggcucccccaucccagaucucugggacuuucuagagguucucccaugcccccacccccagcagcuguauauaucuacucauucucccauaaccucauuauguaguccaucuucauucuccucuaguuuuacucuuuccuaauuccaaguaacacuugucagaaaacagaaguaugccaaauguaguuauagauccaguuagcuuuaacuuucaauucauuaaccccuguucuauaaaaugcaugagcaugcccaccaaacauuagccaaacagugggguuuauaaaauuggaucagacagcaauacugaaaaaagcugaugaguuaacaucagguuacauuuuuguuguuguuguuguuucuucucucucucucucucucucucucugugugugugugugugugugugugugugugugugugugugugugaaggagggagggagagagggaagaggaaggaagguaggaaggagaggguagaggagagacaaaagaguugguauuucaugaaggcccaaagagugugauagaucccccuggagcuggaguuauuugauaugggugcuggaaaaugaacuuggguccucuggaaaggcaucaaguacuguuuguuaacccgugaaccauuucuucaacuccagguuacucuucuguaaacauuaaagcagaauggauuugcuuauuaugcugguagagauagguugaaaucuguuuucaggacagauuggucuguuugggcauuuauuuccuucaaguuucaaauugauuaugugacauuguguaaaggggugagguggggaggggaggguagauguuggguguuuuccucuauuacuucaacuuauuuaaccuggagcucaucaauucauauagagccagugagccccgaagcuccaccuguauccccuucucccaccccagcacuagugauauaggcacaugccuucaccccugacuuuuuaugugagucaugagaaucuaaacucaaaauucuugugcuuguguagcaagcaacuuccuauggucuaucucucuagccugaaugauguggcauuuaacaggggugacuccauuuugguuuaauagucuguucuuuuaggguucaguaaaggaacucaguucaaaacaauagccuccuauaaugauucugcccgcuugucuauacauuuacuuauucuaaaaauuuaaugugaguggaauuaauguguucauuugugacugacuuuuuugacuuagcaaguuuuuguuuguuuguuuguuuguuuguuuguuuguuuugagacaggguuucucuguauaguccuggcugucuuggaacucuguagaccagacucagaaauccgccugccucugccucccaaggccgugcgccaccaccacccggcacagcaagcuuuuauauuucacccauauuacagaauguucuaguaaauacuucauaguguugucaaauaauacuccgcuggagcagaauugcuaagauauacuucauauuuuaacuuuuuaggcaacugacaaacuauucuccaaagugacuguaccauuuuacauuuuaauaguaaugcaugacaccccaguuucucuuuaacccuuuucuuuuuaaagauuguagacagccuagugaaugggcuugaagugguuuggguuuguauuaguuucaugguuaauaacaagugcaaccgugugcauauggugcccaggaaagucagagaagacuugauccuuugcaauuggaguuauaaauaguuuuaagugucugaguguugggaaccaaacccaggucuucugcaagaacaguaaauggucuugauuucugacccaucucuccagccugucuccuuuugccuauuuuaaaauuguguuauuuuauguuuuuuguuauauuauaacuuuuucuuccuucuaaauauuuggcuucuaucaaauacauuugaaaauauuuuuuucauucugagaaauguuucauuuaugugaugguacccuuugaaauauaaaaauaauuaauucuuuuggggguuuuguuuguuuuaucucugugcugggaccuaucucaggaccuguaccaguuagacaaguacucugccacuaagcuagaggccagcuuuuuguuggucuaauuuuauaagucuacacuuucugucauaauaaaguacaauuuagucuagggcaagacuuaguuuugucgguucucccccccgcccaauaucucacauuuaauaaugugacuguuuugacuuaauuuuuuuguuauacauuguguuauuuuaaaaacauuuugaagucacuaugaaaaauguagaaugauuucaggaagaaaucugguuuuugacucuugaucugaucaauaguacugccuagagucugggucuccagcugguacaguuucucugcuugcuggggaagccugaggcaguucagucccugagcagaugagggcagcaguguuuuagugaaugagaauucuuacucuucuaaaaacagcauuuuaaaguuagagauuuucuuaaucuguuuaaccugucuucuuuuuggugauaguuauuaggcacuaaguuuaaagccuuuuuuaaagauucuuuaauauuuaaauuuaggaacuuucuuucucuacccucauaaauuauucaggauucucaguuuauggucccaguucguaagaugugaauaugaucuggggaucagugucuucaaacuuaggacauaauuuucucaaauuuccauggugcauuuuuccauucuccuuuuauuauuuuguugcuaccugugcucuuuaaguagugguaaaguaguagaguaacaccuaguaugcuaguaaaugcuaaaguuuuccucugcucacucuagagacgaacuggcagguuucagucucauugugaggguggauaauauagaaguuggacgcauggacaaugcccuuucuuuucuucaauauaagaauuuuuaugucaucucagcauuagacccgguguccuuuauagaacugaauauuaaacauggauuaaguguuucuuuuauucuguuaaugguuguuuucaacauaaggaaagacagucuagagagauggcucaaugguuaagaguacuacugucuguccuuccagggggcccuguugauuucccaacacccacaacuaucgauaacuauacuuccagauggucugaugcccucuuggcaccagacaugcacgugguacacagacagacauacaggcaaaacauucauacacauuuuuaaaggaaagaaguaauaaauaaugaacaucuguuuuguuuaccacucugcuaauaaguacuuuauguauauugucuucuaauuuuaaaacuaguucuuccuuaaugcuguuuuuuuuuuuucuacaguuuccugagagggaaacauauuaggaaaguaaaaauuuaacuaggcucacuuagguggugaagucaauauguguggucauauucgauggcgguauccuccauauuacauuuuacagaaaugauauacuuauaugcaucacugugcaacuuguuuugguuuuaaauccaacaguauuuugaaaaaucuccuucuugauuacuacuguauagagauaauuuggccaauuguuuuaccucaugaguauauguuucaguuuauuuaacuuggcuacugaaaaaucagcugccaaggaaaccuuuaacuugagccuuucuuggcuuuuccacuagaggguguaacaaauguuucuuuuuguuauugcuauuaaaauguaauguguuuacuucuccuuaugauuaucaggaaggaaauauuuauugcauauaauugguauaguacccuuccuguucuguuuuuuucugcagguuauucauuuuuggauccuaugacagagaaacaaauguucauugcacacuugagcugagcagugguguuugggaagaaaaacaaaggaguucuauuaagacgguaaaaugcauaguuuugcauuuauguaagauuuauucuauaaguaugccuuuauuaguauuucuguauuucuagauauauuguuggucauaaguaaguuauuuucuuuuuugcuaagcagcaucaguaacaaaguagaucaccuggaacugguaaugaacacacugcauaagaagcagucuguucugcuugcuuuucaaaaugucaguguuguuucagugaaggaaucaaagguuauaacuuguucaugugugcaggugcacaugugugagcccacauguaaaagccagggcucuguguaauuccuuagacaacaucuaccuuuguuucuuucucauggucucugacuggccuggagcucacuaaguagguuagaugggcuggccagccagcccagaaauccaccugucuuuucuccuuucuagaacuaccaugcuuacaaaacaaaauuuaaaaaaauggguucuagaaagucuaacuuagguuccucaugcugaaaaggcaaacacuuuaugacugagcuaucaccccagccccuggaaggaauuaguuuuccugcgugcuucagaugcugugugugcauccacugugcuuacucacucagcaggauuuuaucuagagcugcuuuugcugggcucaaguucugaugcuggagaaacaguucaagacagacggauucuguuccugugggacucgugucagcuagaaguaugcucgguagaagacuggguaaagaagcagcagcugucaguaacccugaaaaguggggagcugucccuggagcuugacagcugcuacucugaagaaagcaaaaugaaaguuauaaaaggaugcucuuagaccuuacugacuauucagugcauccuucaauuuaaaaauggguagcaaagauuuucuuggaagaaauggaauaauuuuucccugagugggaaauagaaaugaaguuaaacugauagaggaggauuggcugauucacagagcuggguuaugacagacacaagaguuguuaaagaucgugaaugugguaggagaagguuacgaauuccuccauaugucucucaauaugaggugccuuucucuggcacccacuaccuuauguuuugagacagggaaucuuauugaaccuugaguucauauuuuggcuaugcuagcgggccagggacucuaagggacuuggaucucuagguuccauccugccccaccucccgccccuggcacuggguuuagagacuagcauugccaugcccaccauuuauuuaaguugcuucuuuuuuuuuuuuuuuuuuuuuuuuuuuuuuuuccuugagacaguuucacuguguuacccuggcuagccuggaaccuguuaauauagaccaggcugguuugaacucauagagaucugccugccucugccucugccucccaaguggcugggauuauaguugugugcucucacucccagccagcauuuguguggaugcugggaaacaaaggucaaaaccuuaugcuuguguaguuagccaauuagcuaucucucuaggccaagguagguaggcagauagagcacaaucucucucucucucucucucucucucucucucucucucucucucucucucuccccccucuucguuccuucccucccccucucccuuuuucuuucuuccugcuuguaauuccuguaccaacuuuaaguuuacauuuucaaucaauuugaaguaguuucuccaggaaaugaaauaaccaguuuuagaguuuauaccaagauauauaauuuaagaaggagauuauuguuuugucuggguaaauuuuggcuucacuuugaguugcuuauaacuugccauugcugcuggccuuuucaguuuucuuuauuuuaucuucaaauauaugagauuagacagauuuaauauuuuauagcaaagguuaguaagacuuuuuaaauuuugaauuauuauuuuagaaccuagcauaugucacggguagcugucaagggagaauaauuuuaccagguguuaaaaaugucaacaaaagugucaacaaccaauaaagugaaauuuugugaauuuaauaauucuaggaaggcaaauuacauuggcagaauugaguuauauaauaugagagauucuguguguguguuuguguguguguacacgcacgcaugcauguacauaugcuuguggaggcuaaaggccaaccuccauuauuauuccagggcuaggaaaaaaacucuuauuauucuagaaaacaaaaacaaaaaccuucuuuuuguucagaugagaucucacuggccuggaacucacugaguaguaggcuaaaugagccaaugagcauuggguuccagagaucuugucucugucuccagcacaggaguuacaaaguaugugccaccaugcccaggugugguggggcuuuuguuguuguuguugguuuuguuuuuuaaugugggcagugggugucaaauucucagauucccccauguuuucacagucaacacuuuaccaacuggagaauagaauuguaaauggauuuuauauggcuaguugacaagaaaacaaacuuguuugauagcuuuuuuuuuuuuaaguuaguagaaauagaggcaguaaaggaggcacuccugaagugagugugugcuaaugagcugggacacgaaugagcauauacccaaagcacugggccaacagucugagggcccucuguauguuacucacuacugucuucucuagcauuugucaguccuaggcugcuuuuaugccuacuguguuucuugcauguagcccagauggggaaauguuuccugccauccugccacugacuucuuuuguaggcuaaucuugaugcugcuuucugcaguugcuacucuugccacaacucuucccccgugaaguagccauauaaagguaaaauguuaguguuaccaacugacaagauggugagguaagcgauagguccugcuggauaggaaacucagucugccccugaggagagaagucgcacaccacugguggguagcagugacagaaagcuugagaagucuguugcugccagcuacacaaguauuaauaaguuucuuagacuauugcaauucaguggcugaauguucuggaaggaaagaggaggcuuuccuuuagggucugauuggcaaaaauuaucaugcccugaugcuugauuaaaucccugaguaauuccuuauugcuccaaagauaaggacaggccguuuaguauggccaggaaagugaccugguaagccuggucccuucauauucccucccacucugagcuuuagucacacuagcagucacugcugcuuacuggccuuauucuguacuauacaucuccgguaacuguauauccuucccaaauuguccuaaaguucuuucuugaagacugggcaugugcuaacccagcuuguuucuccauguacaucuauguucuccagaguucugcuugugccaggucuuagcuugucugcccuuguucagauauauucauggacuucuuuccuguuccauuccuggagaguucccuguuguuucaaguucucagugucaguagcuuuccgcuguacuugauggaugugaaacacucaugggaaauaagagugaacuagagaaaccaggguauucuuccuccuggcagcugguuuauccuucuuggcccacucuucucacaggacaaaccaccauuccaguuuccaccacauaugucuauccuucagucugagguugauaguguccucuuacuuuugcugguaucuggguuuuauccuggaauucaguuuuucucuuacccacaaguuacucccuuuugcucuugguuucacauauuuaagaauuuucacuugccacagcaaugucaccuaccuaccauaaucacuucuggggaccuucccuaacugacacagacucgcguguuaaguacuugucacagcuggaguauuaguuauauuuguauaauuguacaacuugaucccuagugucugcagcagaaccuucuguuacaguaaguaccuggauagguuuggcucugcauauucugggaagacuaagucuaacuaucuagacaucaaucuccaaguaccuuaccgauuuuucucccagacugccgugguuucagcaugacuuuuagucaggccuugauuuccuuuuuccuucccuugaauauaucccaucucuuuuaaggaaauaaaaauacuuaggaugaggaagucuaccaaauuagauuuauuaaucaacauugcuuauauaaagagcuguuucuucagugugagaaucuuaguuuacaauuguaguucccagucauguacuuucuuucuggcaggacuaaaaacaaaagaaugccucaugaguguaauucagcauaacugaaauaaaugacuugaugugauuuaaaauugaacuaucuucauuuuguuuuuaguuuuggacaauuuuagaagccuuguuggauaauaaugaauaaaaaaaucuacauuuccagauuucucuacauauuacugacaguccccacaaaugauuuaaaagggcuuucugaaaaacuguaauuuuaaguaaaaacauuugacuuuuaaauacauuaggccaggugccuuaggacuuggcauuuugguguguuuacuuaaggccacaugccuggcagguggaguuuuggugugccuauuuaaccauuugccauuugcagucuuaaucucaucaaaaggaagagaaagauuaaagcaaacaaagcuuuguuuuggaaaugucagucuuuuaugaaaacuuugcuuuaguucagcuugauaacauuugagaauacaguagggacucaaugaaauuuuaaccauauguaauauuuuauaauugguuucuuaaauaaggcaaaugcauuucagcucaaauaguaaauucuauauaauauuuucacucuuaaaaaguucaucuuaguuaaaaauaagggaugagauucuuugucucagauuuuuauacucugguaugguuaugaaauucugggaacgaguaagaauuuguguuaaaauauuauuuacuuuaaaucaaaguagucuaggacacuaagaaacaauaugagguguggucugucaagagaaagaggucagcauuucugugugcaucauguauugcuauuaguagcucugaacaugucggagcuucagagcaaaaguaccgugagcuucugauaaaggaaaggcguggcguucuuggggaaagcgagaaaauaauguguuaaagaggugacaaauggaggaaacaucacaguguacuuaggguuuugagagagcacagagaacauuucagaguggaagacauaguguaagaccccacaggaaggguaucugaguguacugaguggcuagaaugaucuguccaaguucacugagagaaugcaggaaaauuauucaaaacaagaguaaaagcuuuacauagaaucugagaaauguaguuauuacuuucaagacaguagaaacuauggaggguuuuagaauaaaacuuuuuaaaaauauuuauuuauuauguauacagcauacagauuucugucugcauguaugccugcaggccagaagagaacgcuagaucucauuauagauggcugugagccaccauguguuauaucaucugcacugaugguauccagugugccuggguucaaguccacauucuuccacucuaguugugugaugcugagcacuucacuucaacuacuagagaagagaaauaaacaguggucuccuuagaucaaaggcuguaaaauaacuccaucugcauaaucgguacacgaaguuuucuuuuuaaauuugauuaaagccuuuauuaaugcuuugaucugaaacaaauuuaaauuuuauacacccaaucuagugaaauaaaaaguaagaaaaguaggcaaagguauggaauacacaucugccuuagccccuuggcccaugccuucaaaaucuuccuauaacaagguaaggagggcaaauaaaauaguuucuugggccaugaugacacagugguuaagaguacuugcuauucuuggagagaaccuggguucaguucccagcaccugauagcuauaugauggcuuaaaacuauccauaacuccauuuccaguuccagguauauauguaacacacccuguucugcuuucugggggcagcagauguauaaauugcucacauacauauauacagacaaaauauugauaaaaauuuaaacaugaguuuaaauuuuaaaaacuauuuuuaaagaugagaaagccaagcaggguaugguggccauuaccuuuaaauuccagcauucaguaggcagagccagguagauaucugaguucaaagauagccugcuauacaaaguaaguuccaggguaagcuaggacuacagagagaaacccucucucaaaaaacaaaacaaaaaaauuaacaagcaaacaaaaaaauaagagaaccaagugguuacucuuacauaagcagauaagcagguuuacuauaauaaggaggaugguuuauuugagagaaugcccuuguuagggaauacuuagguagcuagugaaaagggguaucaugucugugucguauuuucagaugauucaggaaaaaaaaugcaagagaaaaguaaaugugcugaaacucuagucaggaaauguggcucaggauaaguaggaaaaaauugcaacucuucuucuguuacuacugaaauuauuucaagauaaaagguuauuuuuagaaaaguauauuuuaaaauagcuuucccuaagacucccccauagacuuuguaauauaugaaucacuuugcagaaguauauuguuacuauguaaaggugaagguuaauuuggugacucugauuaagagcuguuuuucuuuaacaagaauuuaaaaggaugagaguauucugugcuauuguuuccauaacaaccccagccuuugccuacuuuucuuaccuuuuuauugcacuagaaugauuguauaaaauuuaaauuuguuucagauuaacaaaggcuuuaaucaaauuuaaagagaagauaacuuaaguauauugauuuuuuucagauggaauuauuuuaacauccuuuugaaucuaagcagaaggccauuuuuuauuacuuagauaucuuacgucauuuguauuuauauaaugaaauuuuuauauuucuaugccucugcugucucuguaacugaaagaugcaguccuaauuuaccauucaguuacuuuagaaacuaaguuaucugauugccaagcuaguauucuguuuugagaggccuuauuuuucauccaaaagaaagucuuucugaggaaaaauuauggaggugccugauuuauguuugacauuuaugcccaguuucauuuagucaugacaacaacccaguguccuaugauagugcgacuucucugugacuuggauaugguuuguuucuccuaaagguuaauguuagaaacgugucccaguuuggcaauauagaauagaagaugauagaaccuuuaagcaaguggagccuugagggaaguccuugggucacagagcuauucucagaaaaguuaaaguagcucucauaggaccccuagagcuuucuaagacaguuaugaggagcccagcugcgucccucuggcuuccugcaaugcugugugcuuucucuuauacuguuagcacgguaguaagcaaggcuacuuauuaugagauccucaggagagcugaccugugccauaucagugaacccccaaacaucuaaguagacccauuuucuucauaaauauucuguuccaggcauuuuuuugguuguaacaaauaagaacuaauguauucucuuuauaaauaaauccuacaaaccaaauguaccagcauaugcauuuagucccagcacuggaagcagaagcagggagaucucuguaaguuugagguuagcuugguuuacauagugaguuccuggguagccagggcuauauaguugagacccugccggagggagggagggagggaaggaaggaaggaaaaaaaaguuugguaaaacuaauauguagagccagaaauucaaaccccacugaguacaauaguauuccaacuaacaaguguccuucaaaaacuuuuuuuuucaauaugucguaacucuuggggcuugggagaauaaucaaaauuugguggguuuucuccuguucauuagaaguuagcugcuaaauagguacgcaucacugccguaaggaagauauuuaccuguagaguucaugugagagaacuuagaauucauucuugacccuauacagaucuacccauuuaagcacuauggcauguuagcaugguguguguguguguguguguguguguguguguguguguguguaugugugugugaaagagagaaugaaugaaugagacucuaaagggagguuaggggagaggagacagauuaucacuaucauugagacaaaaacauaaaaauuuguaaauagguuaaacuauaaugacaggucuuugaaaccuccauggguaauuuauuucuggauaucagggacuagacaguuaucauuaguauauuaaauauuuaucuucaagcucuggcuuauaauugagaggucaagauuucuaaaacuaaggcugacaagauggaucugugacuaaaacccaacaacccagguuugaucccagaaccuacaugguucagagaauaccuacaguguacacauacacauuaaauaaaauaauguuccaaagcccaucuaaugacauggacuauuccugcugaauuugagaaaagcaacagucaagauccauucacaguauaugauuauauuuaccaugucucagcuuugauacaagugucaauuuuauauuaaaguauaaacaaaugcaaauucuggcucaauucuuaauuuuuaaaaaagauuuuauuguauauguaugugaguacacuguagcuguuuucagacacaccagaagaggguaucagaucccauuacagaugguugugaaccaccauguguuuggugggaacuauacucaggaccucuggaagagcugucagugcucuuaaccaaugaaucaucuuucagcccccucaauuuauaauuuuguaauaaaguauaagcaaauguaaauucuaacaguaguucuagaucguaugauuggaaguguuuuucuuuugauuuuguuucuuuaauuuccagaauuucuauuauagguaugaucccuuuaaaaacauugaauacauuguguuucauguuuuuagaauauuuuuguuuauuguuuggcaguuucauacauguauguauaauuuuuauauuugauguguauauuuugacccucucucccacuucccccaggaccagugaccuucauacucccuuaucucucacaucuucauguucucuucuuuaugauagacuuuuauucuuugagaauuuuauacuuguaccaugucuuuugaucacauucucuccccacucccuccuccaauuuucccagacccuccucaacacauccucucucccaguuucaugucaucuuuucuaauuuuuaauaauuccaaucagugcuuacaugaauguguggguaucgggcuaucccguggaguaugggcagacuaccaaugauggccacacacccagagaaaaauaacucucucuucccccagcagccaauagcuacucagccagacugcccccagaacacguuccucucguuauuccauuauuaucuccuguuccucuuccuuguaagaacacaugugguccaguugguguugccugcaugcauguggguaugaggccauacacgggagcauaggcagaccaccuuuuuuuauuguuuuuuuuuaugaccacauuuaagucaucauaaucugaaaguauauuuauauuuguuaguaaugucuuaaucugucacuuaucuguaauuauagucacaaugauuuaaaagucacgacugugauacucuuaucuguauuacuuuuaucucaauguuuucuuucuuuuuaauccuuuaucaaagguugaauuaauaaaagggaauuuacaaagugucggacuuacacuucgucuuguucagucaacugauggguaugcugggcaugucauaaucgaaacuguggccccaaacucaccugcugcgauggcagaucuucaacggggagaucggcucauugcuauuggagguaauuacacacuguauaguauaacuuacguguacagagaaacuacaaaauuggcuggagagguuuuuuuuucucucgucucccuauuuuugaaacaagcaucuguuaguuuuauaauggaaaaaucuucauuauaaagaaaauugcaaaagaggccuuagcaugcuuguaaaaaacaagagccaguuuaguccugauguuuaaacauaauuucaucuuuaaaccacuucacuaaaauuuucucauuuccuuucccuucccaccuucuccucuauguauuauuaaauacaaaauuaagagccagauaauaaugucuuccuguauguccauuaccacaugacuucucucaucguguuguaguacuagaauugaacaggagagaaaugaauauuccuuaccugagagggaggauacaccuaacccuauucugagacuccauguuaugggaaaggccugugguuugucaggaugcuauuauucagaaugcaacccaaaucucuaugguaaauacuguauaccuuccugucagcuagaugguuguaaauaauaaaaauaaaaaugaguuaucugcuugaguguauauacauaauagcggacucaaauguacacaacagcacagaaguaauccaagcccuuuucauauuucauaguaccuggcccaccugguguaggcuuugagcauauaaaaauggcuauaauuuagcuuaaucuuuucagaagaguauuguguguucuuuuacagcuaagacaauaaggugaagcaaaaaggaauuaucacucaauaugucagacucugcuuuugauucaaauccaucuugacauuaagauaaugaaaaugauuuaguuaagcacuuggaguuaaauuagcauuuucauguggaaaucucugauugugguauauacaggaccauuuauuccauagucaccugcaauaauaaugcucaaaagucauucugauucagaaaaacuggggugaaaucuaagaguucgcuuuauuuauuuguuuguuugguuuugguuuuaucaaggcaggaugccucuguguagcccuagccgcccccagaacacacucuguagaccacaccaccgggcaagaacuugcauuucuaacaagcucccuaagucaugcuaguuuuccugguucauggacagaagaggacuuaaaguaaaccucauccaucacacaccucuguauagaaauauuaaaaaguucgucucccucacccaaaaccaugguucaguaucaaugguuuugccuuaguacauauccuguuuuggccuuaucuauagguuauuuuuuauuauuauuauauuaucguuuuaauuuuucuuuuuuuaauuggguuuuuuuuguuuacauuucaaauguuuuccccuuuucaggucaccccuuuagaaaccccccaaucccauccccccucucccuaccucuaugagggugcucccccaccaacccacucccgucuucccacacuggcauucccuacacuggggcaucgaacacccucagacccaagggccucuccucccacugauguccaacaaggccauccucugccacauauguggucagagccaugggucccuccauguguacuuuuugguuggugguccaguuccugggagcuccagggggucuggcugauuaacaucguugcucccccagggggcugcaaacucccucugcuccuucagucccuucuccaaccccuccauuggggaccccgcgcucaguccaaaauaugccuuuuaaguucuguuuucaauuauacaaguagcaaauaccuauuaccccaaauaaauaaaaguccaaaucauacaaaucuuuacagagaaaaaagcaaaaguuaaccuuuucaagguauccaguguucauaaagguacuaagaaguuuuauugauuaaaaagucagauauuguacacaaguuucaaauauaauagaaaaacuuuauuuaaugaguauacauguuuuauuuccaugagugugcgugcaccacaugcaugcaugcaugcagugucugcagaagccagaagaagaagccuuuccugggacaggagguacagaggauuaugagccacuauguggaugcuaggaguagaaucccauccucugaaagagaagcagugcuccuaacugcugaagcugucuucucagcaccacagaaaacuuuguuuccuagugccccuccuccuauauacauaaauauaucccuugucccaacucugggacacaaauucaaguccuacaauauacuuuuaguaacucauuucuugaaauaaacuuugcccaauguucauagguauuucuaaaauaaauuguagcucauuuggauuuacaaaagucuuaguaauaggagauugguaguaguaguaguagaaagaagauuggcaaaauauauucaguuucaauaauagaauuaauuuuacuguuuucuugaucucugagcauguuugaaauaaucugaaagaaaaauccagauuccagcaaaugcugguacagugaccaccuccagagcaccugagaugagggagguuucccacagcacaaacgacagaggugggguugggaugagcucaguaaaugaugcuucgucugugcguauggcaugcuacgugcuccugggacauagugcucucagacagaagcaguagaaguuauuaagcuacgugagucaggaagaucccugugaagaagcucagaauuccacugauguuuugagcugaaacuggaaaaugugaucacauggauauccaagcugcaaaggucugaugggagauaguuaaagguacuugugacuuaacuuaaagaccaguggucaggaggaagagcagaacaucaaagaccagaggagcagaacucugaguuaggaucgacaccugugggaacaggggagucagcagucuccagguuugcauuaggagguagcaaguugauuuauagucgggacaagacaauguguauuguagucaacuuguaacuuuaaagcaacuuaccuuuuauacuuuuccuucuuaaaaugguugaucauuuauggcuaauaaacaggaucugagaaauggucugacauugguuucuaaauuuaaaucauuugcuugccagcacuggacuuauuugagaacuuccuucaguaaaaugucagcuuuccaucauucagaguaaguaaaccuguuuaauuaggccuuacucugcucucguccauaguucagcuggacaugagguuguuuaugucaagagggacugggaagccauuagaaauuagaagcugcucagggguuuguaucacaaagauaacaguauuuccagagugccaugugcugauuaauuugaaauuuaaauaaagucauuuuugaagcucccuauugcucuuguuaugaaguaaucgugagguagucacaguaaccgaguauugcuguaguuuacgugcuucccccuuugaaucuuaaaccaggugugaaaaucacaucgacccugcaggugcugaagcucaucaagcaggcuggggaccgcgugcugguguacuaccagaggccggcugggcagagcagccaagacagccugggccaguuggaagaaagcuucuuguccagcuccugccaggcagccuacgaagaggacgcugcugggcugucagcggacacugaaaacagagaccuagauucugaauucgaagacuuggcgagugaugucagaguacagacagaguugaaagaggagacacagccguugagucacagucccaaacguacuccaacaacacuuucuauuaaaccccuuggcgcuauauccccgguuuuaaaucguaaauuaauuucaggaauccacccaccaccacaaaaacuuccauccaaagaaggaaauaaaccaucaacucuaaaaacuucagagaccacagaagcagcacaaguguccaaaccccaaggacccacuuucaaaccaccugugccaccgcgaccacaggggagagugccucugccucccacugacaccucagcccaagcagacccggaagccccagaaaagccagacaaggugcugcucccuccuccuccugcagauaaaccugccgagaagcaagugaagaguguggaucaaggagaagauguggcagcagguaagcagucuucagcgaagcaggaaggagugaaagaucuuccuucagaaaguucugcuccuacuaaagacucuucagaugacccucagaugugggaauccucagagguucuauaucgcaacaaggugggaaaguggucaagaaccagagcguccuguguguuugacauagaagccugccauagguaccugaacaucgcacuguggugcagggauccuuucaaguuaggaggucucaucuguuuggggcauguuaguuuaaaacuugaggaaguggcuuuaggaugucuagcuacaucaaacauggaauaccuuacaaaguucagacuggaacccccuacaccuaaggccauggucacuagaacugcacuacguaaucugaguaugcaaaagggcuuuaaugacaaauuuuguuuuggugacauuacuauucauuucaaguauuugaaggaaggagaaccagaccaccacauaguuccuaauguagagaaagaaaaagaacuccauuugguugaggagguuucuacacucccuaaagaagagcauuuugugggacagaugaguuugucagaaaauaaacauaguuuccaagauacucaguuccagaacccaacuuggugugauuacuguaagaaaaaaguuuggacaaaagcugcuucccaguguauguucugugcuuauguuugucauaaaaaaugucaggaaaagugucuagcugagacaccucuuuguggagcaacugagaggcgaauagaccggacccugaaaaaccucaggcuggaaggacaggacccacucuugggccuuccuccucguguugagauagaagcuaacaagucagucaauaaaacaacaggguugacaaggcacaucauuaauacgagcucucguuuacuaaaucugcgucaagucucuaaaacucgccuuucugaaccaggaacagaucuuguagaaccuucaccaaaacacacacccaauacgucagacaaugaaggcagugacacagaggucugugguucaaacaguccuuccaaacgaggaaacagugcaggaauaaaguuaaugagaaaggaaggagggcuggaugacaguguuuucauugcaguaaaggaaauuggucgugaucuguacagaggcuugccgacagaagagaggauccagaagcuggaguucauguuggauaagcuacagaaugaaauugaucaggagcuggaacacaacaauucccuuguuagagaagaaaaggaaacaaaugauacaaggaaaaagucaguucuuucugcugcuuuagcuaaaucgggagaaagacuacaagcucugacacuucugaugauccacuacagagcgggaaucgaagauauugaaacccuagaaaaucugucuuuagaccagcacucgaaaaagaugaacaaguacgcagaugauacagaagaagaccucgauagugagauaagccaguugauagacucucagccauucagcaacauuuccgaugacuuguucggcccaucugagucaguguaaucaauaagcuauuucaacuuucacauggauggaggggacaagacguaucugaagugccauggguacagccacguucgguucucucaugguacacuuuggccugcuucuauaguuacuugcuuguaugagaaagaaaagguaguuuccagcuaaaacaugaccagcucaucaaauugguuguuucggguugugcuuauagcuuuggcuuuuuuggauuuauacugggaauuggguuuuauuaauuuauuuuuaaccuuuucuaauuauguaagccaacuuuguguuuguguaugugugaugucucacugucauuuuuuuuuucuuuccuccugguuuuuuaauuaguguuaaauaagauccugucuagauuccugaaauauuuucuuucauuuucaucacgguuauaacagcaaauuucuugcaugccuaaauugacaauaaucauugagggaacagguuugagucuucuuccuucuacguuuugugguuugucagcuguacuuccuugauguuuuuguuauacggggcuugggggauuuuuguuuaauuuuauuuugcuuuuauuguuguugccaaauguaaaugaaagcagacccuacagcuuuaaucuguuaugcuuauauaauuuuuuuuacauauauugcuugcuucuuacgcuucugcgauauuuuuaaagcuuuuaugcaguugaaauguaguaaaauuacagugauuaacuaggagagguugcauugaauagagaauaagugcaaaguccaguuggucaagaauuuuguaggcaggauaauaagauuucauuacaguaggauuuugaaauaucuuucaaauguugaugcuuuccuuuuaaguggaaauuacggacacucaugaugacuucaucugugguucucucauaggacauaaagcauaugcaaggacauuuacaaucgcacaggacuuauucugaaaaugacuguauugauaacuggcuuuguuuguaugauguggagagcaauuauacagacuauguuuacuacaucaucuggugucuuguggccuuaaaggacugucggucauucugaauacuuuaguaguucagaccaucuuuauucauuguaaagaaaacuaaaaauagacaguaugcauaguucacuaaaugaaggccugcuaugacaaaaaugaaggccugcuaugcuauugggcccaucuaguggaugcugguaaugaacaacugagagaaauauaugaacuuaaccccuauugauauaucuuaaaagucuaagcuuguuauaccuauagaauagaaaaguguuuucccccuuuacagguaacuucuaugauaacacauaaaccaacuaaauuaaaaaauauauggaauagcucuuuggcugcagaaaaaugaauaguauaauaguaaaaaggcuugcccaggcuguagcccaaacucccaacaggaguuucaggucaagcuccuuagugagcuguauagccacaggcagguuacaaaggguucugcagcuuccccagcuccaaagguccuuacacuucucacaggacuguugugaggaggacaggaacaucacugcaaaggcgcuuugaagaguaaaugcuguaaaaauaagagguauuccuuacacaagaaaacauuucugaguauagaaaaguuacuccagucauaaacucaauagcuaacucucacauuauuaagugaaauauuggggcacagaccuaccuuugucaaguuuauagcaaggcuacaucuguguaaccucacccccacucuuuuacuguuuauuuaagcaugcucacaguuuaaaagaacaccacaauagaaggacuucccacaauaaaucccagaagcuaaaguguuccuccauuuuacacuugaaacaaucugcccaauguauagccguguuucaucuuguaaacaauaacuugccauugcuacccugaaggugguauggcuguaacuggcugguguguugauggaucaaacuauggaaguuuuaguggugcccaagcaugcuccugcacugaugcauuuggaagagcuguagaaauaaugcaaagcuuuaguucuaagaaucuacucaugcuuuaaaguauuuaucucuguagaaccacaaucauggaaagcucaacagugcugcuaaucauguuuguaaaauauaccuuuaauguagugcaauauuuuucuauugggagagacaguacaggcaucacaguugggagcuccaauacccucaagcauaguaagggauaaggcuucaauuuaagagauuguguuauauuacauuacucauguaaucuugcugccaugcuauguuaucaauagcuaaaauaauaauaaagacuaccacggaaaauaagaauaucuucauuugaugacaucuaaaaacaggugauugguucucuggcauuauuaccugguauaaucuggccaugcagacaagcuaacgauccacuuuuacuaaacaaauauguagaccugucucagaaaagaagaaaaauuaaacuauuugaaguguacgcucuucauuguuuuuaaguugaauggcugaguuagacaaaaugaauaacauuuuaguauuauuuugcaaucauuuauuuguuuuuuuuuuuuuuuuuuuuuuuauuuaucguguugcuuuuuugagacagagucucuuuggcuucaaacucaguagagaucugucugccucuccucuggagugcugggguuaaaggcaugcaccaccaugccaaguuuuacuauauuucuuagcaccagacuucguucaguaacacuagaacuuacuguguagauacuuucucauucuaagaacaggcuaaaacuuugagaguaaaaucuaccuuaaaaaaacaaacaaacaaaaaaacaaaaaaaaacccuauaaagacauuuuaaacauauuugguucuaauaaguaagauaguggaguuuaauuuuuaaguccccuaaaguuuuuaaaucgcuucaauuuaaaaaaaaaaaaaguauuacuuuaauauuuaaauugaagugacagcuuuccuuacccuccccucaaaaggcaaacaaggguggaaagggggguuaccuucauccuuucugaucccuuaauguuccuuaaggucugaguaaaccaggucucuaauccuggaaacuacaauguguaccaccuucaaaaugauccuuauuucuaggucuuucagagccuguucugucgucauauagcuaggaauuaccauucucuucaucagaaaauuaccuguucacagcaauuagagcaauucauuugaguuaaaguccagggcaacuuuacuguuuuuccacacugauaggguauaacaagucuauauuucauuuaaaggaagcagugggaagccaaagaggaugguuuacccuagccuggagugacuugccugaugccugcaaacacagagaaugcuuuuuaauuaaauacuuacagccaaaacagugucuguguauuuuaucccggcaacaauguugaugaaaugguuuauaaaagaauacagccaggcacagcacaguguucaagaagauuuauuaaguaaucuaacuaaagugcaaccagcacagauacaguuagcagucaaaaggaaguugaguauucauuacuaccucacuaagauuuuugugucugaauuaccaaguacaaacaaaagccaucucuacuuuaaaaauaaaaauaaaucuucagagagcuguaaguucuuuguucugguacaugcacagucucuuuuaaacgcuauuuucggucuuguguacccaggagauuagucauauaaaugucuuuccuuuccccucauaaacaacuuauccuuuccucuccaaauaguucugcaauuuuucuuuuuucuuuggagagcaguaacaggcaugccuuugcugaucguuuuuacugaaacugaagccucaaaagcagaaaugacaggaaucaguuauuguauaugguauuguggguaaggacaacuacaaggccucucucacaucacaucacaaggcauccuggagaagguuaagcccugcccuuuuagccauguaagagcagccaucuuucagaguugcagacccaugacuguccaauggcuuaagagugggaacccaauugucccuuaaacacaccagacuucacaucaccagggucccacagaaagcuucauaaaacaaaagaaauauuugccacuuuucugaagaauguggauagccaauaagauuugagggguugucauccuaaaguucucaauguccaaggucacacaaacaauuaagcuuaacaaaacugacaguuuuuuuaaaacaguuuuuugacagauacuauuugagacaaauucuauacuguguuugcauuccggaagauuguagucucauacaaagcaauuguagauagaguucacuaacagcauuaacuggcacacugaaaagacauaucaguguugucaugcuuagaaaaguuauucuacccagcacacaagaugauacaauaacacauaucauuuguagauuguuuuuuuccugcuucagaaaggggagguguccuaaccacucuauuaucuuucuuaacauaaucguguuagccgugaacaauuuuauuucuucaucuuugcuugaaauucauuucuacauugauauaaacaacuuuuaggagucuaaaaaauaacagcaacucaaaauuaacaucucuagaaaaacacuuggaugaccugcaagcaggugagagaugugauuuuuuuuucacauuauaacagcuugaugauagccuuguuuacuguuccagaacaugaacuggauugauaaaccuuaacauauucaaccuugacuguuuaaagugcagaguuuuauuuucacccaguaagaccaucaagaauauauaaaagaaagcagcauuuggguucuuuccucugcuuucagaacauucacuuuuuaccccuuguuggcuuuaauuacugcugccaaugauaugacacagaaaaccauuuacaaccaccucuuuccaggugagugguuauaacagaaaacuaaugccagcaaagguuuaugaauaagucugaaagauggcugauaaaguuucuuguccuuuguauuuaagaugacuagcuuuuaacucauaaauacauugguauuaguuucaaguuaaauaacaacacauucaguguugguauacaaugcauugucuuacacgauucuguuucucagacugcuaguuuuuuguuggagaaucucagauaaugugugcuuuaaacacucauuaccaguauucagaaaaaaaaaaauaagauuuuuuuuguccaaguguugaugaauguaaguuaaaaaauuauauuuaauuuggauucaaauauuuauacauuuacaguauaccuauuucgucaaaauauauuguauaauauuaauaaaaucaaauacauaaaauaaaguuuucaacacuauuuauacaaaccccuagaaaaguugcuuuuucuuuauaaggcuguuggcagucgaucauaaccaugaaaaagaaaguaucaccuuugguuguuuuacucuaugccagcaauggauggcgugacuaagacagcucuuaagucaucucacuggagacacauguacacaguuaaacauugggcaacguuagaggggcucagucacucucagauucuucaucaucaccgacgggguacggcuggacauuauucugaguguacaucuuugucuuaauggggcaguugugguccaugaggauagccuggaagcaaaaugcaaguacauuaacuucuuguuuuauaaagauaaagagguuuuaaccuacuguuaaggauuacuguucugaaagcuguauaauagucauucgaagccaucgaaugucuugacccugaaggucugugguccuccacgcaguggagaguuucaggcaagaaguaaaacaucuagaauguuuuccuuguaccuguuggagauagaaauugaguuuuuugacucaaagguagguuagguuuuagaaaaguuaaacugaaaauuuuguauggggagggccuguggaccucauuacauccaauuuccacuuuauagacugccacaacagggaacuuaaugauguuugaagagagcucuuguuggaaguauagggauccacuucacuaguuccagucauggaccuugcucuggugagagccagacuauuuuacaauauguuaagaccacauucugcuuacaaaugugauauuucgauaucucccuuuuuagauccuacuuuauagcacaaauguacaauaaaguuccucugcccuuucuauuuuugaaaauuaaaccaaaacuaagugugacugcaaaauaaaaaaagaaaaaa

SEQ ID NO: 9346 - RNA, 6989 nt, Mus musculus
ggaagaggaggaggagaggaacgaggaagaggaggagaagagggaagcggaggaggcgaaggaggaggagagaagccgcagcgggcgccgcaggagcgagggagcuagcccggagcgcagggcgaagacaccaagaggucggcggccgggcgggcggcuggaggcacagccggggcaguagcgccgacuccguuccauucugggcccggauccaggccuccggguucccaggcguucgccucccucugacgcacuuuaaagagucuccccccuuccaccucagggcgaguaauagcgaccaaucaucaagccauuuaccaggcuucggaggaagcuguuuaugugauccccgcacuaauuaggcucaugaacuaacaaaucguuugcacuacuagugaagaagcgaacacuuccauggauuguccuuggacuuagggcgcccugcccgccuuuugcaaaggagagaaaacuuuuuuuuugccuccccgaaaacccccucccugccucuaacuccaaucucccccccccccacgccaccucgcucaaaaaaauauuaccccaauccacgccugcaaauucuucuggaaggauuuuccccccucucuccagguugggcgcguuuggugcaagauucucgggaucuucggcuuugccucuccucccccucccccuccuuuccuuuuuccuuuccuuucuuccuuccuuccuuuccuuacccccacccccaccccaaacaaacgagucccccauucuccucgguccucgccgcgggcagcgggcggcggaggcagcgcgccgcggucgccgggagcagggagcccagcgcgcccgcuccucggcgcagcauguuucagccggcgcccaagcgcugcuucaccaucgagucgcugguggccaaggacaguccccugccugccucgcgcuccgaggaucccauccgucccgcggcacucagcuacgccaauuccagucccauaaauccguuccucaacggcuuccacucggccgccgccgccgccgccgccggcaggggcgucuacuccaacccggacuugguguucgccgaggcggucucgcacccgcccaaccccgccgugccggugcacccggugccgccgccgcacgcccuggccgcccacccccugcccuccucgcauucgccacacccccucuucgccucgcagcagcgggacccguccaccuucuaccccuggcucauccaccgcuaccgauaucugggucaucgcuuccaagguacgugccacgucgcggaacugaagcacgccgcuccggucgccuccuucauugcgcccggccugcuccgggugggcgcuccucgaggccuggacgggcggaggucagcccggguucuugguucugaaacugggcagcuaggggcccgagaggcuuugguccccagucucugaagcucguuuggguuacuggcuugcccacuccuugacccuuuguaaaagggugcaaacgaggugucccgugguucgggccggggucgggcuggcugggacacgaugcugggcgacgaagcccgcugucaagaagcucugagcccgcgaggucuuugaauccuguuucccuggaccguguucccggccggucuaucacucagggacucggacagggccacauggccagguucacuggacuucaacucugcucuacacucacucuauguccccccagcccagacccgcaacuucuaggucuucaaccccuuuaaggagacaaggagaccuuggaaaccucagagcaaacuguuuccuuccuccugcucuggaggcccagggaggggcgggaagagagcgaauagaaaccuccacagcuccacuaguucucucagcgaccuguuuaacccgggcacccgcuggacguggcgggaagucggguuccguuuggucuuugguugcugauuuuuguuuuuguuuuuguucuuccugagagaaagaaagaaagaaagaaauuaagaaagaaauuuaagaaaagaaaagagaaaauccagucgagagaaggcccgacaagggaagaucuguuuggauaucuucauuuuuuuccccgauuuaguaauuuuguaugcuucuggguugggguugguaagaaaguuaaaacuuuaggaaaaggguucgaauuaguuugccgacugcaguccauaaaagaccuaccuccgccgggcgcgaucgauaacgacgggcuuuuccauucaauaacacuucgcauuccugucagucuagacucggguguaugccagcucgccauuuuauauauuuauauauuauuuuaaaacaccccaacaaaacaaacaaauaaacaaaaacccaaaccaaaguaaaacaccuuuucccuuagcucagcacugaauuugccuucacucccgcugagacuaccggcuguuuuuggguggugguggugguaaauacauucacuuccuuuaauacgggaagccaaaauacccaagccuagcuuucaaaguuuagagcucagcuuccccauucuuugccagucccauucuuggucgccuggccauaucacggacagcuuggaucuucgcccgaccaucucggcgaguacccucaacucgauccccgcgaggcuccagucccuucacucuccucuccuagcucucugcaaccagggaccucuagaaccggguacucuggaagcaacggccuuagacacugggcauacuugccucgagauuucugucccggcccggcugcaacgucucaaccgaucucugcaauuucucagagagauagcaagacaaaacuagaaaccaaacaaacaaaaaaauucuugaauaaauuuccgcgagaaaacacgacgucauuuuuacgcuuaauuuuaaauuuuaaaauaggcuagaaaguagggaauuacuaccacuauuucuucuacugcuacaacuuauuauuguuauuauuauuauauggugggcaccaauccucgagcccggguucuguuguccuguuaucugcccucgacacacagaguggagguaucuaggcuugagguacuaaggcaguuagggaaccggcaaaggucaggagccugaggacugccaccuuagagaccauugcucuuuagcuaccgcccagguuuggagcccuggggccugggucugacgacugggccgguguccuuuucaaaagcuuagagagggucuggcgcugcggacuaggcagagaccuaggaagcuaugcccagcccggcuccagagaagccggcgacacuugccugggaggcccccuaaugguacuucugcucugcccccugcagggaacgacacaagucccgagaguuuccuuuugcacaacgcucuggccagaaagccaaagcggauucgaaccgccuucucgccgucccagcuuuuaaggcuagagcacgcuuuugagaagaaccauuacguggugggagcggaaaggaagcagcuggcucacagucucagucuuacggaaacucaggugaguguggcccagcagccagggccaggccacacuacauccagacccaggcagccagcacccagcacuccagccagcgcccagcacuccgaccagcgccgaguucuggaucaguaacucuccaggugcucagcuuuguuagggcaauaugagauucacugacaggcuagcuuuucuccgcuggucaggccccugcaacuccaaaguuuugagagaaucacggagauucagcugggguccgagauaugguuaauugcagcaggguguucuggugauugggcucaaggcuggagagagccgagagugguuuagauaagaguucugaaagacuccagggcucacccgauuacuccucuuaagggaaugccugggaaucugaagccggaggccaggcaagcugggcgauccugaaaacuagacgguuugcagagagggcuagccuugagggacacauucuuucugcauagcgggguuggaggggcggagggccuggcuuagguuagucccaaggugguuagggaguuuaggucuacaguaggcgcuacuguacucucagucgcgaggcagggucaaaguucccaguaaacaguuacguuuguaggcagaguauagcaacuuuuuuuccccccugagaagcucacauugaggguuuuguuuguuuguuuguuuguuuuuaaaaaguuccuucuucacgaaaaaaaaaaagaacgaauagggccucucgcguuugcacagggugggcacaaggcaaggcccaccugauuucuccuggauagaggaggcagcgguugucuuuguccgccucgcugcccacacugccuggagucuuugugugcgugucaagccaggagcacacugacacuggcuuugggcaaacgcuggggggggggugcgcguaugaacuguccucccccuuaauuaguagacucaaagcaaauuaaacucagucuuguucccaguuccuacuuugcuuuucauggggcacuuuggggggacaggagcauuggggagaacaagugagaccccguggcagucuuaaaggugagaguggaguggcaucucaggagcccggaggcucugacugagcugcugugggcugugggggcugcagucacugcugucuucuucaucugcaccgcacugcugggcagacuugggcagugccgcugaauggagcucgcugcccaauuuccccauggaaggcaauuggcuugauccucaaugaugacuucgagcugcaagcuauggguaggccugguuaccagaaucucucuggaggcuggagccaaagcugauuuuacccuguuugaggacuggacgggagcagaggaaagagaccucuuuccuucucccucucauucaguuucuuuuacucacuuucucuggcauggucuuccgggagcuuucaauuuguccaggcccugagugaggcuuguaaaguccauguccacuugacuuccucugggcccuuuccaguccugcuuaccugccagugucccccaaggccugaggacaggcaaucccuccauccuccacucagggccuugccugguagaagaggcacuauauuuaggcaacuccagacuaguagaaaguagaaagcacguuaggccaacagagacugagucuuuccuguacucacugggcaagcaaggaaucucucucucucucucucucucucucucucucucucucucucucucucuuuccauauauauuuuuucuuauuauuuuuacaaaguuuuucaugcuuugcaaagagccuuugcucuuagugggaauuugugugggagaaacggccauacuuugggcacuguggcccuuggggaaaggcuccuugguaggguuuggaaagacaggaacaaggcuucucuagagggggcuugcucucagagggaaggagaagaaaguggucagcccuaaggauguaugucugggggucuggggucagcccugggcugugacaggccucugguauaugauaggaaggcacuaagaaggaucuaaagaugcccacuugucucuccccacagguaaaaguaugguuucagaaccggagaacgaaauucaaaaggcaaaagcuagaggaagaaggcucagauucucaacagaagaaaaaagggacacaccacauuaaccgguggagaauugcuaccaagcaggcgaguccggaggaaauagaugugaccucagacgauuaaaaguccaaacccaauccuacaaaaauggacagcacagagcaagaaagacagggagaggaggggaagaaaaacccuacaaaacaaaaacaaacugcacacacauccaccgagaaagggagagagggaaucagagcagugacgcucgcagcagacuuuggacagcgagggcacuggaccgggaaccggcgccgggccgggcaccgcuuacaggacagcagaggacggaggcccgaucaucaacaugcaacccucgucuaaagaggcagcugagugagugagagagacagagacugggagggagagagaggaaugagagagagagagagagagaaugaaugauccuugugaggcaaaggcacauucugacaaggggagcugucagucaaaugccaaaccagggaaacaagaugauuggcggguauuccgcuuaucgaaguccauuuagaaaugauaaugauuuuuuuuuuuggaaaaaaaaaggcacaggacuuuuaauuuugcacuucacaguguuucccccucaucuuuaauuagaaauaacauacaaaauuccaugucuagccccauccuacaccuguuucaaaacuugaauugcauguagcaguugucgggcgaauggugucuaaaaacugaauuguaauuuuauuccucuuuuaaagacagguucuguguauuuuuauuuuuuauuuuuuuucugagaaauguucagucuguaaaaacacuuuuuugauaccuucuauugucaaagugauugugaaagcuaaacgaaguaggcucggagauagugguccucugacagagaaaugagggagcaggacugggauggagggcgggggagggugccccugagaagaaucaggacucaugcuagggguaaaaacaacccacgauaaaagacccaaauuaauucuauuucuuggauauuuccuuuccuaacauucugauacuuuaaaucaccaagucaacuuuuccuuuuagugguuggagagauugacugcauccagccacucaucauaauggccauucagaacuuuuaagucugucuauugcaaaaguggaaggaaggacuguauuuaauggggugaugguggcguggccaaggacaugggaguuuucaagcacugaguuucucuuccaagaccauagacuuacuaaagaggguuacaaaugcuuccuuagugucuucuauaccagauuguaaauauuuuuguguuuuguguuaauuuguuagaauucuaacacacuauauacuuccaagaaguaugucaaugucaauauuuugucaauaaagauuuaucaauaugcccucaga

SEQ ID NO: 9347 - RNA, 6481 nt, Mus musculus
uguuuauuaucaaacuuuauuagugucauaagcggguauuuaagacauuucauauuaacauuuggaaaacauacauguaauuauauauguauauaaacguauauaugcuaagacuguacaucuuuggcauuuuuauuccaguucuacccaaugcacaaucacaugcaguaaguaaugagcguucauggaugggaugaauguagaaaaaacuagggacuaaucaugcuagcauuauuucuuucuaccccaugcuauagcuucuucccugcccccucacuauucuggucacuccucugccucuagcaguuguuauggaauaaauauaguuuucccccaaauccauguagaagccuuaauccaucacauaguuauaucuggagaugggaucucuaagugaguaaccaaaguaaaaucaaaagaaugugucucugaccuggucccauuaguauccuuaugagggcuucagagcacucuccuaaacuguguuucaacuaggucaugugagcacacugagcuaguagcugcuuacaagccaagagaaaagaccaugugccagacauugcagaauccagagcuggagaaaugcauugauuaagauacccagucugugguauuuuguuauagcaacucacagcaaacugacacagcaauuaccugcucaaugcugauaguuaugcuuuucccuagaaucagggaaugcuugaaaggaauccuccgucaugcaaacuuaucaaaucaugauucuagaacacuacaucauaaacuugcauaucuuccagaaguuauuggacaaugcauggguauaauguauguuuaaauauuaggauuaaauauguaauaaugauuaauccauucacauuauugaauagaggcaagaauuuuguacaucacaauauuuuaaaagguucuuguucauaaugugaauaagugaaaauuacuguaaguuaagccaugugugcauuaaguuuggccuacaaccaacuccuuccuuugaaaaacuaaauagcuugaacugcagcuucacuuaagaguauguuaguauucuuauaacguguugcugagucuuagucagucauaguaguugacuuuuagccagucaguaugacagcugaucacaccauguuuuuauaagguaaauacuaagauaugaccaaccacaguauuauauguuucuuuuuaccuuuuuuuaauuuacaaagauugcuugcucacugauggaacacucugaacuuugacugggccagagucuauucaugaaacaacuguuuguucaaaucaauucugcaaaguuuaauuuuucauaaguuuuuuuaaacuuguucaaggcuuuguauuuuguaugugcaugugccauauauguguucuaaugcaugugcauuaggucagaagacaacucgaaaguguaguuccuuagggguugcccaccugucuuuuguggucacuggccuagagcuugccucguaggcuagucugccugucugcauccacagugcuggcugccaugccuggcuuuuaaaauacggauucugaggguggaaugaacuuagguucuuacugagcuaucucucagcccuguaguuucuuauauaaccaucacaagaaaauagaaacauaaucugaguacagaacaguacuucagaaaauggaagcauuucugaagugguccuacuucauccccguaucaucgccuggauuuacuguuuucacauggugaaaauuucugcucuuuuccucauuuacacgccgguaaaccccucaucaggaccuauacacuaugccagccugguaaaucaacuucugaguagggggugcuuagcuggauuugauucggucaaccagacuggaaagucccuggagaacuggaauccgguugagaauugcaugaggccuggaacacaguggacacucaaauauacgcaaaaagauaggaaaggcuggggagagggguggcgaggaagcgaaggaagcaaagccuuccuugaagagaucaucuacaguucuccauugaacucaggugggcaucgaagucagcauuuucuuuagccaaguucaccagcacaggaaaggagcgaggaaaggacaaaacuuuaaaaaaaaaucgcuugguuaaagugaggaaaaggagaaaaacaaacaaacaaacaaacaaacaaacaaacaaacaaaaaacaaaaacaaaaccucaacaggcuccucuuagcagaggcguuuaggcaagccaggcuguucccugggcgaccauagagccagaacggccgcagccgauuggcugauccgcccgagccaaucagaagacacgauguuggcgggguucuaagauggccgccgagccgcuguuuccucccugguaaguucggcuucgcgaggcgcgacuuggcggcaggauucgcggcggccugucgggcuguguuccgaggcagggagggcggcgcaggagucggggcggcucguccucgcagaucugccgaagcgggcuuggaaaacccuggguucgggcgggcgccgcugggcuccgggggcgucgugagguagccguccggucccgggccagcgaggagcgcgaaagcccacacagcaacugcggcugaccagagcgagguucgcggcucgccgcuccgccggcgucccgaugcgaguucugacgcggcuggagagcugaagguggugcggccucgcaccgggugagugccgccgaguuccagguuguccgugcgggaaggggugugccuuucagagccacccucucagucuugaacuuuguaaguacuuguacaguggcauggauugcgugguuuaaaaucuuuccacacaaguuagagagggucccgggggaaaguggguuccaagccuuggcuguaaacauuguuuuaauucaaacucaccuauccuuaagauuaaaaauacaaaaaauaaauaacuuauuugaaguauaucugaacugaggccccugacuccccucggguuuucugugucguuuuaagaaaaaggaacacauuuucuaacaauaaauaagacauuuacauuaauguugauaaucuuaagccuaaaagugugucaguuaacuaguuccaaaguucaggaacuauuuauuaugcucuuauagguuagaggauggcgguuauaauuauuuuacaaauaggauuaaauuuagauguuugugauuauuuaaaaucgaauacauaagacagccacuugauggaaaugcagcuuaaauucuggcauaguagagacagaaaauuuguuggaugcgcagauuuuauccuuuggguauugcuuguaaccaguuuuguggucuagaaauacauuucucaaaucucuaaaugugacucucaguguguuacuuaguauaauaucuccccuuuuucauaugcaaaaagugcagaaaaaauuauuaguaaaauuugccuagauuugaccugucucccaaaucuuugucuccaagaauucgccaccaacuuugcccucuaaaaguucauaauuuaaagcugucaggcguaacuggaucacaaugauuuuggccaguuguagaaagaguugcuguuaguuucuaauguguguugugaugaagauuagugccugccucuugguuuguguguggugugugacaggucugccuucuuuuucuccugcugcuugucugucuuuuguuguaacuugguuuccugccccuuuucaguggacccugugcagagccucugaaaacugaucaucuagugagguagaggagagaagcugcguuuauauugaucaaagaguaaagcagcucuggucauuuaggacucugaggccauuaagaucauaaacauuuuaaaggugugugugagaccaucgcacugguauuugaccauaccuucguuuuaaagcuuagaaagaacgaaaacccaggcaaauacaauggccugcucaggauggaagucaucugacuuucaagacuauuuuuaccucuauaacuagucuucuacagaucugacacaaacuagaacuuuuauaauugguauuuuuuuuaucucuaugguuucuguaucucaaaagaugguauuuacuaaauccuuuuuaauuuuaauuuuuuuuuuuuuuuuuuuuuuuuguagagaaugagguguauagucaacaucucugguaacagguaaagaauauacuuuacuggauuuaggguuucucaccuaaagguagaugauacugugcuaccagggggaaaguaaaauacuggauuuaaaaaaaaacaaaaacugauaauuagcuuagugacuuucaguacuuucauuauaaaacuucuuaagaauacauagauuaccagaugcugaaccacuuuguucuaaaugcauugcuuucugccagagucugcucaguaaugguugugguuguuuuucgaggguaaaagaaacccucuuuauuuagacuuagaaauucaauucauagcaaaugaugucugcccagaacuagaagauaugucccacguuguacacaaaauaguuuguacaugggaaaaguccuaacugcaauggugaaguguuggaaaugaagaagugauauuucaaacuuuagaaaaaaggagaaauguggcucauuuacaucuuccuugaggauaugauuaaauuaaauacuggguuacaggcuaaaaacugaaagcuuacaaguuaauucauuuucugugcuaugggccuggcuauaaucuacauagaauugaguuucuguuugucugguauuccacauccuuuuaaaauggcugagugaauauucucagagacuaaucuaggaauuuuaaagacauauaaccugaaaggaaugaaagagacacuucaaagaauuaaucacccuucugagaaucccaaacaggaauaacaggaggccagauaugacaccaauuggaaaauguaugaaugacauguauaugcagaaagacagugucuucaaacaggagcccaaggcagaaauuaccagucagccucuccauacuggcuaguuuacaguugagcugcugcuuaacuggaccgcuguguuaggcaagcucguuaccagcaguuaccuguguuuaucugcagaaaccuuaaucuuccuuacaucuguuuuuguuuuccuuuuguuuugggccacccccucccucaguaucaugggaaacugauaugugacuaaagauuuuaaggaacugaguuaaaaagcaaacaaacaaaccuuauuugaguuuuguaguauggauuuggaggaucuuuuaacuuuuccucuuucuucagguccauuuaagaaacugucaaaccaggaaaauaccguaucagcauauuaaaugcuuuaucaucagucaauaagaguaauuuugagaaaguucaaaaagccgugaaaacuggguagcugccugaaaacugaugaggaaaugauaccuucuauaggguaccugagaccgcucuccuuggggaaucacauuugaauguccagaauauagauugugaaacuccagaugugcucaaacagcagccugccaugcugucuaaggcccaggccgagugacauuuccaugcugcggugcggauucuggucugugaagcuccugguucuccuuuguguacuuugguuccuagacucuugagaguaucuagcgugcagugaacugccaugggcaguucuucuauaguaggccccaggcaugcuuaaaaaaugccugaaauuguuaauuuuaacauccucaacuagauaacgaaccuaaaggugaugcagaugcuucacuacgcuguucucgcuggcucauuucacaguguaucucaagacuucauucaucuugucuuuuaaaaccuaagaccaagcuuggaggagaugcagguuuuauaagucaaaacacuuauaauuugggggucucuacuuugagcugaacuuauguucuggauggaaaguuacacacuguaguuuagagcaaaccuuuauaagugagaaacauuaauauuugaguuucauucauugucugauugucugccucuuauuuuacugcucuauucagaaggccaagcacaagguuauucagagaagcuucgugucagacugcagaucaggguggggaacaugauucguaucaguugacaaaugaaacgcuucaaauauuagaaacuucagagguaucuuauggguucuucguccauacuaggagugauaaaaaugcauucauggccacagaaaugauagcaagaaccacugaacaguugguuuuuuuuuuuuucuuuuugacgcacaguucaaauuuauuuauuuauuuuuuaaauuuuaacacuaaacguugagccccuagagccuccugaaugcuguggaguacuguaucucauuuaauccucagacgaaccaguguaauuauccugugccacagaugaagaaacugaggaucaggguuguuaaguaauuuccuucuuccucuagaggaacuggagucaggaguccaguugagucuucuuaaaaagcaagagaauguuucagaaagucaaauacugauaaacauauccua

SEQ ID NO: 9348 - RNA, 1649 nt, Mus musculus
uagacuagccggcucccgaccccggcgggagguggagcggagguucucgcgugcauuguccccgggagggagccauguuuccuccucccggcacucccagauggcggcagggagcgcggggcuucccaagcagcccgcggguuugaaaagccagcagaaggccgaucguagcgaagaaucgcaagacccgagaguccugacccgcugggccguggcccugcgacgcaagccucgggcggcagccacucaacacacaccagagcgacgguuccugauccgcgccuuccgccgcggcccgcuugaguagggaggccgugcgcagacgcggcccgguggcggcggccgugaccacuggccuccacagcccgggcugcgggcagcaggcggaggcccucgaaacucccaggccucgggccggcccugcgcggcgcgacccgcugccuuacucaccguuggcgcgcuugagggcauuuuccggccucuggaaauaggccggcaucuugacgguacgcucaguucacccggcgucagcgaacucccuaguggccuggaccgggagagaaggcggaggggaacuagcgcgagcuuccacgcgccucgccagcagaugcccgcgcccagccggccagagacggaaaggaaggaaccacgugauucccucgcggcggcagcgccgccgcccgagccccggauguaggaggcaggccuuugcgcauguuccgccuuucuccgcgcgcaggcgcgcuggcgucucgagcgcgggcugacguggcgcugggugccgagcagcgcgagcugugguguucuuugguugcgggagggaaccuucgggaccguuuucuccgaccaccucugccccccgcggacacagagugggaaagggaaauuugcggucugaucugcgacgagaaaaggcagugucuacacagucauagccaaaaugacgugcgcggaagcaggccgcguuagggucgcaucgccucugccgggaccucuccuggaaagguugaaaauacugaacggaagugcugaccccguaucgcuggccagugguguucaucccugaaaaauaggucaccagucacuugauugacaaggaaggggagggaacaaacgaauaauaaacagaguuauuugguauccuccuaggguuagugucccaaggauucccgaaagaaggggaguagaagacccaggaaccuggcuuguauauuugaaaauacgcgagugucaucgauuuuuacauacagcucacgucacaaacaaauauaagaaauguguuggugaagaaauggcuuauugcaagccaugucuuuuauugcuaccuaacaaauguaguguucacagauuaauuacuaugcuuagagcuugaaagccauuuaaaccgcgucgaauuauuaggcucuugguaggaaauuaacuugaguucagggcuguggcuguacaguggcugagcgcuccucuagcacacacaggggccuccauaaucccuggcaccacacaaagguucagagaaaauucaggaagaaaagaauaaauuauuguaaguuuauuacauauuuuacaauaguaugggacaugugaguuaaugagauacugugucaaugaaugaggaaaccuuaaaaaauaaauaaaaccugagcguggug

SEQ ID NO: 9349 - RNA, 1649 nt, Mus musculus
caccacgcucagguuuuauuuauuuuuuaagguuuccucauucauugacacaguaucucauuaacucacaugucccauacuauuguaaaauauguaauaaacuuacaauaauuuauucuuuucuuccugaauuuucucugaaccuuuguguggugccagggauuauggaggccccugugugugcuagaggagcgcucagccacuguacagccacagcccugaacucaaguuaauuuccuaccaagagccuaauaauucgacgcgguuuaaauggcuuucaagcucuaagcauaguaauuaaucugugaacacuacauuuguuagguagcaauaaaagacauggcuugcaauaagccauuucuucaccaacacauuucuuauauuuguuugugacgugagcuguauguaaaaaucgaugacacucgcguauuuucaaauauacaagccagguuccugggucuucuacuccccuucuuucgggaauccuugggacacuaacccuaggaggauaccaaauaacucuguuuauuauucguuuguucccuccccuuccuugucaaucaagugacuggugaccuauuuuucagggaugaacaccacuggccagcgauacggggucagcacuuccguucaguauuuucaaccuuuccaggagaggucccggcagaggcgaugcgacccuaacgcggccugcuuccgcgcacgucauuuuggcuaugacuguguagacacugccuuuucucgucgcagaucagaccgcaaauuucccuuucccacucuguguccgcggggggcagagguggucggagaaaacggucccgaagguucccucccgcaaccaaagaacaccacagcucgcgcugcucggcacccagcgccacgucagcccgcgcucgagacgccagcgcgccugcgcgcggagaaaggcggaacaugcgcaaaggccugccuccuacauccggggcucgggcggcggcgcugccgccgcgagggaaucacgugguuccuuccuuuccgucucuggccggcugggcgcgggcaucugcuggcgaggcgcguggaagcucgcgcuaguuccccuccgccuucucucccgguccaggccacuagggaguucgcugacgccgggugaacugagcguaccgucaagaugccggccuauuuccagaggccggaaaaugcccucaagcgcgccaacggugaguaaggcagcgggucgcgccgcgcagggccggcccgaggccugggaguuucgagggccuccgccugcugcccgcagcccgggcuguggaggccaguggucacggccgccgccaccgggccgcgucugcgcacggccucccuacucaagcgggccgcggcggaaggcgcggaucaggaaccgucgcucugguguguguugaguggcugccgcccgaggcuugcgucgcagggccacggcccagcgggucaggacucucgggucuugcgauucuucgcuacgaucggccuucugcuggcuuuucaaacccgcgggcugcuugggaagccccgcgcucccugccgccaucugggagugccgggaggaggaaacauggcucccucccggggacaaugcacgcgagaaccuccgcuccaccucccgccggggucgggagccggcuagucua

SEQ ID NO: 9350 - RNA, 1019 nt, Mus musculus
gauggaucuuaaaauugaaugcacuugggaagguuuuccagugagacaugagccagggugugucaggcugaauccgugugaccagagagugaagauggagguuagugcuccauuauucaaugauccuccauccccucuuggagaaccaggaaagccuuucagugaacuguggaauuaugaaguuguggaagcauuuucuuugaaugauacaacuaagcagcauuuagaagucgaacuuuguccgcauggacaacauuuaguucuuuuacuagcuggaagaagaaacguuuggaaaaaagaacuugcauuaucauucaaagcauccagaggaggaacuaauugggaaggugaagcuuauauuccuuggaguuauuucccaccaaaugugacaaaauuuaacucauuugcaauccauggaucaaaugauaggagaguuuaugaggcacuuuacccugugccacagcaugagcuacauacaacaaggacaaaaaccugacuuccaucgucuagaauauuucaagccuuucaguuuuaacacacugcuuggagaagaauggaagcagccagaaucaggccugugguaaucuaauaaauuacauaaacacauuucuacaacaaacauuuuaacagagaucacugaaauguaguaucucugugguaaauuguauacggugaacaaagaaauagacacucuguguagcauaaaauaauuuuuacuuaauuccucuccacacuugaaaucaguacaaagcaauacucuauuuuaguugaugagaccaucuauaucugcuaaggcaucaagauagaggaguuaucuaacuagauauuuuuacuggguaaaaagaaaugaaauagucuugaauuaaggaaauggaguugauaauuuuacuuauagauaaaugauauuuucuuaauguugccaaaaaagaugucagaaaccuucauuugauuuuugaagugucaaacaauccugauugaagauuguucccaauauaauaaaucaguaccccugucucacu

SEQ ID NO: 9351 - RNA, 3379 nt, Mus musculus
ccuuuuucccccucaguguagcuaucacucuccuguugacuuguaacaagcugaaugaaaugccagaaugcacuugggccaucucccaauucaaacacaucauugguaagaguacuucuaugagcaggacuuagacauugcagugucauuggccuccuccuguagggcauccagcauauagggcaaggaauccuaaaucauugggauagagaucguggcugcuaaaaccagugguuuaaagagguuucuguuauauuuggggauuucuguuauauauucuuuuuaggaguuuguacugaugauaaugaugcgucaugaaaacccaaguguucucaaucauggaacuauggagaagugugaauugggauccauccugagugacuaccuccaaguuuguuuaggccuuggcuggucagcaaacuggucaccagaucaugaaccuucaugugacuccacuuauuuguuggcuucugugacaugaagaaagucucaccaggaaaaugggaugccuaagaacaagccuaggcaccagugaaguauaaaggcaucucauugucacuuccccaggagaggugggccagaggcugguucuaauugggcaucucaaagucacaggcaaaaaaucacuccuguaacacuuagaugggcuuaccuuucuagcccuggggaguugucaccuagccccugaagccccugagguaacaaagaauacauuugaucucucuuucccaccaggacagggugagcagcuagucuuacugcucccugggaagcugaagcucugaguaugacucugccucaaaacuugucucagccaccaauuacuaggguuuuuuacagaaugaggcaggugcuaccugaaucaaccccuguuacaaugcagacuccuaggcuacaccccaagccuacuauguggugaucuuauuuuguaguucaggcugguuuuaaacacauaucuuccugcuucagccucuggaauucuaagguuacaggugcauacuaccauggaaacuguaucuauacuaaguaucucaaacuuggugcacuuccccuuguccacuugcuccauacuguagugugagaacuauuccccgggccugugaguauggccauaccaaauguguuuuuuugagagaccugacaacuuugggucuugaguuugccaggaaaagaaucccaagcauaucagucucauaucuuugauuccaagcucucccaaggcucauugcuagaaaagagccuuugggaaugaucauucugaaaucaguuaaccaagagagcagccaggcuccauggugaaaaauuaacuucaagccuggcucccaggcuauuucugaacuuuucuugggcugagcaugaagcagaugcaagugaccguauucagguucuacuggggagcaggacacucaguacucccagaucaucaagcccuugcugacacuucuuucuuaaggaaaagaauuaucgucuuccugggauggucaucagccucagccacacacaaucccugccuccuccuuacagguuuguuucuuacuuccccauccacggcuguuuaacucuuaggaacucuuaggaagcaguuucuccuuaggccucaaagucaaagcaauguccauuguagcagagaauccccaagggggggaaaugcaagucugucuaccaagaguucccaucaugagguccugaaaggccuguacauggaaaugugccugagugccugugggagguaaggaaagucaugugauucagucuuucacucauggcuucauaacagaacagugugugaaaacuggcucuccucccuaagucuuccuccugcuuguguuucuguagcugcauuuuuagaagguuuuuuuuguuuaaugaaaacaagccuucugcccuuucaccuguccaggagaaaguguguguggcuaaugaacagacuguguuguguaucugagcucuuugcaaaagagccuuucuucgaggguggcauuuuucucaccaaauuuccacugacuuggaaugagaagcuucucugcuuuugcuguuugggagauaggccucugcuaugaucauucugacuuacaauuguccauuaaacccuucaggaggggacucagaauaucaagaaggccugaucccuaccuuccaggaggacggugucuauccucuacuugagccaggcuccaugcucacccagcucucuaggggcugagucuggcagcagccacagggcuagucucugagauguguuguucucuuggaggggcagccagcaagaggcuugccacacagauacaggcagguagcuccaguaacaagcaugccucauaguuacugacccuugauguuucugaugaguccaugugcguggggacaugaacauggcacaucuuuacauuagaggagcaaguaagaugggaaucugccucauaacugaggccagccccaaagaaagcugagaucagaaaguuuccauggaacuuagccccacuguugaaauccauuuuuuuuugaacccuguacuuucuugaaagucuggcucuacuuuccaucaaauucacugagcuacuacccucaacauagagcaagcaaugcaacuuccuguagcuuagcauucuaagccuugauaaaggaaaugguggcagcuucuuuggacaauuagaguucacaagagaagaauaggaaaaaaugauucaaacaacacuggacucuucucaugagcuauugugugcuugcuuuucuggcuguauccuuaucccuuuccgagggucucccaucuucauaaccuaauacccugagauaagaccuuauugcuucuuagguuuuacuauggaaaggcaguauaaagccucuuccuccaaacuacaauugauaugccuacccuuggaucaccuucuguaccuauuuauacaaccagccacccaguuauugaagcugacaggcauguaggccagauucugcauaggcacauaugaugccuccucugaaaagucuugacucaggacaaugguuuaacauaugacaaacuagcucacccuagggaagaaguacccuuuacccuaaaagaagaugcugggcauuuuuccaguucaaugacacaccauccuauaauagaucacaaguaaauguuguccauuagaaaggcauuguggcuacuggcauuguuauaauaauaacucuauuuuccaaaaguuucuauuuuuuucccagggagauuuuagcauuaaugaaugaauguggguccaucuuggagguuauugucaaugauaacagcuucuguugugcugcucugaaccucacauguuccauucacuaugucacagugccaccuugucuagccacaaccacuguuauuuuauagagaaauaaauuccuuaaugaacauaac

SEQ ID NO: 9352 - RNA, 1626 nt, Mus musculus
uccaguauuuuaaaagauucauccuuguacuucuguuacucuagaaccacuccugguaccaacuucuguuauuagucaggguucucuagagucacagaacuuacggauagucucuagauaguaaaggaauuuauugaugacuuacagucggcagcccaauucccaacaaugguucagucgcaguugugaauggaaguccaaggaucuagcaguuacucagucucacgcagcaagcaggcgaaggagcaagagcaagaacuagacuccguucuuccaauguccuuauauugucuccagcagaagguguagcccagauuaaagauguguuccaccacaccuuuaaucccagaugaaagguguagcccagauuaaagguguguuccuuaaacucggagauucaaucuucuggaauccauagccacuauggcucaagaucuucaaaccaagauccagauaaggaacuccaagccuccagauaagggucacuggugagccuuccaauuccggauuguaguucauuccaaauauugucaaguugacaaccaggaauagccacuacacuguguucuaugauacacacucccagauagcgaaauacuguaaaugaacgccuaucauuuucgcugauaucaacacuugauaaaguuguagauauaccaaaggucugcuaaucauuauucaaagucaucaucuuuggguucaacucuuacacaaguaaaaguucuguccaggauguuccugacacaugaggcuuccaggugaauuucagaaauauuaagaaaaguaucuuccuuuuuugucugugaauguuugcguauugcuguacuguuggcuuauauccacuacagacacugguucuaggccagcccaagggucuucaagcauugaaggcuuaaaauaacuuuccaauucauuagacauucuuuuuucucuaccacgcccugauccaaaugguguagauguccuuggagaacccuggggguaggucugcugcugcccuggggaguagccgaacugaugcugggaccccgcgggggaccuggaguaggagccuggguagccgcccggggacggagacgcgaagcggaccccugagaaguugcugcugugcugcugagacuggcggcucccguauggccuagcacggggcccgcagggcggaguguggugcggacuccuguaacagucccacagggagggcggccgcggccccccgcccagggcaccccagaaguuauuuccgccaccccaaccuccuauccccgggcugggguacggaggaguugggggucgaaaauucggucgguacauaucaggaaaugaagccgcagagcucacucgcugaacgccgaacgccgaacgcugaacgccgaacaccgaacgccucaacugccgaaccucagcgaucaacugccagaaggaaacugguauuccucaaauuauacagccuuccggcucccagcggacuaccgcaccuuaguucugguugcacaaagguuccgaccucaccaaauuuagucugaaguccaacucccaacaacggucaguagcagcugugaaugaaguccaaggaucuagcaguuaguugcucaguuccacacagcaagcaggugaaggggagagaga

SEQ ID NO: 9353 - RNA, 1626 nt, Mus musculus
ucucucuccccuucaccugcuugcuguguggaacugagcaacuaacugcuagauccuuggacuucauucacagcugcuacugaccguuguugggaguuggacuucagacuaaauuuggugaggucggaaccuuugugcaaccagaacuaaggugcgguaguccgcugggagccggaaggcuguauaauuugaggaauaccaguuuccuucuggcaguugaucgcugagguucggcaguugaggcguucgguguucggcguucagcguucggcguucggcguucagcgagugagcucugcggcuucauuuccugauauguaccgaccgaauuuucgacccccaacuccuccguaccccagcccggggauaggagguugggguggcggaaauaacuucuggggugcccugggcggggggccgcggccgcccucccugugggacuguuacaggaguccgcaccacacuccgcccugcgggccccgugcuaggccauacgggagccgccagucucagcagcacagcagcaacuucucagggguccgcuucgcgucuccguccccgggcggcuacccaggcuccuacuccaggucccccgcggggucccagcaucaguucggcuacuccccagggcagcagcagaccuacccccaggguucuccaaggacaucuacaccauuuggaucagggcgugguagagaaaaaagaaugucuaaugaauuggaaaguuauuuuaagccuucaaugcuugaagacccuugggcuggccuagaaccagugucuguaguggauauaagccaacaguacagcaauacgcaaacauucacagacaaaaaaggaagauacuuuucuuaauauuucugaaauucaccuggaagccucaugugucaggaacauccuggacagaacuuuuacuuguguaagaguugaacccaaagaugaugacuuugaauaaugauuagcagaccuuugguauaucuacaacuuuaucaaguguugauaucagcgaaaaugauaggcguucauuuacaguauuucgcuaucugggaguguguaucauagaacacaguguaguggcuauuccugguugucaacuugacaauauuuggaaugaacuacaauccggaauuggaaggcucaccagugacccuuaucuggaggcuuggaguuccuuaucuggaucuugguuugaagaucuugagccauaguggcuauggauuccagaagauugaaucuccgaguuuaaggaacacaccuuuaaucugggcuacaccuuucaucugggauuaaaggugugguggaacacaucuuuaaucugggcuacaccuucugcuggagacaauauaaggacauuggaagaacggagucuaguucuugcucuugcuccuucgccugcuugcugcgugagacugaguaacugcuagauccuuggacuuccauucacaacugcgacugaaccauuguugggaauugggcugccgacuguaagucaucaauaaauuccuuuacuaucuagagacuauccguaaguucugugacucuagagaacccugacuaauaacagaaguugguaccaggagugguucuagaguaacagaaguacaaggaugaaucuuuuaaaauacugga

SEQ ID NO: 9354 - RNA, 7660 nt, Mus musculus
uguauugguacaauuuuauuuggauucuaauaugacuuuggggaacugugaacccuguaaagcauauuuaugccacugcaaugaaagaauugacaaagcuaggaagggagcagaaaggaacaaaacaucaaaagaugccuggaguuuuaccaugaacacucuaucugcaucuuggagggaauugguccagagcauauuuucuaaagcacauagauaagaacugaaagcaaaaauaaaauuucagcugagaaaaaaaaaaagaauaggcuuauauuucuguguugugaauucuuauucugaccagccauccauacguagauucuaaaagggagaguuggccuccaaguaacuucuaaggaauacaguuuuacaauuuuuauuauggaaaauuucaaacauauacaaaaguauagagaauaaugaauucucaaacaucuaucacacagcuucaacaauuaucaagucagagucagucuuguuucaucuauguacaaacguauaccacccugauuauauugaagcaaauaacaguagcaucucuguaaauuuucaguacaguuuucuaaaagauaaggguuucuuuagaaagcacauccacauaguacaugucacaaauagaaacuccagcaaauuagaaugugugguuuuauuuuaacgucuguaagauauggggacacaauacauuucacugguaccaugaggaaggguguuaacacuaaauuggaguucaggccuuuccaaaucuaaugguuuauaaugaaaaagcgagacacaaccaccagccauaucagaaccucuuuggaacccucaggaugagcugaguaagaguguugacaucacacacccugugacaaaacucugaaaugucuuuguccuuggcauaaaguuauucuucuggaaagagucaaacugagcuuccucauuuaaacucuuuauuuugcauuccccuuuacagcagucucuuucccugaagccuuucuaagggacaccaauuuagcacucacucuccucugcauaaacaugcagagagcuugugguacugaggagccagccagaccacuguacuaggaaagggaugagaaccacagccaacugaaaaagugagagaggcaaaagacacuuaagcaacuaaauggcacaauuagcucugaaaacugcuucaguagcagguuuuuuuuuuuucgugcucaucaucaaauaauacagaauauugaaucuguaaacaacaacaacaacaacaaaaacaaccccagaauuuucugcaaggaaauguuaaggugacauuucagaaguagagcacugcaaaaaaaauuaaauguauuauucuuuguauauuaauuuaaaauuuauuuuuuauaaaaacucacaauagguuuucauuguaauguguuacaauuaccuuuauaccaagugauaccuuuugaauaaaauuuuaagcaaauuagcaacaguacaaaaacacuaaaguuguuaggugaaggacuaauucuauaaaauguuacccuaaaugaugacauaauauuaaaaccaugccagccauugugugguaugacauauaaaugaauacuaauucuuguucuggaacaucucaaacuguccugaaauguuucugcaacaccgaauacacaugagcuacacacguggugcuuagacagcggauacucuacuagcaccagauugggagggaaauguuuagccacaaagagauuacaaaauacuaauagaaucaaagaccuccagugaugccaaccauauuucaaguagugucuuggaugcagaauaugcagaguaaggaaaaauagucauugcucucaaagguguaaugaagaaagcagacacaucagaaaagcacaacgaaaggcuauaggugcugaauuaaguccguucacacacaauaguacaacaaccagagcaaaaaacguugguaagauagacagaagaguguuccaagauguagaaggaaaaccagaaugagcggucuccuuggcaaccuuaauggugcuccggugaacuugacaauaccacuggauacuggguucacaucaaugaugauuucagugugaucuugagcaugccucgguucaucuggaaaaagaaacaaacauacauuuaacaaguuuauauuuaaaauucuugcaauggacagacuaagugcaccugucacuugguguuuagaaagcccucgcaggcucuaaggcaagugcaauguaggcacaugcacacgcaugcacacaaacaccuuccuauaaaaauuaugaaacuagugguuaucaaaaggaaaguaacaaugaagauacagaaaaaaaugauaaauucuaccuuuaagacuagagauaauucaggcugauagccacauaguaaauaaacuguuaaccgcuacauagaaguaucuuaaucuaguuuaaaaagaguaucucauugagagauauuuaugcaauaucuaugugcauuaucuacaacaacggauuucacagaaaaccugugugcagggaugaugugguaacuuggaugaaauuacaauguaagaacuaacaccagggcaguauccuuuaccuccuggucucucauaaaaacgucguguggccacacugaauucucauaguucugccugcucaaaaauguuuaaacauguucaauacaguguaguuccuugagagggauaccaggaaaauauuaagccugaagauaaaaauucuggccagggaaaauucccuucuagauccuauacggcauucuuauagaaaccuuuguaaaugaacccauacuguucaaugauaaaccuuuuauauaaauccucuaaaauaaaucuguauaaaguaauaaauaaagcaaauguauuauaaaaguaaauuuccuauuucucguuuguuucuuuaaaguacagaaaacguuguauguuuccagucuacauacaaaccaauauuaacauaaaccuacauuaacauguuuccucuuuguacaucuggaagaacaaaauauucuaucuuggaguuguggguggagcucaguggccugcuacaugaucagcaugcaugaggaucuggggaaaaacauuccugguuaccaacagaacacuucaagaaaugggaaaaacauuucuaauucgugucuacaaaucacaauuaucuguugggaauauuccuuccuuuuccucaaagauggauguaaaauuuggcuguauauuucaguauacauauaacuaguauguaaaaugagcacucucacaaggaaaaaauacccaguuucuaaacagucuuuagaagacugacucguagaaauuaauauauuaucccugguaaccuguucaaaucugggacuauugacaaaaccuuaaagauaaaaaucauuuccuaggaguuuguaauuucucugacaugucuauguuucauagaacauuaaaauuuuuucaaugaugucgaaacucaagccuaaagaaaccaaguaauuuuuaaaggggggaaagccacaguauauuuuuaggcaaacaauucuuaauaaugaauuaugaauacauuuugauuaugcaaaauauauaauuuaaaaaugcaagaagaggaccugcaagauggcccaguggguaagguacuugcugccaaucacugacuacaugaguucuauuccugggacccaccugguggaagacaccaccacucccucacauaguucucugaccuccacagcuauacaagggcauucucacacccacccaaacacauauacacacauguauauauaugcaugagggcuauuuaugcauguaugugcacaugcauacacacacauacaaauaaaauuuaauuuuaaaggcugaugcauugcugacuaauaccaaguacaaggaaagcuuucaaugcauuucuaaggcuuuuauaaaaagaaauauccagaaacccaaauccauuuuauaugcuagaucaauggagaacuuaagguuaauugagaugaaaucacagaaucuauuagaaacuuuuuaacuagcaaaugacauuuugauuagaauuaaaaauaagugcuucaaauuagucauauaauuuuuccuuugaugagagaucaagauauauuuuggaaauuaggcuuuauguuuuaaaugugcaagaaauuuuuucuuaaagguaaaccgcauuucuuuagaaaaauccaaggaccccacuuuuagaagcuuaaagcaguaugaauuuuuaaauaacuccagcccaauggagaaaaacauuugaauacucugaauauuaaguugcacaauaaggcaguaagaaccgggauacauacaguucaaaaccaaaauuaucucugguauuaaaagacagaagaagaaucccaguauugugauaaggaguuagaaauagagugugaguuucuggagcuggauauugauguacuucaugcauuccugaaauaccaauugauucacacauugauauguacaugaacuaaaugaaaaccaucuuuuuauaaagaugaugcucaaaguuuuagcaguaguuauguuuuaaaaauaauugugagagcaaugaacuggggcucucuuuauuaaacacccuuccucgaggcucagggaucuauggggaagcgaauucaauggaaagauuguagaguaagaagugguauaugauccuaggaaacagcauccucuggacacagcaggguugaugugcacaugcgcucauagagccugagacaguuaguacaaggccugcacaaaucugagccacgaaaaaaaucucagcauggagaaggggaagggaguagaaaguccuagcccuaaccaugaagcucuuugcaauagguacuuucugggacagagaaaauccugugucucuaaaggaguuacacuaugucuaccaacucaacuccuggguaugucucguguucagggaacaggugacgagcacaaaacagacuccauguuauuuugugugcuuuuaucuugcugugauuugcugucuuuuuguggguuuuguuuguuuccuugguuuuguuuuuaagcaagaaggaacacaaaucugaguguggguaaggaugaggaguacugggggcagggcaaagauuaugaucaaaauacauucuaugaauuguuuucuguuugcaaaauaagaauaaaaaguaaauagcuccaacucaagugagguuaguucuuuuacacgguuaauuccccaagcacauucaucauucucaucugugauguuucuugaaaacgcucaaauauggagugaucuuuccagucuuaaaacagucuuuaaaaaggcuuucuagauacccaaauagacauggcaggggaaggugaucagagcuuuagaagagaauguggaaugacuuacaagugacuccuuauuugaaacaaguaucaagguaagaacaagaccaguagaacaaccaaaagauuugugguaaggaaugaaauguuuacucugggucuaugagauaagugguucccaugucuucacaguuggagaacagcugagcagcaagaauauaaacccauucaugauuugaauggcuacaaauaugcggucacauuaaagauucccacucccgugguaacugacagggaauuuaaccugggacaucaguaaauucaaguauaaauuacuuucuuucaaaauggacauacagggagaaaaacuaucauuuuuaaugaguauccagaaaugugcuggucauuggaagcugcuggaugcgcaggcuaaaacaacggaauaaccacaauuauccucaaaauaaguaacuaauuagcaauucucuagaaauaucgauucuaccaggggaacaguuuguaaauuauauagggcguuuuaagucagcaauaaaaaaaauccucagcuguaauuuuuuucuugaaaauuaaaaugguuuuuggucauaugaaaaaaaaaaaaaccacgaaguuccuucucugggacuguuugauggcauuuuggaugcuaaaaguacugucuacaaaaaggaaacuguguaaagcaccaguuguucuuuuucuucauuuauuuucaaacaaaucaucugagucaaagucuaccaagaaugggccacugccaagaagcaagaggaaaacgagagagaaagagagagagagagagagagagagagagagagagagagagagagaaagaaaccaggaaccaaaaaaagaaguccgccugacacagugcgcuggcccuucaccaguggauaaaacuaaaggucccuucacuaggaaacaaaccagaaaaagcccuacaacaaaguugcgcacgcacacuaugcacaaacacauguaaaggcuguuuaacggggggaaaacccauccaaacaaaaacauuacagagcagacuggcgcacgaguacacaucaaugcacaggugaacacacacacacacacacacacacacacacacacacaaacacgcacacccuccaagaagagcagagcaagcagcuaaggcaccuuucacaaaaucccaugcagcuguggcugaccgcaagauuuuuacagugucaccaagaagcgauuggaaaagcaucugaaaaacgugcaaauugucugcaaacagcgccuggcaaccgagacaguuugcaagcgugauucagaggucugccugccaaggaaacaaaagaagccucccuccugcccgugcaggagggcgcacagggcaggagaggugcuccccaggcaagcaggaggcaagugcggggaggcgacaggcaggaguccgggcgggagcgguacauacuagggcucgcucucuggcggggacggggcggccgaguucccauuaguaggggagccgcccagcuucaguuucuccagguacucggcgugcacgggcuuguggcacugcaggaccuugauggcaucuucgaucuugaaccacucgcgcuuccugccgaugcugaccgagucuucccaauccuccagcagcucggugacggugagcacgaacacguagguccggugcuugcgguccugguucugcucgaagacgcccagcaagcggcccaacuuccccuugacucccgccuccucguacaccucgcgcaccgccgcgccguccggcuccuccucgggcuccaugcccccucccggcacgauccagcggucgggguagcggcugcugcucaccagcagcaccucguccucgcgcucgcugcggaagcacaggcacgcggcgcgcuucuugaagcccucggggucguagguccgcgucugguucggcuugcacuucauccuccccgacgccgccgccgccgccgccgccgccucugaggucgcuugcagcugccuagcgagcgggccgcugccgccgcgcagccgaggagcaaaggcuggcagggagagggcccggcgaggcuggaggagaggagaggagagcggaguggagcggagcgcagucugugccgagccagcggagacgaggcgggggcgggcgggcgggcgggcgcgggggcgggggcgagccggcgcgucagucaguccgcggggcgggcggcaccggccgggcgcgccgagggucgcgagcccgccgccugauuggaggcgccgcuuccgccgcccggagccgggagcccagagcccgcgccuccgcacagccccggaguggaccgugcgcgguccccgcccuccggaucgccgcgaucucgcgcgcgcucgcccgcucugccgccgccgccgccgccgccgccgcug

SEQ ID NO: 9355 - RNA, 11174 nt, Mus musculus
caagucagccgugccgcgacacguguuaauaagcagagacucgagcuuccuccaaguuuggaccuuagugggccggaugauuuggaacuuggagaacugagaaauaaaaacguaaguagguagcuuauggcucuuucauuuuagguccuuauugucuagacgcuuuacuuacauucccuacgcgugcgugcgugcgcgcgugcacgagcacacggggaaacuccccccuccccccugcccccgguacuuaaagaagguaaaaugugcgugugugugcgugugugcgcgcgugugugugugcgugcgcgcgcgcgcguguaagguguucgugcuggugacuacagagguuacaagaggggcauuggaucgaucccccccccccgaacgugaguuauggaccaccacgugggucuuaggaauugaacccagacccucugugagaauuaagugcucucaacuauuuaugcaucuucccaccuccaaguguuaguuuccacaaguagauguuguggauguucuagagacauaguucggaacucaaccacagcaguguccaugcggacaagaagagggaacauacauguuucuacuacuuagucucuaaaucagauuucuagccagcuacaaguuucuuugagcucccuaauaggucgagggggaggggcgugcacacacacauacccaugccaucuaucaucuauaucaucugucgucuaccuuguuaccuaaggaaggaaaaccagugucccugcgcagaaauguaugugagcuaaacacucaaacacauaagauaaauaaaucuuaguugauucuaauccuuacugucccuuggucauggucuaucacauccauggggcauggcuucugccaggcaguucuuguuuuccucaugagccaaaguuguauggaagagcauccaaucaguagaaccuacuagggcauaguccuuccccuaggcuaagcuuggguuuccauccgagggaggcaggacucugaauggaaggauuucugaaaaaauuacaaggacuguugagaaaugcuuggguaaggcagggaaccaugaguacuucagaucuugucuuccuuucccagauccagcucucccaacaacaguaggcuugagagauguauggcccaggcacaccugggaaucuagagcugccuaauuuuugguuagguuacauuuaagcuauuuucuggguagguaauguguuaacaaaugggaggguuguuuuuggacuagggucuccacuggaguauggaucaugcugucuaauuuaccauuguauuacguagcucagugccucaugaacaaacuaaguuggucauugccuugaacguguauauuuuuauugacauuucaggccccuaaucucaagagaagccuaaggaguguuguuuuggugucuuguuaacuaagggaaaucuagaggcagccccagucuuauaaucuacaguuucccauagggcuucugacucccucccuuuccagagagaggucuuucucucuuccacagucagugucuccauucugauacuucuaugcagccagauguuuucuagggccaguucugcucucaggacauguuuucaggaggaagagaugaaucauucuagcuuugguauugcugcaucugaaauccuguuggcauugaacuuaauauccaggggggaugguugagcuugccugcagccuuggcauuugagcaaguaccuuaucucuagcuuugucugugacugcuaaauggccacuagagggagccaguggagcuuugguggaacauggcacuuccuguuugcacucgguuccuguucugggggggaagaaaaaaaaucacuguugcuuagcaacaagaaagccaaucaugcuugcgucucaugccucugucacuaaccccaagugagacauagaacauaaagucuccuucagauauuauauacuguaacgguuuggaacuuacuggucacuugaaauguggccugugaucucauuauuuuaaauggauggaacuugagaaucucauccugagugagauaacccagagccagaaggacacgcaugguauguacucacuuauaaguggacauuaaaugcaggauaaccaugcuacaaucuacaggcccaaagaaacuggguaauaaggagguccugagggaggaugugcgagucuuacucagaaggggaaacuaaauagguggauggagagagggaacuggguaggagaggaggcgaggaggggaacagggaugacgaucagauguggggagaaggggggugagaaaggccugggaguaagaauggaagccugaggggggugcaucucuggugacuagcuagaggccugggaugggagaggauacagggagucuauggggaguauaccuuagcuuagauuccuagcagagggcacugaaauaggggacucaagacagcccacauauucaguguauuugcuagacagacucauaggacucaguguaucuuugcauucaugacucagguuuuauuauagcaaaaggauguccaauaaggccaaugggggcaacuacuucgggccuggagagaucuaugcacaggcuuccucauggacuuuuccucuguugaggggacauacuaauauacccuuucuuaagaauaaaaugcacacuacauaggugguauauuuuauccaagaaagcuuagagcacacgguuguuccuggagacugcuuacugaacaaccacugccuaucacgcaccaaauuucaggcucucagaagaaagcaagcauuguaggcuacaugguuuguacaaauaacaugucgggugccauauuccuuuugaauuucugcuuuaauaaauuaucccaagcaugugcuucuaaccccagaaucugggcagcugggucagguggacuaugaaucuaaggccugccugagcuaugauacccugucuuuaaaaaccacaaacaaaaucuauguuaaccaaacuauuuucaauuaccucaaacccagaggcuuaagguauacaguguuaucaucuuagaguccagcaggucaggaagguaaccuuggguuagaaugcagguguugauagggccaagguccugucugaugggcuaggccuccaguuccuguuugcuuagguuguuugucagaauucaacucuuuugggauuauaggccaaaagucuauuuccuuaucaauaagcaagggaggcccuaaaaauggccuucugauucuucucuuauuucuccucugaaaggaagcucccugcagcaauagagaccucuagaucucuauguaggaauagagaagccuagauuucuauguaggaauagggaauucuagucuugguuuuacagaggcugcagugcuuggcacaccagccacucuaaucucagcuucuagaggccaccacacuccuuaacuugcagcuucaucuucaaauucaaaaccagaauauugaguguuucucagaucucaucucucuagucuccccugggaaagggucucccaccuucaugaauuuaugugaguagacugggcccacucagaugagcccgauaauucuuccaucugaaaucccauaacuuuaauuacaucuucaaaaucucuucugccauugggagcaacaggaucuggggauugaguugcaaacagcuuugaguggggacccaagaaagggcacauuucaaaagguaaugguuuugaggcuguuguggcaagucuucugcauauccauauguauggaaagaaagaugggugcuauguauugacuuaauagaaacuuggacccagggcucagcccacaaaaacaccuuauucccagauuccaguaugacauacacauucucacuuugagacugggcaaugcuguuuauucucccuucaaaauccaguuaggagggaagguugaggaaaugguuacaugaugaugguuauuauuagcauagggacugguagaagauaaauagucuacuaaaaauucuuagcuaugugccaugagcaacuuguuuuuguaaguuugaucuucucugauauuuccaagcgugaucuuacuguuucauagauuuaaaugagagaaugcauauaaggcacguguaagauaaucgcuuucggaucagaauggcuggugugcuaggugcugcagcaucuguaaauccaagaguagaguucccuauuccuacauggagaucuagacuucucuauuucuacaugaaacucccuuccagagaagaaucagaaggcccuuucugcuugagacagggucuuacucagauucuugguggugccacugacccugguugcuuuggcauuucgugaaugcuuaucaccuuaugaaaaaaaaaacuuacuucucuuucaucuuaugaagguaugcuauugugaauucuuaaccuuugggugucaccucugccuccagcuuguccuucuaccccaggccugcuacagucacaacaggccuaagguuccugacucagaauagagauauuuuagcagaugcucuaauagaaucagagaucccaaguuuuaaguuccaaaaggacauuuguaaaauagaacugcauuaaaaaaaaguuauaagaauuuaggccuuuugaauucaaagaaauaaggaccuauagagaggcauagagauauauguggccugcaaaggguuuggagccaucccagacaagaugaacauccuacacagaagagagagcuuaucgggagccgggauacugaugacagcauucaaggcuaagggauucaaucagcauuucagacuacauugaaacauuaaagggaaucucuucccuccuucccuccacuccuccaucccugccucccugccucccugccucccugccucccugccucccugccucccugucucccugccucccugccucccugucucccugccucccugccucccucucucccuccuuuucuuuucuuucuccauaauggauuuggguuccuuuucaucuccaaauaccauaauaguguauccugggugggggggucuccgauuuccacucaguuaucuuuucaucugaacauagagauugagaaaguaaagguaaucuguggugcucaugaaaggccaacauggaugugauggaguggaaaccauuggaaaccagaggcacacaccauguuuguaaggagcaacaauuugucuaagaguccucagcaaaaucgacuugaauccacacuccacugccuugaugguggcuugcaaaugaagauuccccuuuucccacugcuagaauagucacgaguucuccuguaagaaaggcacaauaucuagaucacaaaucagcagaauguuucaacacaccuacaaucagaacaauguguucuagggucagcuguccuccacgagagaugucagguucuuccaauuuuuuugguggaagagagccugguuaagacuaaaaagugaggcaugagaaucaggacagguuaaaacaacuaacucagugacauguagucucuucuagcaccaguaauacuuugcgacuccuaauguaacagcacucuguauuucggggacguuacccaugcacacuagagaaaaaauaaaauaaaaaugaccuaggagugcugucuaacaugguuaaaagcccaccugagcugcauaggugcacaccagggcaaaaagugucucucugaaugacaagccccugggacuguacuaaaugguguuuguggguaccguuuuuaagggagaggagguggcguaugauaugauuaucagaccguucugauacauaaaggguuuuagcaggagggaaucaugaugugcguuuuauuagcugugugcccuaugaagacacguuugcaaucuccacaccauacuauucuugccuauggaguggaaaaaaaaauacccagagaacagcauuauuggguagaaagaauuugaaagugcuuucugcagaaauugauuuuuaaauaagacaucuucauguguuacuugucuuccuccuacaaaugaauagcucuauuaaauaaagaguaauuaggugagauuuaagguaguugguacuucacccucccuucaagaauauguguacauuacaguuucuauaacauaauauggagcugaauucuggauuuguguuaaggaauaauuuucauagauaauuuggcuuugugugcugggaaauaaugguggcaguggugacgaggacaacuccgugugcuugcggagccaguagcccgcucguuuaucucaucuguuguugauaaagcccuccucucacucuuguaaaugaaaugaagcuauugcugggccugcaguguuugguugccaugguuugaauucguuucauaagcuguugcuuggcaaucccacgcgucagcuggcuuuuuuuccucagcacucucgccacacgcugucugaaguauaaugagccugaggcugggcaagggaggacagcaguccccaagcacuuucugucuucccacacaguccugcugauuaccccgaugccugauaaaugcauugguaacagagcagugaagugauuaaaaaugcgggauuuaggcuucagauucugcucugcccuaauguuuccuuuagccuucuacuuagagccuugugucaccagguccuagagugguuacaaaacaugaaagagaaaauccauuugaagcaccugggcacaguagguuuucaguagcuuugaccuguccugagaaggacaauggaaagugggguuggacuuccuuuguucuguuguaaaaucaucugauguuuggauuuaauuuguacaguuguaacccacuuuccacuuuccaucauaugagugggccuacuguaaaucuguagagcaaaauaaaaauuuagaaaugagaggcacaagugggugggagauaggguuauuaggauuagaagaccauaacuauggaugauguaaauggaaaagaucaauaggcauagcagguguccucucucugucucucucugucucucucucucuuccuuuuugguuuuucaagacaggguuucuguggugcuggaaaccaaguccuggaaaucacuuuguagaccaggcugacuucaaauucacaaagaucagcuugccuaggcugggauuaaagauggcgccaugccugauucuuuuuuuauuuuuuucuaguaguaguaggcguccacucuuagaaagaaagucguaauuuauauuaguugcccauuuuuaugguguacuuauuccuacaaaggcccaggccaagcuaccaauggccuucuucaguggaauguggaguugaaaagaguugcuuauuuuaguuagguagccucuuaucuaauagcccuuuggaaccccaccuuaucacuaaacuaauccaguuucuagagggagcuuuacuggguuucuucuccuuuguggacauuucccgaaaucuccuguuuuuauggcaguuugaggagagccggaucuuaggaaugcgcuuuuggccgucaacaggaaagaauguagccaagggaaugucuguugugcaagcccaggauguuccuuuacauaugggcucaugugcucuuuucuugccuaacauacacaugagcugagggugguccucagcacugcauuaguuaauccacccauuaaguaaguaaguaagacauucaaugugucccacgcuccccgcuccaggguugucuuagcuauugcaagcuuugguguagccuucugauucugaaagcuggaguaaacuacaucuccacgcauggggugaccaguuucaagugucaggcagugaaggucacuugcaaggagagaggcaucuugccugaccggcucucagcaaaaaacuaugucauauguaguuuacauuucacucgauccguaguguguaucaccucccggguuuuuaccugacaaugacuucuacagauagacuccccaaaugcagugguccccuacaaacaaucugauagaauucugauguuuaugucgagaaaucagaucaaacacaauguagcuuugugagaggacuaagcccacuuaacagagcauuuuguuuuuguuuuuguuuuuguuuugagacaggguuucucuguauagcccuggcuguccuggaacucacuuuguagaccaggcuggccucgaacucagaaauccgccugccucugccucccauuaacagagcauuuuuaagaaauguuucuucuuuguuuuguuggugggaggauuacuguaaaguuaucaacuucaauaaaauuaauuaaugaucccguucugaagaggguauccaguagugggucgagcauacauguagacaagaaggaggaaaagaaguuggaaugucccagcaagagcaaguagagggguuugggggaacugggcaacuccguacuggcggagcagaagccaggcuguuggagaaaugauguggacagugaagaagaggggagaugggaaaggaauccuugggagaagaaauaacgucugaggaauuuuuagguagauucugcuggggcaguuccucuaggacauuuuccccuaggaaaucuuuuugcugcccuagaauguccauauaucuggugggaaaggauugucugucuauaagugacuuucaaugagaucaagauuuaaaucuggagaaaaucagaggcugcaggucaaaagagagacucucguguaaaugagagagcauuguuuguaugaaaagaucuaguguucaguccaguaugguggugcacaccuuuaaucccaguacucaggaagcagaggcagcagguccuuugaguuugaggccacccugguuuacauuuagggccaauauccagacaauagaagaauacguuucuaauuuauuuugaagagauauugcuucaugauaagaucugaaauuuuauuucuagcuaugauuuauuuggaagucauuuauuugaaaaagaaggguagcguaucugagauggcucagucucuaagauucacuugccauuguauggugcgagaugguugcuaggagcaggugcuuagcaacagauuaugguugucgaugcuuaccacacugcuuucaugcaggugacuacuggagcaccagaauuacuacaugacucccccacccccagacaaugguugugccauuuuaauagucuguuuuucuuucugcuuuauaaaugggggaaauacugagguggucuagagaaaguggggcauccacuggcaggcaagacuauuaaaugugguuuuacuggggaagaauuaaacaucuauuguuguaccccaaugaaguucuaucauuuuuuuccugacuuuuuuuuuguuuuuuugagacaggguuucucuguauaguccuguaacuugcucugugaaccaggcuagccucgaacucagaaaucugccugccucugcuuccugagugcugggauuaaaggcaugugucaccacugccaggaguuuucauuuguucauuuguuuguuuuugaguugugucaugauuuaucugcuaugggagauagugcauuuguuguuaccuuaacuaguauagagaaguaucagagacaucccuaagcaaucauuaauuucuuaauucaugcccuuggauuuugcuucuccaaacuuuccaacucugaaacccauuucaggaaagcaugcagagagucuacuggggggaagaaggggaccaaaaggagggggcaggcaagcaggagaggaggaccaauaaaaucaaguguaugugaaaacaaacacaauacgaucuacugcuuugugcacugguuuucaaaacccaguaacagaaaguaaaagguuguagaaacaauuccuggguggauggcggaggacuacuuuaccaaguuugguuaagguguaauccuauacuaggcuccaaggggggguuguuuaggaauuuggggguucgaaaauauuugguacaaauacauggcugauaagaggcuagaaacuacaacccaaagguagcaaagcagcuggggugaguugauguagagacgaggaagggcugaauaggcgcacauucagggaacugcugucucugcaguugugccucaucuguauggucuaccauucuuugcauacuucucuuugggcugcccaagauccucacacucugauaguucuuuagcuaacacccacaaguguugcaaacaaaggcauuuuacccaggagugugcauuucacauucucugagugaugggucacaguccauggacuagggguggggugagaauguaaagcaagucagaagcacgggcuagaaauugcucacucugaagaggacucgcagucugacucuucuccagugcggugcaguuucagaugacccaaggagcugaaggaucucuuuaacacucucaggccagguacuuuugugguauggugaaguuuuugguuucuucaaaacuacaaaaauguuaugugaauauguuuuuguuucgaucucaggugugggaggauagggacugcuucagacuguucacagcagcuaacuuugauuugucugguguucuggcaggggugugauuuugccagcugaaggcaguuuacauucggaguuccgcggacucuucagaggcuguaaaaaugccggagucacgaaagccugcaaagagcuguugcuugccuugcugcugcugcugcuacugccgucccugcccgugcugcagcugcuacuccugcugcugcugcugcugcuuguugcugauuguugcgguugcugguugcuguuuacuguuugcugccggcuggauugcuggauugcugauugccagucggcgaaauccuggcgaugaagauccaacuugccccaagaaacaagacgacccuaagaaguagucuaaugauuucaauacgcccuuucccccucugaccuuucucucuuaccuuaugcugggggauuggaaggguggcagaaaaaagaacccaauaaaguagccaaaaguaaaguuacuuuguggcuuauuauucuuguucuuucagugucuuucuaaaaauaaucuauacauuuuauuuguucccuucacucuuuccuucuuuuagaccuaauacuuggguguuaagcaaagaauagugaggguuuuuuuuucuagauuguuuuuauucugauaugaaagaugcuauguauaauuaaaagcaaacuuuauugagaguagggacucaaauuacccagagaaaggaguuucuccauuagcacagaauaaacuucuuucaucuaugguuugugggucaugca

SEQ ID NO: 9356 - RNA, 48220 nt, Mus musculus
gggacuacaagugaaagaacuacaacuuccaggagccauuacguaauucacaccccgccuccagcgccgcugccugcgcaacgcucacuccuuagaacuacauuucccaauguuccucgcgcggcacgugacucucuguccucgccgcgccgagagcagcgcggagagcuccaauuucucugaucugguccuagacccagccccggaguuagaauuaacuccaccauggaggaggcugaccgaauccucauccauuccuugcgccaggcgggcacguaaguacgcaacccccagucgccuccaauugcucacauccgggacuccaaauccuaggacccccauuacccgggaaccuuaaaaugaagaccuugacacccaaaggcccaaacuuacaggauuccgaagccucuccuccuccucccugcuuacacucuaacaucaugacuuuccuaaauacuuugauguggacauuggguaaaaccucgaggacucagacaccuuacaaacugagaccugcauaugcugggauccugauaucuagagguuccaggacacccacaccaggaaacugauaacacaggagucuggcacccagagucuccagaauuccugagacuggcaacuugaucuucgaacaauaacuccugaaacucccaggacuuaucaaaauaccagggcccuacauucugacaguagcagcacuugguaacacaggaacacaaaggaugcacuauuugagggaccuaaaaguccuugaugccaaaauuuaggaugcccgauuuuuuauuucuauuuauugacccugacauuugagacuucugaaaacuccagccucuuccuauguagcuuucccaaaccucguagaucuaggaggccuugccaugcaaagaacaauguccuggugcccagaaauauggagacugugccacuuggaccauuuucacuuuugcagaucccagagguuggaaacuuugaaguguaggggaguuugagacuuuucugaauucaggucacccucauucaccgaggucuuaggacuaaguaaaggucauagucaccagcacccaggaucuguugaagccuugguuguucccugccccgaccuggauucuagagcauucccucucuagaagucuguacuuuguuuccuaacuacucaagccuggugcuuuccuuuuuagggcaguuccuccagaagugcagacucugcgagcuuucaccacugagcuggucguagaggcugugguccgaugccuucgagugauuaauccugaugugggcucuggccucagucacuugcuaccaccagccaugucugcccgcuuccgccuggccaugagucuggcccaggccugcauggugagugcccuccucccagugugcacacugucuuccuuccuuuuucacaaagucgccaaguucuuugacacuugccuucuucucugucccuuuguauagcuaaagcugcugccucuguagccaaacugugugacuaguucagacccuaccuaguucaguucacgcuuucugugugacccuaacuguucuaugccuucuccuuauuugugaaauggagaugauauaaugagcuuguguggauuaaaugagcugauucgguuugugcucaggcuaauguuaacagccaccuucuaagcuugacaucaaaaucucacuccacugucacauaguaggccauuuaccuauuuauuagggcugaaggaagaccuugacuggguuacauucuccuaaauaaagcucugacuagcucugcccagaccucaugggcauccuaucggaccugcgauuacuuguuucaucaaugggacuggggaagaggaaggucauugucuguuccauuguauugugcuucucauaguuccaaaaaugaugcucucaugaagcacccaccccucuucacuucagagcugugcccauuuacuguggucaagagcagagaggucuaccuuuucuuguagcucacugucuuugcagcuuugaaccugccuuuuaaccuuuuugguccucaguuucucuguguuggcugugugugaaagccaaagugaaccaguguguagcucaguuucagaguuuguacuucauauguaugaggucuuggguucaagucuccagcaugcacaaagcaaaaacugaguugcuauaggaauaguugaucacauacuuuggcagccuguaucccagcagccuguggcuauggagugauuguugauuuuuccagaauacucaauaaauugcuguaagucuaugguagaucuguagaguauccauccaguauacuaaaggggacaggucaucacaguuguucgccuuggaccacuguuuaugcaguuuuggucugagcaguaacccuguuggcucugccuauccugcucauuacucucagguuugccuagcuaucaagagcucucacuuucuucugucuaggacucuagacauggucuagaccauggucccaugaaacugucaguccaccccugaucugggaccauguucuggaagauggccuucaaagacgaaagaaauuaugucuucuacugggccugaaaggaacucggugggaagcaccaagguggugggcugaggcuuucucugauguuccccuucucagugcugucugccuuuugaucuuguggcuccuguugauuucauuguggaguagagaaccuggugguuaagggauauauauaucuauauaucucuauauauguauauacauauauguauauauacauacauacauacauauagauacauacacacauacauacauauauacacauacacacaaauauauauauauguauguauauauauauauauauauauauauauauguauauauauguauguauauauauauaucauauguaauuguccagcucaguagccaugguuugccagaacaaccagaaagugucuccaauucagcacuguguguucuggugucuuccucuguauauaccuugcuucuggugucuauuucuguaccuaagccaccucucucuuuuuggcaucucuuacuauauauaggugucuuaguaugugcucuguugcugugaagagacacuaugaccaugacaacucuuauaagagaaagcaauugauugaggcuuacuuacaguuuuagaggucuagaccauuaucaucguggcaaggagcauggcaguacacaggcagaugugguagcugagacuucuacauguggaucccaaggcggcaggaagaaagacucuagucuugguuggcaugggcuucuaaaaccucaaagcccacccccagugacacauuuucucuaacaacaccacaccuucuaacccuuucaaauaguacccacucccaggagaccaagcauacaaaucuaugaaccuaugaggcgauucuuauucaaaccaccacaacagcacacuccuggaaugaguuuucguaucagucacaagucuuugauugcagauaucaaauaaaaaauuccuaaauaacguagcauagaagcagguuguuuuuauacguguguggccaugauccucggauauaacuuucuuuugacagaaugcaugaauacucaucggaaugacuucuuuugagucaauauuuuguaccaggcacugugguaacaugcuuauaacucaaucuuugugacaacugucugagaugaguacuuuuagugucauuuugaaagauacugaaagcauuuuacuuauuuggauuuauuuuuuuuuaaauuuucugcauaugagugcuuuugccugaguguauauauaugugccauuugugugccugguaaugguggaugucagaagaggccaucacacccaugaaacugaaguuacagaugguugugagccaccaugugguugcugggaacagaacccagguccuuuggaagaacagcuagugcuccuaaccacagagccaugucucuagccacugguauacuuuucuuuucacaugacagaacugaaguacagagaaguauuggccuugggucacacagucgguaacaugcagagcuugaguuugaguccaggaaguuugcuuucagggucuguaugucuuugaaccuaucuugaacucuugagaguccguccuuucuggcuguguguuugcugauauauauauauuuugucuguuguuguuguuguuguugaugaugguggugguggugacgaugaugacgauuguguuagugcuagggauggaacccagggucuucucauguuaagcaagcccucugagccacaucccuuguucuguuuauuuuuaggcacugcuuauauaauagauugggcuauggcuucccucucaaaggcucuggauauugcuuuccuaagcgucagugcucucuugacuuuucacagggcagagauccuguguccucuuguggccuuuggauuuugcgucauauuucgguagcaaugcuaugcuuuuuuugguuuuguuguuguuucugcuuuuugagacaggguuuuuauguauagcccuggcugucuucugagcuuuaacgucugguuuuuuguuuguuuuuugaucuuguaauacugucuaggguggcuuuguagcugucacuggggccuggauaccuuggggaugcaggggaaaagugggagggugauggcuagugaaggcgacagagccgguaugguagucacagggcuuccagagcaggaggcaccucccugcuuggcagaugggggucuguuuuuuuuuuuauccucagcaucauuaugugcuuauacuugcuaacccccaggaccugggcuaucccuuggagcuuggcuaucagaacuuccucuaucccagugagccugaccuucgagaucugcuucuuuucuuggcugagcgacuacccagcgaugccucugaggacgcagaccagccugcagguaugggguccuauaggacuggggaaauggacuguguucccagggugauaggggccugagagaagugucaggaaggguagggggcagggcauaucuucuggagaauuggguggaucagaggucagagaacagauggacccaagacaagcagcgugaggacuggguucccagcuuacccugucccucgcacacucacuaacuccagucuucucacauggguguucuuaguggucuccaaauguaccaggugagagcuagccucaggauauuuuggucccugaauuauucuucccucaguucucuucauagucagcucccuaccaggugaguccaaagcauggggcacaugcugcuaaagauggcuauaaacgccacccacccuggaacuguaaacguguuuaaaauguuaggagauuuuuuuuuuuuggugugacuugguugcacuguucuugagcaugaacuucguagaugacaacaucaugcccaagugucaaaagguuaaaucuauccucaguguucuguggcuucugcucuguuaugucaaggaggucuuucucuggcuguucguugagacguuccggcuccccuuuaccauccuucucuuuccugcuuagaauagauggugcuagugguccuauucuugaaguuccuuuucuguucucuugcugacucaugaagauggagaccucauuuugguuuuccugagguggucuuuaaccggguaacugguacuccuauguaguuaacgcucagugagugcugaguggcugagaaugguaguugaauccaucugcaucuggaggugagggaucagguguuauggcuggcuucccagauugguagcauguuacuccuucccuacccaccccccucgcccccucauaggugacucggcuauuuuccuucgggccauugggagccaaauccgggaccagcuggcccugcccugggucccaccucuccuucgaacucccaaggugcagcgccuccaggugggaauccccaccuccguuuggacuuguccccuccuugccuucuuugucugucaucuguuugaucagguuguugucccuuucauuaguaccucauucuggaggcacugacuuugcuuuccccacagggcucagcccuccagcagccguuccacuccagcagguugguucuaccugaguugaauuccagcggaggugaggaugcagcugugugaaucuaagcgaggaggggagagccuugugugaacacugguaugcgaggacaaauggcugacacugucucugccuucagagcuaugggaguuccaggccaguccccugcugcuaccagcccccacacaggugccccagcuucaggggagggcagccucacuccuugaacaccaugccagccagcucugccagcaugugaacagggauugcccaggagaugaagaccgggugcgcugggcaucccgcgucccaucccagguaccgccugaguucagcucucccugagaggcuccuguuucuggcggcuccuguuuguucucugcaucucguuuccccccauucuggcccucucuucauugcuucucuguguauaccugccuggcucccugccugaaagaguggauaagaagugcagaaccuacaccaagcccuuccugccugcucuucuuuucugaaaaauggggguguagaguagugaccuugcaugaguuuuaccugggacuguugggggcauucccuguggggacagggccugagccuuucaguuugucugacugugcauuugucagugauucuccuuugucuggcucuaggugacugcaccaucuccuccugucacugucuugugcuguaguucucugaugcacucuaucaaccuuucugucucccuguuuguagccuucaucuuucucugucucacuuuugccuauuucuuccuuuucuuucuccgccucaguccauuccaugucuuucucuguccucgcuuccucccuaucuacuucucugcuggucucuucuuucuaccuucuuccuguccacuuccaguuuugccuuucuaucugucccugccgcccugauugccauuugcuuauucuuucucccucccugcccagucugcuuuuuuggggggugggggugggagugggggugggggaugagauuugagacagcgucucacuagauaacccaagcuggcaucaaaauguauaaugcccuugcuucugccuccugagcgccgagacuaaaagcaugugccaccacacccagcucccgucucuucuuuacacuuacaggaaguuugauguguaaauauagaggaaucgcucuaaugauacuugucuucuagcccuucuuuuauucuccuuuagcuuccccacugugguuuuagagaaaaucucagagcuuggacuacaguuucaugguagaaccugguuucguguucaggaucaaauccuagcgaacccaaacugucacauaauuucagcucugaguacucagaugugucauuacucacaggaacauuuuuguuaauggaaccacuguacuguuuuuauacugaaugaaaugaaugauuucuuagcaccauuuaauacugacacagucucuauuguuaacucuaauuucuuuaucuuccuguccccaacucuagauuuuuuuuggccugguacuuuuuuuuuccugugucuaugcuguccauaucuuucugucucuuucuaauuugaaagcuccaggcucaguuuccucucuagucacuuucuuccccagggucaggggugacuggguagagaagugcagcuguggagagagggcacuccuaggccagggcugggaccuacaguggugggaaguuccagcccuagggaccagcagguaugccuuccucuugcccucuguccuuuccaggaggauucccgggcuccacagcagagacugcacaagcagcugauugaacaucugcgucaaagcuggggcccacuuggagccccgacacaaguccgagaccuaggagagaugcugcagaccuggggugcuagggcuaugacuggugugcccaaaggcucccgcuucacccauucagagaaguuuaccuuccaucugguggguaggcuagaguggacagggcguguccggauugcuuucuuuauaaauaccacuguuacugacagaggaucuggugcccacugaguagguccucuccaacuaggacagggugucuagauggcuccccuagcuucuugagacuuuaguggaggaaaggcagauaggugggacuuguguaagagugugaagugcuccuaguacaaaguccaucuuuccuugggcuuuccuuuggaaauuuuuucccuuuggaaacaucuuuucuccuuagacacucaucuuucuuguggacauuuugggcaaggucguuauggagucagaguaguuauagggucaggguggacauaggguccggguggucaggugauuauagggucauggcgguuguaaggucaggguggucaggguggguauagaaucaugaagagguuguagggucaggguggauauaggguccagauggucaggugguuauagugucaugguaguuguagagucaggauggucaggguggguauagaaucaugagguuauagggucgggguugucagggagguuuccuuguggucaggcacucuaaucagcaguuacagauggcacuuuauucucuuguaguaacaaucugaaaacugucagugguugaguggacauggguacagugcuugagggugcuuuggggguuugaggcuggccugggagggauagaacuuugugugauagucagguugcuuuuucuacccauaggagccccagguccaggcagcucagguggcagauguaccagcuaccucucaaaggcuugaacagguaaggagaccaagacagacagacagacagacagacagacacacacauagagucagcugggcuauugccugucuucuggacuugguagcuccaccuagacuggcguguguuucucaggacacacgggcagcucaagagcaggaguuagagucccuucgugagcagcuggcgagugugaaccacaacauugaagagguugaagcugacaugaagacccugggaaucaaccuugugcaggugaggggcuuagagagggacuugggcuggaccaggucagaacuggggccuugagagaugaucugacaucuagagaucuauagaugccauaaucguuuauggagcauccuagagaccuuugguauuguugaaggcuaaggagaacuuaugcaaagaaacauguaggguugauggcuugcuagacuauaggucuauauagacuauauaggccuauaggucuggcaucagucaggcuuuguaggggaacauaggagcuaugggcaucaggggaucaaggaggauguguaggggcagggccuuacagggcuucucagagccucuggcugucaguacagagcugaagaugccaaagccuguaguagguaggggccuuggaguucucugaggucuugagcugggccagggccauaaugggcucacugggaucgugggcuguguguaugacugggagcuuggcugugaguguaccagguggaaaccgagugccgacaaagugaacucaguguggccgagcaggagcaggcccugcgccugaagagcaggacgguggaauugcugccugauggggcugccaaccucgccaaacugcaggugggcugggguuugggguugggcugagagggguggguagauggauccagcccaucuugacauauccuugacuccugccagcuugugguggagagcagcgcucagaggcucauccaucuagcaagccagugggagaaacaccgggucccacuucuugcugaguaccgccaccucagaagacuccaggacuguagggagguaaguggcacagugggcugaguguagauggacugcccugauagauagggagggggcugagggagggggcuguuucugagcucugcucacugccuucugccuauggguuccugcuagcuggaaucgucucgacggcuggcagaaauccaggagcugcaccacaguguucgagcagcugcagaggaggcucgccggaaggaggaggucuauaagcagcugguaaggccuacuuuagggcccuggguuguaagggugguugugguauagggcuugggcucacgccugccauguucccaccuaggugucagagcuggagacucugccaaaagaugugucccggcuggccuauacucagcgcauccuggagauugugggcaacauccggaagcagaaggaagagaucacuaagguaugaugucacuguggcucugauugauggcucauguaggcagacaagcauaggggugaucacacagggacuuuaugcucacuacuaggcagagcuguucaggcacacuccaacacauaauagucaccccaacacagcgacaugggcccugacuggauguaaguauaggcacgugaguguuaucacugaucagcuaccuugcccaagaugugcacugauaguuacccugguuucuaccagaucuugucggacacaaaggaacugcagaaggaaaucaacucucucucugggaagcucgaccggacauuugcagugacugaugagcuuguguucaagguauggagcaggcuggccuccgggaggguggaggcgggacugaguuguugccugccccucugugaguccuuuaggugcacuguugcuuggggccuagcuuugcucuguggaggaugaaggcaaaguacuaguaaaggguggucuuauaggggcauagaguaguggaaaagggggaauggcuugcugauaucucggagauccccuuugucuuaucaggaugcuaagaaggaugaugcuguucggaaagccuacaaguaccuagcugcccugcaugaggugaggggagccaugugccugguggguuggcuggagagggccagcauaggugcaagccuuguauucuugcugucuccagaauugcagucagcucauccagaccauugaggacacaggcacuaucaugagggaaguucgagaucuugaggagcaggugagaccugggacugguaaggggaauggagacaggccaggggauaguuccuuguuuugcgcugagagucuuugaaaccagacaacuaacagcuagaggcuuugccuucgugcccacugugccugggaccugaagcuagccaguagccuacucugagcccuggcuuuuagcuugcggcuccuaaugccucccagagcccauggcagaaguugcugcuuuagguggaguggagggaaggacauacccagaagcccagugaugggaaggaacaggcugcuguuacgggaauaggaggagcagggaggaguucaguagaggggcagccugcaggggcugaagaagugugcauccuguuuucuuagauugagacagagaugggcaagaagacuuugagcaaccuggagaagaucugugaggacuaccgagcccuucgccaggagaaugcuggccucuugggccggguccgagaggccuagagcccugauggaugucuccuaaccacaggcaggaauuuggggugcuggagacagugcugaggcaccuguucuagcacucucuuucauuugguauccgcuuucuccugcugggaucuuaaacccagcugucugcuuauauguucccauaucugaucagggugauuguccagcugaccacaguuuauuggaugggcacugggggccaggggccuuggaucccaaauaaaagagaaguucuucugugggccacgcuuaggcauggauuggggcuuguggguagggaacuggggucaguggcaagugagacgugggguacaucuuggagagucgguguguauucauggaacucaggagauagaguggaggggcugcauguguguacgugcacacgagcguguucugacaagcugugucugacuuguauuuugggcauugcuugaggcugcguaugaucaguuaugccugugugguuuggggggauguaauugugaagguuccagugcuguugcuguguaagggucuguauauacaccuaugugugauagugcccgugguuccagauguugugggugagugcuuuggggugugagucaguaggacugcagucaugugugacugcaugacuaacuuugaaaguucacgaauguaccaaggcaggcucuucauguuuuaggguuuggguugaguaaauauuaggauggugucugucaucuuucugcuuggcaguggccaaggcagauauguauagcugguugugagggcucuuugacuggaaaguucaucuuggggcuagguuggaacuaggggcuaggcugggauuggcaccccucucagcuguaaggcagaugauaugaucuaggagggcagcuagauagggagcagaggcccugauagcaggcacaucaucgcccgguuuccauagguacacguaggacuugccuccuugcccccacagccucagucucaugguuuuggcccccucccccgcccaccuuuucuugguuuugaggucaagggcagggauuggagcacuuguuggggcguuggcuccucuucuugcgaaacucaaauucaucuacgguccacacugcucccuucucgcucuccacucgcacaaagcacuugugcaggcucagguuguggcggauggcauucuguggaagggggaccgggaccccagucagggacaggguugacagucauccugagucugagacugaccugcuccuuccccacaugucuagccccaggcuaaccauccuuggagccaucccagcugccaguguguacagaggaacucaccuuccagguggcggggugguuucugaaguaggcgaacaugcgaguaaaccaaugguagauuucauugaguguccucugccucuccggggcuuccaggauggccuggaaguuggagucagguggaauaaggggcauguuccucaggguuguggcugagggagcagccuacucucggcccucugagcuaugauagcuuuguaauugugggucaaggggaaggagaaagaauagggugaggcaugaggucaagggugauguuagagauaggguggacaaaggaaaggguaguuuguaguguuacaguuugcuuugcacugaccuggcuugcaguaguuuuggguugagggcuagaucugaggugaagcuaucaagaaggaucacaucuuggggcuccucagagcugagguuuguuaaugggugaauucugcucuuggugcaauguaggaggcaagcacuccccaccacaacucccccccugccgcccaccagcugcugggccucuauugcccugcuuacccaucggauaaggguggcauaggugaaagggggucgcauauugugguacuugaaguaguccauguuguggaagaacucugcagaagguuggcauagaucagagccuuuggccuccucacccccuaccccaccuuugucugcaucaggaauccaaggucucaauuccuaccacuagcaccaaggggggagggacagucuaugcucacacauaguacuguuuacugaguacccgccguaagcugugucuucuuugcaguacuccugccaaauagcucuccucacuuuaaaaaggagucaaguaauuuguacaucaaaggcauguaagcagcucaaguggcauagccagccugacaccaaauaucuauggucccugguaaacucacaacccaggccugacaggugggagaggguugguuagcuugguugagugcaccugacuuccuggagguggggacggaagagagggcucuuuggacucacuuggccaggcuccucccucauggugacugaaugaaguagcagaugccaaauaggucaggccuggcuccaaucccccaaaacacggggcccaaggcuaugcauuuauaacaguugagggcuucuaagccuaauaaacucaggugcaguuuccucccagcucuuagugggggugaggggggugggggagcuccuuuguacccccuggcacugggguguggacuccacugaccugggaaggaacuauugccauggcuuccccagaggugccuccgcacugcaaacaggccgccgucuggagccucccgaggagcagaccaggccgggagcacacugcccugaguacugguggcuacgaugcagcaagagcucuuguccauugaggccugagggguugggaggggugugguaaucgagacacuuaagcuugucauuucauuguagccuuucaaacauuaguuuguauuuucuuauuaguuaaacuuguuuuuagacaauuuuguacauguauguaauacauacagaccacuuucacccuaucuccucccucaucgcuuaucuuccuucuucucauuccuuucccccuucauccaugucuauuuauuuuggucuuaaaauuauuauugccauuauuauuauuauugacagggucuuacuauguagcccugacuggccugcagcucucagagaugcacuuccucugccuccugaguguuugccuauucauuuucguuuugucugagacagucucacuauauaucucuaguuggccuugcaccuucuagccuaguucuaccucuggagugcuaggauuauaagugugugccaccacaucuggcuuccacuuuuuauuuuauguauauauauauauauauauauauauauuuuuuuuuucuuccagacaggguuucucuguguagucuuggcuguccuggagcucaguguauagaccaggcucuguagaccagacuggcuucgaacucacagagaucugccugcaucugccucccgaguucuaggauuaaaggcgugcgugcgccaccacacugagucuuccauuuuacuuuaaaaaaugauugcuugcuugguuggauauuuauguaggugggcucuugcucuguaguacaggcuagucuaacauguacuauguagcauguaguacaggcuagucuaacauguacuauguagcauguaguacaggcuagucuaacauguacuauguagcacaggaugggcugagauuacugccaagucagcuugcauuuuauuuuagguauacgggaguuuugccugcaugcaugucugggcaucgcaugugugccugguaccuguggaaggcagaaaagugcauuggauccacuggaacuggaguuagagauagcugugagcggcucugagggugcugggaaccaaacucugguccccugaaagagcagcaagcucucuuaaucccugagcuaucuguccaguuccccaaccccacuuuauuuuacaauuugcauuuccugauuuggucauauuucuaucugauuuguaugugugguguguguacacaugcugggauuacagauuuacagugcugcaucuggugugggugcuggcaucuaaacucagguccuuuuucugucagagguguucaagacaggguuucuccguguagcucuggcuguucuggaacuagcuuuauagaccaggcuggcuuccaacucacagagauccaccugccucugccucccaagugcugggaucaaaggcaugcgccgccgccaccaccacccagcaaaacucagguccuuauccuuguauggcaaucacuuuucccucucaaguuucuccccaaccguguuucuuuguguuuuagaagagucagggugucucuguguugaccaggcugguuuugaacuugaggguucaagugcuccuccuucagccucuccaguagccaggacuacaggugcaugccacuguguccaguaaggucaaugcuuuugagaagggcaccacccuauagucaauugcaggcucugguggagcucuguaaagcagcaucuuagaguacaggcaugagcaugcgaugaagccauagaugcuagggcuggggugagcaggggcagaauuggaauccccuagcaccaacugugaaccugggagcaucaacuaaaucuuccugaccuaaguuguccucauuugugcauuaggaugauggugguagcuaccucuguuauaguauaagacucauaucagccugagacuggguaugugaaauguguggucacacacuguucgauguucugagcuuaucuugaaauuugaacauaaggcccuccauuuuccuuuuuugcaguggcccugugaguucacugccuucuguaugugcccugaaaaggcagaaucauaauguuuuggaggucagaagguuuguaagcagaguaggcgugucuuuggaucuggcauauuaauuaggugggaauggucuguacagggcagggcuugcaugugagaagaagacauuugguccuuaugggcuccugucuugccccucagcaguugaagucugcugccucuggacuugggguacucaccacagauggagccuuggccagcgccaucuucccagccaggugggccugcauagcucccagcuucuccuuuuccagcuccagcuguggggauguacaccaaaguggggcuuccaccuggucguucucaggcacacuuuugcccaugccuucccucacaggguccucccucccauccuucuuucccgcagccacaccccgcagccacacccugcaggcauuaccugcugcuccagagacugcaccacuucucucuggaggaggcacugggccuugccuuucucauccaggagaugaucugcuuggcagugccugaguaaggagaagauuccauguagcugaccauggugggucaggccucuuggcuuaguguaucaguuagggacggccuagacccuuugggagauuucucuaugcucagugcucccccccccacccccuugcuugccuuaaacacaugugcuucagcaacucugggcugccaggccugagcuuauuuacccuuugagucuggccaaaaugcugggaugacguuagacaggagguaugcagggguauggcauuucaggugucaggcacagcccaugcaaaggccuggccacgcaaacacgcaccauugccaaaaguuaggggugacuagcaagauacagaaggggagggacagcagauagagagcagagaggcaagagcucuauagucaucuagaggaacagaaauuggaggaucaggaauguguuuugugugaggggaagcgggacaaagcaguuaggcgugugggcucuggaaccuggcugccuguguucauauucaagauucaucacuuagguccugugugagcuugauugacccuuaauucucuguggccuuagauccuucugcguguaacaggaagguaacuaugagcacauaccuuuauuauuaugucucuucauacaugcgagguaaacugggccuagagacccauaacuugcccaagaucacagagccagggagggauggagucugaaucuuuaugauucuuauuaucauccauugagaggauggugaguugagacgugaagccuagacagcagaacucuguggguagggucaggcuacucacuugagaaacucuucuggcuccucgaagaccuucucacaaccaggccacuugcagacuccauuugccagcaguggguaggauccuuggggugcagccaaaagguugcuggggaugggagaauaugggaugucagcagaggaauaggugcagggguggggugaggugugggcaggggccguuucuugccagcccugccaacucaccugucuuuccuggguguacccgagcgugggaaggugcagaguagagcuggcucccuggacacccauuccagacuggccacauugaucccuguggguagagacaggguacuucuggagcugcagguuagacucuacagcuuguuccagaaggccccuccccuuccugagccuugaagacucugucucauaguacucugcuguucccacagucaagggcuucugacauaacagccuaaagaugcccauugguaagugauggcauuuugacugauaauagcgauuugugguuuuuuuugcauucuaugucuucaagguucuaagucugauauuuuuuuuuuuggagguuggaguuuccgugacucuuaagacccuucuauaccuccauagggcuauaauucagaaaaguuuacauugcacaugcucaaagauuagagaacuuggagauacugugaagguguuaccagguggcaggccaggccgggccuugagggagaagaccccaguggcagcagaagguggugggaggcugaucauggcuggguuguccaguggacgcacuuggagcacaggggucugggcaugggcauccacaguggagagcuggggaacacauggaccauggcucagcggggcuuggggcucugcuccacagcuguccucuuuguucccuccucccagccugcuccgauuccauaccugaugcaugaaguguggucuguccuggagaagggccuguagguggggugagggaccuagucgggccccagacggugccaccaugacuaggggcacuguaggcagcuggagagagaagggagaugccaugagaugccaugagccucaucuuaauaguucugugucucauucauuagcucuuuacuaaagucucacacgguagcaacaauggaacuauccaguucacaucaguggaaucugaggcucguggagagugaauguaucaagguccaacaguuucaagggguagagcuggccccaacacuguuaccuucuugggccccagccaucucgucacagugggaugaggauacauggcuauguccauggaaucauaaggucuccuaucgggaugaggauugggagggguggggaaagccuugaaucucugaagccuggagaguggggauuuucuuggcccugcaauaucugcauaagucagacuugccugggacccauaaaccacuuccugugccccagcccccccccccccccccgccacaugccacaguaaaggucgacaccuauaggcccaaguaccccacccugcuuaccccauucugggccccgggccucaccugcagcugggaugguggcaggggguucaaggaagaagaggugugggccccacuucgcaggucccgaccuuggaagggucccccagagccccuggucccuagaaguucugagcccuugggugcagucuuccagcuuggcaagacuccuggggaugggccaagggccaaggaaggagccauaggcuuggcuggccuaggguugggcauuggguucuugucagaggcaggcugcagggauaacaguggaauggagucacaugcauuccagggguggugcaagauagccucauaacuacaccucuggucugucuuacauacauauaugcuacccugacagcaggaacacagauugauggauauauucuacacaugcacauguccagcaccucacuugcuuacauacaccauaccacucugucgugaauguggggugauggggaguugguuugugggacccuccaguacccccugcacucugugcaggccacauagucuuugcugauucuacuggggcuugucuuggacucucuucucaucuuuuuauuccaaugacuugggcauagccucacaagauucaguuggaugcugugagcaggaaggcuccagggaacugugcuagugggaaguguacugcaauagugaggcgagugguguugcugcuaccaaccuggauaacggcagaggagcugcugagaugugacugucuuccaagucucgucugaaggcagagucaggagaaguugccgggagcuuggauggaggagaugagagaaagggucaagaugaugucuagguuuuuggcagaagcagcuacaacaggagcauuacuggagauggaggguagaggauggaggagcagaguauacagugauagucagauguggcuaaaugcaaagguaagcaguagaggcagggaagacuugcagcugaauucaguacugcagagcucagggccacagcaugggucugucuucucuaagcuuucuucugucuuggaauuggcguggcaggugccaggaaaaaaagagggauaggguugcuugauugagggucccugggcgcuccucaaacuagcuccaaucucugccaagcuuggaaguccacuucuucccuuagccauacugcagucuucugauuuccucuucaaagcucuacauggugacccaggucccugugcugagccucacuaccuuacagucccuuaaaaguguggcuuucguuuuucaggauccuauacuuccagucagagagggaaccagaucuugaacugacuauagaauucuacccugauuuuaauuaagaggauagccagguucagaauucuauagucuucucauggccugggaccuccuuuucuuuuuagauaggguuucuuguagucuggaacuccuuauauacccaggcuguccuugaacuccuuguuucugcauucugaguacugggauuauaaaccaccauuucaggcugauacugccucauuuuucucuaggaaguauauauauguacauuuucccugcuguguuugugugugcaugugaauaugucauucuccguucuacuauauacuacauguguugggcauguagcuucugagaacagccugggggaagcacggaaggguuuuggaaggcaauugcaucuucuuugcuaucaugucuggggcuuaucagaguugagagauuuauaugagaaccuagguauuaagacuagugugucacgggcuaaaacauuagcaugaaaagaggagucugggucuguggaagcugagacuggcuuccuagaaccgugaugcgaugagcugaaagacugcaggcaggcagccaugaggugaugcuccuccaagaaagaacagcaaaggaaagcaucagagaugagaaggaggccaggacuuacaggaggaaucaacccugcugacgucuucaucuuggucuuauagccuccagaacgcuaacaugauaauucuaugcuauguaagucccccaguuugugauacuucauuacaguagcucaagcaaaugcggaucagguuuggugaguagaauuuuccacuauauuggcuuaacccauauggcuggaccauggucacuuuugaagugcucuuuauguuuggucagaacuuauaagaaaucuccuccuuaaauacuuguggaacuggugugacugugugaugcaucaguacauucucagaaagaggaccugaauuggauauggucugucuagugguacuagggaccuggagggcugggcuggccagccagcuuccugcacugucuguuggggcguuccuguuugacuguuucuuagaagcuguauggagguuguuucugggacauagaauauguuuuccuaucggggucuacaucugggcccuguugucacaaccugaacuuggccagauuuuucugccauugacgucauggcggccggaugcauugggcuucaucggcaacaaggaggaagagaagggggcagauaaucuaccccacagguuucguuccgagaaguggcuagucuauccuguagccggauaggcccagguagggugaugugggugcuagcggaugugguaggugacguccaucuggcuaccaugcaaaacccaaguucuaucgauucugucuuucuuggaugccagaggggcccaagguuggaugcuuggugaguauuaggcaggccucauggauauugagacccccuugagucuucaaaugcuguaguaacagaaacucagaacuguacgauaucauuucucaaagccaacggauuuuagaaucucaagaacacagacucuguagggugcauggauccaccuucuuacuguguguauugaugucccagagcccaaagaaaugggaaccaccuaaagccaggaagcuuaaaacuccauaaggccucuugcuggcucuggaaugucagccucccucccuccugagcuccauuaugacagaggauuggaaaacccucuacuguccugaucuggggucaggcuuugcccucuugggacaaaggggccuuccuguccaucucugagcccaguuugcccuucuagacugggaagaguaugugauggaggaaggcuggggucuuucuguccuccugucuaauuugggacaguaacaggagccaucuugcaaaguucguacauacagaaugcugagcaagugucuaugacugauaaauggucacuuacauauggcuccagacccgcucuccugggacaacuuuccccaaauuauaacauucuuccagauacagggacaagaggaagaagacauuuggccuggcccucauggaaagagcacaccaccaggcuuuuuggaagggccccagaaugguugucccaaggaaugcaguaugaacucugaggguucauacuuaacugauauuucuccaucguuacuaguguucuuugguccgcuaggacuucugacucauggggcccagaaccucacauagaccagagcuugugagauuuggccccaugcuaugguuauggacuggauccaacucaugaggauguagaagagggaagggcaccucaggucuccuguuaauggccuccuggguccugagagguaaacuaaggccugcaauguggaauugccaaagucaaggucccacugagaauucugagaucugcucuuggauuuaacucugacacaacaucucugugaggccugggggugggggcugcucaucucugagcccaguuugcccuucuagacuggggagggaagaguacgagguggaggaaggccagcaucuuucugucucguggcugggguaaaucuuauggagcuauauagccguauguauguaugguaugguaugagauauauauauugauauauauauauauauauauauauauauauauauauauauauauauauauauugagauauauauauauauaucauaugugugugaauacagauauagaagagauacagauagagaaauauauagagagaaacaugagauggaauaggaaucaagcucauagagagagacagugagagcaguuuagaggaaaagugacagagaaagaaugaacaagacagagacauauacagacagacagacaugcagagacagagagagagggagugagagaaaggacugaaaauaaucacuggccucuggcuggaggacugaugcugcuaggugccagagacacccauggcugguauugaauuguuuugcaaagcaacaucagaaaaauagugugggcuuuguacaagaauaaacacuaaggagcagauuagaguagaaaaccguggcagagacccaugcacagagggaauggaauuugugaugaacacaacauuucaacaugaggaacagugcaggacagauuaacaaaugauucugagacaauuaggggaaaauaaagugacuggguagauagcccacuuucccaccaauaccucccugcccacuugaaaugucgcugucaucagacgcucuagaauaauuuccagacccacuagagagauacguuuuaaugucuaucauuguuguuuggccuugugcugagcaccuaccaucauuaauaaaaauaauccucagaaagauccucugagguagguacuguuauaaucaucacaguacauacgaggaaauggagguacagagagguuaagagccuggguaaaauucacacagaugacuugaguugaggcuagguuguuccagacagucuggcucccauacccacacuuuugaccucugcaguaaauggaaaaaaugaagccauaaaggagacuggaagccaacauggggugaacaguuaucucauuuucaagugcaaaagacuuaaaacacaaaaccauacacagaagccccacaagaaaagaguaaucuaaagaccuaaaagacacaugcauuacaaagcacaauaaauagggaaaaaaagcaagugauugcccgccguggugguguaugucuucuaucccacuucucagaaggcagaggcagauggaugggucuuugugaguuugaggucagccuggucuauacagugaguuuuaggccagucagggcuauagagugagaccuugucucagaagaccccccccccccauacaaauagggcuggagagauggcuccauggguaagagcacugcugcucuuguagaggagguagcuucucauuuucaagugguaaaaggcuuuuaaacacaaaaccauagaaagaagccacauaagcgccagcacccacguaaccaucuguaacuccagucccaugagaucccacaccaucuucuggccucugugggcaccaggcacacauauggugcacaugcaggaagaacaugcaugcucauaaacuaaguaaaugaauacaauuaaaauacacauacacacaaaugaugaauuucagggaaauaugugucauauacauauagccaauaguuauuauccuuucuaaauuaagagcuauuagcaauuuugaaaaaucaugagcaauuuaguaggaugaagaaugugaucauaaaacucuagccuacagagcacaaauggucaguggucauuaaaaguaaccaaaaugcaaaauuuuaauacuugucauuuuucuuaugauggggaaggauuaaaaaugguaacacacaccuaaaauuaacuugaauagaaacaacagaaaauaagacaacguuuuggaaaagcaauuuguagagagggcaaaaccccuuaagauguacaccccuucuuccccagcuacuccauuuucaggauccauggagucagguauggaguuuuagaaucagaagaaacccaaauaucccaccaucagcacuuaauucagguaaucaaauucauggugaugugaggacagucacggcagacauaaaagaucacguguucguuauuuuaguaugcuacaaaaaugguaucgcuugaacagagcagaaacaaauccaaucuauagcacgauucuaauuuguuuaaaaaugcuaauagcaaacagugagaacucaccauauaccaggcacagugccacagcacuaaaccugcagagaccagcucacccucguccugaacugccugcucuccuugcacauggauucugcucacagucauauaguccuuugcuaaacuguggcugacugaggguguuaucuugcgugacacaagcagaaggucaguuaaaugcuaagacugaccugacagcucacaaaccuaagacacacagaacuaaugcccguucuuggaaaacagagcucuuaagccauuauuauuaagcgccaguuguguacaaauaucugcgcucaauaccgggugcaaaagcagcugaaggaagaugagccgagagucagagagcgggaggaaagaaagggacuguggcuggccaggcuggaagagacagacaggcauauagucagagccugggaaagagacagagacugggcacugauggaaggcagagacaggcaaagaagcagggggagacaggagaagaaauggaagacagcaggaggaaaagaaacaagagaugcacuucuaguuucuaguuauagcuggacagcaucuugaguugccuaaagcuccggcauuccuggagaccagcaguugauagacauauguuaaaaaaaaauccuguuuaucugugcaucaaacaaucaaaguacuucuuuuugccccugucuaaggaccaacugcuccaccuaucuggcauuuaggaugaaugguauuaguuuccaaaguccuuaccuggaguggcuggguguuuccagcuguacuggugggcuccugacacccacccucaauaccucucugccacuuucgccagcagagcugugucuggugggggagagcagggacacucgcucaccuuggugaaguggacugcuagagggggaucagccuggcuugugggaaacugccacauuaucaaaaacaacuuugcuuuuauaccgagaagaaaaaccacggcguggaagccgcagaccucgcucuucuaauaauccaauuuuuuuuugaugagugugugugcugauaauugcagggugggggggggguucuuguaguuuuuuuuucuuugcucucuuacuuuguuuauucuuuucuuaugagacuuaaacggaaauuuugaaauuuuggguuuuuucuuugcccuuuacaagucaucugaaaauaugauuucuuccccucaccacagagguaaaagguaucaaugagauaacagggcucaugagaaaccacaauuucuuaaacaaaaguguguagagucagaaaaaaaaaacugagggaaaauaagucaaaucacaaaggcaucccgaggcagguagagacagcauuguguuugugagacguuggaggaucgcuggguugaacagaagaagggaucugaagccugccaugugaaugggaagcagccaggggagaggugggguagugcucugucuccagaggcuuccuucugcuccaaaccucaguauuuccuuagcaagcaugcauaugaucaccaccaucauguugccaaggcuuggcagagcuggccacuccuguagccuuucuuuccacagaaggcaagaggcauggaaagcaauucauggagaaaaaagugggcuguacuccccccacaaauucacagaaucagagagucucagaauggcuggcucccagaagcugcugcgagucucugagugagccccacaucauguuugugcugagugcccugacccagcagccacccaccugggaacagccccaguggcuguuaaugcagccagcaucaccaagaagggcaaggggaagaaaggcuggccauugcagcucagugccagagugcuuguuuaacacgcacaaggcucuggguuguuaaaacaaacaaacaaaaaaaccauacacauagcggcccaggguccuaguccugucaggaacaauauagccauagccugaugauucuaaacuuuguaacagucuacucugaaaaguuccaguuucauccaguaucacauaccaguaaucccagcaccccagaaacugaggcagaagaaucaagaguuuaagguugcuuggggcuauauagccagauuccguguaaaaagaaaaagaaaaaaacaaaaaacacaaaaaaacaaaaacaaaaaaccaaaaccacaaacaaaaggaaagaaacacucccguuugcaaagguuuaggauucuaaacagcugucauaauuuugguagccaacauuuaacuagaauuuucuacauuccagacagagccaaacacuucucacccucugagguccaucucaucauggcuguauuguuuuuagaccgaugggcaaaauggaggugcagcuugcuuaagaucacaauuuugggaaauagggguccuuagcauugggcucugaagugaccaguuuuccugaagccaacagugucauagaaguucuaggacuuggagacuccucuggaacuugauguuugugagguuuuaagguuuguauucaagaucuggcagcugcguguccucgauuuggcacagaccggcucccuguaaccacuguuuacuacagacgagccuccacagaguuuuuccugacaaggcacggcuaaggcuuccagccuuuggugcccuggcauccugcagagagcuaagaguuccagguauccaacugcauggccaccaccaccucuuugcaagacuggcuucaggccugaggaagagaaaguagaaauacguuuuuauucacaugaugcuaaccuaguaaacaauucccacacuccuuugcucuuucccucauuugcacuuuuugucccuuucggcuaucuucugagcaccuccccccgccccaacaacaacaacaaaaaagagacugacuuuccucaucuuaacucaccuuuuuggaaauaacaagacuggaacugauggcuuggcuuuauaaagacaagaggggaaaacaaagugaauagaaaaaaaaaagacccaaaaauaccagccaacaacaacaacaauuaaaaaaaaaaaacccucaacccuuccuaucauuaguucaaagcaaaacuuucacugguuggggcuucuaaguuggugggacacaucuaagaccaaacauggccuguguggugccuggaagccgggggagguccugaguugagagggagggaggggcagaggugggaugagguccucuuacuuuggaggucugcauggaucuuaggagcuuaacaguugugguugugugugggagggaauaggggaggggugaagagcauaccuaacagguaaugggcagcugacuguagcuaugccccaaaguuaauggucccugcucccuguacacuugggcccaacuagucccuguaucuucuaugucucugagacaguucuaguccccugcccugucaccugucucuuuuuggaauagguacucauuuucucaggguccaugguuuggucugcaucuuccuuuauauccucgucaccaucuuccugccauucugcgaaaacuuggucagagagguggcaggauaaguaaaugagggguaagugacacagguuuccaggaggcuauuugaauggggcugugggugcgggaguguuaagguuacugaaguguaaagcuagggucuuugcagcaugguggcuaggguuuugcuugucagagggugguauuuccucuccaccauuacuauauuggcucauguagguuccuggggaagcaaacugggagggcuaggaguugauggugaauggggcaggauuuaacaggucagggggagcauucccagggaaagggaucuuugacaaagagcaggcauagaugaagaagagagugauggggagaucugcagauccaggagagaagggucaguguggguguccugaggugagugugcuggauauguacagggucagcaaggagucuugugugguuggagugacaugacuggaagggagagaacaggaggaaggucagacggggcuagcuggcuugugcgcuuacgacauggugaagguuggcucuuccucuuaguguagaggaagccagaggguguugggagcagaggagagacauugcuguuaggacuuaagaggaugucuuagauggcugaauauggaauaggggguagaacaugggauggagaccaaccagggggaggugacuacaguaguccaggggacugggacuggugcugguccuguugauggagugguagugaaaagguggauuugggauuuaaaaaaaaugaugcuagagauggggcccaugcacuuucuaggaagugguuuuuaccgcugagcuacacuuaacccuuuuuauuuuuuagacaaggucacacuuguagccuaggcuuggaauuccgugauucuccugccucagccccuugagugcugggauuacaggcauacaucaccauauccugcuuggaaaaugcguuggguagauaaccugcaggauuugcugaagaaugagacucugaggcaagaccggggcacaguugauacccaaaaugggcagauaggauggaguccugagagcacuugcugccuugaacuuucagaugagaaaaaaaaguucuaccuucauuaugccauuauucuucugcuacuuguagcuggacauauuccuuucaugacccuggacacagacaggaggagcagagagacugugggggccuuccuguuaggggucuuaugaggguuagauaaaagcacucccugaaccuggcauauggcaaacacuaagucuuacuaaguuaguaaaugggagugggggauaugugaaugaacacgauggcaaaguccaggucauucccauaggaggugccaucucagagggagaauggaaagaauucacuagaugaaagaaacagaugggacagcacucuaagcagaggagauugggaaagugggggggggggagaagaaagccacuguggggugcaaagugucaaaaugagcaagaagggcaggacucugauuugaauguacauuagcugauaagcuugugaugacauacuaucagucaaugugugcuaagugugaguuggaaaaagcuaauucuuccaaaaagguucuauuuccuauuuugcgauugauucaugcaauagugccaaguccugaagaacaucaaugcucaacuggggacuuuaaggaacaguuaagaacguucauggcuaguugcauuggucacaauaaggcugggagguguguguggugguguggggccagcaggacacacccaguaacugauagaacuguuuugcuuuggucucacaauccggugcagucugggcuuuuaggggcucuggguauucguggagccauggggagucauggaagauuagggaaagguaaagccauuccccagagguccgaucuuacugguugaaugaauucugauucugcgcucaaucacucaauagcucaggcucagccuaugcaccuucuuccaacucagccuauuuauuggcuacucaugcuuuccuucacagcaccuacacuaccauccguggguaugaguucccaucuugccuccaaaguuuccuucuggcuacauuucucuaguuucagcuuugguuaaucccauacuggcacuguccuuugagauauaacagccuucacccuggauccccauuucuuucucgcucccaccuucacuccucacaugccuuagugcucccccccccccccgcccgcuacagccccgccuccaugucugcucacacacagccuucccgucucuguucagucucuguauuggcuagaucuaccuuguuaccaccucuugaagccauagugugcgcucacuagacuccuccauuggcucauugcaacuauuaucgucauucugucucuacaucauucgcgugcaguucuccauuggcuguucauuuuaucugucuuacgucucaccgccuacgcaaccugcggaucucccaguuuuuggaccucuggguucgcuccccguugcccccauugcuuguagccauuucaucuucccgccgccuaccaugcccuucgugcucagacuuucccacuaauugucauacuccugcugcuacaucuucgggcccgcauuaacccuacucaggccucuccauugauuccguuaucaucccgccuuccaucccgcccacgcgcgggcguccucauugguugcuagcuucuccugcuugucaaucaccuguacgucacucccgcguggcuguccauuggcuguuggccguaccugucucuagcucaccgccuacgcuccacuggagccccaccccccuguucuggcuuucucauuggcugcccgccuuuucaggcccugcccccgccggucccaccgccggugccgucggugccgccgccgccgccgccgauauggcgcgcacggccccuguggagccaccgcugcggcaucccgcgcccccgucgccggcugcgggagagccccgcgccucggcugaggcggcgguggccccgcggagggugcuguucgcugacgaggcccuggggcugccucuggcgcagcuacgccgcuaccggccguggggcgggcccggggcgggcaagauggcggcggcgaccgggcaagauggcggcgguggcggggcugaugaggaagacgauggcgaggauggggaugaaggggaggaggaagaggaggcuuuucccgaucccucuccgccgugccccguucccgcuggcgggggguuuuaccuggugcccacauuuucguugccgcccgcgcugggccgucuggagcgguuggggcgcgugaugguggaguuggaggcgcugcugccgccuccuggagcgguucccggggguuccggggugugggugccugggggacgcccgccaguggugcgcggguuggugcgcgugcugaaccgcuccuucgagaaggcggugcacgugcgggccucacacgacgguugggcuaccuucugcgaccacccagcccgcuaugucccacgcagcccgccuggggcaggagugggaggaacaggagcaggagauccccuccuggaucccgggcuaggccugggcccuggccagaugucagccuccucacccgacgacgguggcugcacugaccgcuuugccuuccagcugcccuuugcugagggcgcgagcgauggggcgcgccucgacuucguggugcgcuaugagacccccgagggcacuuucugggccaacaaccauggccgcaacuacacuguccugcuccggaucgcacccgcucccacacccacugaugccgaagggcugccccagcagcagcagcugcagcagcuggagccacagccugagugccaggguccuguggaggcugaggccaggcagcugaagagcugcaugaagccggugaggcgcagguaaugucugccagcgccaccuccaccaacacagggcuggauguagaagccucccaucccagcacuucccccucccccaggccugcucuccaggacaggcaggagggugcauucggucaaagaguagugcaggccaaacaugugcuaggcacuguuuuaaauucugggguaucauccauuuauugaguuccacuauaaggcccugaacaagacagacaccuucccuguccccaaccaucccgcaaaggcuccucugggaaacagaaugcaaaagcaaacaagcagauaagauaaauagggcuaagguuagugcugagaggaaaauacuguaaggcucuggagggaguggcugcugcagacguguugagggugagcucuugugaagagucccagacggugauaacgaagaguuauggacgagcgaguugguagaguuuggaccagguaggacucuuucugaggagguggcauuuaaacuugaguccagagugguacggagcagugaugcacauacaggggagguagauguagauaguggggacagcaaaguccugaggugguucuggguuucguaugacugucagccagugugcuggaguggagagaacaugacgugcgaagguguggacuaagggucucccggcguggggagucagucugauuccuaucugccacagcaggaagccagaguuagagaaacugguugaggaaguggugguacuuggcuuuuuaguuucaaccauuucuggcuuugaagucuaugcauccuuuuuuuuaaaaacuguuccucugguagucugaggccuccaguggaguuuagggagcgaggcucuauucucacauaaaaacauuagccuuggcagaggcggaaacagaugagaagcggacuugaaggucacaucgcucuucuuuuuuuuuuuuuuugcacaccucuuguaaacugacugauauaaugcuuuucuaggucuuuaccagggcuauacguuugucaagggcuccagcuaggccuaaugcccggggucaguuagagccccuaugaaaugcauacauuuuccugcuccuaugagaaaugggaaggggagguugcccuuuugucccuucgaagcugcaugauggagcagggugcugugggaucugcugguugugguaagggcuuaggcugugaaagguuuagcucuucguggauggaccuugaagcauuuagauucugccauucgauuaccuggguucaaacccuaagccugccacuuuuuagugugaccguauccaauucuuagcugcaucgugccguagauaaacacccucaucuguaaaacaggaaguuauggcacagaccucacgggaugagcagaagcacucaggaucgagccuaguuccaaguagugccauagugcugguaauuagcaucgaagcuuagaugcucacuacaguccauguauccuuucccaaacucagcuuuguuguguacucuugucucaguuuccucauuggucagagaggaauggcuuucccauugugugguugaauuggaugcaguacccguagggaagguaacugaggcauaauuguagcuguaaaaggucuggugggcagcauuucuuaaucucuguuaagagugguagggacauucuccucuugaggucagcugaaugugcuguugacuguaggcacuauauugaguccuaguucaugggaaauggggugggguggggggcucggagaggugcucgagcuugcucagagucacucagcuaguaaauagccaggccagggaggaaauguuagggaugcuaguuuaaaaacaaaguccgcauuucacuguuggcgcucuuaguucuuccuuuccccccuguaccuguuacgugugcuucguguuuuauugagauauacacaaguggacgguacugacccccgagggcauggcucggaagaauugcacauguauguguauguagccgccacccaguuccagugcccccagaaucgccugcauuucaaucacuucuuauuccaucggcaguugugggagcccuuucuggaagauaagacaguugaguacugaaguuuggucauuuucaagaaugugaaaggaagggaacagacaaaucaaaaccuugccgugccaagguggguggagaggguguuuuucuuuuaaaauacaugggugguuuuaaggagaaauugaaguaguucauuuagacaauuguuuugguagcuggccccauguuugugguucccaacgugacuugagauguuauuuuaagugggcagauggcuuuuugauagcuucuuuaucuuuugaucucagcucuugcaaaggggaggcuggugugcgcugcuagaucagcgauaagguuuucuuuguaggucggugacuuuccuagcaaauacauuucaacuuauuauuguuuuaaggccugugugcugcugcugauuugaagugcuguugaagaauagcuaccccccgugauccagcccucuggggaaauggugguggaccucaggggaucccuuuucuuaucugugggaggccugcuguagagggcuucagaaucguuggccacaggcccacugugcagcuggcccuuggcagguagggucagaagagaugauuggcagccaugaggauguaguccagaggcugagcuggcugcuuucccuagcuugcaggaccagguuugcaguacucaguagguuuagagagaauccaucagcagcauuuuugguagagccuguuaugugcugagcacagugcuaggaacaagcagagaagacacagacugguccuaagacucccaggagcuugggguagagccagggggcaaggguuaugugagacccuaccaagugauauguggccaagcccccuuuccuugcugggcacuuugcugaguauuuuuguauaguuucauuugugcucaacagcguuuucugugagcuagauuccuuuaaaucccucuucugggugagcacagagguuuugaguccucagugauuggacugauaugggaaggagcccuucuggugugucuuggcuuuauacucugaggaaguauccuauuccucuuaaaaauaaagaccaacaaaaaucuggcuggcccuuacacacccucaccgaugccugcuucagccucuguuagcaucuagucuggcuuuauauugguuucugcucccgagcucuugucgccacaucccuucuguuacuccugcuuugggguugucgcucauacuguuugcuucaccaagaauguguuuaccccucagauucuccucauggagacuccucaguucuaagaggguuuccuuagggaaggaagcuugcgcagcuuagccuccuuaaguccccaguuuuauucauagcacugaucagcaagucaaguuggaaaaugccacauaggccagcaugugagccuucccccaaguuaaggaccaucuuccauccugccccauuguccuguguguccuuugauccacccucggcuccucuuucaugggaucccgucaaguguucuuuaucauuacacucugccuuuugcuucuucaaacacaauagaaaccauaagaauggaaugccugcuccuuagagcccccacgucugaacaccaacaccccucacauuguacaugaggagggggucccuuguucccauuucaggccaguuucuguucuugacuccagagcuucauuuucugccauuuguccagaggcugcaaccauaagccccauuugucuuucaucaggcuuuuuuuccaggucugucucaccugguccucuguugaccuagccucaggccagggucucucucuuaauugcugagccaccuugcccuuugccucuggucaguacuugaugaucacccuugucccccuccccugaagagucaacagcacuugcuuugucugcaguuuuauuagucccuggcuuuggccacacugaaaggcuccguuguuuucuucuugaaagggcuaacugcuccuacucgguccccucuggcuuugggaccgcccucuacuugcuuucuucaaaaucucuggcccuuucuccuguucugucagccucaacuacuaaacuuggugucugcuugacugaauccuuagucuucucaagcuuggcugucucccacucagugcccccaaacaaccucuuauuccauacccaugcacuugcuuucuaagcauccuuaagcccuugcugauucuagucugugccagggccuaguguucuagcauguuccuuccuuuucuaaaggcacuggcuuccgucuguaguaaggccuuuauuaggggauuaaugggugacugcaaugcuagacuguaagcuccgugagggguagggacaugcucugcauuggugaccacuguauuuucacaggccugccuuagugcauggcacuuaguaggugcucaauaaauauuuguugaaagaacgaguuugaguauuuuuucaaaugucuccacaucaaauucuaaauuucauugcuggguuugcucaccagugugucuccugucacuaucccugaugcacagguuuuagguauaccuguaacugaaugaauggguagcuauuggcagccucacagaaaugagaacaauagaguugaaauggguggggugggaaucaucuaaguggucuggagagaggauuucaugagaaagugucccuuuguucuacagacaacugguaggccaucaugguuaagguugugggcuggaggcugcacagcaaaguggcagagcagggaugugagccuguguaguucugcuagugcuccaguugagaacugcagcgcuaggcugcuggauggggccuacagcugggaauggccggacaaguugcuuccuuuuuucagagccccagcgcuauuccaaaagacuuaguuuuaagcacuuuauuggugcuuugcauguuuccucaguccaucgaaaagcucccugaaguauuacuaccauuucuuccuuauagaugaggagacuagggcacaagagaugaggaaauuugucccgggucacagcugauuugugguagagcugggacuauucaacauugcauuuucugggcauuuauugagaugcaagaucaguuugcuggcuuccaacaaacauuggcaaaugguauaggagauagcccagcgcaguuugacaugcaguagaggugaguauuacuuugaagagcaaguguuucaguucucagugugucugugucuguauuuacucgugaaugugcuggcuuaugaggugaaaugguuuucucacccugggcuguggccacgggagugucaguuagaugaagcuugaagcaugcaugguaagcugcccuccaaugcacacaaguccuagaguugaggcugacacucagagaaagcagggcagaguccuacauaacuugaugaugucacagccuccucaccucacccccccaaagcacacgacuuaagcugaccagaauuccaaguaucuugaagccacgccccccccccccccccccagacagcaucaucagauugucuccaugggagcugggcugugcguguuucccuuuggggcucagcacaugacccaguucgggcaagcacaguucuuugaaacuuggcgugcucacguaggacccagacgaugauuguggccgugguauugagucuacuuugcauuucucuugggggcuuguuggcccucauucacucacucauucuuuaucucugcuaacugaucuuucuguucugucuuggcuggccugggcuggggccgcugccaccacuuucucaagucuuaucccuuggucuccagguacuaucugaagucaaguagcuguugacuuucuuuauggugggaagaacuuucacucccaguagagugguccauucuagguaagaugggcuggacucauucacaaguacucaaguaaggcaugccaacacauucccagcacuguguguccuggcccacuguguguucacugccccccagagagacugcauggcauuugugggacaggugccaaaagguuuuauucucgaaaaugaacaggcacaccguauguacaguuuuguucuugauuuccuuccauuuuucuaagaacuguuaacugaucgguaagucuguacacuuacacucgccucauuuugauugcagccacagcuacuuccaaaauuuuacugugaaagacgauucaaagauuucuccccaccaccucucucuuucacucucucucucccuccccccccccucucucucucucacacacacacacacagacacacacaccucucugccuacugucuaagacacugucuucaaaguggggccaguuuuggauguuaucaguaugcaguguaguuaucggggauagagacaguuccuuaaaucauacuuucuauauuuggaagaaggaaagguugcuguuugaaaggauacauguaaacuuuucaaaugacuuugauguaguaacaaaaaggcccaugguggaggcaaugagcaaccgucuccccugcccccagcuuuucuuuccaacucuuggagcuugggaagacaacuugcugacuuuguggaucuugaguugggcugauacuugaauggcuucagcuguggagggcuguggcagccgaagaacacuguggacuguauuuccuuuccuucaucugauuagaagucucuuuuccugcuaggggcugcagccugaguucucuucacucgcaucuaugacuuaauagaagcuugguugguacgcacggccggguugagucagauuacgggcaagcuugcauaggcugucucugggaggaagggcuggcuuucuauccaguugagaguguucuugaaaacuaaagauuuuuuuuuuuacuacuuuaguuuuacuuuagaagauaacaauaaaguaggguuuuuguuuuguuuuguuuuguuuuguuuuguuuuucgacagagucucacuguauaaccuuggcugucccuggagcucuuucuguagaucaggcuggccccgaccuaacagagaucugauugcuucugccucucaagugcugguuuaaaggugugugccaucacugcccagcuuuaguaagacaauuaaaaaagaaaacaaacauaaaaaguuaucccugcuagguaaaagucaaaugagcuguagauucaaaggucuggauuuuagacccacugaagacacugguucagucucagguaauuuuuccugaaucuucuuuuuucaucuguguugugcugagguugcuggcugggcuccuagagucaccugucccaggcucuauaauauucagacugaaauaccucuggugggaugcaggaguccuagacuauagaggaagacugagggccccuugcaaagauuccagacucuagguccuuauauacaguguuaaauuucuuccuccaaagugcugcucagagguucgcauagccacucugguagugaucuagccacguguacuauggaacugcacacacagugaauaugagaguaaagaacagguaaaaagccuuugugaaagggaguggggagggaguguaugugucuguuauagguucuuuccucucuuucuagauagagcuggagauugaguuggguacagucacauagacucuuaucuaaacagcaucagcuuguugguuaaaaguccggguuuugauccuaccugcauaaucuugagucauuuccuuagccugugcuucaucauccauaagauggggauaguagaacuggccccacuugaaaggauguagaagcgccucccucgcagucacaguggggauuaaaucaguccauguagacauguagaccauuggcuaauaccauagcauaggccugcuagcaacauucugguuuugggaaggugauucucaguagguauuuucucaaaguugcaacuuuuuuuuuuuuuuuaaauaagugucaaccguguccugucaccucuuaggaagaaaaguugugauuguuucaguuucccucaggucucuggaucuuguaaucauugcuuccgcccucugccucauuugugaacauuugauauucacuaguaagaauaagaacagugaucgguccacgauaaaggcacgcuccugggaggaucuggcugaaguacuugguuuaugucacucggggaucuaccuuggcuggcagaggagcaguugggccaauagauuucucccauugauuuacuuacugcucuguuccaggccagagagcuggcuuuugauccuuauuccucuugacuccacuauacacucuauauugccuacaaggggguuauggguccuggcaggcugguauggggaccaaggagggguggaguagaggacacaggccgcucugacuaccuucuugaucuccauuugccuucucuccuccccuuugcugcuuccugugucccucagucuuuucugucugcccuucuuaaaaaaaaaaaaaaaaggcuucugugauagccagaaacaaacccuagagaagugauccaaaagugccuguugauauuugguuuguaacuauaaaggaaagaagcuagcuacucagucggaagggaauggcuauaucaauaaugucaaggccauuugauagaagcacaaagcagccguuuuuucaauguuugcaaaagucuauaaugauguuucauacuguuuaauggacaaagccagcugugaaaguauguuugcagaaucuaaaugguuucagggaaugucuggaaugaaauuuuccaaauaguaacagugguugccucuggcucauaugugauuguuuuguuuccuggauccuuauguuuuucugucuuucguaaaauuucuaccaugauugcguagggcucucaugaccaaaaggacugagaagcaggggggagaagaaauagcagcugucaggugaagaugggucaucacagaggcccggaaggugccucuguggguggugcgacugaccucucagggugucauauuuaccugcugucuugucugccccacaggccuuuugaagaagagccaaggaugaggagugcggacgauaauacccuagcagguaagcaccgggcugguguugagaguucuagccuuuguaauacuuuguuuuucauggugcuggggcucgaugugugcuaggcaagugcucugcuccugagcuaugucuccuaaccuuucuaguggccuuuuaccacuucuuucugccuuguuucuauauaaaaaggaaaaaggucaccucuuccuuagacugucacaaaaagcuucuaaugugaacuuccaguuaaugucagagagaagcagaauuaggcugcuuguaccugucuugcuucaacauugccuuucucucucgcagaacauccugauguucgagagucacuagguccccuguuggccccuaccccucuccguccauggccccagaugacacuucaggugagcaggcccugguaaccuuggugcgagcagccagauaggaagcucauagugugaccacaauuggaccuacucuugccuauccuagaaguagggguggagguggggagugaaagcacaaaaaccagaauuuaauggggggguggcgguaagggaaagaugaaauuauucacuuggguuuaacuguuaauuagcaaacauuuaagggaaggcuuguugugugugauagacauuggaaacccagcccaaauggcaucuguauggggauuacauguuagggcagagacauauuguaauaaugguuuaaaggugagacauuugagcugaagaugaaugcuuaggcaaaauggagggagggagagagggagggagggagggagggaaggagagaggaauggagggagaggccugagaagugaggcuucagaaaagagcauuccaagucccaaaggccgggccucagcuacugucuguuagaaacaagacucauguggcaggagcaggaacuucucagagugagggcaaguagagagugaggggaaguagagagagcugaggucagggaagugcuagggaacagaugggguggggccacggggaugaaggggaagaccuaggcuuuacucuuagugaggaggagucaagggacagaggcaggagcagaagaggaaugugaccugcugugagaggguggggacaggggcaccagggaggagaaagcugcugaacccugguacccugaugcucuuagcugggaggaaacauuuaaaguggcucugcuuuaacgucugucuauaagaacuuuaagcacauuuauaaaagagacuaguauaaugaaccugcaucacccggcuucagugcauauuggcauguguccauuccuacuuacauuauccccuucccauuuccuacggaaguauuuuggaauaaagagagccagauacuggucagcucaugaagguuauaguuuauuucuuagaaagauaauccuaaaaggagacaaaacaaaaacuaccgaugauuuaucauaaucauagcuccaaaaauuaacaguauuccuucauaucaucaaaugauuagauuagugauacgguuuuuuuauaacuauucccaggacucaaagugaucuguuguccucuccucuccucuccucuccucuccucuccucuccucuccucuccucuccucuccucuccucuccucuccucuccucuccucuccucuucucucucuucucuucuuucuuucuuuuuuuuugucuuuugcuuuuuugagacagggcuucucuguguaucgaugguuguccuagaacuugcucuguagaccaggcuggccccaaaaucagagcuuugaccugccucugccucccaagugcagggauuaaaggcguggggcaccucugucaggcugauacacuguaucucauggauaugucucuuaacuuuuuaauagucccucaguuucuucauuccacuuuaauuacuaaucccuguuugucaaguacaguuugacagagucugaguuugcuugauuagauucagguuaaaauccguuucuuacucuauuaaacaaaguuuaaauuacauuuauugaguguguguguguguaucugguguauguacaugucaugguauguguguuuguguguguguguguguguauguauguguauauguguguguaaguugaggucaaaggacaacuugugggaguuaguucucuccuuuuguuguguagguccugggugucagacucaagcugugcggcuugguagcaagugccuucccuacugagcugucugacuggcgcucuuccucuguuuccauucauucauuaaucuuauuuaccuuaguguuuuacuaaauuaaauuuacuaaaccauuaaguuugcuaaacauauuuauuaaauauugucuaucauuuuaaaauugacuuaaacagaacuaauuccauuaguuaauagaacuuaaguucuauuaaauucuagauuaaauuuuaggcuggacuugagagagagagagagagagagagagagagagagagagagaggucuaguuuguacagaaaaguguuguaaauauuucauccccuucugauuugucaauaugcauuaaaauguuguuuucuccaaaggucaucagaaaggcuuugaguuuugugugucacucagauuccaaacauaauaguugauuuugaguucacuguauuuguuuauuuugaugcuugcauugaaauauugcucucuguggccaggaggauuuuuuuuucucucaucgucuccuuuuaucuacuaacauuccccguuauucugugagccuguucucacaucuugcuauggcagucuaucauggccuuguacuuuaccugcucuaaaacuguagaagacgaucucauuaagaaaccuugcuucuuuucagugucuagagacucagaggcuccaugugaguguugcugcaagauugagcacuguuuuagaagacaauuagggaguaaacauuaacauuuuauuauauuuguguguguguguguguguguguguguaggucaaaguacagcuuguaggaauuggcauuuuccuuuccaacacauguauggguccuggggaucaaacucaggucaucagguuuggcagcaagugcuguuacccucugagccauccugccagacccgaaaucagucuuuuuaaaagaggauucauuuguuacuaaccgucaucugcugagcgcugauguccagugaaucacuuagcauugucaccugcaaaaggaagccacucuguacuuguuugagcucugcucuuugcgaauacaggaccaagucuuugguggugagagaauuacaugggguucuugagcagauuuuugcugagaaaacgcuagagacuggguguggcuauacugcuucuuacuaugucuucuuguucccccucuucugcuuuauucuauucuguccaucucccauccacguaauggaagcaggugcccgaaguuauguugaccagcaacccucaagaagaaggugacauccccagaagcaacccaccuguggcuuuuacagagguccgccaggcaccugccaucaggauucuuccagcaaccuguggccuggguggccccccaagggaccaggccucagggcccgaugcaagugauagagcugcuggcuccuuccuggaacccacccagcagcagguggaggcugcgugggaaaguggagggggucgaaaggccccuaugguaggggcucugacagaugagcccgccaggggucuggagauugugaguggcuuggaugaguugcuuggugaagacaccauugaccaggaguuggagcagcucuaccugucucaccugagccgcuugagagcuguggcagcggcggguggcggggaaggcacuucccccacucaugcccugggcauacucacagaccgugaccugaucuugaaguggccuggccccgagagggcccugaacagugcucuggccgaggagaucacgcugcacuaugcgcgccugggcuguggcguggagcucaucaaggacacugaagacccagaugacgagggggagggugaagaugggcucuccaucacuccuucuagcccugaagggggcagcccuaaggaaucgccuccagaaauccucucuggagcccgcucugugauagcuacuaugggagauguguggguuccaugggcagagcgcucuagcucuagaugugauagcccagugguucugggaacacagggucaguucacugagaauccagagaaagggaugggcaaggacaccaagucucugcaccugaauaggguaauaguugggaugagcaaguccccuggggaggcugggacggaaagccagauggaggagcuaccuacugagcgggaaagcagcuggguaccuaguucugagaaagagcugccucuaccaguccagcaagagcagaguccugcccuccuuggucccacagggacugaagucugucugucuaguguagccaagccucaugugaacucccaggaagaagaggguggaagccugaaucuugaguccccaaagaggucucccaugccagcggccccugcagaaugugcguguggguuggcuccucagcucugggggcccuugacccaaacuuuggguguacuggcugggcucguuaugguccccguggcuuugaacagcggugugucccuucuggugcuggugcugugccucucucuggccugguucucguaggggcugccgggaggguuagguuccaacagcagguuuccuccucucugggaucuggagauugacagucccucugucaccccagaguguugagaugagacccagggccuguggagugagggacuuugauuuugagagugcuugacuggagagaggccuucccaucucugagcucuccagccagaagcaggcuuccugcaguaguauuuguggaguggaauacaaugguggauggugugagaaauuuuagaauggaaccaggcaugccccccccccaccuacccaacccaagccuguauuuauuuuuguauaauucucuggaugagggagaguggucaugagcuggucuuggggcacaauuacccagagauauauuuauuaacaaccaaccugugcaaccugcuggagcuuuauuuuuaauuuaauuuauauagaguacauauuauuauaugccacaauagagcucuaugagaaaugaugugucuugcugugcuggucuccuguuugggccugaguguauaggguagucacauucuggggaauggcugugguccauguugggagagaagauggccacggccauaccuacugcugccucuucaauguguccuugaggaucuguaucucuuugccuugugguccuaauauaugugguccuuuggucgugcauauuuugucugggagccugugucuguguauaugggugguuucggugggagccgagaggaaggauugguuuuagucaugcggcugaggugguggcuaugcucagcuguagguauggaggcauggauuagcgacaagguuuggaggugacugcagcuuuugacacuagcagggagaccccugaaaccccuaaauggggaaggccccagaaaggaguuaauguacugugaaaaaauuuguaucagguuuguuguccccagacauugcauuucuacuccaaacaggauacccagaagcuuuaaaagaaagguuagauacauuuauugcaugcaaauaaaaacucuuggcauagcaaaauaaaacacaauauauuuauuuacuucccuuuacagcagaacuuuuuaaaaagugauaauuguuuuggugauuuucuucuuuuagcaaggucucagacugacugggaacgcccagucccccugaugcacccugggcgugcacuagcauguauuccuacaggugccacaaacuccuuacaggaacgauuguaggagcuuuuuccauuuuccccauucuuccaauaccccgugccuuucugaaacggcaccaaucuguauuuuuuuccagcaauguuaaaacauccuggugcuguugcugcaacagauaaacccauaugucuucaauggcuuccuggcagcauuugacaguuggucaucucugguccaagccauuucuucacuugguuuccaggaugccacgcucacuguuccucauuucauacugugcccaucaacuagauuugcccaggaacagcccauuggaugaaacacauggaacauuaagugacaguaagaaugccucuugaccaagguacaaaagugacauuuugggagaagacaauggaaguaccuuuaacuaaugaaggacuuaauccuagaauguaugaaaaaugauagaaaagccagggccuacuaggcauacauucaccaaacagaauggugcgcagcaggaagggacgaucuauagcugcaugagcugggggacucucacagcugggaugcugagcaaaaggagccaaagaaaagguuucacaucauuugaaccacuuaaccgaaguuuauaaacaacuaagacgaacacaucaucccaugacagauaauguaaagaaagcaaggagaugaucauaaagucgccaagcauuuccucagugggagagagggcuguggcccagaacuugggaggacaacauccugucauagaguggggaggggcucauggagcccccacaccuucaugaggauguauaugcagcucauuauggguggaaagggagagacauuuucuucaugguguagccaguuauuaaggugucugugauccaucauccaauagugaucccuuuggguguggcuuguggguguacagcucguuuuauuaacuuuuauaaugugcauuagaggcucaguaguuaagaguacuugcugcucuuucagagggccugcggugaguucccaguaucuacaucaaacagcuccaggggauccgaugccucuggccucuguggucaccugcauuuauuuguauaugagacacaugaacacacacacacacacacacacacacacauaucgacacauaauuaaaaaguauuacaucuua

SEQ ID NO: 9357 - RNA, 21695 nt, Mus musculus
augaugucacuguggcucugauugauggcucauguaggcagacaagcauaggggugaucacacagggacuuuaugcucacuacuaggcagagcuguucaggcacacuccaacacauaauagucaccccaacacagcgacaugggcccugacuggauguaaguauaggcacgugaguguuaucacugaucagcuaccuugcccaagaugugcacugauaguuacccugguuucuaccagaucuugucggacacaaaggaacugcagaaggaaaucaacucucucucugggaagcucgaccggacauuugcagugacugaugagcuuguguucaagguauggagcaggcuggccuccgggaggguggaggcgggacugaguuguugccugccccucugugaguccuuuaggugcacuguugcuuggggccuagcuuugcucuguggaggaugaaggcaaaguacuaguaaaggguggucuuauaggggcauagaguaguggaaaagggggaauggcuugcugauaucucggagauccccuuugucuuaucaggaugcuaagaaggaugaugcuguucggaaagccuacaaguaccuagcugcccugcaugaggugaggggagccaugugccugguggguuggcuggagagggccagcauaggugcaagccuuguauucuugcugucuccagaauugcagucagcucauccagaccauugaggacacaggcacuaucaugagggaaguucgagaucuugaggagcaggugagaccugggacugguaaggggaauggagacaggccaggggauaguuccuuguuuugcgcugagagucuuugaaaccagacaacuaacagcuagaggcuuugccuucgugcccacugugccugggaccugaagcuagccaguagccuacucugagcccuggcuuuuagcuugcggcuccuaaugccucccagagcccauggcagaaguugcugcuuuagguggaguggagggaaggacauacccagaagcccagugaugggaaggaacaggcugcuguuacgggaauaggaggagcagggaggaguucaguagaggggcagccugcaggggcugaagaagugugcauccuguuuucuuagauugagacagagaugggcaagaagacuuugagcaaccuggagaagaucugugaggacuaccgagcccuucgccaggagaaugcuggccucuugggccggguccgagaggccuagagcccugauggaugucuccuaaccacaggcaggaauuuggggugcuggagacagugcugaggcaccuguucuagcacucucuuucauuugguauccgcuuucuccugcugggaucuuaaacccagcugucugcuuauauguucccauaucugaucagggugauuguccagcugaccacaguuuauuggaugggcacugggggccaggggccuuggaucccaaauaaaagagaaguucuucugugggccacgcuuaggcauggauuggggcuuguggguagggaacuggggucaguggcaagugagacgugggguacaucuuggagagucgguguguauucauggaacucaggagauagaguggaggggcugcauguguguacgugcacacgagcguguucugacaagcugugucugacuuguauuuugggcauugcuugaggcugcguaugaucaguuaugccugugugguuuggggggauguaauugugaagguuccagugcuguugcuguguaagggucuguauauacaccuaugugugauagugcccgugguuccagauguugugggugagugcuuuggggugugagucaguaggacugcagucaugugugacugcaugacuaacuuugaaaguucacgaauguaccaaggcaggcucuucauguuuuaggguuuggguugaguaaauauuaggauggugucugucaucuuucugcuuggcaguggccaaggcagauauguauagcugguugugagggcucuuugacuggaaaguucaucuuggggcuagguuggaacuaggggcuaggcugggauuggcaccccucucagcuguaaggcagaugauaugaucuaggagggcagcuagauagggagcagaggcccugauagcaggcacaucaucgcccgguuuccauagguacacguaggacuugccuccuugcccccacagccucagucucaugguuuuggcccccucccccgcccaccuuuucuugguuuugaggucaagggcagggauuggagcacuuguuggggcguuggcuccucuucuugcgaaacucaaauucaucuacgguccacacugcucccuucucgcucuccacucgcacaaagcacuugugcaggcucagguuguggcggauggcauucuguggaagggggaccgggaccccagucagggacaggguugacagucauccugagucugagacugaccugcuccuuccccacaugucuagccccaggcuaaccauccuuggagccaucccagcugccaguguguacagaggaacucaccuuccagguggcggggugguuucugaaguaggcgaacaugcgaguaaaccaaugguagauuucauugaguguccucugccucuccggggcuuccaggauggccuggaaguuggagucagguggaauaaggggcauguuccucaggguuguggcugagggagcagccuacucucggcccucugagcuaugauagcuuuguaauugugggucaaggggaaggagaaagaauagggugaggcaugaggucaagggugauguuagagauaggguggacaaaggaaaggguaguuuguaguguuacaguuugcuuugcacugaccuggcuugcaguaguuuuggguugagggcuagaucugaggugaagcuaucaagaaggaucacaucuuggggcuccucagagcugagguuuguuaaugggugaauucugcucuuggugcaauguaggaggcaagcacuccccaccacaacucccccccugccgcccaccagcugcugggccucuauugcccugcuuacccaucggauaaggguggcauaggugaaagggggucgcauauugugguacuugaaguaguccauguuguggaagaacucugcagaagguuggcauagaucagagccuuuggccuccucacccccuaccccaccuuugucugcaucaggaauccaaggucucaauuccuaccacuagcaccaaggggggagggacagucuaugcucacacauaguacuguuuacugaguacccgccguaagcugugucuucuuugcaguacuccugccaaauagcucuccucacuuuaaaaaggagucaaguaauuuguacaucaaaggcauguaagcagcucaaguggcauagccagccugacaccaaauaucuauggucccugguaaacucacaacccaggccugacaggugggagaggguugguuagcuugguugagugcaccugacuuccuggagguggggacggaagagagggcucuuuggacucacuuggccaggcuccucccucauggugacugaaugaaguagcagaugccaaauaggucaggccuggcuccaaucccccaaaacacggggcccaaggcuaugcauuuauaacaguugagggcuucuaagccuaauaaacucaggugcaguuuccucccagcucuuagugggggugaggggggugggggagcuccuuuguacccccuggcacugggguguggacuccacugaccugggaaggaacuauugccauggcuuccccagaggugccuccgcacugcaaacaggccgccgucuggagccucccgaggagcagaccaggccgggagcacacugcccugaguacugguggcuacgaugcagcaagagcucuuguccauugaggccugagggguugggaggggugugguaaucgagacacuuaagcuugucauuucauuguagccuuucaaacauuaguuuguauuuucuuauuaguuaaacuuguuuuuagacaauuuuguacauguauguaauacauacagaccacuuucacccuaucuccucccucaucgcuuaucuuccuucuucucauuccuuucccccuucauccaugucuauuuauuuuggucuuaaaauuauuauugccauuauuauuauuauugacagggucuuacuauguagcccugacuggccugcagcucucagagaugcacuuccucugccuccugaguguuugccuauucauuuucguuuugucugagacagucucacuauauaucucuaguuggccuugcaccuucuagccuaguucuaccucuggagugcuaggauuauaagugugugccaccacaucuggcuuccacuuuuuauuuuauguauauauauauauauauauauauauauuuuuuuuuucuuccagacaggguuucucuguguagucuuggcuguccuggagcucaguguauagaccaggcucuguagaccagacuggcuucgaacucacagagaucugccugcaucugccucccgaguucuaggauuaaaggcgugcgugcgccaccacacugagucuuccauuuuacuuuaaaaaaugauugcuugcuugguuggauauuuauguaggugggcucuugcucuguaguacaggcuagucuaacauguacuauguagcauguaguacaggcuagucuaacauguacuauguagcauguaguacaggcuagucuaacauguacuauguagcacaggaugggcugagauuacugccaagucagcuugcauuuuauuuuagguauacgggaguuuugccugcaugcaugucugggcaucgcaugugugccugguaccuguggaaggcagaaaagugcauuggauccacuggaacuggaguuagagauagcugugagcggcucugagggugcugggaaccaaacucugguccccugaaagagcagcaagcucucuuaaucccugagcuaucuguccaguuccccaaccccacuuuauuuuacaauuugcauuuccugauuuggucauauuucuaucugauuuguaugugugguguguguacacaugcugggauuacagauuuacagugcugcaucuggugugggugcuggcaucuaaacucagguccuuuuucugucagagguguucaagacaggguuucuccguguagcucuggcuguucuggaacuagcuuuauagaccaggcuggcuuccaacucacagagauccaccugccucugccucccaagugcugggaucaaaggcaugcgccgccgccaccaccacccagcaaaacucagguccuuauccuuguauggcaaucacuuuucccucucaaguuucuccccaaccguguuucuuuguguuuuagaagagucagggugucucuguguugaccaggcugguuuugaacuugaggguucaagugcuccuccuucagccucuccaguagccaggacuacaggugcaugccacuguguccaguaaggucaaugcuuuugagaagggcaccacccuauagucaauugcaggcucugguggagcucuguaaagcagcaucuuagaguacaggcaugagcaugcgaugaagccauagaugcuagggcuggggugagcaggggcagaauuggaauccccuagcaccaacugugaaccugggagcaucaacuaaaucuuccugaccuaaguuguccucauuugugcauuaggaugauggugguagcuaccucuguuauaguauaagacucauaucagccugagacuggguaugugaaauguguggucacacacuguucgauguucugagcuuaucuugaaauuugaacauaaggcccuccauuuuccuuuuuugcaguggcccugugaguucacugccuucuguaugugcccugaaaaggcagaaucauaauguuuuggaggucagaagguuuguaagcagaguaggcgugucuuuggaucuggcauauuaauuaggugggaauggucuguacagggcagggcuugcaugugagaagaagacauuugguccuuaugggcuccugucuugccccucagcaguugaagucugcugccucuggacuugggguacucaccacagauggagccuuggccagcgccaucuucccagccaggugggccugcauagcucccagcuucuccuuuuccagcuccagcuguggggauguacaccaaaguggggcuuccaccuggucguucucaggcacacuuuugcccaugccuucccucacaggguccucccucccauccuucuuucccgcagccacaccccgcagccacacccugcaggcauuaccugcugcuccagagacugcaccacuucucucuggaggaggcacugggccuugccuuucucauccaggagaugaucugcuuggcagugccugaguaaggagaagauuccauguagcugaccauggugggucaggccucuuggcuuaguguaucaguuagggacggccuagacccuuugggagauuucucuaugcucagugcucccccccccacccccuugcuugccuuaaacacaugugcuucagcaacucugggcugccaggccugagcuuauuuacccuuugagucuggccaaaaugcugggaugacguuagacaggagguaugcagggguauggcauuucaggugucaggcacagcccaugcaaaggccuggccacgcaaacacgcaccauugccaaaaguuaggggugacuagcaagauacagaaggggagggacagcagauagagagcagagaggcaagagcucuauagucaucuagaggaacagaaauuggaggaucaggaauguguuuugugugaggggaagcgggacaaagcaguuaggcgugugggcucuggaaccuggcugccuguguucauauucaagauucaucacuuagguccugugugagcuugauugacccuuaauucucuguggccuuagauccuucugcguguaacaggaagguaacuaugagcacauaccuuuauuauuaugucucuucauacaugcgagguaaacugggccuagagacccauaacuugcccaagaucacagagccagggagggauggagucugaaucuuuaugauucuuauuaucauccauugagaggauggugaguugagacgugaagccuagacagcagaacucuguggguagggucaggcuacucacuugagaaacucuucuggcuccucgaagaccuucucacaaccaggccacuugcagacuccauuugccagcaguggguaggauccuuggggugcagccaaaagguugcuggggaugggagaauaugggaugucagcagaggaauaggugcagggguggggugaggugugggcaggggccguuucuugccagcccugccaacucaccugucuuuccuggguguacccgagcgugggaaggugcagaguagagcuggcucccuggacacccauuccagacuggccacauugaucccuguggguagagacaggguacuucuggagcugcagguuagacucuacagcuuguuccagaaggccccuccccuuccugagccuugaagacucugucucauaguacucugcuguucccacagucaagggcuucugacauaacagccuaaagaugcccauugguaagugauggcauuuugacugauaauagcgauuugugguuuuuuuugcauucuaugucuucaagguucuaagucugauauuuuuuuuuuuggagguuggaguuuccgugacucuuaagacccuucuauaccuccauagggcuauaauucagaaaaguuuacauugcacaugcucaaagauuagagaacuuggagauacugugaagguguuaccagguggcaggccaggccgggccuugagggagaagaccccaguggcagcagaagguggugggaggcugaucauggcuggguuguccaguggacgcacuuggagcacaggggucugggcaugggcauccacaguggagagcuggggaacacauggaccauggcucagcggggcuuggggcucugcuccacagcuguccucuuuguucccuccucccagccugcuccgauuccauaccugaugcaugaaguguggucuguccuggagaagggccuguagguggggugagggaccuagucgggccccagacggugccaccaugacuaggggcacuguaggcagcuggagagagaagggagaugccaugagaugccaugagccucaucuuaauaguucugugucucauucauuagcucuuuacuaaagucucacacgguagcaacaauggaacuauccaguucacaucaguggaaucugaggcucguggagagugaauguaucaagguccaacaguuucaagggguagagcuggccccaacacuguuaccuucuugggccccagccaucucgucacagugggaugaggauacauggcuauguccauggaaucauaaggucuccuaucgggaugaggauugggagggguggggaaagccuugaaucucugaagccuggagaguggggauuuucuuggcccugcaauaucugcauaagucagacuugccugggacccauaaaccacuuccugugccccagcccccccccccccccccgccacaugccacaguaaaggucgacaccuauaggcccaaguaccccacccugcuuaccccauucugggccccgggccucaccugcagcugggaugguggcaggggguucaaggaagaagaggugugggccccacuucgcaggucccgaccuuggaagggucccccagagccccuggucccuagaaguucugagcccuugggugcagucuuccagcuuggcaagacuccuggggaugggccaagggccaaggaaggagccauaggcuuggcuggccuaggguugggcauuggguucuugucagaggcaggcugcagggauaacaguggaauggagucacaugcauuccagggguggugcaagauagccucauaacuacaccucuggucugucuuacauacauauaugcuacccugacagcaggaacacagauugauggauauauucuacacaugcacauguccagcaccucacuugcuuacauacaccauaccacucugucgugaauguggggugauggggaguugguuugugggacccuccaguacccccugcacucugugcaggccacauagucuuugcugauucuacuggggcuugucuuggacucucuucucaucuuuuuauuccaaugacuugggcauagccucacaagauucaguuggaugcugugagcaggaaggcuccagggaacugugcuagugggaaguguacugcaauagugaggcgagugguguugcugcuaccaaccuggauaacggcagaggagcugcugagaugugacugucuuccaagucucgucugaaggcagagucaggagaaguugccgggagcuuggauggaggagaugagagaaagggucaagaugaugucuagguuuuuggcagaagcagcuacaacaggagcauuacuggagauggaggguagaggauggaggagcagaguauacagugauagucagauguggcuaaaugcaaagguaagcaguagaggcagggaagacuugcagcugaauucaguacugcagagcucagggccacagcaugggucugucuucucuaagcuuucuucugucuuggaauuggcguggcaggugccaggaaaaaaagagggauaggguugcuugauugagggucccugggcgcuccucaaacuagcuccaaucucugccaagcuuggaaguccacuucuucccuuagccauacugcagucuucugauuuccucuucaaagcucuacauggugacccaggucccugugcugagccucacuaccuuacagucccuuaaaaguguggcuuucguuuuucaggauccuauacuuccagucagagagggaaccagaucuugaacugacuauagaauucuacccugauuuuaauuaagaggauagccagguucagaauucuauagucuucucauggccugggaccuccuuuucuuuuuagauaggguuucuuguagucuggaacuccuuauauacccaggcuguccuugaacuccuuguuucugcauucugaguacugggauuauaaaccaccauuucaggcugauacugccucauuuuucucuaggaaguauauauauguacauuuucccugcuguguuugugugugcaugugaauaugucauucuccguucuacuauauacuacauguguugggcauguagcuucugagaacagccugggggaagcacggaaggguuuuggaaggcaauugcaucuucuuugcuaucaugucuggggcuuaucagaguugagagauuuauaugagaaccuagguauuaagacuagugugucacgggcuaaaacauuagcaugaaaagaggagucugggucuguggaagcugagacuggcuuccuagaaccgugaugcgaugagcugaaagacugcaggcaggcagccaugaggugaugcuccuccaagaaagaacagcaaaggaaagcaucagagaugagaaggaggccaggacuuacaggaggaaucaacccugcugacgucuucaucuuggucuuauagccuccagaacgcuaacaugauaauucuaugcuauguaagucccccaguuugugauacuucauuacaguagcucaagcaaaugcggaucagguuuggugaguagaauuuuccacuauauuggcuuaacccauauggcuggaccauggucacuuuugaagugcucuuuauguuuggucagaacuuauaagaaaucuccuccuuaaauacuuguggaacuggugugacugugugaugcaucaguacauucucagaaagaggaccugaauuggauauggucugucuagugguacuagggaccuggagggcugggcuggccagccagcuuccugcacugucuguuggggcguuccuguuugacuguuucuuagaagcuguauggagguuguuucugggacauagaauauguuuuccuaucggggucuacaucugggcccuguugucacaaccugaacuuggccagauuuuucugccauugacgucauggcggccggaugcauugggcuucaucggcaacaaggaggaagagaagggggcagauaaucuaccccacagguuucguuccgagaaguggcuagucuauccuguagccggauaggcccagguagggugaugugggugcuagcggaugugguaggugacguccaucuggcuaccaugcaaaacccaaguucuaucgauucugucuuucuuggaugccagaggggcccaagguuggaugcuuggugaguauuaggcaggccucauggauauugagacccccuugagucuucaaaugcuguaguaacagaaacucagaacuguacgauaucauuucucaaagccaacggauuuuagaaucucaagaacacagacucuguagggugcauggauccaccuucuuacuguguguauugaugucccagagcccaaagaaaugggaaccaccuaaagccaggaagcuuaaaacuccauaaggccucuugcuggcucuggaaugucagccucccucccuccugagcuccauuaugacagaggauuggaaaacccucuacuguccugaucuggggucaggcuuugcccucuugggacaaaggggccuuccuguccaucucugagcccaguuugcccuucuagacugggaagaguaugugauggaggaaggcuggggucuuucuguccuccugucuaauuugggacaguaacaggagccaucuugcaaaguucguacauacagaaugcugagcaagugucuaugacugauaaauggucacuuacauauggcuccagacccgcucuccugggacaacuuuccccaaauuauaacauucuuccagauacagggacaagaggaagaagacauuuggccuggcccucauggaaagagcacaccaccaggcuuuuuggaagggccccagaaugguugucccaaggaaugcaguaugaacucugaggguucauacuuaacugauauuucuccaucguuacuaguguucuuugguccgcuaggacuucugacucauggggcccagaaccucacauagaccagagcuugugagauuuggccccaugcuaugguuauggacuggauccaacucaugaggauguagaagagggaagggcaccucaggucuccuguuaauggccuccuggguccugagagguaaacuaaggccugcaauguggaauugccaaagucaaggucccacugagaauucugagaucugcucuuggauuuaacucugacacaacaucucugugaggccugggggugggggcugcucaucucugagcccaguuugcccuucuagacuggggagggaagaguacgagguggaggaaggccagcaucuuucugucucguggcugggguaaaucuuauggagcuauauagccguauguauguaugguaugguaugagauauauauauugauauauauauauauauauauauauauauauauauauauauauauauauauauugagauauauauauauauaucauaugugugugaauacagauauagaagagauacagauagagaaauauauagagagaaacaugagauggaauaggaaucaagcucauagagagagacagugagagcaguuuagaggaaaagugacagagaaagaaugaacaagacagagacauauacagacagacagacaugcagagacagagagagagggagugagagaaaggacugaaaauaaucacuggccucuggcuggaggacugaugcugcuaggugccagagacacccauggcugguauugaauuguuuugcaaagcaacaucagaaaaauagugugggcuuuguacaagaauaaacacuaaggagcagauuagaguagaaaaccguggcagagacccaugcacagagggaauggaauuugugaugaacacaacauuucaacaugaggaacagugcaggacagauuaacaaaugauucugagacaauuaggggaaaauaaagugacuggguagauagcccacuuucccaccaauaccucccugcccacuugaaaugucgcugucaucagacgcucuagaauaauuuccagacccacuagagagauacguuuuaaugucuaucauuguuguuuggccuugugcugagcaccuaccaucauuaauaaaaauaauccucagaaagauccucugagguagguacuguuauaaucaucacaguacauacgaggaaauggagguacagagagguuaagagccuggguaaaauucacacagaugacuugaguugaggcuagguuguuccagacagucuggcucccauacccacacuuuugaccucugcaguaaauggaaaaaaugaagccauaaaggagacuggaagccaacauggggugaacaguuaucucauuuucaagugcaaaagacuuaaaacacaaaaccauacacagaagccccacaagaaaagaguaaucuaaagaccuaaaagacacaugcauuacaaagcacaauaaauagggaaaaaaagcaagugauugcccgccguggugguguaugucuucuaucccacuucucagaaggcagaggcagauggaugggucuuugugaguuugaggucagccuggucuauacagugaguuuuaggccagucagggcuauagagugagaccuugucucagaagaccccccccccccauacaaauagggcuggagagauggcuccauggguaagagcacugcugcucuuguagaggagguagcuucucauuuucaagugguaaaaggcuuuuaaacacaaaaccauagaaagaagccacauaagcgccagcacccacguaaccaucuguaacuccagucccaugagaucccacaccaucuucuggccucugugggcaccaggcacacauauggugcacaugcaggaagaacaugcaugcucauaaacuaaguaaaugaauacaauuaaaauacacauacacacaaaugaugaauuucagggaaauaugugucauauacauauagccaauaguuauuauccuuucuaaauuaagagcuauuagcaauuuugaaaaaucaugagcaauuuaguaggaugaagaaugugaucauaaaacucuagccuacagagcacaaauggucaguggucauuaaaaguaaccaaaaugcaaaauuuuaauacuugucauuuuucuuaugauggggaaggauuaaaaaugguaacacacaccuaaaauuaacuugaauagaaacaacagaaaauaagacaacguuuuggaaaagcaauuuguagagagggcaaaaccccuuaagauguacaccccuucuuccccagcuacuccauuuucaggauccauggagucagguauggaguuuuagaaucagaagaaacccaaauaucccaccaucagcacuuaauucagguaaucaaauucauggugaugugaggacagucacggcagacauaaaagaucacguguucguuauuuuaguaugcuacaaaaaugguaucgcuugaacagagcagaaacaaauccaaucuauagcacgauucuaauuuguuuaaaaaugcuaauagcaaacagugagaacucaccauauaccaggcacagugccacagcacuaaaccugcagagaccagcucacccucguccugaacugccugcucuccuugcacauggauucugcucacagucauauaguccuuugcuaaacuguggcugacugaggguguuaucuugcgugacacaagcagaaggucaguuaaaugcuaagacugaccugacagcucacaaaccuaagacacacagaacuaaugcccguucuuggaaaacagagcucuuaagccauuauuauuaagcgccaguuguguacaaauaucugcgcucaauaccgggugcaaaagcagcugaaggaagaugagccgagagucagagagcgggaggaaagaaagggacuguggcuggccaggcuggaagagacagacaggcauauagucagagccugggaaagagacagagacugggcacugauggaaggcagagacaggcaaagaagcagggggagacaggagaagaaauggaagacagcaggaggaaaagaaacaagagaugcacuucuaguuucuaguuauagcuggacagcaucuugaguugccuaaagcuccggcauuccuggagaccagcaguugauagacauauguuaaaaaaaaauccuguuuaucugugcaucaaacaaucaaaguacuucuuuuugccccugucuaaggaccaacugcuccaccuaucuggcauuuaggaugaaugguauuaguuuccaaaguccuuaccuggaguggcuggguguuuccagcuguacuggugggcuccugacacccacccucaauaccucucugccacuuucgccagcagagcugugucuggugggggagagcagggacacucgcucaccuuggugaaguggacugcuagagggggaucagccuggcuugugggaaacugccacauuaucaaaaacaacuuugcuuuuauaccgagaagaaaaaccacggcguggaagccgcagaccucgcucuucuaauaauccaauuuuuuuuugaugagugugugugcugauaauugcagggugggggggggguucuuguaguuuuuuuuucuuugcucucuuacuuuguuuauucuuuucuuaugagacuuaaacggaaauuuugaaauuuuggguuuuuucuuugcccuuuacaagucaucugaaaauaugauuucuuccccucaccacagagguaaaagguaucaaugagauaacagggcucaugagaaaccacaauuucuuaaacaaaaguguguagagucagaaaaaaaaaacugagggaaaauaagucaaaucacaaaggcaucccgaggcagguagagacagcauuguguuugugagacguuggaggaucgcuggguugaacagaagaagggaucugaagccugccaugugaaugggaagcagccaggggagaggugggguagugcucugucuccagaggcuuccuucugcuccaaaccucaguauuuccuuagcaagcaugcauaugaucaccaccaucauguugccaaggcuuggcagagcuggccacuccuguagccuuucuuuccacagaaggcaagaggcauggaaagcaauucauggagaaaaaagugggcuguacuccccccacaaauucacagaaucagagagucucagaauggcuggcucccagaagcugcugcgagucucugagugagccccacaucauguuugugcugagugcccugacccagcagccacccaccugggaacagccccaguggcuguuaaugcagccagcaucaccaagaagggcaaggggaagaaaggcuggccauugcagcucagugccagagugcuuguuuaacacgcacaaggcucuggguuguuaaaacaaacaaacaaaaaaaccauacacauagcggcccaggguccuaguccugucaggaacaauauagccauagccugaugauucuaaacuuuguaacagucuacucugaaaaguuccaguuucauccaguaucacauaccaguaaucccagcaccccagaaacugaggcagaagaaucaagaguuuaagguugcuuggggcuauauagccagauuccguguaaaaagaaaaagaaaaaaacaaaaaacacaaaaaaacaaaaacaaaaaaccaaaaccacaaacaaaaggaaagaaacacucccguuugcaaagguuuaggauucuaaacagcugucauaauuuugguagccaacauuuaacuagaauuuucuacauuccagacagagccaaacacuucucacccucugagguccaucucaucauggcuguauuguuuuuagaccgaugggcaaaauggaggugcagcuugcuuaagaucacaauuuugggaaauagggguccuuagcauugggcucugaagugaccaguuuuccugaagccaacagugucauagaaguucuaggacuuggagacuccucuggaacuugauguuugugagguuuuaagguuuguauucaagaucuggcagcugcguguccucgauuuggcacagaccggcucccuguaaccacuguuuacuacagacgagccuccacagaguuuuuccugacaaggcacggcuaaggcuuccagccuuuggugcccuggcauccugcagagagcuaagaguuccagguauccaacugcauggccaccaccaccucuuugcaagacuggcuucaggccugaggaagagaaaguagaaauacguuuuuauucacaugaugcuaaccuaguaaacaauucccacacuccuuugcucuuucccucauuugcacuuuuugucccuuucggcuaucuucugagcaccuccccccgccccaacaacaacaacaaaaaagagacugacuuuccucaucuuaacucaccuuuuuggaaauaacaagacuggaacugauggcuuggcuuuauaaagacaagaggggaaaacaaagugaauagaaaaaaaaaagacccaaaaauaccagccaacaacaacaacaauuaaaaaaaaaaaacccucaacccuuccuaucauuaguucaaagcaaaacuuucacugguuggggcuucuaaguuggugggacacaucuaagaccaaacauggccuguguggugccuggaagccgggggagguccugaguugagagggagggaggggcagaggugggaugagguccucuuacuuuggaggucugcauggaucuuaggagcuuaacaguugugguugugugugggagggaauaggggaggggugaagagcauaccuaacagguaaugggcagcugacuguagcuaugccccaaaguuaauggucccugcucccuguacacuugggcccaacuagucccuguaucuucuaugucucugagacaguucuaguccccugcccugucaccugucucuuuuuggaauagguacucauuuucucaggguccaugguuuggucugcaucuuccuuuauauccucgucaccaucuuccugccauucugcgaaaacuuggucagagagguggcaggauaaguaaaugagggguaagugacacagguuuccaggaggcuauuugaauggggcugugggugcgggaguguuaagguuacugaaguguaaagcuagggucuuugcagcaugguggcuaggguuuugcuugucagagggugguauuuccucuccaccauuacuauauuggcucauguagguuccuggggaagcaaacugggagggcuaggaguugauggugaauggggcaggauuuaacaggucagggggagcauucccagggaaagggaucuuugacaaagagcaggcauagaugaagaagagagugauggggagaucugcagauccaggagagaagggucaguguggguguccugaggugagugugcuggauauguacagggucagcaaggagucuugugugguuggagugacaugacuggaagggagagaacaggaggaaggucagacggggcuagcuggcuugugcgcuuacgacauggugaagguuggcucuuccucuuaguguagaggaagccagaggguguugggagcagaggagagacauugcuguuaggacuuaagaggaugucuuagauggcugaauauggaauaggggguagaacaugggauggagaccaaccagggggaggugacuacaguaguccaggggacugggacuggugcugguccuguugauggagugguagugaaaagguggauuugggauuuaaaaaaaaugaugcuagagauggggcccaugcacuuucuaggaagugguuuuuaccgcugagcuacacuuaacccuuuuuauuuuuuagacaaggucacacuuguagccuaggcuuggaauuccgugauucuccugccucagccccuugagugcugggauuacaggcauacaucaccauauccugcuuggaaaaugcguuggguagauaaccugcaggauuugcugaagaaugagacucugaggcaagaccggggcacaguugauacccaaaaugggcagauaggauggaguccugagagcacuugcugccuugaacuuucagaugagaaaaaaaaguucuaccuucauuaugccauuauucuucugcuacuuguagcuggacauauuccuuucaugacccuggacacagacaggaggagcagagagacugugggggccuuccuguuaggggucuuaugaggguuagauaaaagcacucccugaaccuggcauauggcaaacacuaagucuuacuaaguuaguaaaugggagugggggauaugugaaugaacacgauggcaaaguccaggucauucccauaggaggugccaucucagagggagaauggaaagaauucacuagaugaaagaaacagaugggacagcacucuaagcagaggagauugggaaagugggggggggggagaagaaagccacuguggggugcaaagugucaaaaugagcaagaagggcaggacucugauuugaauguacauuagcugauaagcuugugaugacauacuaucagucaaugugugcuaagugugaguuggaaaaagcuaauucuuccaaaaagguucuauuuccuauuuugcgauugauucaugcaauagugccaaguccugaagaacaucaaugcucaacuggggacuuuaaggaacaguuaagaacguucauggcuaguugcauuggucacaauaaggcugggagguguguguggugguguggggccagcaggacacacccaguaacugauagaacuguuuugcuuuggucucacaauccggugcagucugggcuuuuaggggcucuggguauucguggagccauggggagucauggaagauuagggaaagguaaagccauuccccagagguccgaucuuacugguugaaugaauucugauucugcgcucaaucacucaauagcucaggcucagccuaugcaccuucuuccaacucagccuauuuauuggcuacucaugcuuuccuucacagcaccuacacuaccauccguggguaugaguucccaucuugccuccaaaguuuccuucuggcuacauuucucuaguuucagcuuugguuaaucccauacuggcacuguccuuugagauauaacagccuucacccuggauccccauuucuuucucgcucccaccuucacuccucacaugccuuagugcucccccccccccccgcccgcuacagccccgccuccaugucugcucacacacagccuucccgucucuguucagucucuguauuggcuagaucuaccuuguuaccaccucuugaagccauagugugcgcucacuagacuccuccauuggcucauugcaacuauuaucgucauucugucucuacaucauucgcgugcaguucuccauuggcuguucauuuuaucugucuuacgucucaccgccuacgcaaccugcggaucucccaguuuuuggaccucuggguucgcuccccguugcccccauugcuuguagccauuucaucuucccgccgccuaccaugcccuucgugcucagacuuucccacuaauugucauacuccugcugcuacaucuucgggcccgcauuaacccuacucaggccucuccauugauuccguuaucaucccgccuuccaucccgcccacgcgcgggcguccucauugguugcuagcuucuccugcuugucaaucaccuguacgucacucccgcguggcuguccauuggcuguuggccguaccugucucuagcucaccgccuacgcuccacuggagccccaccccccuguucuggcuuucucauuggcugcccgccuuuucaggcccugcccccgccggucccaccgccggugccgucggugccgccgccgccgccgccgauauggcgcgcacggccccuguggagccaccgcugcggcaucccgcgcccccgucgccggcugcgggagagccccgcgccucggcugaggcggcgguggccccgcggagggugcuguucgcugacgaggcccuggggcugccucuggcgcagcuacgccgcuaccggccguggggcgggcccggggcgggcaagauggcggcggcgaccgggcaagauggcggcgguggcggggcugaugaggaagacgauggcgaggauggggaugaaggggaggaggaagaggaggcuuuucccgaucccucuccgccgugccccguucccgcuggcgggggguuuuaccuggugcccacauuuucguugccgcccgcgcugggccgucuggagcgguuggggcgcgugaugguggaguuggaggcgcugcugccgccuccuggagcgguucccggggguuccggggugugggugccugggggacgcccgccaguggugcgcggguuggugcgcgugcugaaccgcuccuucgagaaggcggugcacgugcgggccucacacgacgguugggcuaccuucugcgaccacccagcccgcuaugucccacgcagcccgccuggggcaggagugggaggaacaggagcaggagauccccuccu

SEQ ID NO: 9358 - RNA, 14789 nt, Mus musculus
cagagucucuagccucccgaauggaauggccgcaggcgaguuggggcgggcgaggaguauggggcgggggggagccauggugcgcaggcgcuugcucaaaagauaggcagggugcaaggggcguggcugccgccgacugggcuguuccgacgaucgcgcaccgcccccgccgcuccccgcgcccgcccuugcuaccaggcaccuuccgccccccgcauugcugaugcugcugcuggcagacauggacguggugaaucagguacgcgcuccagcaccguggacagagcccggcgcuugcagaaaucuggguggcuuuggcccucgaacccugagaggugguggcgaggggagcagagauacggucgcuggagcuggggcuggggcuggggcuggggcuaggggucugcagcaggcaaggggaaagggggagguggagaaaaggagugcgcucuuugccgcagcgaaggcuguccucacugccgcagagggggccuccagaugccccaaaagaacugucgaccuggagggggaaaagagagauucgggucuaggaagagggcaaagggguagagaaggggaggggauaaugaaaaaugacucggggggcugcagaugagcuaggaaauagagcgacagaaggugugggggcggggugggggaggguuggcacccgccccucccaaaaagaaugcaccccgguagaugacgacccuuucacccccggagcagaucuagaggaggacgauccaauuuugccucuccaaaaaaccccagacuccucguucucagcgcauguccaguaaacccaugcccccagcucuuucccaccuuaagagaucaccuccgccaucucccucuucuucgucaccucaaaaucggcuuucucccuaaccgguagcgaccccuccccauccccaucuccucagacacaaccaucgucaucugacucaccuuuaccacugcagaccucuccccucugcuguugugacucaccuucagcacuuggugcccccucccccacucuaaugaaccccaucuucuuccacucaaccuuuucuccaaucugacucaccuuuaagcaguucagaccuuccuucgcuaacuagucuggacccccaucuauuuucuacacccaaccuccucugccaugugacucaucaccucacacuucaccacuccugagcccuggggguggggggcugcugagacccugauguuuacuccguccccaaagugucguuuuucuccuccucacucccucuccauaugucacccacucccggagggucacauguccuauccccagggaucauugcuuggcagccuggccccucacuuccaucccuauuucccacaccccuuccccuccccacuguuuuucuccucagcugguggcugggggucaguuccggguggucaaggagccccuuggcuucgugaaggugcugcagugggugagugugguccgggcuauaggugggggaaguacagggggagauggugguggugaugggcuccagcaaaacagaggggugaggcaggaggcguccuacugaacugguggguggaacgacagggguggaaggagaugagggaauugggcuccagaguaaggucccagggauuuaaggacagggaacagaaggcuaugacgucacauaaggccguggguaccccuguugugaagugacagagugugacguucuaccuccucucuugaacuaaaggaggaaaggaugggagguggagccugaagcccugacugcugaaagagagaugcaaaaccagaaaaauccagagacagccaaggagacagaguaugagaggcaggggacggugguaauggcagugcugaguaaaagaaaugagagccagggagcugcucucagagcaggaaaauguguaggggaaagaaaggcacacacagauauaaggaaucucaaaagagaaaacagaaggcaacagacagaaggcacaagggagccagagaaccagagagaccuugugaaagacuuaacagacagacaagcagggcaagaaacaggcgcgggagggagagggagagagagagagaggggagagagagagagagagagagagagagagagagagaggagagaggagagagagagagagaggagagaggagagagagagagagagagagagagagagaggagagaggagagagagagagagaggagagagagagaggggggggagagaggagagagauuaauggggaaaguguguaugagagagguggagagcaugcauaaaaacacacagauacugagagacagagauauagugaucaugagagaaaggggaggggagaggagagaaaacgaauagaggaaagaggaggaaaggcgaggcggaggggagggaaggagaagccagagcaccuagagguaaaaaaacggagagacacagggaaagagaaacagccacaccccuguaaucagcuugugcuaggacccgaugagcccugauuagagggguggggguggggaccucuccaucugcuacugucugugcugcccccccucaaucuguccagaggagggcacucccucccacaugcauacaggcucacuacagccauccaccucccugcuacccaaggucuuugccaucuucgccuuugcuacgugcggcagcuacaccggagagcuucggcugagcguggagugugccaacaagacggagagugcccucaacaucgaagucgaauuugaguacccauucaggugugccccugcccugguauccugagaccugggagaggcaggggcagggugggucagagcaguucuucccagaguccuuugcacagcucacaccuuugaggccaccgccccugggauuacuucccgugcaccgaacacuuugcuguguagcuggcacagcucuggcuucuaugacaauuggugugcaagcuagacacagggugucauccugucugacuauauucuggcaaaggguaguaauagaggacaggaaauaaguaagauucauaaguaaaugacagggcugggguuggagucugugguagagagauugcacagcaauggguucggggggugggggaucauggaugagagagcaucaccuuaaagcaguaaaugcucaauuaauauuagucacucggcacaauggcaaguucuuguaaucccagcacuugggagacuaugccagaauuguagugaguuccaggccacccuuggauacaaagugagauccuaucucaaacuaaagagggugcucugcagauaaaggcacuugccacugagccugacaaccugaguuugaucccuaugucacaugugguacaaagaacagacuucccugcaaauuuuucucugaccuccacacaugagcugugacauacaugcaccuacauacacacagguaugcacccauuaaauacauaaaaugcaaucuuuaaaaaaaacgcuuuaaaauaauauuaauuaacaucauuuacuucucaaacagaccaaguucccucuccucauagcucuacaucagaacaaagaggauaacugcagauacagauaaauacuagaagcauaucuucaugcaggaguuuugcuagaaaacaaugaggguacuauauagaugugggaaaucaagggaccaaauuagaugucccugaaaguuccccaccauguaccaggcacuaugcuaaguacuagguauacaugaguaaggacaaacugcaagagucacuaucuccuaaggaugaggagacagacccaugguuucacuuagcuuuccuugacuaccagacuaaaucauauaacaguuagggucuuaacguccucauuuguaaacagagaaaauacugaugcccuccaggugacggaacauugccacuaaggugacacuuguaaagcacuuggugccaagucugggacacgagaagugcucggcauaagcuuguuaaguauaagaauucagauuuagggaagaguuggaaucugggacuuggggaacaccaaggauuaaacggaggcccagaaugucgcacacuagggagaggaaagccagcucaagcuaugagcagugauagaaacaggaaauaauagaggagaacagccaggaguauccagguucacacaagccaggaagaaaagaguuuggaaacugaggguauagcucaguggcaaagcaccugucuagcaugcccuggguuguacccccaguacuuuggaggaggacaaacacacacacacacacacacacacacacacacacacacaguggggagugaaggguaaucagcagcaugagagccagccuuuugagaauucacaaggucacaaaagccuuccaugaacucccccuagaaccuuccaugcucagaaccauugcuaugcaaggacaucaaccugaggccagagcuaggggccccagaccaguuccauucugcccacacaugagcccccccaucacagcacagggaaggaaggccauugucuuugaguaccaucccagacugucccucacacauccugaucccuccuaucccuucuguccuuuccuauuucacagcuguuuggcuucucugccacgcaugcaucugucuucucucucaggcaccuaaagcaugacauagaaaacagccaacaugauuuaggagggcacaggaugcauacagaaguucuguccuuucucuacuagcugcaugacuucauacaagcaaaugcacuucucugaaccucuuccuaucucugaacauuucacccccaaagccacugcgcgagaagccggcaugauuccagauccuugggaucugucaguaaaagaaaaaaaaaauaggaauaaggccuaccuccucauagguacagaaaaaaaaaagcaaaaagcaagaugaaaagacaaauccuagggcugaggagauagcucugucaguaaaguguuugccucacaggugugaggacuugaacuuggagcacagagcccacuuaaacaaagcccaacgugguggcccaugcuagacuccaugccagccagcucagcaagcucuaagccagagagagacccuguuucaaaagaggggggauggaaccugaggaacaagacacgagguuaaacucuggcugucacaaagcggugcaaccucguacaccccaacauaugugcaccugcacacacgugcacauucacucacacauggauaagaaaucuuuccuuuaaagugaaaugcagaaagucuuugaugagaagcugauaguuaagcaaagucugaaggggcugaaagaauaaggcaugaaagcuaucuuaaggaagagcacccgucccuacacuugaucuuagccaaaaggcugaaaaacaaugagggaagaauauuccuguuaaagaggucagccagugcaaaggcccuaagcuagagagauaccugucacuuucuacagugaacucagaggcaggaguaccugggcugcagugagggaggggugccacagauauuaccaggaugcuuucggcaaucaaugguacauugcaagugcucugugaauggccauuuccuccuuuuccugggaccucaaaacagucugggaugcucuuggccaggaaggugagaaagggauuccggaccacaccugaacaccucucucugcaggcugcaccaaguguacuuugaugcacccuccugcguuaaagggggcacuaccaagaucuuccuaguuggugacuacuccuccucggcugaauucuuugucaccguggcuguguuugccuuccucuacuccaugggggcccuggccaccuacaucuuccugcagaacaaguaccgagagaacaacaaagggccaaugauggugaguccccacagcugauugcaugcagugaccaaggacaugaggccgcaggggcccagcucauuuggcucacaggccaaacagacucccagacaagccccauacccaagcagcccaacgcugaugcugcugcugcuguugcugcugcucucuccaagacuccauccacacugggcaucauagaaucaugggggacauacccagagcccacacagaaugccagacuggcccacguaccuaaccguaccaccaucucucacacgaccacacagacuagaugaaaagaaggaguaccgagguucacugugacagucaugcaugucacccugccacacagacaccgaguccuacacagagagguucucacacccucaucccagacaucaaaugacacauauucccacaugcaaauaaaagugguaagacacacuucucacagauucagaaacaucccacggaguuaguuccucccucaacgucugcacccacgcaucacuagcacacucccucuguaucauagacacucacagacacucaagcugagaccuucaggugaaaaucuaauaagccucagagcugcaaaggcagaaaagaggcgagccucuucuaaaugaccccuuccacaaaggcuuggggucuguaggggcucaaggcucagcagaaagccgugcguucacuauaacaucuuccucaugccucccugccuaggacuuccuggccacagcaguguucgcuuucauguggcuaguuagcucauccgccugggccaaaggccuguccgaugugaagauggccacugacccagagaacauuaucaaggagaugccuaugugccgccagacaggaaacacaugcaaggaacugagggacccugugacuucaggacucaacaccucggugguaagcccugggaagcuggccgggcuggaagagaaaagcugggagacacagucuggcaugggaaacgggggagagagagagaaugggaggagagucaggagguugguccaugagggcucccuggaagaggcacaccaacaaaagaagguugaacaauuauaaccacugggauaccacauaucuguucccaguaggagaacaugaggucuuucagauuaggcggggauaacugggcccagcccagucaugccaaagcugcugaaauucaguauccuuuuagaauugauuuccuuacaugcaaaagaacaagaucuugaaauguuuucuuacuugggcgcccccuagcggcuaaaaacagucugaccauagauccugucacguggcaagcucugugaccuacagcuaguaacaagccuuucagguaucauuuugaacaugcaaacugaaggcugaugauagguccugcuccaaacaugaguauccacugaauucacagcacguacacacacacacacacacacacacacacaaacccaacacaaaacuacauccuauaucaauguuacagaugcuaagauuugaagucuuuuuuuuuuccugcuacuugcugauuguguaaucuuggguaauuuagccugucugaacucggcuuuuaaauggacauaacaagggcuggagagguggcugaacagcuaaguaguacacacuuguaguuccagcacuggggaggcagaagcaauccgaucugaguucgaggccagccugggcuacaaagcuauuuccgggacagccagggcuacaaaaagaaacccugucuggggugggagcuaggaagggacagcaccuccugaccaugcagaggacccauguucaauuuguaacauccauaauucuacucccaagggauuuaugggcaugcagugauauacaugcaugcaugugggcaaaaugcuuacagucauaaagcaaaaccuuaagaucauuuuaaacacaaaauaaaauggagguauuagcccaaguguggugguacaggccuauaguucuagcacgugggagccugaggcaggaagacugcuaagagauugaggccacucuggcuauauagugugaguuguaggacaucugaggcuacagaggccuugucucaaaaauagaaaaauaaacuaaauaugcuaaaaaaauaaauagaacggggauaucaacuggagguagugguauaggucuauagucucugcuacucagcaaguacaggcggaagaucaaucacauaagcccaggaguucugggccagccugggcaacauuucaagauugugucaaaacaaacagaauaaaauguaggucuuacuuucuguccaaacauggauugauugauugauuuuuauuuuuuacuuuuuuuauuauuauuauuuuuuguuuuucugacacagaauuucucuguguagcccaggcuguucuggaacuugcucuguagaucaccacuaaccagcuuaaaccuggaacuuuaaggaaacuuaaggugcucagaagaggguguaacauguacuaaauggcauauagaauuuugcuuuuaaguauuucauauaagcuccauauuuauuuguaauuuuuaauuguuuuuaaaaaauaacauauacuuagcugggcacaugguagcacaugccuuuaauuccagcacuugggaggcagagacugguggaucucugagaguuugaggccagccugguguacaaaaagaguuccaggucaaccagggcugcagagugagacccugucuaaaaaaauaaaagaaaagaaagaaaagaaaagcauauacuuagagccaaggauguuaauauaugccuguaaaccuagcacuuaaaagacuacuuuuaaaaauacuuauuauuuuuauuuuauguguaugaauguuuugcuuauaugagucacuugcauucuuggugccuguggagguaaaggaagggugucagauauccugaaacuagaauuacagguguuugugagccaccauguaggugcuggucauuaaacuuagauucuaaccucugugccauuacucuaugcccagggcuaauuuaaagccagauuggccuagguaguaaacuccaggucauccuuggauaaaaggcaagaccgucucaaaaacaaacaaaacaaauaaaaaucuauuuaaaaagaaaagaaaaagacgggcuagagggaugacuccaugguuaagagcacuuaccccucuuccugaggacaggcguucaaguccuagaacccuuuaaucccaucacuuggaaggcagaggccagccuggucuacacagugaauuccaggacugccaagcuacauaguaaaacccgugucucaagguauauacacacacaccacuugagaagcagaagcauguagauuucugugaauuugaggcuagccucuucuacauaaggaguuccaggacagccaggaccuggaacauaaaaagacccugucucaaaagacaaccaaaaaaaauuuauacauguacauaugcaucuaugugcuaaguuguauauacauaaguuuauauaugcaucaaugagugaugucuguuucuuuaaaauguauauuuauauauuuuauaaauuuaaauuuauauuuuguauauguauaaacauguacucaaauauauuuuuaaaauuagggucuuuuugguuugguugggugguuuguuuuggguuuuuuuguuugguugguuaguuaguugguugguuuugguuuugguuuuguuugagacaggaucuacuuaugugacccuggcuguccuggaacucacuacucagaccagacuggccucaaacucacagaccucugcuugccucugccuccugaguacuaagaugaagacugcaccaccacacccagcccaaaaaugaguuguuugaggcugacuuucauguugcacaggcuagccucaaacuaugaauuuaaagguagacuugaauuucuggguaguggaggcagagacaggcgacuucuaugaguuccaggccagccuggucuacagagugaauuccaggacagccagggcugcagagagacccugucucaaaaaaaaaaagcuagccuugaagugaucgccccugccuccagcuuccuaagauuacaagaugugggccuucagacuuguccauguaaacacugauagaaguugaacaucaugggaaucuaacacacacacacacacucccaaguuuuucuguacacugauagucauagaggcccacgaauuuaugcccuaaaaaugcccauuccuguucacucagccucaaagacccuggggcugccgaggcaauggguaagagacaacagcuuuggucaugucucccugcagguguuuggcuuccugaaccuggugcucuggguuggcaaccuaugguucguguucaaggagacaggcugggccgccccauucaugcgcgcaccuccaggcgccccagaaaagcaaccagcuccuggcgaugccuacggcgaugcgggcuaugggcagggccccggaggcuaugggccccaggacuccuacgggccucagggugguuaucaacccgauuacgggcagccagccagcggcgguggcgguggcuacgggccucagggcgacuaugggcagcaaggcuacggccaacagggugcgcccaccuccuucuccaaucagauguaaucuggugagugacaacugggcggaugcgguaggcagggagcauacaaggagugaaguuugaaggaaccaauagauaggcagaaccaaaaaaaaaaaaaggugaacuugguaaaacuagccaaugagaggaaccgugagaaggaaggggacggagcagugcucagaguaaccaaugaaaggaguguaggggcacuugcgcaguggagaaucaccaaagugguguagguuuccaggaagggaaggggaggagggucuuugaaaucauugguaaaccaauaggcgguaacgccaguagguggaagaagguaaacacguuggguuuugaagggcgcuagcgcuaaagcaggauguaggucagcugcuaccucuccuuaacccuuuaaugaaagagagaguuuggaauuucaaaugaggaaaaggggagggcuggaggccuuagaaacacgaguaugccuuuuuguugggccuuuaaaaaaugaaugccgccggacgguggaggcgcacgccuuuaaucccagcacuugggaggcagaagcaggcggaguuuuugaguucgaggccagccuggucuacaaagugaguuccaggacagccagggcuauacagagaaacccugucgcgaaaaaaaaaaaaaaaaaaaaacccugccuggugugauggagcacauauauaaucccagcacuugagagguagaggcauggggauugcaaguucucgaguccugcguggucaguauagcccaauccugucuuaaacagagacgguaacagcaucuaggugggagcagaugugguccugggugagccuucuacagcaacccacauuuaauuguuuuuaaacuccuuggacaggcucugagacacaccuuuaagcacagcucugggggaauuagagacaggccuaggucucuuguuuugcaaagcaauuuccaggcugcuuggagacccugugugugugugggggggggggggggauuccaguccuguugguuccuauuuucaaaaucucuccagccuuuuccuuuuuuucacaauuaucuuccuuagagugcuucccaagugccugucuucuauccuguuuacaaccccuucuaccacccacccagcagccucaaggauucugcugggccacuggccuagauucagaagucacuguccuucccucacugucuguuguagcaucucacuuaaaagcaaaaacgauguuagugugcgcccaggcccaccaaugcagcacugcccuaucuuccccacagacagaaugugaccuucgccuccuagcauuguuucgggcaaacuggcccgggccaggucuaggugcacugcagggccuuugcuuuugcuuucuacauacacaccuuucccuagccauugcuuuggucacucacucaaugagguuuuuugcuggcuggcuggcugucgggagaguugcuuuguuuuacaaguacugagacuugaauucuugcacacuaagcaagugcucuaacacugccucuuuuuacuucuuuuuuguuuguuuuguuuuuccgagacagaguuucucuguguagcccuggcuguccuggaacucacucuguagaccaggcuggccucgaacucagaaauccagcugccucugccucccgagugcugggauuaaaggcgugcgccaccacugcccagucucuuucuacuucuuauuuugagacagaguuuacuaaauugcccagaucaauuuggaacucauccuauaacccaggugggcugugaauuugcaguacucuugucuccaucucccauguggcuggaacucauagguuugcacccaccagcacaccugacuuaguuguugauaguauuuuugagacaagaucuccuguagccaaggcuggccuggagcuccuuaggucacuaaagcugaucuugacuucccgacagugccucuaccucccuguuuugcuuugguuugaguuaggguccgauuauggaaccaaagcuggccuugaacuuguuuuccuccugcuucugccuccuaaauuuuggcacggguauauaccaccagcuacauaucaaagguugucugucuaaaacaccuccgcuuguuaucucucgcaucauacccuauguuuuuccuucucacaauuuguaauuuacuaauuugugguucauauauuacacuagauuggagaucuaagacucauucgugcuacccauauaucacuuagaguacuuuuuuuuuuuuauucuuuuauuuaaucguaaguucaaauguccauggaguccagaagaaaggucagcuuccuuggugauaaauguacagauuguuguaacccacccaguguggguucugugagugaaauguggguccuccagaagagcagcacacauucuuaacuccugagucaucucuacaggcucacuuagggauuuuuuuucuuuuuuuuuuuuuuuuuuuuugauuuuuuggugacacggucucucuacauagcccuggcuguucgggaacucacuguguagaucaggccggcaucaaacucacagagauccaacucccucugccuccugagugcugguaucaaaggugugcaccaucaugcauggccuauuaucgucuuauauuugauaaucuacuaauaugucauguucauugugaaaccugucuccuuuccugauaugauguaaaccucacagagauagggauuuuuuuuuucucaauguggauuuucaacagugacuagaacgguacugguuaaugggcuauuuugguuaagagaggggaccuuaaccguuccuuugguacccuguuugagcaggguugguaauaucuuccuagugagagcagcuaggauggcgcugacuccagaccuguuggagaagaaaaagccuagcggcccaaucccuuccugaggguacugcccuccucugggagcucagacucugcccucaccuggaccccuucucuuuucucucuacaggucagugaagcccacgaagaccccacgggugggcaagagcucaagagaaggccugccccccuucccauccccauauccuaggucuccaccccucaacccaggagacccugucuuugcuguuuauauauauauauauuauauauaaauaucuauuuaucugucugagcccuaccuucacccacuccuccaugcacuaggggcccaguccugaaugggcuccucccuaccccugaccuugcacuccucagccccuaucgguuccccagcccugucccgugauguaagggggcucuagaaaggggacaggaagggggccagaccuuggcugcauggagugggucgaugugacuuuuucccccuuccuucucucccucugccccuccuaacucuagccuugguuccuccagcaucgccugaacuuaagaagcucucaaauggaaauucaaccccaagaguagagggguggagguggcuuggaugaaauggguggagaggagauggccucuguagagagaggaccagucagccaaaaguugaauuccacacauacuggauguggagccuaaaagggaagugguguccuacaccauucuggaauggggcuaaaagggacuggggagagggguacuaggagggguguggcuuaaacacaugguggguuccggagugggcagguuuggguuggauccagcaucucuagaaggggugugucuuggaacauucaggaguuugagcuugauuccaaagagcuugagcaaggcuagaagugggauucgggaaugaucuaagcuugagagaagguucuggucaggauugcagacaggcaggugaagaggacgagggauguguggugcucucagaagaggaagcccauucuguaauggggcagaaaagaaaauacgguuucaguugaguggaguuugagcaguggguguaggaggccaugguugggagcugugaggugaguuuugcuaaaaguaggaaggaguacuccugauuccaccccacgccccagaacggacauaaccugggaagagccaaguauugugguuuggagggugagcgaaaugucccuuacugacucccucagaagagggcuagauaaucagaagacagaaucuacaggucuguggggcuggccuaccuucuccacccuuucucugcccucucccuccacacucccgucugucccggagcacugggaggcuggcucuggagccccaauccuggacccucugcugugucugugacguugguagugccugugaucguguguugccauuuugucugacuguggccccucccuuuucccuccagacccccuacuuuccugugcccuucgguauuguuugaagaccccccuccccaaggaagagcaaauaugagaaccccccccaauaaacuccucaacuaucuagucgu

SEQ ID NO: 9359 - RNA, 14789 nt, Mus musculus
acgacuagauaguugaggaguuuauugggggggguucucauauuugcucuuccuuggggaggggggucuucaaacaauaccgaagggcacaggaaaguagggggucuggagggaaaagggaggggccacagucagacaaaauggcaacacacgaucacaggcacuaccaacgucacagacacagcagaggguccaggauuggggcuccagagccagccucccagugcuccgggacagacgggaguguggagggagagggcagagaaaggguggagaagguaggccagccccacagaccuguagauucugucuucugauuaucuagcccucuucugagggagucaguaagggacauuucgcucacccuccaaaccacaauacuuggcucuucccagguuauguccguucuggggcgugggguggaaucaggaguacuccuuccuacuuuuagcaaaacucaccucacagcucccaaccauggccuccuacacccacugcucaaacuccacucaacugaaaccguauuuucuuuucugccccauuacagaaugggcuuccucuucugagagcaccacacaucccucguccucuucaccugccugucugcaauccugaccagaaccuucucucaagcuuagaucauucccgaaucccacuucuagccuugcucaagcucuuuggaaucaagcucaaacuccugaauguuccaagacacaccccuucuagagaugcuggauccaacccaaaccugcccacuccggaacccaccauguguuuaagccacaccccuccuaguaccccucuccccagucccuuuuagccccauuccagaaugguguaggacaccacuucccuuuuaggcuccacauccaguauguguggaauucaacuuuuggcugacugguccucucucuacagaggccaucuccucuccacccauuucauccaagccaccuccaccccucuacucuugggguugaauuuccauuugagagcuucuuaaguucaggcgaugcuggaggaaccaaggcuagaguuaggaggggcagagggagagaaggaagggggaaaaagucacaucgacccacuccaugcagccaaggucuggcccccuuccuguccccuuucuagagcccccuuacaucacgggacagggcuggggaaccgauaggggcugaggagugcaaggucagggguagggaggagcccauucaggacugggccccuagugcauggaggagugggugaagguagggcucagacagauaaauagauauuuauauauaauauauauauauauaaacagcaaagacagggucuccuggguugagggguggagaccuaggauauggggaugggaaggggggcaggccuucucuugagcucuugcccacccguggggucuucgugggcuucacugaccuguagagagaaaagagaagggguccaggugagggcagagucugagcucccagaggagggcaguacccucaggaagggauugggccgcuaggcuuuuucuucuccaacaggucuggagucagcgccauccuagcugcucucacuaggaagauauuaccaacccugcucaaacaggguaccaaaggaacgguuaagguccccucucuuaaccaaaauagcccauuaaccaguaccguucuagucacuguugaaaauccacauugagaaaaaaaaaaucccuaucucugugagguuuacaucauaucaggaaaggagacagguuucacaaugaacaugacauauuaguagauuaucaaauauaagacgauaauaggccaugcaugauggugcacaccuuugauaccagcacucaggaggcagagggaguuggaucucugugaguuugaugccggccugaucuacacagugaguucccgaacagccagggcuauguagagagaccgugucaccaaaaaaucaaaaaaaaaaaaaaaaaaaaagaaaaaaaaucccuaagugagccuguagagaugacucaggaguuaagaaugugugcugcucuucuggaggacccacauuucacucacagaacccacacuggguggguuacaacaaucuguacauuuaucaccaaggaagcugaccuuucuucuggacuccauggacauuugaacuuacgauuaaauaaaagaauaaaaaaaaaaaaguacucuaagugauauauggguagcacgaaugagucuuagaucuccaaucuaguguaauauaugaaccacaaauuaguaaauuacaaauugugagaaggaaaaacauaggguaugaugcgagagauaacaagcggagguguuuuagacagacaaccuuugauauguagcuggugguauauacccgugccaaaauuuaggaggcagaagcaggaggaaaacaaguucaaggccagcuuugguuccauaaucggacccuaacucaaaccaaagcaaaacagggagguagaggcacugucgggaagucaagaucagcuuuagugaccuaaggagcuccaggccagccuuggcuacaggagaucuugucucaaaaauacuaucaacaacuaagucaggugugcuggugggugcaaaccuaugaguuccagccacaugggagauggagacaagaguacugcaaauucacagcccaccuggguuauaggaugaguuccaaauugaucugggcaauuuaguaaacucugucucaaaauaagaaguagaaagagacugggcagugguggcgcacgccuuuaaucccagcacucgggaggcagaggcagcuggauuucugaguucgaggccagccuggucuacagagugaguuccaggacagccagggcuacacagagaaacucugucucggaaaaacaaaacaaacaaaaaagaaguaaaaagaggcaguguuagagcacuugcuuagugugcaagaauucaagucucaguacuuguaaaacaaagcaacucucccgacagccagccagccagcaaaaaaccucauugagugagugaccaaagcaauggcuagggaaagguguguauguagaaagcaaaagcaaaggcccugcagugcaccuagaccuggcccgggccaguuugcccgaaacaaugcuaggaggcgaaggucacauucugucuguggggaagauagggcagugcugcauuggugggccugggcgcacacuaacaucguuuuugcuuuuaagugagaugcuacaacagacagugagggaaggacagugacuucugaaucuaggccaguggcccagcagaauccuugaggcugcugggugggugguagaagggguuguaaacaggauagaagacaggcacuugggaagcacucuaaggaagauaauugugaaaaaaaggaaaaggcuggagagauuuugaaaauaggaaccaacaggacuggaaucccccccccccccccacacacacacagggucuccaagcagccuggaaauugcuuugcaaaacaagagaccuaggccugucucuaauucccccagagcugugcuuaaaggugugucucagagccuguccaaggaguuuaaaaacaauuaaauguggguugcuguagaaggcucacccaggaccacaucugcucccaccuagaugcuguuaccgucucuguuuaagacaggauugggcuauacugaccacgcaggacucgagaacuugcaauccccaugccucuaccucucaagugcugggauuauauaugugcuccaucacaccaggcaggguuuuuuuuuuuuuuuuuuuuucgcgacaggguuucucuguauagcccuggcuguccuggaacucacuuuguagaccaggcuggccucgaacucaaaaacuccgccugcuucugccucccaagugcugggauuaaaggcgugcgccuccaccguccggcggcauucauuuuuuaaaggcccaacaaaaaggcauacucguguuucuaaggccuccagcccuccccuuuuccucauuugaaauuccaaacucucucuuucauuaaaggguuaaggagagguagcagcugaccuacauccugcuuuagcgcuagcgcccuucaaaacccaacguguuuaccuucuuccaccuacuggcguuaccgccuauugguuuaccaaugauuucaaagacccuccuccccuucccuuccuggaaaccuacaccacuuuggugauucuccacugcgcaagugccccuacacuccuuucauugguuacucugagcacugcuccguccccuuccuucucacgguuccucucauuggcuaguuuuaccaaguucaccuuuuuuuuuuuuugguucugccuaucuauugguuccuucaaacuucacuccuuguaugcucccugccuaccgcauccgcccaguugucacucaccagauuacaucugauuggagaaggaggugggcgcacccuguuggccguagccuugcugcccauagucgcccugaggcccguagccaccgccaccgccgcuggcuggcugcccguaaucggguugauaaccacccugaggcccguaggaguccuggggcccauagccuccggggcccugcccauagcccgcaucgccguaggcaucgccaggagcugguugcuuuucuggggcgccuggaggugcgcgcaugaauggggcggcccagccugucuccuugaacacgaaccauagguugccaacccagagcaccagguucaggaagccaaacaccugcagggagacaugaccaaagcuguugucucuuacccauugccucggcagccccagggucuuugaggcugagugaacaggaaugggcauuuuuagggcauaaauucgugggccucuaugacuaucaguguacagaaaaacuugggaguguguguguguguguuagauucccaugauguucaacuucuaucaguguuuacauggacaagucugaaggcccacaucuuguaaucuuaggaagcuggaggcaggggcgaucacuucaaggcuagcuuuuuuuuuuugagacagggucucucugcagcccuggcuguccuggaauucacucuguagaccaggcuggccuggaacucauagaagucgccugucucugccuccacuacccagaaauucaagucuaccuuuaaauucauaguuugaggcuagccugugcaacaugaaagucagccucaaacaacucauuuuugggcugggugugguggugcagucuucaucuuaguacucaggaggcagaggcaagcagaggucugugaguuugaggccagucuggucugaguagugaguuccaggacagccagggucacauaaguagauccugucucaaacaaaaccaaaaccaaaaccaaccaacuaacuaaccaaccaaacaaaaaaacccaaaacaaaccacccaaccaaaccaaaaagacccuaauuuuaaaaauauauuugaguacauguuuauacauauacaaaauauaaauuuaaauuuauaaaauauauaaauauacauuuuaaagaaacagacaucacucauugaugcauauauaaacuuauguauauacaacuuagcacauagaugcauauguacauguauaaauuuuuuuugguugucuuuugagacagggucuuuuuauguuccagguccuggcuguccuggaacuccuuauguagaagaggcuagccucaaauucacagaaaucuacaugcuucugcuucucaagugguguguguguauauaccuugagacacggguuuuacuauguagcuuggcaguccuggaauucacuguguagaccaggcuggccucugccuuccaagugaugggauuaaaggguucuaggacuugaacgccuguccucaggaagagggguaagugcucuuaaccauggagucaucccucuagcccgucuuuuucuuuucuuuuuaaauagauuuuuauuuguuuuguuuguuuuugagacggucuugccuuuuauccaaggaugaccuggaguuuacuaccuaggccaaucuggcuuuaaauuagcccugggcauagaguaauggcacagagguuagaaucuaaguuuaaugaccagcaccuacaugguggcucacaaacaccuguaauucuaguuucaggauaucugacacccuuccuuuaccuccacaggcaccaagaaugcaagugacucauauaagcaaaacauucauacacauaaaauaaaaauaauaaguauuuuuaaaaguagucuuuuaagugcuagguuuacaggcauauauuaacauccuuggcucuaaguauaugcuuuucuuuucuuucuuuucuuuuauuuuuuuagacagggucucacucugcagcccugguugaccuggaacucuuuuuguacaccaggcuggccucaaacucucagagauccaccagucucugccucccaagugcuggaauuaaaggcaugugcuaccaugugcccagcuaaguauauguuauuuuuuaaaaacaauuaaaaauuacaaauaaauauggagcuuauaugaaauacuuaaaagcaaaauucuauaugccauuuaguacauguuacacccucuucugagcaccuuaaguuuccuuaaaguuccagguuuaagcugguuaguggugaucuacagagcaaguuccagaacagccugggcuacacagagaaauucugugucagaaaaacaaaaaauaauaauaauaaaaaaaguaaaaaauaaaaaucaaucaaucaauccauguuuggacagaaaguaagaccuacauuuuauucuguuuguuuugacacaaucuugaaauguugcccaggcuggcccagaacuccugggcuuaugugauugaucuuccgccuguacuugcugaguagcagagacuauagaccuauaccacuaccuccaguugauauccccguucuauuuauuuuuuuagcauauuuaguuuauuuuucuauuuuugagacaaggccucuguagccucagauguccuacaacucacacuauauagccagaguggccucaaucucuuagcagucuuccugccucaggcucccacgugcuagaacuauaggccuguaccaccacacuugggcuaauaccuccauuuuauuuuguguuuaaaaugaucuuaagguuuugcuuuaugacuguaagcauuuugcccacaugcaugcauguauaucacugcaugcccauaaaucccuugggaguagaauuauggauguuacaaauugaacauggguccucugcauggucaggaggugcugucccuuccuagcucccaccccagacaggguuucuuuuuguagcccuggcugucccggaaauagcuuuguagcccaggcuggccucgaacucagaucggauugcuucugccuccccagugcuggaacuacaaguguguacuacuuagcuguucagccaccucuccagcccuuguuauguccauuuaaaagccgaguucagacaggcuaaauuacccaagauuacacaaucagcaaguagcaggaaaaaaaaaagacuucaaaucuuagcaucuguaacauugauauaggauguaguuuuguguuggguuuguguguguguguguguguguguguguguacgugcugugaauucaguggauacucauguuuggagcaggaccuaucaucagccuucaguuugcauguucaaaaugauaccugaaaggcuuguuacuagcuguaggucacagagcuugccacgugacaggaucuauggucagacuguuuuuagccgcuagggggcgcccaaguaagaaaacauuucaagaucuuguucuuuugcauguaaggaaaucaauucuaaaaggauacugaauuucagcagcuuuggcaugacugggcugggcccaguuauccccgccuaaucugaaagaccucauguucuccuacugggaacagauaugugguaucccagugguuauaauuguucaaccuucuuuuguuggugugccucuuccagggagcccucauggaccaaccuccugacucuccucccauucucucucucucccccguuucccaugccagacugugucucccagcuuuucucuuccagcccggccagcuucccagggcuuaccaccgagguguugaguccugaagucacagggucccucaguuccuugcauguguuuccugucuggcggcacauaggcaucuccuugauaauguucucugggucaguggccaucuucacaucggacaggccuuuggcccaggcggaugagcuaacuagccacaugaaagcgaacacugcuguggccaggaaguccuaggcagggaggcaugaggaagauguuauagugaacgcacggcuuucugcugagccuugagccccuacagaccccaagccuuuguggaaggggucauuuagaagaggcucgccucuuuucugccuuugcagcucugaggcuuauuagauuuucaccugaaggucucagcuugagugucugugagugucuaugauacagagggagugugcuagugaugcgugggugcagacguugagggaggaacuaacuccgugggauguuucugaaucugugagaagugugucuuaccacuuuuauuugcaugugggaauaugugucauuugaugucugggaugagggugugagaaccucucuguguaggacucggugucuguguggcagggugacaugcaugacugucacagugaaccucgguacuccuucuuuucaucuagucuguguggucgugugagagauggugguacgguuagguacgugggccagucuggcauucugugugggcucuggguaugucccccaugauucuaugaugcccaguguggauggagucuuggagagagcagcagcaacagcagcagcagcaucagcguugggcugcuuggguauggggcuugucugggagucuguuuggccugugagccaaaugagcugggccccugcggccucauguccuuggucacugcaugcaaucagcuguggggacucaccaucauuggcccuuuguuguucucucgguacuuguucugcaggaagauguagguggccagggcccccauggaguagaggaaggcaaacacagccacggugacaaagaauucagccgaggaggaguagucaccaacuaggaagaucuugguagugcccccuuuaacgcaggagggugcaucaaaguacacuuggugcagccugcagagagagguguucaggugugguccggaaucccuuucucaccuuccuggccaagagcaucccagacuguuuugaggucccaggaaaaggaggaaauggccauucacagagcacuugcaauguaccauugauugccgaaagcauccugguaauaucuguggcaccccucccucacugcagcccagguacuccugccucugaguucacuguagaaagugacagguaucucucuagcuuagggccuuugcacuggcugaccucuuuaacaggaauauucuucccucauuguuuuucagccuuuuggcuaagaucaaguguagggacgggugcucuuccuuaagauagcuuucaugccuuauucuuucagccccuucagacuuugcuuaacuaucagcuucucaucaaagacuuucugcauuucacuuuaaaggaaagauuucuuauccaugugugagugaaugugcacgugugugcaggugcacauauguugggguguacgagguugcaccgcuuugugacagccagaguuuaaccucgugucuuguuccucagguuccauccccccucuuuugaaacagggucucucucuggcuuagagcuugcugagcuggcuggcauggagucuagcaugggccaccacguugggcuuuguuuaagugggcucugugcuccaaguucaaguccucacaccugugaggcaaacacuuuacugacagagcuaucuccucagcccuaggauuugucuuuucaucuugcuuuuugcuuuuuuuuuucuguaccuaugaggagguaggccuuauuccuauuuuuuuuuucuuuuacugacagaucccaaggaucuggaaucaugccggcuucucgcgcaguggcuuugggggugaaauguucagagauaggaagagguucagagaagugcauuugcuuguaugaagucaugcagcuaguagagaaaggacagaacuucuguaugcauccugugcccuccuaaaucauguuggcuguuuucuaugucaugcuuuaggugccugagagagaagacagaugcaugcguggcagagaagccaaacagcugugaaauaggaaaggacagaagggauaggagggaucaggaugugugagggacagucugggaugguacucaaagacaauggccuuccuucccugugcugugaugggggggcucaugugugggcagaauggaacuggucuggggccccuagcucuggccucagguugauguccuugcauagcaaugguucugagcauggaagguucuagggggaguucauggaaggcuuuugugaccuugugaauucucaaaaggcuggcucucaugcugcugauuacccuucacuccccacuguguguguguguguguguguguguguguguguguguguuuguccuccuccaaaguacuggggguacaacccagggcaugcuagacaggugcuuugccacugagcuauacccucaguuuccaaacucuuuucuuccuggcuugugugaaccuggauacuccuggcuguucuccucuauuauuuccuguuucuaucacugcucauagcuugagcuggcuuuccucucccuagugugcgacauucugggccuccguuuaauccuugguguuccccaagucccagauuccaacucuucccuaaaucugaauucuuauacuuaacaagcuuaugccgagcacuucucgugucccagacuuggcaccaagugcuuuacaagugucaccuuaguggcaauguuccgucaccuggagggcaucaguauuuucucuguuuacaaaugaggacguuaagacccuaacuguuauaugauuuagucugguagucaaggaaagcuaagugaaaccaugggucugucuccucauccuuaggagauagugacucuugcaguuuguccuuacucauguauaccuaguacuuagcauagugccugguacaugguggggaacuuucagggacaucuaauuuggucccuugauuucccacaucuauauaguacccucauuguuuucuagcaaaacuccugcaugaagauaugcuucuaguauuuaucuguaucugcaguuauccucuuuguucugauguagagcuaugaggagagggaacuuggucuguuugagaaguaaaugauguuaauuaauauuauuuuaaagcguuuuuuuuaaagauugcauuuuauguauuuaaugggugcauaccuguguguauguaggugcauguaugucacagcucauguguggaggucagagaaaaauuugcagggaagucuguucuuuguaccacaugugacauagggaucaaacucagguugucaggcucaguggcaagugccuuuaucugcagagcacccucuuuaguuugagauaggaucucacuuuguauccaaggguggccuggaacucacuacaauucuggcauagucucccaagugcugggauuacaagaacuugccauugugccgagugacuaauauuaauugagcauuuacugcuuuaaggugaugcucucucauccaugaucccccaccccccgaacccauugcugugcaaucucucuaccacagacuccaaccccagcccugucauuuacuuaugaaucuuacuuauuuccuguccucuauuacuacccuuugccagaauauagucagacaggaugacacccugugucuagcuugcacaccaauugucauagaagccagagcugugccagcuacacagcaaaguguucggugcacgggaaguaaucccaggggcgguggccucaaaggugugagcugugcaaaggacucugggaagaacugcucugacccacccugccccugccucucccaggucucaggauaccagggcaggggcacaccugaauggguacucaaauucgacuucgauguugagggcacucuccgucuuguuggcacacuccacgcucagccgaagcucuccgguguagcugccgcacguagcaaaggcgaagauggcaaagaccuuggguagcagggagguggauggcuguagugagccuguaugcaugugggagggagugcccuccucuggacagauugagggggggcagcacagacaguagcagauggagagguccccacccccaccccucuaaucagggcucaucggguccuagcacaagcugauuacagggguguggcuguuucucuuucccugugucucuccguuuuuuuaccucuaggugcucuggcuucuccuucccuccccuccgccucgccuuuccuccucuuuccucuauucguuuucucuccucuccccuccccuuucucucaugaucacuauaucucugucucucaguaucuguguguuuuuaugcaugcucuccaccucucucauacacacuuuccccauuaaucucucuccucucuccccccccucucucucucuccucucucucucucucuccucucuccucucucucucucucucucucucucucucuccucucuccucucucucucucucuccucucuccucucucucucucucucucucucucucucucucucuccccucucucucucucucccucucccucccgcgccuguuucuugcccugcuugucugucuguuaagucuuucacaaggucucucugguucucuggcucccuugugccuucugucuguugccuucuguuuucucuuuugagauuccuuauaucugugugugccuuucuuuccccuacacauuuuccugcucugagagcagcucccuggcucucauuucuuuuacucagcacugccauuaccaccguccccugccucucauacucugucuccuuggcugucucuggauuuuucugguuuugcaucucucuuucagcagucagggcuucaggcuccaccucccauccuuuccuccuuuaguucaagagaggagguagaacgucacacucugucacuucacaacagggguacccacggccuuaugugacgucauagccuucuguucccuguccuuaaaucccugggaccuuacucuggagcccaauucccucaucuccuuccaccccugucguuccacccaccaguucaguaggacgccuccugccucaccccucuguuuugcuggagcccaucaccaccaccaucucccccuguacuucccccaccuauagcccggaccacacucacccacugcagcaccuucacgaagccaaggggcuccuugaccacccggaacugacccccagccaccagcugaggagaaaaacaguggggaggggaaggggugugggaaauagggauggaagugaggggccaggcugccaagcaaugaucccuggggauaggacaugugacccuccgggagugggugacauauggagagggagugaggaggagaaaaacgacacuuuggggacggaguaaacaucagggucucagcagccccccacccccagggcucaggaguggugaagugugaggugaugagucacauggcagaggagguuggguguagaaaauagauggggguccagacuaguuagcgaaggaaggucugaacugcuuaaaggugagucagauuggagaaaagguugaguggaagaagaugggguucauuagagugggggagggggcaccaagugcugaaggugagucacaacagcagaggggagaggucugcagugguaaaggugagucagaugacgaugguugugucugaggagauggggauggggaggggucgcuaccgguuagggagaaagccgauuuugaggugacgaagaagagggagauggcggaggugaucucuuaaggugggaaagagcugggggcauggguuuacuggacaugcgcugagaacgaggagucugggguuuuuuggagaggcaaaauuggaucguccuccucuagaucugcuccgggggugaaagggucgucaucuaccggggugcauucuuuuugggaggggcgggugccaacccucccccaccccgcccccacaccuucugucgcucuauuuccuagcucaucugcagccccccgagucauuuuucauuauccccuccccuucucuaccccuuugcccucuuccuagacccgaaucucucuuuucccccuccaggucgacaguucuuuuggggcaucuggaggcccccucugcggcagugaggacagccuucgcugcggcaaagagcgcacuccuuuucuccaccucccccuuuccccuugccugcugcagaccccuagccccagccccagccccagccccagcuccagcgaccguaucucugcuccccucgccaccaccucucaggguucgagggccaaagccacccagauuucugcaagcgccgggcucuguccacggugcuggagcgcguaccugauucaccacguccaugucugccagcagcagcaucagcaaugcggggggcggaaggugccugguagcaagggcgggcgcggggagcggcgggggcggugcgcgaucgucggaacagcccagucggcggcagccacgccccuugcacccugccuaucuuuugagcaagcgccugcgcaccauggcucccccccgccccauacuccucgcccgccccaacucgccugcggccauuccauucgggaggcuagagacucug

SEQ ID NO: 9360 - RNA, 6155 nt, Mus musculus
uucuuuuauuuaaucguaaguucaaauguccauggaguccagaagaaaggucagcuuccuuggugauaaauguacagauuguuguaacccacccaguguggguucugugagugaaauguggguccuccagaagagcagcacacauucuuaacuccugagucaucucuacaggcucacuuagggauuuuuuuucuuuuuuuuuuuuuuuuuuuuugauuuuuuggugacacggucucucuacauagcccuggcuguucgggaacucacuguguagaucaggccggcaucaaacucacagagauccaacucccucugccuccugagugcugguaucaaaggugugcaccaucaugcauggccuauuaucgucuuauauuugauaaucuacuaauaugucauguucauugugaaaccugucuccuuuccugauaugauguaaaccucacagagauagggauuuuuuuuuucucaauguggauuuucaacagugacuagaacgguacugguuaaugggcuauuuugguuaagagaggggaccuuaaccguuccuuugguacccuguuugagcaggguugguaauaucuuccuagugagagcagcuaggauggcgcugacuccagaccuguuggagaagaaaaagccuagcggcccaaucccuuccugaggguacugcccuccucugggagcucagacucugcccucaccuggaccccuucucuuuucucucuacaggucagugaagcccacgaagaccccacgggugggcaagagcucaagagaaggccugccccccuucccauccccauauccuaggucuccaccccucaacccaggagacccugucuuugcuguuuauauauauauauauuauauauaaauaucuauuuaucugucugagcccuaccuucacccacuccuccaugcacuaggggcccaguccugaaugggcuccucccuaccccugaccuugcacuccucagccccuaucgguuccccagcccugucccgugauguaagggggcucuagaaaggggacaggaagggggccagaccuuggcugcauggagugggucgaugugacuuuuucccccuuccuucucucccucugccccuccuaacucuagccuugguuccuccagcaucgccugaacuuaagaagcucucaaauggaaauucaaccccaagaguagagggguggagguggcuuggaugaaauggguggagaggagauggccucuguagagagaggaccagucagccaaaaguugaauuccacacauacuggauguggagccuaaaagggaagugguguccuacaccauucuggaauggggcuaaaagggacuggggagagggguacuaggagggguguggcuuaaacacaugguggguuccggagugggcagguuuggguuggauccagcaucucuagaaggggugugucuuggaacauucaggaguuugagcuugauuccaaagagcuugagcaaggcuagaagugggauucgggaaugaucuaagcuugagagaagguucuggucaggauugcagacaggcaggugaagaggacgagggauguguggugcucucagaagaggaagcccauucuguaauggggcagaaaagaaaauacgguuucaguugaguggaguuugagcaguggguguaggaggccaugguugggagcugugaggugaguuuugcuaaaaguaggaaggaguacuccugauuccaccccacgccccagaacggacauaaccugggaagagccaaguauugugguuuggagggugagcgaaaugucccuuacugacucccucagaagagggcuagauaaucagaagacagaaucuacaggucuguggggcuggccuaccuucuccacccuuucucugcccucucccuccacacucccgucugucccggagcacugggaggcuggcucuggagccccaauccuggacccucugcugugucugugacguugguagugccugugaucguguguugccauuuugucugacuguggccccucccuuuucccuccagacccccuacuuuccugugcccuucgguauuguuugaagaccccccuccccaaggaagagcaaauaugagaaccccccccaauaaacuccucaacuaucuagucgucccggcucuuuuucucagugcgcguccuuuugggguggggggacaugcagaaggcagaggaggcuggaggaaaggggacuuagaggaagcucaguuccuguagcauccugcugaagccuugccuacagaguacucuugaguuccauucugccuuacaacuguuuacuguuccauugcuggcuuccuggcccacaaggaagucuucucaaauccucaaggccuccccaacuaggagacuccacaagaccucaccuuacgcaagccuuuguuucugaacccuucugugguaucuucccuccuuucucuugccucagccucagcaggaaaaccagaggccugccagguggggagaagagguugauuaacugaugaagaagugccccccucccccagcuucucgcuggaccagagucaggaaguggcaagguuguguguuguaauaggguugaggugggcagaaggaggaguuccugggcgcccaagaugaaaggccugucugaccauugcugccucauccuaauuaaagacucaagucaggcgccugaguucugaguuguagcugcagaugcuugacccccuuuccuggcuccaaggcccagagaugcggagagcaggagagacccagcucuagaaaugaacucaggaaaggagaucuaccuggagacagacaaauaggggaacaggaaggaaggcucugagaccuccuucuuugggcagaggugcagugggggaaccucgccagugauuucagacuuuuccacauaaaccaagaccuaaauaacguuaaaagucccacagucuuuacauauuaaaaguucaaucccuuuaaaauauccaauaucuuuuaaaauccaaagucuuuuuacaauuaaaagacucuuaacugugggcuccacugaaaaacuuccuucaagagggaaaauuuucagggcacggucaaaagcaaaagcacacuccaaccguccaaugucugggauccauucacgaucuucugggcuccuccaagggcuugggucacuucuccagcucugcccuuuguagcacacaccuugucuucuaggcuccagcugccuguacuccacugcugcugcuguucuugguggucaucucaugguccugguaucuccaaaacacugcaugacccuuucaguccuggaccaccaauugcaacugaggcugcaccuucaccaauggccuuccauggccucucacagugccgagccucagcugcucugcauggccccuucaugccuucaaaaccaguaccaccugggugacucuuacacauuaccaaguccagccacagcuucagcuacaacuuuggcuaucucuggaacacagccucuuugugcucuccgaacacuucccagaagauuucaccucagugaugcuggucucuucuuaaucacugcuaauuucuuagcuccagcuaaccagcaucaauagucccuuuaaugcagaguuuucgauuuaguaguucugguaucuuguuaaucacagcugauucuucagccccaacuaacuaaaaccacagaaucuucacaaucaaaacagcaauggcccugaaaagagucuuuaaucuucucuggaauuucacaagccagaccuccaucuucugcacuguucucaacauuaucuuccagccuccuacacaacaucccacagaucuuuuaacaccgaauggaucuucuagcucaaaguucuaaaguccuuccacagccccccccccaaaacauggucagguugucacaggaauaccccacuaugcugguaccaauuugucuucaucaggguuucuauuccugcacaaacaucaugaccaagaaacaaguuggggaggaaggguuuauuccgcuuacacuucccacauugcuguucaucaccaaaggaagucaggacuggaacucaagcaggucaggaagcaggagcugaugcagaggucauggagggguguuacuuacuggcuugcuuccccuggcuugcucagccugcucuauuauagaacccaagacuaccagcccagagauggacccacccacaaggggccuuucccccuugaucacuaaaugccuuacagcuggaucucauagaggcauuuccucaacugaagcuccuuucucugugauaacucuagccugugucaaguugacacacaaaaccagccaguacaauugaccccuugucaacuugacacaaaaacacaucacuauuaagccucaacccuuacuuucuguuuuuguuuguuuguuuguuuguuuguuuuugagacaagguuucucuguguagcccuggcuguccuggaacucacuuuguaaaccagacuggccucgaacucagaaauccgccugccucugccucccaagugcugggauuaaaggcgugcgccaccaccaccaccuggccaacccuuacuuucuuauucaucccccaaaucuaaauaacuuuaaaagucccacggucuuugcauauuaaaaguucaaucccuuuaaaauguucaguaucuuuuaaaauuaaaagucucuuaacugugggcuccacuaaaauacuucaagagggaaaaauaucagggcacagucacaaucaaaagcaaaaaucaaucuccaaccauccaaugucugggauccaacucacaaucuucugggcuccuccaagggcuugggucacuucuccagccaugcccuuuguagcacacacguugucuucuaggcuccagaugccuggacuccacugcugcugcuguccuuaauggucaucucaugguacuggcaucuccaaacacuacugucuucugcuguaacuaggcuucaccaacagccucucauaggcucucuucauggugccaagccucaacuccuuugcaugaccccuucuguccugggccaucaguugcaacugaggcugcaccuucaccacuggccccauggccucucucagugccgagccucagcugcucugcgugaccccuucaugccuacaaaaccagugccaccugggugacucuuacacauuaccaaguccagccacagcacaagguacaaccuuggcuaucucuggaacacagccucuuugugcucucagaaaacacuucccagaagauuucaccucagugaugcuggucucuucuuaaucacggcuaauuucuuagcuccagcuaaccagcaucaguagucccaguaaugcaaaguuuucucuuuguuuuguuuuuguuuuguuuuuuucgagacaggguuucucuguauagcccuggcuguccuggaccucacuuuguagagcaggcuggccucgaacucagagauccaccugccucugccucccaagugcugggauuaaaggcgugugccaccacucccggcuucaaaguuuucccuuuaauaguucugguaucuuguuaaucacagcugauucuucagccccaacuaacuaaaaccacagaaucuucacaaucaaaacagcaauggcccugaaaagagucuuuaaucuucucuggaauuucacaagccagaccuccaucuucugcacuguucucaacauuaucuuccagccuccuacacaacaucccacagagcuuuuaacaccgaauggaucuucuagcucaaaguuccaaaguccuuccacaguccucccccaaacauggucagguugucacaggaauaccccacuaugcugguaccaaaauggaacagaucuagcaggaugcugagcgccacagaacaccagcuaccacugaagaugaaguugggaugguccuuguaacgcucaccccgggaaaagagaaccugggaagggaccaagagguggcuuugaccccugucccccaaagcuuucaagacccuauucuuagaaacaagcacucuaguguaacacucucaccaugucuccacauccaaaccguuugcuuccggcuuuccaacacuaaaggccaugcggcaccgagggauacugaaggcucagccuucugacagucugcuccggcucuagcccugggaugaacgccaauaaug

SEQ ID NO: 9361 - RNA, 12027 nt, Mus musculus
cuaccacgugcuagaacuuugucucuaguuguaggaagcaagcccucugcauauggggcaaugggggugucuguccugugcugagagguauuggggagauggggagguaguaagcauucagacuucugaccagucccagagguuuccagccuuccuagcaugagacuggcgucacuaaccuacaagggccccucccuggagguggauacaaagacaugggggcucaguagcaaugcccccuaauccagucucuucacuccuaucuauccagauacugggcuuacuugcuacguugcucuuuggcuacgaugcauacaucaccuucccucuaaagcagcaaagacauacagcagcucccacugguaaguguguguguguacacguaugugcacacgugugugcaugaacacugagagcagaaacaaacaaaagggcugggcagugggagcaaacaccuuuaaucccagcacccuggaggcagaucucugugaguucaaagccagcuuggucaauauaguaaguuccaggacagccagagguauacauaguuagaaccuguuuuuuuguuguuguuuuugguuuuuuuguuuuuaaaaaaaaaaaaauuaagggaaaaaaaaggaagaaaaaggaaaaggaccuccuaggggaagauaugacugccaacugugucccuuauugauucuuaaugucuuuugugucaugaaaugccaugugucagcauuccugucuguauaaauaggccucuagauucaucgaugcuuucuuucuuccuccugcagaccccacugauggcccgugaucgucuuucagcugucucugcuaccugucaauagcuccuccaucaaaaacuuuccuccugucgggcggugguggugcucgccuuuccuccaagcucucaggaggcagaggcagguggaucccugugaguuugaggccagggcuacacagugagauccugucucuaaaacaauuccuucuccgguuuccacaacacuccagccaauucucugaccccauugaaagugcuuaugguacaagagauugaaccuagagccgugugcauacuaggcaaguauucuccacugagcuacaucccuguaaaagugccuuuauugggaguuuugucuuccagccugccaaucaacccaucuggguguggccaccuuuaugggugugccuagauuccccuuugcucugcaguaccagcagccgacaucaguucugcuugaaccauauccccacauaagcuacaaaaugagugacccacuacaaauaaccuuuuucucuguguggggugagcugugaagggcuaaauaaacaauaaaaauaauguuuaagucuauaaugaauaaguuaacuuuuuuugauguuagcaucggaaauugaggcaaaaccauuggauccaagaagccaggccuguuucuuuaacaacuauuacauugcuucgcuaauacaaacaagauggagugcagaaggggaccaugacuuaguuuaggacaaucaucauuuacacugacuuuagaaagguagaauuccuucuaaaguugccuuccuuuaagccacgaugcaguucuugucccgggucuggcgaggcaucacggggugagacuccuggacaaguggcugggcuggggaguuaaagguuucgguugagguguccugagugguccugggccugcacaggugagggggcagugggauacguucccccaggaagaagccaucauccucagaagacucugaacuggggcuggagggugagcuggagcaagauccugaaucugaaccugaucccaagucacagcgaugguggccaugucugccaggauggugguggugaugguggcucccucggcggcggugccgcuggcgccggcggcgaugauggugguggugguggcagcuggggguccugggugggggacuucguggucuacggcgcugggcuggaggugcacuaaggguccuucguggaccuccuucagacaccagagggucucggaagcugacacgagguguacuuuggcgaccaaaggcauuaucaucuggaugcggggcaggauggccaggggauucuguggguggcucaggagcacugcggagucccaguucaggcauagaauggcgguggggggccccucucagaaagugggagggcucuucagggccugcagcugggaaaaaggaaagauggacgacaccagauaugugcuuguccuggcuggcccuuaccucaggaaagauuugggaaugauuucuucccccuacuaggacuaggaagugggacaggggucagacacuggauaccccaaaguuugccucuugcuucaggccuuggguggagagaaggauagggaguaaauuagcaugaguagggaagguuuggccaggaaaugggcagauggguuggccagaagcggguauuauuaagggcuggaguagauuuuuguugagauagaacaaaggggaagccuggguguaguggguagaaggugaccgguugccugaagugagggaauuacuucagcucaggaugggacgaguuaagguguaaaggcuuugcaggcacaggguggacuagggucagcagaaagguggggucagggcaagagacuaguccugaaauggagaaagaugggcccagcuaucuagagauagaugcuacaggauaagacugggcagcccaggaaaggccugguggagguggggcucaccaggcucugccuugguacaggugccuuugcuggcugucucugauguccccuccguagcugagaaagaagcuguagaaguugugagcgguguggugacggugccggcgcuccagcugcgucggccgggcccuggagcaguggucucagacccaaggcugcaggcucgugagcagaagaucaggccucggcguggcaggaaagggcggcccagaagaggucgacugcaacggcuacagcagaagcagcgaucugaagcgugccaguguuggcccucauaagccaucuggcccugguccaggccugugaggacaaacacacguggggaaacugagggagcacucaugggcuacccuaccuaagugggcucuuucuuaggaagaggugggggauuugaaguaggggacccugacuuuucuccucacuuccagaagggagccuuucuguggagaaagcagauaaugugagauuuaacccuccucucccuuaucucuugggaauggugcuuucucuuucuuuccuaccauaagcauagcugggcacugagcucuuacacguggccauuaggagcgccagucagcuuuagguagaaggcaaauaaauggaaggcuggaacuggaaagaggugugguuguuggggguggggcuuagggaggagcgggauuuggugggaaagaagccaguuuaagaagguaggauguccaaaaagguagggugugcuagaaagcaggacuucagguaggaugagggagggaggaagguggaaaggaagagaauauagcucugcaugguaaaggcuuccuuuuagcgugcuggaaucagacggugcucuguagguucaguuagguguuguaggggcggcugauauguugguggaauuuagaaagcaugacauaggcuggggaagauagauaagugauagaaaaucuguugggcaugguaggagcucuggcccugagucccaucuccagcaccaaaggaaaggagggagguggagaaggagcuuuguggagagggagggagggagggagggagggagggagggagagagagagagagagagagagagagagagagagagagagagagagagagguaaguggggcuauggccuagcuguuuguaugccccuuugucuugucccagcacguucucacccaccgauguguuccccacagccaucacaguauuccgcauggcgggccucauagcaggcacagcagugggggcggcucugacgcaugacauagcgcugcccuccuaacgaagcuucacacucgaaacagcagaagugacccaugugccagugucgccccuccgccuccguacauucaggggagaagaugaucuguaaggcacagaucaccacggggcugucgaaagagcuugcuucuggcucaguccacccuccauucccaccucuggucagggcggcacaaaccucaucacacgcuuggcagcgaggacgcagacacucagcaugguggcgcccacaguagaccuugccagcaugauagaaguagaugaggucaaccagcagcuccuggcacgugguacacacaaagcacugagggugccaacaggcaccaaggccugcgcggcuggcaaagacugcaauguccccaccgccgaucugcuugccacacugccaaaugacagaugccaccacagucaccaagagagucagauggauggggucagccaagcaugugagaacuuggccucucccaugaugaaacuuugcauauuuucuuaugacaggaucucacgcagcccaggcugguucugaauuuaauauacagcuauggcuggccuuaaaccccugauuuuccagcaaccagcaucuccuaugggauaaaucugagauaguuuccacucacaagucaaucacgauuuacucugcuugugggaaaaucauaaagacaagacuuaaucauggguggccuuacaggcaaaccuuuuucuaggcgacuggggcaaauauuaagcugcauccaguggaggugcuguagagauagucuccgccccacagaggucucagccaauggaccucaccaaauaguuuuaaagacaggcccccacccaccaggcaaggccuuggggacaaaucccaucaacuguggaggguucuccggcaggauucagacucugccacuaugcaucaguuuauuaaucuuauuauuuguuguuauuaauuugcaugguugggggauaggcuugugagugagcucuuuguuuugaaacauggucuuacuaugggaugcccucgaauuugacaauccugccucagccucccacauuauugagauuucacgugugagccacaaggcccagcuauauggaucagaucuuaagaacaaguucugaucacaagaagagcagaagagacagucccugcucuaugccuucugcaugggggagaggaaacuacaaaaguauccaucaaggccuuagagacaaauuagacccaauauggguaucgaagggacacaguauauucaccagaaggcucuagagacaccccacuggguguuaagugguaggccucagagccuucacuugcugagaccccacuauagcucaccuccucgcagauggccccaguaauggucacugggaagauucgaacgguggcucgucccagauucucccgcuuccucugcuggcugaaggcucgcaacucuuucuucuccuccucuuccagggccgugcaguacugugccuggggagauaaggaguccuuuggacuucauccacgcucacagaguauauaguucuaggccauugucuauaagaugccucccauuggugagacccaucccucgccucuucucucaagacucagcuacguuuggucaaggcauguuccccuuuuggcuccugcuucuccaggccuuuccugagcugacccugcccauuucuugucaguuagcccuggauuuguccaggccguaccccacuccuggcaugcccgcccagccuucuccccuccucaccucacugucguguggggguagcuggugcaguagcugcuuuauucuguauuucuccccaggacuguugacauaggggaccuuguccucuggaaggcaacugaaaaacugguaaaccugggaggacgugaaagggugagagaaaacaauuacaguuagggaugagcuaggauacagcgaggucaugggucccugguucuaugggaaaauuaaagccaucugaagggcacuuguccugaagccaaucucuuucucgaaacuccugaaugguugaagggaccgcagggcaaacucugcucucuucuucccuuuagagcaaaacuucucaaaagaguugagcauuccugcccagucugcuuccuuugcucccauuguaucuuggcccaacucaggucacuggggaugucugugcuguaaaaaaauaaaaucauuguucucgucuuaguccucauugguuagagcauccuuaguccaggucccugcugauuacucuugcuuccugaaaacaguuucuuccuugggccuccagaauaccacaaagccccagguuccuuccuuccuuccucacuggcuguuugucucauucuuuauuguuccucaacuaguagacaucugaauaugggaugguuauagggcugagucuuugguccccuugccucugucuauauauaccuuguuaaaaauuguggggcuagagagauggcugagcgguuaagagcacugacugcucuucugaagguucugaguucaaauaccagcaaccacaugguggcucacaaccauccuuaaugacaucugacucccucuccuggcgugucugaagacagcuacaguguacuuacauauaaaauaaauaauaaauaaaaucuuuaaaaaaaaaagaaagaaauugcauucaccuuggcuauaauggugaucuguuggcuaaggugccaaaaaugcagcuccgagaccucuccccauguccuagguaaugugguuauguaacuagcaccaccaacucuuauucaaacuugcucuuuguuggccuuuuuaaaaaaaucucuccuucccugaccuuuccucuuugagaugggggacucaauaucuaguucuuguugguuuggccccugcaauuuagaucaggccggccuuggucuccuaagggcugggauuacagguaugcacuacugugcuuaguuuaccuaagcuucuuucccuuuuuuuagguuuuucaagacagacaggguuuuacuauguaguagaccaggcucgccucgaacucacagagauccugccugccucuguuucccaagugcugggauuaaaggugugcaccauucucauacuacuucauucacccauucaucuuuagagucaucuuuuacuucucaauccccagcucugucucucucauauauauguuaacuauguaggugccuggagcuugauauauggaccagguugaccuugaacacacaaagaucuaccugccucagcaucucagaugcuucagaugcugguacugaaagccugugcaacuaugcuuggcuuugcauuuauuucucucucucucucucucucucucucucucucucccucucccucucccucucccucucccucucccucucccugucccccccccaccuaguuaggguuucucuguguagcucuggcuauccugguacucccucuguagaccaggcuggccuugaacauugaaggaucugccugccucugccuccccagugcuggaauucaagccaugugcccggccugauuucuuuucuuaaagacuggaacuuguuauguagccuaggcugcgcugggucacauagugaguuccaguccaauaaagggacacagagcccuguauccuaccaaaacaacaaaagaauaauguaucuaggauugaggcugggagguugggagguuucccacacucagugguagugcauguacaaaggugcagugccuuaguccuagcacuguguagauuuccaaaagcaagccucacucagcagugaccccgaguauugacauagcuuccuagucagcagaccucauuccacccuugcuauuacaggcuguuauagcagccagauauacuguuacauaagaagacaagccaugccccucuucucacagucuucuugagccucuccccucagaguaaaguugucuccaugacccucuccauccguuccucugcccuucccugcaggcacucucacuuugcccacucugcuccugccccacuggucuccucacauuucuucacacagaugugccaagcacaccgugccucugucccuuggcauuucuacuuacuuagccuggacugugccaacuucagaucucuguaaggcucacuucaccuccuucagggagguucagauagggcuugccugggcacucuauuuauaauccuggccgcccuuccuuuccucccuccgcuuuuguuuuuuuuuacuuccauaucccuuaugccaccugaugcacagucaugccuuuccgagaguccccacacuccaggauuuaacucaccaaagacaguuuuuaaagauccauaugaacagaacaccucuacauacugacuauucuucugagacaggguuucucuguguagcccuggcuaucuuggaacucacucuauagaucaggcuggcauugaacucacagagauccuuuuugccuuugccucccaagugcugggauuaaaagagugcaccaccacuucccaauagcaugcauauuuuuucuugccauuauuguuauuuuuuaaauagggucuuauuauuacuccuggcuggccuggcauucucucuauauaacauacagccucaaauuuguggugcuuuuccugcuuuagucuucccagggcugggauuacaggcauguauuaccacacccagcuauuuuuuuuuccugaacacuaucuucuuuuuucuuggcugugggcuugaguccaaggccuuguacauguuaggcauguucuuuacaacagagccacaaaugccagaccagacauaauacaacugccuaucugacauuuacaguguagcacggacuauaaucuagaaaagauuugaaguguagagaagauguuuagauuauauacaaaaauaaugugccauuuuacauaagguguaggguauauacagauauuauggaguuuuauaaaagagacaagaauuuuuggauguugguauucccgugugggaauauaagugccagcacgugugugcauauguguguaauuuggugcuggaguuaaaacccagggucaaauacaugcuagggcaaaagcucuaugccugaaccaugcccucagccuuuguuuuaugcuuucuuuacugucuguccucagugccuagacguguccaacaaguggcgaaugcucaguaccauugaaugcaugcauaauucaauggagacauagugaaugacaugcugagauagucuggaguaaaggauagaauagaaauggggcuggagagauaguucaguggcuaaaagugcucuccugcucauccagagaacuggaacucaguuuccagcacacacacaugccagcugacaaccuuuauaacuccacuuccaauggaucugauacccucuucuggucucuucaggcaccuguacacacacacacacacacacacacacacacacacacacacaccuuuaaaaaagaaugggaugaaaaaugaacaagacccagaggaauuggcccagugaucacucagaacagagagacacugguagguggaccacacuucagcauuacuccagaaauaggucugcacuuaaaugcauaugugccugcauaugugugugcccauuggggaacuagaguggguagccagccuuuggucaccugcuccggcuuaaggccaggggguacccaggcauacuccucugaggcacagccugagucgucaucggaaauggaguggcgcuggaagucugagaugagccggcacaugaugcguucuagguccacagguacagugcguacagcaugcuccucccgcgggcauuugcagugcuggcagaucuuucugugagagccaggauaggagucaauuacuaaggagugguccacccagaucucuagguacuccagguccaacugaaggucaggacauguagauuaacaccaaaggacucagagcugggacagagcucugugccugaggccagggcugacaggagcugaggcuaagagccaggaucugacuuugccuugugaccaggccaugggacacuggcugugccaggcucagcuuuucgaugaugacuggucuggaaauaggggccuagaggacugggggguggggugggggcggguugggcugugauucuggguacaggauaugaagggguggggcuucaguuucagcucuggugcuugggucagauccucugggaaacaggucuggcaggggcgggacuccggagcugagacuaguaucauaaaucaagggauuuccuuaggcaaacgagucugugcucugugggguaaccucuccugaagaaaggucucuagguuauguguagggggagaggggacacaauugggagucugugggacuaugggcucuuagacuuugggugcaaggccacuggguauggggggaaaaguucugaggcuaagaagggaggggccuguggacggggcuagaagaucgcucuagacaugggacuuagacuugagagaagauucuuuugggguucagggcuguggaacucuucugggaacaggucucuugggaaugagucaggggcggggcccuggaaagaacuuugaggcuucuuucccaacugagcucucugugggcggagcucaagcaauggggcggaucucugacaaaggcuagggucacuuaccuccagccaugcagcaggaagccugggcacuguucccugcaggaauugcaaggcuggccgcgggcaggguccucugccucuggaggcuguggugggugggagcagaugcaagaagaaauaaggugugggaggagggaggaagaagucaacgccugcuacuccacucccaggcucacaaccgcaggcuggggccugucuuacugggggcagcgcugggcaggcugagaccgcgccuggagcgcgggggaggaggaagcauucaaaucagaggcagggcagcugagacuacuuuccuguauucccuuuccagggaauucuucugucugggcuggucugucccucuuuaguucucagacaggucugucagagagagaguccucuaccuacuagagcagagacccuagucugggcauucccucccaagucucccuucaauauccagggcuccagcagcacuccagucccacagggcaggcgucugagaaccucuccuuucccugggaucccucauggacucugggcaaugccauucccucagaaguucucccgccccucccccaaacccuggcuccaucucuccuaccugaggaccgcaggccaucccugcuccauucagaaagcccuagcccaagaaaucuuucucuuuacccgucauaguuuaggacuacucucuuuuuugguccagauuccaccuuucuugguuaaagaucuuucaaaacaagagagacaccauccuaucuaggaggucagcuuccagacuccgauggaaaccugaaauucuucugauccuaaaucuuaguucauugacucuugguacccagggaugaaggacccccacuuucacucuacaguccuucaauguaugaggucccuuaaucagacacucaggauaccccacucuugcucaaccucaaaucucaagccccuauucuuuucaccuuucagauuaauucacagauaaggggggcauccccagauugcaacagugauaaaaguaugaggcguguuaggggcuugagccaccauaucuacacguuuuugcauccaggauucuacuucagucucugugccccagucugggaaagcuggggaagggaguucccagauccucccuuagggugccuccccucugucccggugcccugccccccucgccuggaucuuaguuuaccccugacccccaccacuguccugagcccugcucaccgcacgcccagagcggcgccuccgggacccacgcgcgaacauggcgcgcccagacagauucaagcacggcugguuccgacgaauggagucggcugccacggcgcgucgggccuggcagcucuguuccguaaacuugacuuagugggaggagcacgcuuucuagggcccgccccacggccuguguagugucucagucacccugguguccccuaucuaaaggugagugccuugcuggaaag

SEQ ID NO: 9362 - RNA, 4287 nt, Mus musculus
uucccagcugcaggcccugaagagcccucccacuuucugagaggggccccccaccgccauucuaugccugaacugggacuccgcagugcuccugagccacccacagaauccccuggccauccugccccgcauccagaugauaaugccuuuggucgccaaaguacaccucgugucagcuuccgagacccucuggugucugaaggagguccacgaaggacccuuagugcaccuccagcccagcgccguagaccacgaagucccccacccaggacccccagcugccaccaccaccaccaucaucgccgccggcgccagcggcaccgccgccgagggagccaccaucaccaccaccauccuggcagacauggccaccaucgcugugacuugggaucagguucagauucaggaucuugcuccagcucacccuccagccccaguucagagucuucugaggaugauggcuucuuccugggggaacguaucccacugcccccucaccugugcaggcccaggaccacucaggacaccucaaccgaaaccuuuaacuccccagcccagccacuuguccaggagucucaccccgugaugccucgccagacccgggacaagaacugcaucguggcuuaaaggaaggcaacuuuagaaggaauucuaccuuucuaaagucaguguaaaugaugauuguccuaaacuaagucaugguccccuucugcacuccaucuuguuuguauuagcgaagcaauguaauaguuguuaaagaaacaggccuggcuucuuggauccaaugguuuugccucaauuuccgaugcuaacaucaaaaaaaguuaacuuauucauuauagacuuaaacauuauuuuuauuguuuauuuagcccuucacagcucaccccacacagagaaaaagguuauuuguagugggucacucauuuuguagcuuauguggggauaugguucaagcagaacugaugucggcugcugguacugcagagcaaaggggaaucuaggcacacccauaaagguggccacacccagauggguugauuggcaggcuggaagacaaaacucccaauaaaggcacuuuuacagggauguagcucaguggagaauacuugccuaguaugcacacggcucuagguucaaucucuuguaccauaagcacuuucaauggggucagagaauuggcuggaguguuguggaaaccggagaaggaauuguuuuagagacaggaucucacuguguagcccuggccucaaacucacagggauccaccugccucugccuccugagagcuuggaggaaaggcgagcaccaccaccgcccgacaggaggaaaguuuuugauggaggagcuauugacagguagcagagacagcugaaagacgaucacgggccaucaguggggucugcaggaggaagaaagaaagcaucgaugaaucuagaggccuauuuauacagacaggaaugcugacacauggcauuucaugacacaaaagacauuaagaaucaauaagggacacaguuggcagucauaucuuccccuaggagguccuuuuccuuuuucuuccuuuuuuuucccuuaauuuuuuuuuuuuuaaaaacaaaaaaaccaaaaacaacaacaaaaaaacagguucuaacuauguauaccucuggcuguccuggaacuuacuauauugaccaagcuggcuuugaacucacagagaucugccuccagggugcugggauuaaagguguuugcucccacugcccagcccuuuuguuuguuucugcucucaguguucaugcacacacgugugcacauacguguacacacacacacuuaccagugggagcugcuguaugucuuugcugcuuuagagggaaggugauguaugcaucguagccaaagagcaacguagcaaguaagcccaguaucuggauagauaggagugaagagacuggauuagggggcauugcuacugagcccccaugucuuuguauccaccuccagggaggggcccuuguagguuagugacgccagucucaugcuaggaaggcuggaaaccucugggacuggucagaagucugaaugcuuacuaccuccccaucuccccaauaccucucagcacaggacagacacccccauugccccauaugcagagggcuugcuuccuacaacuagagacaaaguucuagcacgugguagucuaacagguugacaaaggggcugccuuugccucucacaagaucugugucugacaagggacaguguuuucacaccaaaugauccuugcugcggccagacuuugcaucuguuucuugggccccuuaccccagcgacaacucuggagcugccucuuccuucuacaaggacaacaauggaggugaucagguacaggaugguugcuaugagggaucugaagaaguccugcgaagugggccaagaaaaaggugagagcugcagaccauuccaacgucccaaccccugcccagccccggcacugccggccccuuucucacaguccaaggccaguugaugaaugauaucuuggagugcaggucacacguguagaagacaaguaagacagcagcacagaucaucucaaucaccgacagggaggaguaggccgauguuguagaugcacugaagcaaaucaagaucaccaggcacaguaucugagaggggagcaacggagcucaaucagccacggguuaaaagcaaugguuuaaauuagaaaagagggagccgggcuugguggcgcacgccuuuaaucccagcacucaggaggcagaggcaggcggauuucugaguucgaggccagccuggucuacagagugaguuccagggcagccaaggcuaucuauacagagaaacccuguuuugaaaaacaaaaaaacaaacaaaaaaaaauuagaaaagagggcucucaaaccuaaauauccaugggggaggggaggaaaucuacuuuccaagauguagcucaguggcugagcauuugcauaacauaugcaaggcccuagguugcacccacgcuccagagacgguaggggaggauggggaagaaagagaaaaaaaaaaaacauuuuucucaaauaacuaccaggagugagaaaaugacaucugauaauuacgaaacaccucucgcaugcucaguguucuuccaagcauugucuaagggcuuuacacgucguauuccacuuaaucaucacgagaaucuaaugagcuagauacauuuauuuuacacaggaggaaagugagucacagagagguuaaguggcuugcccagggucaaccaguaagaaaaaugccgaauuaugugcuucaguucuccuuucccugaggggaguggcucugccagguguuuugugagcgcuuguggcgccagcguccaugccuugagggggagggacguucgguuccccaggcaaccccuuugggaaggggggggggggagacugacacuagaagggcagggcuccguuaaaggaaccgcaccucuuuuaugagugacccaaaggcggugcccacuuggagggggauggaaaaaccaagguucccuauaaccauccaaagagcaaaggaccucccauccagucccaaaugggcaaggaagaacuggcgaaguguggaacgcccuacccuagaggggacuagcucuaccccaccccaacaggccccgccuuuaggcgcacugccagcccgccagcuagugcccaggccggccacgcccugccacgagaggcucccacuccccaggaccccuucucuccgaccacuaugaaccuacacccacacacgcacccacacauccccagcccccaacauuaguuauagauaacucaccucaccagugaaccaccagcucuccaccccuucgcccaugccccaccgaacgcccugcaucuuggcuggcuucgacccuccuccacaaacucacccaccugcaucccacuggcaagcagcuggaccacgugccugccucaaccgccacagucccguacccagugguccagccugcacacucagccucuacccaaccuccggccggggaacacucacaaucucagcaaacaggagaauucccuuuuuggugcgcgagaagcuggugcaggcuaaccagcagccgggggccgagagacgcucagaauccgccauggugguguacuggagucccugggacgcagaagcucugcuuucuggcucacggguucgaggucgcugcacacccagccgucugucccgccgucuggccgggaagggggccccccgggcaaaggagggaaugaaucaccgcgccuagcaaagcag

SEQ ID NO: 9363 - RNA, 4287 nt, Mus musculus
cugcuuugcuaggcgcggugauucauucccuccuuugcccggggggcccccuucccggccagacggcgggacagacggcugggugugcagcgaccucgaacccgugagccagaaagcagagcuucugcgucccagggacuccaguacaccaccauggcggauucugagcgucucucggcccccggcugcugguuagccugcaccagcuucucgcgcaccaaaaagggaauucuccuguuugcugagauugugaguguuccccggccggagguuggguagaggcugagugugcaggcuggaccacuggguacgggacuguggcgguugaggcaggcacgugguccagcugcuugccagugggaugcaggugggugaguuuguggaggagggucgaagccagccaagaugcagggcguucgguggggcaugggcgaagggguggagagcuggugguucacuggugaggugaguuaucuauaacuaauguugggggcuggggaugugugggugcguguguggguguagguucauaguggucggagagaagggguccuggggagugggagccucucguggcagggcguggccggccugggcacuagcuggcgggcuggcagugcgccuaaaggcggggccuguuggggugggguagagcuaguccccucuaggguagggcguuccacacuucgccaguucuuccuugcccauuugggacuggaugggagguccuuugcucuuuggaugguuauagggaaccuugguuuuuccaucccccuccaagugggcaccgccuuugggucacucauaaaagaggugcgguuccuuuaacggagcccugcccuucuagugucagucuccccccccccccuucccaaagggguugccuggggaaccgaacgucccucccccucaaggcauggacgcuggcgccacaagcgcucacaaaacaccuggcagagccacuccccucagggaaaggagaacugaagcacauaauucggcauuuuucuuacugguugacccugggcaagccacuuaaccucucugugacucacuuuccuccuguguaaaauaaauguaucuagcucauuagauucucgugaugauuaaguggaauacgacguguaaagcccuuagacaaugcuuggaagaacacugagcaugcgagagguguuucguaauuaucagaugucauuuucucacuccugguaguuauuugagaaaaauguuuuuuuuuuuucucuuucuuccccauccuccccuaccgucucuggagcgugggugcaaccuagggccuugcauauguuaugcaaaugcucagccacugagcuacaucuuggaaaguagauuuccuccccucccccauggauauuuagguuugagagcccucuuuucuaauuuuuuuuuguuuguuuuuuuguuuuucaaaacaggguuucucuguauagauagccuuggcugcccuggaacucacucuguagaccaggcuggccucgaacucagaaauccgccugccucugccuccugagugcugggauuaaaggcgugcgccaccaagcccggcucccucuuuucuaauuuaaaccauugcuuuuaacccguggcugauugagcuccguugcuccccucucagauacugugccuggugaucuugauuugcuucagugcaucuacaacaucggccuacuccucccugucggugauugagaugaucugugcugcugucuuacuugucuucuacacgugugaccugcacuccaagauaucauucaucaacuggccuuggacugugagaaaggggccggcagugccggggcugggcagggguugggacguuggaauggucugcagcucucaccuuuuucuuggcccacuucgcaggacuucuucagaucccucauagcaaccauccuguaccugaucaccuccauuguuguccuuguagaaggaagaggcagcuccagaguugucgcugggguaaggggcccaagaaacagaugcaaagucuggccgcagcaaggaucauuuggugugaaaacacugucccuugucagacacagaucuugugagaggcaaaggcagccccuuugucaaccuguuagacuaccacgugcuagaacuuugucucuaguuguaggaagcaagcccucugcauauggggcaaugggggugucuguccugugcugagagguauuggggagauggggagguaguaagcauucagacuucugaccagucccagagguuuccagccuuccuagcaugagacuggcgucacuaaccuacaagggccccucccuggagguggauacaaagacaugggggcucaguagcaaugcccccuaauccagucucuucacuccuaucuauccagauacugggcuuacuugcuacguugcucuuuggcuacgaugcauacaucaccuucccucuaaagcagcaaagacauacagcagcucccacugguaaguguguguguguacacguaugugcacacgugugugcaugaacacugagagcagaaacaaacaaaagggcugggcagugggagcaaacaccuuuaaucccagcacccuggaggcagaucucugugaguucaaagccagcuuggucaauauaguaaguuccaggacagccagagguauacauaguuagaaccuguuuuuuuguuguuguuuuugguuuuuuuguuuuuaaaaaaaaaaaaauuaagggaaaaaaaaggaagaaaaaggaaaaggaccuccuaggggaagauaugacugccaacugugucccuuauugauucuuaaugucuuuugugucaugaaaugccaugugucagcauuccugucuguauaaauaggccucuagauucaucgaugcuuucuuucuuccuccugcagaccccacugauggcccgugaucgucuuucagcugucucugcuaccugucaauagcuccuccaucaaaaacuuuccuccugucgggcggugguggugcucgccuuuccuccaagcucucaggaggcagaggcagguggaucccugugaguuugaggccagggcuacacagugagauccugucucuaaaacaauuccuucuccgguuuccacaacacuccagccaauucucugaccccauugaaagugcuuaugguacaagagauugaaccuagagccgugugcauacuaggcaaguauucuccacugagcuacaucccuguaaaagugccuuuauugggaguuuugucuuccagccugccaaucaacccaucuggguguggccaccuuuaugggugugccuagauuccccuuugcucugcaguaccagcagccgacaucaguucugcuugaaccauauccccacauaagcuacaaaaugagugacccacuacaaauaaccuuuuucucuguguggggugagcugugaagggcuaaauaaacaauaaaaauaauguuuaagucuauaaugaauaaguuaacuuuuuuugauguuagcaucggaaauugaggcaaaaccauuggauccaagaagccaggccuguuucuuuaacaacuauuacauugcuucgcuaauacaaacaagauggagugcagaaggggaccaugacuuaguuuaggacaaucaucauuuacacugacuuuagaaagguagaauuccuucuaaaguugccuuccuuuaagccacgaugcaguucuugucccgggucuggcgaggcaucacggggugagacuccuggacaaguggcugggcuggggaguuaaagguuucgguugagguguccugagugguccugggccugcacaggugagggggcagugggauacguucccccaggaagaagccaucauccucagaagacucugaacuggggcuggagggugagcuggagcaagauccugaaucugaaccugaucccaagucacagcgaugguggccaugucugccaggauggugguggugaugguggcucccucggcggcggugccgcuggcgccggcggcgaugauggugguggugguggcagcuggggguccugggugggggacuucguggucuacggcgcugggcuggaggugcacuaaggguccuucguggaccuccuucagacaccagagggucucggaagcugacacgagguguacuuuggcgaccaaaggcauuaucaucuggaugcggggcaggauggccaggggauucuguggguggcucaggagcacugcggagucccaguucaggcauagaauggcgguggggggccccucucagaaagugggagggcucuucagggccugcagcugggaa

SEQ ID NO: 9364 - RNA, 13136 nt, Mus musculus
uuaguuuuauuuucuaauuuuuauuuauuuuuauuuuaacuuguuuugguagggaggucacaaaguagugugggggacagacauggaaggacugggaagugugacgaggauguaugaugugaaauucucagagagucaauaaaaauguuauguuaaaauauccuaacaaaaugcuuagaaacugaaucuaggaacacauugagaagauuacacauuaugaccaaguaggcuucauucccaaaaggcaaagguguuucaacauacauauacagcaaauggaauacagcauauaaacaaacucaaggacagaaaaacaugaauuauuaaaguaagugcugaaaauccauuugacagugauaaaagcugugagacuguagaaauacauggaaauaugucaaaauaauaauggcuauauacaauaaaucuauagccaacauuauauuaaauagacacacugagcauuuccucggaaaucaggaaugagauguccauuguccccuacaguaucaaagucuuagauauagcaauuagauaagagaagacauaaaagggacaauaggaagggagaaaaccacaguauccuuuccuauuugagauagguucuuauuaggaguucuggcuggccuggggccuguuuuguagaccaggcuggcuucgcacucauggagaucugccuacuucucucuccugccugcgaagcucaaagggugugcuacuucaccuagcacauuuccugcuagguuuuucagugaagcuccucagacugucuuggaacucguggaaauuuuccugccucagccucucaagugcuagauuacagauaugggccaccacacucugugugacucauguccuuuugucuguuuauuuuggccagagaguucagcccaguucuagccacauuuaccagucucauuguguucugggauguuuugauucuuuucaguguguguggcgggcugacaaguuggguauuuuaaccuguggcacaggccuaacuuaaauacuauauauauuagggauuaucuagaaacaauugugucuaaggcucugacuuuucuucuccaaccaucaagcaggaaaaagguucaggauucucaacaauaaccuuuuuuuaaaaagaaucuaaucacccauggcaagcaaagaaagugcacgagucagaaauaccuuuuaaccuaagccauguucggggacuagaagugacuaguccuuuggaaacuggagccaacccgugcuguucaugggcagaaguuccccuuucucuucagugcauuaucagcccagagacauuccuagaggucaaacguaugugcuacuagcauaaucccgagcaagaguccuuuaccauaugggcacaggagcuggagagguggcucagugcuuaagagugcuuacuguacuuccaaaggauccaagucugcucccaugcagggcucccaugcagggcagcuuacaauugucuguaacuucaacuccuggggaacucaacauuaauggucucugagcauucacauauuuucucucucucuggaagcauuuguauucacaaucacauacucguucucucuuacacacauaaaacaacaacaaaauacaauaaaucuuaaaaaaaaaagagccuuugaagaccauucaagauccaaacucaggaaguuguucugagaugcaacauugcagauucuauuguguuugucuggggacagacuucauagauuucauguuccaaggguaaacuauguacugaauggggaauuuaacuuguccugaacccucagcagggaaaugaggcuaagaaaugaaguguuuccacuuugauuaucucagcuuccacccaaauuuacaguuuacauacugguuuugauuucaucuuuccacuauuuaaaaugguuuuuaucacacucuaaaguuugguaaacaguucugcucuaucuagucacauccccauccuugcaucucaaaggaggacagaacaucugucuucucccuggcaucugagcgacgggcagugguccaugugucagucuucaucugagucaccggggcccauguacuggcagauggcguuauaguggagcuccaccaccugguucucucuccuaaguuggaccaaagcaugacucugcgcucugucccgacuccuaagaagucccaccugaggaaggauggggcagaguaagcaaggucagccaacauccacagugaucugaucuucagacuccuauuuccagacaugggacuuaccuuuccagcaugugguccgagcaccaccaucacacgguggccuucucccuugggaaucagggucuccagcauaucuucucucacaucuacagaugagggagagggaaugagguccacagcaagaaccagccugguugguagggccuuucuaauauuuauuagagcuacucuuauauccugcugauagauggagucacacucuacccauuucacaggugagaaaaccaaggaguaguuuacagaaguuaccacaauacaggagcauuuuccuacagaaacuauguacugggcauguuuucagccuacccuauagugcaagcucaguacacuccuuccuguaaaggcaauaguuuugauagggacaaacugucauuuccugcuacucuaacuuggaaaauacauaggguuuaggcuaucucuuuuaaggaaguaucugcucugaaagaggaugcugggucuugcaaacaaccugaauccugccuaacuucccagaucuuggcccgagauucuuuuuuuuucuuuucuuuucuguacuuuuccaucccccuuucuuucuccauuucuuuucuuuuuaaagauuuguuuauaugacuacacuguagcugucuucagacaccccaucagcaaauccuaccggugugcgccacuacuaccggcuucagacaccccagaagagggcaucagauuucauuacagaugguugugagccaccaugugguugcugggauuugaacucaggaccauuggaagagcagugggcgcucuuaacugcugagccaucucaucagccccccuuucuagcuucuaaaaaguuuuuuuagauuuuuuuuuuuuugguuuuugagacaggguuucucuguguagcccuggcuguccuggaacucacuuuguagaccaggcuggccuugaacucagaaaucccucugccuccagagugcugggauuaaaggcgugcgccaccacgcccggcuuagauuuuuuuauaugcaugaguauuuuacuugcauguuaugccuguagcaccaugugugugccugcuguucacagaugucagaagagggcggcagacagauccucuggaacuggaguuccagacaguuaugagcugccacaugggugcugggaauugaacuugaauccucuggaaaagcagccagugcucuuucuuaaccacugagccaucgcuccagcuccucaaauagacccguucuuuaucauccucuaagaugggaacaucccagguauaguagcucgauuuaccuuccagaacucggccuucauccguccgacacacacaugugucugggcucaggacaucuucaauugucaucuagagagaugaauagaaguaagauguuagaaaguuaaaggguggcugggcagguguauuucugaguucgaggccagccuggucuacagagugaguuccaggacagcuagggcuacacagagaaacccugucucaaagcaaacaaaaaacaaacaaaaaaaaaaaaccaaccaaacaaaaagaaaguuagaggguacaguccugggugaaggaggggccuccggugguggggaaucauaccuugguguuauaauagcggccacucuuguguaguuugucaaugaaccgcacacguaggucccugugcaaccagugcuuguuucuaggggcugcuuucucagucuugggcacagguccauccugucuguggagaaagccagaagcuagcuuagcuuguuauacucauguuguagcuggccuaucuuuaaaagccaugcuguaaaaccugccccuacugcuguucccagucccuucuaugcccugcuuugccuugacuccuugagccaccuuauaccaugcaaguccaguggauuagcuccuaccggucgggagaguguuuccgcuucuucuccgaacccuuuugccuccucuuugagucuuccugauucugugcagccuucaaugacgaggcuguuccaguugcucuguuuuguuguucuguggaaguuuggcucacauggccuguucaaggggguauagggacagcaagaagaaagccuuacuguaucaucggcauuuccauccaagggucauuguccuccuggcuaaggccccauucccaauccaccuccuucaagaagucccucucaaccaccaggcccacaacaaagacagcagagucaacugccugguguucacaagaguggaagaagagccacaggcaccacuguucuguuagccucuccuugcucauacccuaacccuagugucauauuuagcgaaagaggggacugccacuuuaaauacaugaggaccucuugggguagaaacuggauucucugagcaguaagagaggaugaagaugcaugguguuagaucaaacucuucucaguuaagcugagggcagggcucauugcuagacacugucaaggcucuggguucuaaucccagcaccaucaaacaaaaaggaaauaaacuacucuugucgcuucucaucccugaccucugacugcaagucacacagugcccuuucuccuuacacauccggagagccugccuguccccaugcuucucuaagucuccagcucuaagagacucaccuggcuucgagguguggcuaucaaacuccugcugggaaacaggccgcaggcaauacucacuaacagucacaaugcgguugcccacugccaagcgaaccauggcccguacguugucaggaucuaggccuucuaccuaaggugggaaggaaggaggaaggcagaaggcagagugugaauggacuacuguugcuagcccuaaaaucucuagccauuaccucaaccaggcuuggucugucugucugucugucugucugucugucucucucucucagcuguaaccuuugcauuuguuugucuuguuuucgaauaggaguucuccuagguagcagagguuggccaauaacguagaaauccacgcaucuuucagugcugugauucaagguguauaccacuaugcccaaacauacacugggaccuuuggugauuaggagcaggcaugguuccuuugucuggucucucaaaccaugacucaaacccgagaagugggaccaggucucuguuccuguguuucccuuagcaaaauggaaaacgaagacauguggucuacaugcacauacccgcuguuuguguggugugugcacauguguguggaggacagauguugacagcagguaucuuccuuaaauauucguuaucuaaugcuuuuuccuuuuuuuuuuuuuugaaacuauguagauguagauagcccaggcuggccuggaacucacucuauuagcaggcuaucuucaaaguuacagagaucugccugccuuugccuguugagugcugggauuaaagaagugaaacaccuuacuucuuugacauuuuuauuuaugugugagcagcguguuuuugcuugcauguauguguuuguacaccaugucaugugcaugucuggugucuguugaguccagaagaggguguuggaucuccugggacuggacgguugugagcugcauggugcuggaaauugaauccaggucugggagagcagcaaauacucuaaacugcugagccaacacuccagcccccaccaccguuuuuuguuuuugagacagugaaccuggagcucacugacucagcucugcuggcuggccaaugagccccauagauccaccucgagucucuccuccccagcucugggcuauagauggguguaugcuuggcucuuccgugguacuggggacccaaacucauguccucaugcuugcaagcuagucaggcacuuuacacacugagacaucuccccagcuuucacuuuguucaagacaggauccaaggccagacuaguguuugucauauaccccaggcuagccuuaaacuugcagcaauucuguuggaguuucuuagguacuggguuagcaggguuucuucagcuucaauacugaaguuuuguggaaguuaugggauauggucuuuucucccuucuggcugagacugaggcucaaaggccuugcagcugccacacuuugcugaguuuuacacaggcuuuggggucuucaagcuuggguaggaagcucuuuuccaugagcuaucucccagccccuuguuuuuuugggcacaaguuuugcuaaauaccugaggguggcuuugaacucacuaugguuuuauuuuuucugcuuggugccucuuccuacuuacugagcuagaucccuacuccuuuaaaauguuuauuuuacuuuggacaauugcuaggcugccuuugaauucccuacagaagccaagaagcucuugaauuugugaucucccugccucagugucugcagugguaggauuacaggcauguaccaugacaccuggcagccuuuccuaaccaccaggcuuacucacuccagcuaccugacauggcuucaggaauauguuuucuuaccuugccauagaggccccgguaggggccagaaaggacaaccacagcucuuccaugcaucagcccuugagguuggccuuccuuaucauucucucgauccccaucuggucuugguggguggugagagccuacggaggccaaguccugagccuccauccgguuggcaccuagcccuaagcccuucggccuuauagaguugacucggggcuucacuacccugcagagaaaaauaggcuuguaggaguacaaaaggcaagccuuccaauauccaacccaccucagcaauccuuguuuuaauuguuaauuuacuuguguaugcuuguacaccacaacacacauguaaaaaucagacgacugcuugggggugggaggggcuguucucuuucagccacgugaguucugaguucaucaggauuacagacaagggccuuuaccugcccagccaucucaccagcucacaucuguauuuaauuacccuuucugauaccauauaaggacucugugaguuauaaaaaugccaacuuuucuuuuuuugugguguuaggggucaaauccagggcuucaaugcauaagccauucuaccauugagccucacuuuuagugcccccauagcaauuucauguaguguaacuaaauuaacuugucccauauacucuuauuacuccuaucuacaagugccaaguuagguuuguauaaacaaauauacuaacuaauauauuuacagaagaaaucauaauauguacacagagcaaggggaacaguaaagaauguucacuaucaaucacagucauaucuggcuuaccaaaugacuuaaauucuuugggauuuacaacugcaaagggauuuugcuuucaguucuacagauggaagaccuuuuacaugguagguaagcuacacaccagcccaacaaaaggacuauaagucuauaaaauaagagaaaagaugcuuaguuugggggcuggagagauggcucaguggguaagagcacugacugcucuuccaaagguccugaguucaaaucccagcaaccacaugguggcucccaaccaucuguaaugagaucugaugcccucuucuaggguguuugaagacagcuacaguguauuuacauauacuaaauaaauaaauguaaaaaaauguuuaguuucugcuaguuuauuagggacuaaauccuacucuugcaacaaaccugugaaguuaguaccgccugcauuuuucagaugaggaaauugauccacaaagaggaccuuaguguucuuuuggaauaacaacgcuguggaaaccacaguuugaaacaguaguggguaacuagugauaauguccucccucagcaccuagauaguucuagauuaaauguaacuacaggggucuuauuuauacccauugucccccccauuccccccaccaaacucacugacugaagguauugccgaugcccuugccagguuuccaucccaugccccgcaacauggccagcccauaggccuccacagggacugccucauagucggcuuccuccggcaccuauuggucaggcaggagaagagagucagguuuugcuugggaugggcccucugccaugcacuugcugccugccacucacgggcugacuuucucuagcccuggccccugaacagauagcuugaaggacaguuuucauuucuuaucacuccucacucugcuccuccacccccgagucuuucaguaacaacaaaacguuuuuuaggauuauuuuaugcuaugugucugaaugguuugcuuacauauauguaugcccaugauguguguugugcuugguuucaguggaggucagaagugagcauuugaugcccuggaacuggagguauggagcaaguguucuuaacucugagcuauugcucuacugccccuucuucccagucugucugcuugagacaggcucucacuaugcagcucuggcuguccuggaacucucucuguugaccagaccaggcaggcuuuaaacucagagaucagccugccccugucuccuaagugcugggauguaauacauggaccaccauacccagcuucaacaaauauccacaugcuuucaaaagauuuacaggaccuuuuauuuaggugcugaggauaaggaacuaauaaaauggaaaaagucuguugggccuuaugaucuaguugucaagacauacaacaaaucgaguucugaaaacacgauacaucaaguggugacacauuuaaaaauaaaguggcacuguccaguaggcccugcuauguaugagguaagggaggaaucuagcuuaaacccaagaauuugaaaccagcuugggcaacaugcugggacuccccccacccccaaucucaaaaccaaacccaaacucaaaaaauaccuggcuaagggaauucaaagggagaugggagccacgaccugacauuuaaucagauaaaugauaaaagauagcagaacagaugaggaugugagaagacugcuccaaacagacucgguuguaaaaauaaagggcauacuugggaggugggagcagcuuaucucugugagcucaaggccagccugagcuacacagugaagcccugucucaaaauacaaaacaagcaaaaaaaagagccugcaguaagguuagacuuuguauguaugguuaagaaccauggaaaucaacaggaaagguggaagcagagaugguaaggaauuaaugaggagaacuggaaacgucaugggaccaagagucacaugggagccccaagaaagacccaugagaaacuuaguccagaugcugccucugcccaggaugcuaguaauguggaugacuaagaagcuauuggcuucuggaucuacugaaguggagaugaugagguugggcugauaggcuacguguagaauaugaaauaaaaagggaagucaaggauuggcuccaaggauuuuaagcugagaggacggauggcuagaauuguggucaucugagauguagaugguauggaggcuuggagauggggaaauuagagagaugaggucaaggccagaacaggauagaaugaaguaugggcaagaagcacagcucauuccaggacaaccagggcuauacagagaaacccugucucgaaaaaccaaaaaaaaaaguauagcucaauaacaggcauuuuagcacagggaagguccugaauuccaaucaaagcaugaaaaguaaaaagaaaaaaaaaguuuuguuuucuuaaggaaggcaaagugggacguaguuugcacaccuuuaguuccagcacuugggaggcagaggcaggcagaucucugaguuugaggccagccuaaucuacauagacauucagaacagucaggaauacagcaagacccuguuuccaaaaaaguagggcagaccaaagccugauuauaguuguaagcaugaaguucaaggucauuuuuaucaacagagugaauucaaggccagcuuagacaacaugagacugucucaaaaagaagaaaguaaagcacacgagaaggcuaagaccagcucagcugaaagagaggauguaucacaaaaauugucugaauaaaagcuaaaauacuagccaggcgugaugacacauaucuuuaauccuagcacucagaagguagagggagguggaucucugugaguuugaggucagccuggucuacauaagugaauucaggauggccagaggaucucuguuauacagagaaacccugugucaaaaggaaaaaaaaaagcuaaaaagcuaagaagcugaacucaaaacuugacuuccacaaacacacuuuccaucucuuuugcugucauuucuucauuccuuuccaaugauacagcacacugcaaguuggcucagauugacccauaaguguugcuuucuugggcuguugcugccauuaagagugcccacucugagcugggcgugguagagcacgccuuuaaucccagcacucgggaggcagaggcaggcgauuucugaguucgaggccagccuggucuacaaagugaguuccaggacagccauggcuauacagagaaacccugucucaaaaaacuaaaaagugcccacucugaucauucuucucucacuaaacccuaacuguccuuccagcccucacuccagccacuccuaugaauguguguguccuugugaccucuauccugcauuagguuccuuucuuccuucccuaccuucacuuccuagucauuuuuggucaggacagacaauggggacccuguuauaacccuugucugcucaagacauccccuuagcucucacuucacucacaguaaaagacaggagcccucuggagcucagaaugcccuuucuguccugccccccucugccuucauccacugcccaaccccucaucauucacugcaauccaguaguaggcuuucucagugcuccucaaacaugcagucugaaaucagaccaaagaaagaaggaaagaggaaacaggccaaugcggcuccaaacaaugcacagccucauggcaccuguacguccugucuacuuuguuguccaccucauucacaucaucccagaauucaaguacguuuuuaaaaugcccuaucuauuuuguuaauuuuucuaauaagaauggaaggaggaaaggcuaauuggcagggcuuagggacacgcacacacacuuuuccggcuaugugcaaggaggcuaggcagccagggcagagggaacaguguaggagggagguagaggggccgcucacugucucagccugagguucgcugucugauccuuccucaaugggaguacauccuuucuggaucauggggauagugagcguggggucaacaccugcauucucccucuccuccagagacuucuuggauucuaaggaagaaugggagggaucaaugaggccacagccuauccuuccaacaucuuccccuucuaucugcacuggggcagagcaaagagacaggguccacucacccucaaugaguuccuucacagccugggacaacacaccgucugacaucaacacggugcuaguuucugaggauggcuuaggguucuuggacagagguugccugcgagagccauucuggaucaacgggauaaccagcuccuugggggcuucuggaggguucacacuuaugucgggagagaaaaaagguugggaaaguagacaugucacaaagcagaaauaucaggccggcaguggugacgcaugacuuuaauuccagcagcacucaggaggcagaagcaggaggaucucugaguucaaggccugcccgaucuacagggugaguuccaggacagccaggaugcagaggaacccugucuugacgcccccuccaaagaaagaaaguauaaauaucaagauagaaaggagguuaggaaacaaagaaaaucaauuucaauggccagaaagaaagaaagaaagaucaaugcccaguccuauggaccauguucacagguuacuauucacagguccacucguuuuuuuuuuuuuuuuuuuuuuuuugagacaucucacgauuuagcucaggcuggucuuauaaacucucagucagccuggugcaauccccuagugcuggaauuacaaccauggaucucuuuaaguaugucuugugggaaucagccuuaggccuucaaccacaauggccuaaaaaucaccaucuuuaguccagauucuucccgguuccgggccggcaagcugccuuuuacaagucccccacuuaggccuuucggaccuuuguuucuuacuuaauuauacugcugauggccuccccagacuugaauuugccuaguucuccaaaucggagaagcucccacaauuucagcugagacaggaagaauccugucauuuuucccuccuuucccuuucucaaaaggcacacauacucaagucccaacgacauuuuuucugaggaaucuauaccucugguucucaggccccauuucacccaccuaacaaaccucccucuucuugcccuuacauucuuauguucuuccuguuuguuuuuuaguugcccaggcuagcguucaauuccugauccuccugcgccagccucccagguccugacuuauaggcguuugccgccacuccugguuaccuccauaaauuucccgaggcaguguuucaggcuuuccaggccacugucaccaggacaaacaacucuuacucugcccuccugcuuaagcccauuucacagauuuccaaaacgcgaaagacccggcguuucaccucugcagcuuccucccuuccacggucgccaagaaaucuuucuccucuggggccugucuuucgcuaucuccgaggucugccagucgccuccggacagacgugcgagugaacccgaaagaaauuggagccauugacggggcagacggcggcggacucucacggcccgccaucuucgcucgagucacaggcgagcgcuccgcuugcugggaaguuuagcucgagccgugaggggcuggccgggaaacguaagaaucaaucccagcaug

SEQ ID NO: 9365 - RNA, 16889 nt, Mus musculus
agcguggcccaaaccacugcguguggccuggggggcgcccacgucgcgaccccugcaacccggcgcaugcgcggccgcccggacggaaccacacggcugcacggcgagggggggaaucgggagcggagcccgccgcccgcgcucccgcgcgccacugcggagggcggccaucuugggacguuccacuugcugaagggggcagagugaggaagcggcgccuggccacgaacggccaccaguccgcucgcccuagaaccccgucaugguaugucuucugcguggugacucuggcggaugguaagaucgagucagcggaaggccucuaugccacccaccacguucacccgcuuuccucuaacccccuaauccuuccuuuuggaaccggcucccaaggcacucgcgcaggccauugguucggaagcugcccugaugagcucugauuggcccucuuccggauggaggcgggucuuccuuucugagguuguggcccugggaauaacguggcuccgccuccacagucagguuccugcugacugccuuggagcaugcgcagcgauuguagccugugaacugggcaucgggcguggguaaaggguucaaauaccacgucagucuguaaaauuagucguggguaaaacgucagcggaggguacuuguuuacugucgaagcucuuaucauaacuuuucugagguagcagauuaaaaguuaucaauccuauugugcacaugguugagcacaccuuuaaucccaucacuacagaggcagagacaagcugauuuuuuaauuuggggucauccuagucuacauagauccaagccaaacgggugcacgguguuggaaacaagcaauaaauaaucuuggcuuugcauaaaggggcacucaaauggaaagcaaaguagcugggcauaguaauucuugggagcucgaauggaggaagggccggugugggcaggggcagccguaaaagacugcuugaacgcaaaccugggacaacaugacuacuuucauuugucccuaguauaaguguugacugcauuuuaucccaauggugugaacuugacuuccuaaucugacacaauuggcuaaccaaagcuaaggggaauagaaaaaucucagaauucaaguccuugccagacuaacuacuuuuuauuuuauuuuauuuauugauuuauuuauuuauuuugguuuuucgagacaggguuucucuuuauagcccuggcuguccuggaacucacuuuguagaccaggcuggccucaaacucagaaauccgccugcuucugccucccgagugcugggauuaaaggcgugcgccaccauguccggcugagacuacuuuugauuuaaaaaaaaaaaauccucacuauucuccccauuuauuaugcuucuuuuucaaacguagcaagcauauguuggccauuugauaucucuuacuguuauaagugaugacuuacacgccuuaaaacacugguucucgaccuucgucgugcugugacucuuuaaugcagcuacuccuguuguggugacccccaaacauaaaauuauuucgcugcuacuucauaacuaauuuuacuacuguuauaaauuguaaagcaaauaucuguuuuccgguugacuuaguugggauccaguuguggguugugacccaaauguugagaaacccuggcuuaaagucgguaugccucccaaaggggagucuuuugaucaagcaacugagcuggcccagcuagaaugugagcuuuacacucucuccagaaauucuguuacuugccuaggaagaaguuuuuacaagccuuuacugcuauuuacgauucuccccucuggaaaggucacugcagaaauguuuaggagccaaauuagaggucagauugcccaaaacacauuggcaugucuagucuugggcaaggaagaaccugacaagaggaacagauauuuuuguuuuuuagaaaaaacagaggggggcuggagagauggcucagugguuaagagcacugacuacucuuccugaagguccugaguucaaaucccagcaaccacauguuggcucauaaucaucuguaaugagaucuggcgcccucuucuggagugugucugaagacaccuacaguguacuuacauguaauaaauaaauaaaucuuaaaaaaaaaaaaacaaagaggcuggagagauagcucaacaguuaagagcccugauugcuccuccagauguccugaguucaauucccagcaaccucaugguggcucacaaccaucuguaauggaaucugauguucucuucugguguguuugaagagagcaaaguguacugacauacauaaaauaggguugggggggaagccgggugugguggcgcacaccuuuaaugccagcacuugggaggcaagaggcagguggauuucugagcuaaagaccagccuggucuacagagugaguuuccggacagccagggcuacacagagaaacccugucaugauuucucaauguuaacaacuauguaaauuauagauaaauaaguaaauagaugaccauaaaagaaguggcacuggguaggaauuuguugguuuuggggggguuguuuguuucuuuuuuucaagacaggguuucucuguguagcccuggcuguccugaaacucauucuguagaccaggauggccucgaacucagaaaucugccugucucugcuucccaaaugcugggguuaaaggcaugcaccaccauggccugguucuuuaaaacauucuuucaagaagacgugacacuccaauuuaagcaaacuuucuacugucagaguuucuuucuguacaauaagccauaaauucauagggacugagcuccaccagcucugggcuccuucccaucaccuuaauuauuuaauagauucuuguugguuuuguuuguuugaaaugaggugucacuguguaucccuggcuggcucacuauauagguagaguggcccggaacucccagaguucugacacucuccucaaacauggaguguacauggugcccagacauacaugcaaacaaaacacauacucaaaauguauucugaagaucugaaucacacaugguuauaaaagcaggcaaguacuggcacugaaguggaccaaggacacagaaggaggucagcacacaaccccugcauggagagucgccaaguacaggggaggguaugaaaauaagaccuaguuuccuauauaauacucuguugcaaggcccacucuggauaaaauuaaggcuuaagaaucuuuggauggaaggaaacagcaugauaacucacaccaguaauccuaacacucaggaggcugaggcaggaggauuguuaggaguucaagcccagccuggacaauauagugaauaucagacaauucaaguaaacacaguaugauuggaccucaaaaaauaaaauaaaauuuuccauuuauuuugcguguuucaggagggggcauguguuccaugaugugcuuguagaggucagaggacaauuuucuagagugaguucucuccuuccgccaaugaacucaagucgucaggcuuggugacaagugcacacacaugcugagccaucucacuggccccaaagaaaucauucucaagaggggaggugcuaucuuuuuuuuuucagauuuauuuuacguguaugcgugaauguuuugucuguauauauguauugcaccauacguuugucuggcgccauuagaggaaagaaggggucacagauggucaugugcuaccaugugggagcuuggaggaaagcccggguccucugaaagaacgagugcucuuaacugcugaaccaucucucaggcccaaauuguguuuaagacuuccuuuuuuuuuuuuuucccuccaaggcuggaauucucugugugacccuggcuguccuggaacucacuguauccaugcuggccuuaaacucacgcagagauucaccugccucugccuccugagugcugggguuaaaggugugugcuacuaguggacugcuugagaauauuucuauuuaaaagaaagagucucuacguugacaaccuuuaccacacacuugagccucugcuagaauccuugauuuucagcuggcaaguagcuucaaccacacucuagaagaauagcuaauuauuuaguucgauuuucuucuuaucuauguguauguguuaacuaaaugcccuguuaguguggaugcccucagaggccagaauaggguaccagaaacccuggagcugaguuacaagugguugugagccaccugauguguguugagaucccaauuugaguccucuggagaagcagcaaaugcucuuaaccacugagccaucucuccaaccccuaagagggcaauuuuucuuuaccgaguccccauacuuuuuucuccugccucaguggcaugaggaucaggaauuuaagcucucaaaggacaacugaaccugcccauacuuccgccaugagguuaguacuguucccagcuuucaucagaucagcuucugaguacagaggacagugguuaaugcacaaacccauaccugguaaagaaaagggagggcuuggaacagaaugggaccacuauaucauaucacccccuccaagacucaggggacaucaaagggaaaggggagagaggaugugagagccagagaacgaggagauguauaccaaaaauaugucuccugaagcugacuuugccuuugcacucaugacugaagcugugauugucugcacaggacuggcacaagacugagcucaucgccaacacuuuguuaugagugggagaagugggucccaccccuccuuucaggcaauuaaguguuguuagggaaaaugauguaguuuccuucagugguauaggcacugauaaguuggcaaaucaccuccugcccauucucaagauuuggugcgccacccaccaaaagaagccauuaaaguagaacgggugcuuguugggagaaaaggguuccagcaggagaaggaggggcaaugagagaaggggauggagaggauuaagcaaggaaaacccauuauauaaaugaaacuguccacacugucaaaagacaaagggauuuuagaaaaaacauaaaaggaagacugaugacuucaaaguaaguuucauuauaaggaaguguugccccaagcccaucucuccccucaaagugagagagagacacagaguuggccacacaggaccauaaagaacuuaaauggccauuuauaacggaagggcuaaacacugcugucuuggucaagguuucuauuccugcacaaacaucaugaccaagaaacaaguugaggaggaaaggguuuauuuggcuuacacuuccauacugcuguucaucaccaaggaagcaggacuggaacucaagcaggucaggaagcaggagcugaugcagaggccauggagagauguucuuuacuggcuugcuuccccuggcuugcucagccugcucucuuauagaacccaagacugccagcccagagauggucucacccacaaggggccuuucccccuugaucacuaauugagaaaauaacccuacagcuggaucucauggaggcauuuccucaacugaagcugugauaacuccagcugugucaaguugacacaaaacuagccaguacaacugcuauauuugaauuaugaaauaucaugaguagguuaaaaaagaugagguuagggcuggagagauagcuaagcagguaagagcacuggcugcucuuccagagguccugaguucaauucccagcaaccacuugguggcucacaaccaucuguaaugggaugugauuccuucuucuggugugucugaagacagauacuguguacucauacauacauaaaauaaauaaaucuuuaagaaaagaugagguuaagccuggcgugguggcgcacgccuuuaaucccagcacucgggaggcgguggcaggcagauuucugaguucgaggccaaccuggccuacaaagugaguuccaggacagccagggcuauacagagaaacccugucucaaaaaacaaacaagaagaaagaaagaaagaaagaaagaaagaaagaaagaaagaaagaaagaaagaaagaaagaaaagaugagguuaaacagaagauuacauguuaauuggagggacucuggccagcuugagcauggccaaccuggcucuggcaggccuugcccuucucauucccucuuccuugcuaaaaaccauuagauuccauuccuaaagcuaguccccaaggucuauuccuuacuuauccacuuccuccuccugaugcugauuaacaaggucaagcuaucaacuguugaaauccagcaaucaaaaguggcccuuuggcuccccuaauuaacaggcccaguuaaaaugaaacaccucauccuaacaugggguuuccccuuuuaccuuuauagaccuccuuuuuccuauaugcaacgccugucuggcuuucuccuugguccauuuccccugcuccucccuccucuaucucuugucuuugucucuuauucccugcccucugccccucugggauaaauaaaucuuuuuugcugagaacuuggucuuggguccugagcugauacuucuccuuucauuaauaaagccuucaccucaaugaacaaaauacaagggugacugagaaugguucccaaugucaacacugggcccccacauguauacauacucaugcaugugugccuacacacacaugcaaaaugauacauacacacacaugcaccacauguauacacacacacagagaaauggaaacagucaaagaaagggaguguuggcugugauuauuguuuaacacauuugauagguaaggaagccagggcucagugggauucagcaacuugccuguggaugcacagcuaaagaaugguacaguagccgggaggagggaaucuucuaaggauaugggauauagaauagaaucauauaaagggauaacaggggaaacuacaacagaaggauuaaguauggaggucaguauagaggagggacuauagaaaggaaggggugauuaagacuaaaggucuuuaggccaggcugugguggcgcacaccuuuaaucccagcacuugggaggcugaggcagguggauuucugaguuugaggccagccuggucuacagagugaguuccaggacagccagggcuauacagagaaacccugucucgaaaaaaauaaaaaaaaacauaaaaauuaaaauaaguaaagacagaagcagaguguuaacuauuauggcucugauuaugguaaaugcaagguaguuccccauucuucuuucccuuuuauugacuuuuuuuuguaacucaggauggcacaaacccuccgauccuguuucaacagccaguacuaacucguuuauuauuucucacaacugucgugcauauugcacuuaucucaacacucuaauauuuccagugugcaauuuggggccuuuuguguuuccauguaagcauucucuguuuguagcuuuuguuaaaaaagacaggaccucauguagcccaagacaaccucgacugucccucgccaacuacuagcacuacaggugugugagcaaucacgcccggagcacucacauuuuacgguaacaaaggaucuuuuuguaaagagcuaggaauaggguggggaaaagaaaguaaaauuccacucuuaucuuuccccuacucaagcugaucucaacuuucaagaucuuuuauuccagccaggagcacccagagccacaagguaaacaaacauugauagccacucuagcccaacucggagaacucguuagccugggagguuugccccucuaucucuccgugaguuaacgaguucaaugcuuggcccgcuuccguuugggggugggggcaagcccuuucccggguucccuuagacaguccugccuuugggcagucuuuugugccuccaguccccuaauccgcccucauucuuuuuccggaacuucccucggaggacucuacuacugcucgggaugcuccacagguccgccaagugggugagaagagcccuggcuggagucucugcccagaaugagucacuuccguucacagacucccuccuccggaaguaagaccugauguaaacagcagagcugggcaccaaagcccgggaggucagaaauuugugccgcaggcggcaccaacggcuagggcaggggucggggaggggugaucaagucggcagaggugacgcgcaucuggagcaagauccaaggguuggucacggucauggguuggguguuucuacuagaggucuugacaggugauggauggcuggggauaugggggcuugagucggugcugucuuggaaaggaucauggcuuuugggagagggugaggcguuucaauuaggguucuucguuagugugggcauuuggagcauagauuuaaaaagggcucuuggaagcuagugcucuccagaguauggcucauguagaagcaagacccaaguuuuacgcgagaaaaguagauuugcgaucuuagcugauaggugugccugaagagaggucuuggaagagaugggauuugaaaaaaggacgagguuuuuagggcaggaauguuuaggggagggagucagagcagcagcagcagcagcauugguagguugagguuuuccuaggcaggauauggguuuuuuuuuugggaggggguggggcuagcgugcccuagggcagaaccuucaagagauagcauggagacaaaagggacaaauuuuagggggaggggacucaugaguaacauuguguaagcuuaggggucguggguagacaguauagggaauggaaugugucacaugugaagaauuuggaaugucagaguaaugccucgggugugggguaggguguggauuggucuuuaggacuuaaguagagggaguggaggggguucucaggcuugccuuugccuugagaguuggucauaugagagaaggguuuggggaaaguaugcugcaugggaggauguaaaugagauacccuggaggcgaauaagccuccagguaaaguuagaagggcuugaggagggcaguucugugggugaugggccauucacggcagugaagaugcaggaaaccuuagcuuuuuuuuuuuuuuuuuguuuuuuuuuuuuuuuuuuuugaaaccuuagcuuuuguuccacuauuuauugacagguggaguugggugccggugugcagaugaauagcuuguagagagguuugaggucauaucaaacauuagagcuaagaauggcugggaggggggaggagguaccaugggauauucccuaccccauuaccccaugcuugguguuugugccuguuaugaggcuuuuugucauuaugggccgggauacguucugccuguggucuugguuuaaacagauacucugagguauccuccacuuguuuuuguuuuuuacagucuggcaaagaaaaguaucaaaauggggaggaagccaggcgugguggcauacgccuauaaucccaucccucaggaaguggaggcuggaggacugcugggaauugaaggccagccugugcuacauagggaguaccaggacagccagggauacauagcaagacccuaucucaaaacaaaauagaccaaguggugaggaagaagaaaugauuugggggacagaaguuguaggacuucagagaggacacuggggaacucuucacaaugcugucuuuucuugcgccuaggaaggccguccugaaucaugacucagcagccacuucgaggugugaccagccuacauuucaaccaagaccaaaguaagcuuaugauugugucuuugugggaaagaaggaaaagaagggccagggaugacucugagccccagaauacgggaguccgacugauuccuuccauccccaggcugcuuuugcugcgccauggagacaggcguccggaucuacaauguggagccacuuauggagaaggggcaucuuggugaguggcuguagcgguggggcagugggcagaagggcugaugugugcauuggcauggaccucuccugacacccuauucccuguccagaccacgagcagguaggcagcgugggccugguagagaugcugcaccgauccaaccugcuggcccuggugggcggugggagcagccccaaguucucugagaucucagguaagcgcuuucauccuauacuugacccagauuccucaaauuccucccuucccacguauacccugagggcauggcaaauaaaguccucagugccucuugagucccacaguaaggcacaguuuggaagucaugaaucuuauagcuuaaguuucgucucuuuaguauuuuuuuuuugaggcagggucugucuaauucuuucuaaaccaggcuggucucaaacucacacagugcuauuggggcuggagguauagcucagugguaaaacacuugccuggucuguacaaggcccucgguuccauccccugcacugucaaucagcaaaacuacuuauugucugucaccuauuucccugguucuuguuuuucgagacaggguuuuucuguguagcccaggcuguccugggacucacuuuguagaccaggcuggccucgaacuuggaaauccaccugccucugccucccaagugcugggauuaaaggcgugcaccaccacgcccugcuauuuuccugguucuuaacaaugggacacuuacagggagacuacuaauuaaucuacguacuuugcauacaaacauguuaauuugagacaaguucuuuuguagccagguaugaccuugaaucagucugucucccaagagccagaauuacagccuaaugcuguaacaccagacuuuauauauuagcucauuuaguuuugugaggauuuucuuuuucuuuuuuggugauguagggcuuuuuuuuuuuuuuugguuuuucgagacaggguuucucuguauagcucuggcuguccuggagcucacuuuguagaccaggcuggccuggaacucagaaauccuccugccucagccucccgagugcuggaauucaaggcgugcgccaccacgccuggcgauguggagcuuuuugagacagggucuuucuccauaguccugacuguccuggaacucucuacauagaccaggcugaaugcaaacugcuaggauuaaaagaugugccccuccaucccuggcucauucugugugguaggaaauacugcuagucucucuccguuuuccugcuguggauggaacccaggccuuugcacauguucugucacuaagccauacuccgaccuccuuguccucauuuuuauggaugagaaaacuguggcucaguuaauagacuuacccaagauuacacaauuacuaggcauucaaaacuuggagcugucucucuuaugcccucuugguuugagucucaaguaccaucuuguuuuaaggucuuuuuuuuuuuuuucauauugaccccaccaauaucuggcaaguguuguccugggugagucauagaacccuagaacucaucacaggacucuccugaggguauagacuggauucuggagacugaaguaggccugauaucaagccuguaacugguugugcucauuugagccuugcuuuccuuaccuccaagugauagggcugcucuagaaugugcuuuaucagcgaucugguccacaaguacucaugcgguaugaggcacacacugacuauuugaugaaagcggaagcaagugguugagauccugugaggagcaggagugggcacccaggcugccugucacccuaaacuuuggucuugccaacccacccaucugccuggcagugcugaucugggacgaugcccgagaaggcaaggacuccaaggacaaacuggugcuggaguucaccuucaccaagccagugcuggcugugcgcaugcgccaugacaagugagcuugaugaagacuggggacaggggcgggggcaggaaguucccacaacaaguaagguaaccucccgcccuccacccccugccgcugccacugccuccucgccucgcuggcaguugccccgugcuuauggcccucuguguuaugugugaugucuccaggaucgugauugugcugaggaaccgcaucuauguguacuccuucccugacaguccaagaaagcuguuugaguuugacacucgggacaaccccaagggugagaagacccagauuugccgguguaagacugaggcuguggaaggaacaaggagaggaggagcuaagagaaggggcauccugacauugcugggggacaggcucugugcccuuccaggcccacagucaguuccucuucccugcccuaguccugccccaccugacagcagaaagcauucauugagaacguggguagguguguccaugagcgcuggguguucagaugggcgagcagagcuuacugcaaagccuuaccccugugagguugcuaugggcaccaugccacggaggguucaauccggcccucccucauccagcucuguccauucugagacucagccuugcccuggccucuccuucaccugcccauccccacuucauccucaccacuuagggcugugugaccucuguccaagccuggagaagcagcugcucguguuuccuggacacaaguguggaagucugcaacuuguggugagccagcuagcgggcaaggguggagagcugggugaagugccugucuuugggaacguuggucccuccuccguuaacacccccaagcccaaucugcucccuccuacuccaggaucucgcaagcacaaagccugguacuucgucggcgccauucacuaucaaugcacaucagagugauguggccugugugucccugaaccagccaggcacuguaguggcgucagccucccagaagggcacccuuauucgucucuuugauacccaauccaaggaaaagcugguagagcuucgaagaggcaccgacccugccacccuguacuggugagcacaggacguguguggugggcugcuuauguuucagcacaagucguuaugguggacuucauuacgggucugucuugcagcauuaacuucagccacgacuccuccuuccucugugcuuccagugacaagggcacuguccacaucuucgcucuuaaagacacccgccuuaaccgccgcucugcgugaguaucuucacccuccuaucccaaucccucuggccgcgugacaugccuggacuuaccaaacgcugccaacaggcuggcucgugugggcaaagugggaccuaugauugggcaauacguggacucucaguggagccuggccagcuuuacugugccugcugagucagccugcaucugcgccuuuggucgaaauacuuccaagaaugucaauucuguaauuggugagugacagcagccccuugauuugugguacuaaguggguaaaggacuacagguccccuaaaagaauuuaagggcuaucagagcuggaggaaacuggaacaugaugccauuaguaagggguguggcacuuggggagggcccuggaguuagaccauuagccccagugggacacccgaggggauugggguauguggcugggcaccuaaccuuucacaacaccuucaccaccaccaccaccaccaccaccaccccccagccaucuguguagaugggaccuuccacaaauaugucuucacuccugauggaaacugcaacagagaggccuuugacguguaccuugacaucugugaugacgaggacuucuaaagcauccuggcagcuguacugggaaccuacaguaccgauggccggccgaacugagucuugaggguguugaaccagccagcaagcauaaaugagccuuucacucugcaucaaacacagcugugucuaaauaaacagcucgcuuccacgagcacuuuuugugacuggagugcuaaaggccagaggacagcuuagucugucccugggccuccuagucuggaaaacaccagggacccaaagggauuauacuaauccaaccuaaggauuuaaaaauaaugguuaccaggagauagucucuguaauguauaugaauaaaaggccuuugaguggcauuuaugacuugaccucaaggguggggcgugcuuucccgggcgcagcguaaccuucuaggaaccugucgggaaguggaagccagcuugggaucugacuuccuaguuuuagcauauucauuguugagucaaccccagccuguacuguccgguggugccccgcccagggguaaagaguuuugagcugcucgccgcguggcgacgcuugguuucccagcagucucugcuacccgaguugguaguuucuggucacauucauguuugcagcugcgcaguaugcauacguugcuagucggcggcucccuagacuccauuucccaaugugccucacggugcugugagugauaacuggguguuguagucucgccgcccuucgggcugguccagcaacccgcaggaugucggaggugcggcugccaccgcugcgcgcccuagacgacuuuguccuggggucugcgcgccuggcggcuccugauccaggcgauccacaacgauggugucaccgcgucaucaacaaccuccucuacuaccaaaccaauuaccuucucugcuuuggcaucagucuugcgcuggccgggugagggagggagguagcgauuggcugaagauacuagcgggacgcagggugggcuugcgggucuuugagaaggagggggaucuaagggaaaugcuagacugaguagugugaguucgggagaauaugaaggucuggggggcauggguggaaaaauuugaaggaagcagaucuuuguuauaaggagggccauggaggugggaugggggaggugucuggaggaaagacacaggaccuggguagaaaagggaggagggcugagguggagugugggcuaggaaguggacucuggacuuaaggaaggacugauauggggaugugagaguaccuaagagguucagcgauaugaguggcagauuaggggagcccuggaaggguuaauccagagguggagguguaguaaagucagggcuugggaagggagcugguagagaagcugcuccuauugggcccagagggaagaccuacuagacucgagaagcuugcggccaaaaacagacgaucuagaagagggacuugggcaggguugugagagugggacugaaaccaagcaacugggggaggguggcucuauaaaaaacuaggguaguggggggccuuuggaaggagaaugacaccuggaaggugccuacaucugacugcaggaugggggaucugccaggguuaaaaucaacguagaggaauaugggagcagauguaggaauaccagaaagaaauccugcagauugaaaggcaaagaccagagaaguguuggcagccuaggaccucuagcaggaagugagggucugguaggauuguaggaucgaagaggaacugagaguccacaggaauugcuggaguggagaggggccuggugagacuaugccgggaugcuaauuccagaaacagggaacaaaucucuugggguccagaauuggauguacaaugaggcuagcugagugcucuuguuccugcagguacauucguccgcugcacacccuccugagugcacugguaguggugguggcccucggggugcuggugugggcugcugaaacccgugcagcugugcgccgcugccgucgcagccacccugcugccugccuggcugcagugcuugccauuagccucuucauucucugggccguggguggcgccuucaccuuccugcucagcaucacagcgccuguguuuugugagucucgacucucccugcuagagcuggggaagacggucagcucaugcuugaacaucaggccugccuggcacugguuucugaacuaagagaggacuagaaacccuggaggacagacaugcuuccauuaagugugucuuccuuggcuuugguccucugggagcaucccucuauuaccuuuguggguguuccaggguuaagugccuuaaacuguccaagucccaauuuacugggauguccuuccuggccacaucccccacagcaggcuuugagaacucaccacuccauuagccugccucugagugaauuccccauuucuugguaucgccuacagugauccugcugcaugcuucacugcgucugagaaaccuuaaaaacaagauugagaacaagaucgagagcaucggucuaaagcggacaccaaugggauugcuucuagaggcacugggacaggagcaggaagcuggauccuaggaccuuggcaucuacacccuggacguagaggacccccaccccauacccaagaccaacccuuuuccuagccauuaaaauaggugccuagaguccucuggccuggccaaaaagagacaccugugauugaucacugcagccccaaacuagucaucucuuagccuccagccccuguuaccuagggaccaaagucuuccucgguccugaauuugagacucagucaccuacuuccagucuugaaacuggacuuuuaagccagagcaucuguggccaaucucaaaacuggaccccaagauacuccucugacccaaaugugggacucacuagucuuccauacgucaaagcuaggcccuaaggcaggacauucucaaaucuugagcucuaaagauuuuucagaccccacacagcuuggaauauagguuauaagaccuggccaaaucuugagccuaaugaguccacacugagcccuuaaccccagacgacccuagcccucagcagucccaauagccucccuccaaccguuaagagggucucuuccucccucacaguguucucaguaucaaggaccaacauguggggcuggcuagggauagccccaacugggaaagggacacauauaauaguguugcuacaacaauaaagccuuugaaucucaagcuag

SEQ ID NO: 9366 - RNA, 19308 nt, Mus musculus
cuucuucauuccuggugcucccaaagcaggaaaaccuaagacccaagcuggcgccugcgcacuuugucucugccgcugcugugguccugcgccccgccccccucguccuccagcccccuagguucgcgcucagcggcggagguggcugugcagccagaaacggacguccugaguuaaaggugaggggcgcggggccgccgcccacggcggggccaccgcaccucucccgccauccgggggucccccaucugccucugaaggcgaacgcuugugugugcggucaaacgcggcccagagguagggagcaggcgaggaggcgcgcgcccaggaacgagcggggcgcugcgcgagaaggcgcgcccacuacaucccuuucggccucuacggaccccaccugcgcggcagugcaaggacccucgguaaguaaccguuccagccagaagaagaaggguggggacagggcgggacgaguccuggaaacgcccacaaggauggacuugcgcgcgcaccuacacccucugacccuaugcccccaccccugaccccugucugaccugacgacaucccuuuugaaccccaaaguccuggcaaccuuggcccagaaccuucaguucuaccccugaccuaacuauauuuuggcguggugugaucuugaaccccuucuuuguccgcccaguucugauucccaaccccaaccagguuuguuuuugguccaaauccuuccuugcuugacccuauccuaucuccaaagcccuuguuucaaugcacagcauuaacucagauucugaucugaugcuugaccacacuguucuuaaaaugcuuauccagucuccgaaucccuuccagucaaaugcgcugacacucuguaacccuaauuuguuccaauucuauccugauugcugaccucugacuucuguaaugcuccccacuacugucccccccaccccgccacugcucaucuccaucauggcucacuaccuuuagacauccucuucugucuccugcaguuuuuccuuuuucugucccagcagcaccuacugcaucccugucuucauucugcccuggucuucuuuuuguuccugaccucgccuugaaccugcugcucuuucccucucccugcucacuggcuuggcuuaucucagucauaccuucuagcuauuguucuauaccguugacugucuccuuguacuuucuguccucuucugaaccccagucuucuaucuggugucucaucuuggcuguauucgucuuuuuagauaggauuugucuauguagccuugacugucuuggaacuugcuaugcaguccaggauggccacaaacuugugggguccuuuugccucugccuacugagugcuuggacuauggacuuguaccagcaccgugcuccaccuuaguuuuuagacaggaucuuacuauguagcccaggcuggucugagacuuguaaucauucugucugcaccuccagagugcuaggguuacagguguaucccaccauagcuggcaccugcucugccucuggaucaccauccuauagggacuuuuucuguuuuauauccuacacucauuuuuguccuaaccucucauaccaccccccaaaacaaguccccuauuuuaccuguuauuguagccuuccaacccucuccuccuuccuaacacccauuucccaucucuuuuggacucuggaucucauuauaccuugccucagaacuugaaggcucuguuguccccagggcucccaaagugugcucuuuuuuuuuuuuuuaaagauuuauuuacuauuauaucuaagucuucagacucaccagaagagggugucaggugucauuacagauggcugugagccaccacaugguugcuggggauugagggauuugaacucaggaccuucggaagagcacucagugcucuuaaccgccgagccaucucuccagcccccaaagugugcuucuuauacugcuuuuaacaggaccgaggcugggcaaugaugacacacgccuuuaaucacagcgugauuggaaggcagaggcaggcagauuucugaguucgaggccagccuggucuacaaagugaguuccaggacagccagggcuauacagagaaacccugucucgaaaaaccaaaaaccaaaacaaaacaaaacaaaacaggaccgaguaggcuuguaagcuccguguggcagguggaguuuuuguaugggauuuccccuccuccaucuccauccuggugaucucacagcgagcuugcauuucucuuccugcccaggagugcauggaaauguuccuccaccuccaugcuuuccccaaaugugaacaaacagccuaaauuauucauugacucucugggagucugagaggucuggauuguguuuccagccuuucuauaguggggacugucccauguugcguuugggagguauggagguugaaaacguacgagguugagagacagacacaggguaugagucuuugaagucaugguuaucugcuucaccugcuucaccugcuucaccugaucuuggggguaugcacucugcucuuuggggacugacaaaacaaaacacuuuucuaggucacagacuucaggacuugguggggguggggugagagaagggauuuaucccuuucccuuaugaagucaucaguaaacauuuugaugcuaaccccaucuccucccuuggcaucucugugugaguguguaggguauaggcagugacuauugcuggauauuggaaugaggcccguucagccugguagugcuaugcaccuguaucuccagcuacccaagaagcagaucuuggggggggggucacuugaucccagaaguccuuguucaucucaggaaauagcaagacccaccauuuguuuguuuguuucucagacagggucucacuauguaauucuagcuggccuugaauucccuauauagaccagauuggccuugaacucaaaaggauacaccugccucugccucuugagugcuaggauuaaaggagugugcuacaaugccuggcaagauacaucacccuccagaauacuuuuauauguugauuuuuuuuuuuuuugguuuuuugagacaggguuucucuguguagccuuggcuguccuggaacucacucuguagaccaggcuggccuugaacucagaaauccgccugccucugccucccgaaugcugggauuaaaggcgugugccaccacgcccagcuauauuaauuuuuuuuuuugagacaggguuucucuguauaacagcuguggcuguauuauaacuugauuuguagacaaggcuggccucguacucacacccaucugccuguuuuugcuucuggagugcuggaauuaaaaagguguaccaccacauugggccccuuuuauauuuuuuggcaaaauaaaauauaauaagaugaaaaaaaaacaucacguugaaguuggauaauguaaaccaacagaaggaaaagaccccaagacaaggcacaagagucagaggcccacucauuuacacacucacgaguccuauaaaaacacuaaacugaagcugggugguggugguacacgccuuugaucccagcacucaggaggcacuggagucgaucucugaguucaaggccagccugguuuacaaaaugaguucuaggacaaccaggucuacacacagaagcccugucuccaaaaaccaaacaggcaaacaaacaaaaaccuaaaaaugaagcugaaagcugucccauauagaugcagaggacaugguaaaacuuaucuuuuaaaaagugggaagaugaaccagguggugguaguacacgccuuuaauccuggcacuugggaggcagaggcagguggauuucugaauucgaggccagccuggucuacagagugaguuccaggacagucagagcuauauagugagacccuguacagcgaauaugaaaacaacaaacgaacaaacauaaugggucagugauauagcuggauaaguuucaucucuaguguuguggaaaaaauaaauaaaaauucaggcucauccaguaguaacaagaaaaugagauuccugugcugugcaaauccuugaauuugaggauaaauagggagaccaacagcggcuacuguguuaguuucauugccuguugagugugaguaaggaaugagacccauuuuauuuauccagaacaguuauauagaccuacuaccaauucagaguuuacucaccaucccaaucuauuugguaguuaaguuaugagagaggaagacuuccuuccaggaguacacuagugaaaaacacuaaguuauccgacguuuuugcauuuuauauaggaagaugaguucaagugguaagggacaauggcugacucgggaucuugcucagaaguagagucccaaggucccaaguuucaucgcuagcuggcacugauucccuggaucauauggaguuacaacaaugucugugaaauguaucugguuccugcauuuuuuaaagauuuauuuauuuuuuuuuauguauaugaguacacuggccaggcagugguggcgcacgccuuuaaucccagcacuugggaggcagaggcaggcggauuucuaaguucgaggccagccuggucuacagagugaguuccaggauagccagggcuacacagagaaacccugucucagaaaaccaaaaaaaaaaaaaaaaaaaaaaaagaaagaaagaaugaaaagaaagaaaaauaaguccaguguagcuguacagacaguugugagccuucaugcgguuguugggaauugauuuuaagaccucugcucacuccguucgcucagucccugcucucucccgcccaaagauuuauuuauuuauuauuuguaaguacacuguagcugucuucagcugcaccagaagugggugucagaucucauuacaggugguugugagccaccaugugguugcugggauuugaacucaggaccucuggaagagcagucagugcucuuaccugcugagccaucuggccagcucccugguuccugcauuuuuuuugagacaggguuucacgagguaacccagccuggcuuggaacuccagauuuuccuguuuuagccucccuggugcugggauuacaggcauguaucacacuuaucccaguuccugcauuuuaaaucaugaguuagacuguguguguguguguguguguguauguguguauguguauguguguguguguaugugugugugugugcgcgugcgcguguuguguguugaagggagacacuucuuucaaauaugucuuuuggcaaggagggagaauuuagaggcugagauaccagcucugucuaucucaaaugcaucugaauauguuuaguucuuuauagaaaauuuuuauguuuauuucauaugcggaaguaaggaaugcuuuuaucucuaucucugugaucguguguguguguguguguguguguguguguguguguguggugugagaaagagagagggagagggagagagggagggagggaggaagggagagagagagagcgggagcacaggcguguggauuuggacaaccuucaggagucagcugccuucuugcaccauguugaauucuugaacucagucuucaagcuugguggcaagcaccuugugaccuauucugcugacucuguuuauuuuguguauguauguucuuguuugugaggacuccuguguggagaucaaaggaaaacuuuagauguugguccuaggccuaacucguuucagguaggguuucucaucugcuguguaucucaggcaggucagcccacauguuuaggggaauuccaucauugccugcuaucuugcugugggugcuaagauuacagaccugcaacauugugucuggcuuguauaggaguucuaaggacccagguguaaguugucaggcuggcuucaugaggguuuuucccugcuaaggcaucucuuuggauguccccaugaauacuuucaguucuugauuuuggguagugaaaauucagacaaaguuccccaagaaaagaacaaacagacaaacaaacaucuguuucagauuuauugggugacacugagugauccagcuuugucuccuaagaagcaugcagacauaucuguuugauucaguggggaggaacccuccucauuauaccagcaacaugcuuuguguccuaccaagcuggaaauggguuaauucaguugcuugcaacaacucuaugagcaucuguuaccauuuuauaauugcguuuuuagacaggggcucacuaugaagcccuggcuggcuuggaacuugcuuuguagaccaggcuggccucgaacucgucauagauaucugccugccucugccucugccuccugagugcuggaauuaaaggucuccuugccugacaauuaacuguuguguaauuuaacauugaggacucugaaucccuauaauguucccuucacaaccccgauuucccucuuuaacagauggggacagagaggcacagaaaagugaguuuucuaagcggucacauacugucacugugagcgacaacagaauuaaacccugacucaccauuuacacuauuugugcaagguucauguauguuuagagguuagaccaucuucuggucuguuaaaauugugcggcuaggcuaaggcagugggagaaugcuugcuuagcgugcuccaggcccuagguucaauuuccugugcugagaaaaaaaaucaugaaggggacaaugauguauggggugacccagccccacuugucuacuuacuauauccuuccuacuuccuucuaaacucuaguauaccucuguggaauuauuauuacuauuauuaaagggugggugguuuuuuuuguuuuuuguuuuuuugaaacaggguuucucugcauaaccuugacuguccuggaccucacucaggcuagccuugaacucaagagaucccccugccucugccucuugagugcugggcuuaaaggaaggcuuguaccgccaccacugccaggaguuaagguuuguuuuuauuuuuguguauaucugugucauaugucaccuguguacuaauacucacaggggccagaaagaagguguuggaucccuuagagcuagaguugacuguggugaaccgccugauccagaggccaggaagcaaaccccaguccucuagaagagcuugugcucaucauaaucacuaagccagaucucucaaguucuuuaaaaacagacaaacaaacaaauuuguucaaauugcuguggcuggagagaaggcucagcgauugaaaacacuggcugaucuuccagagggaccagauugaauuuccaacagccacaugaugguucaucuguuguuccagucuggggggugggggggugucuguggcccucuucuggacgccacaggcacugcagacacaugguucccagacacaaucaagccaacacucauacacagaaaaauaagcuggacacgguggcacauacuucuuuaaucccagaauuagggaggcagaggcaggcggauuucuaagaguuugaggccagccuggucuacagagugaguuccaggacacugacggcuacacagagaaacccugucuugggaaaaaagaaaaaaaagaaaaguaagugaaaucuuaaaauuuuucauagguguaauuuuuaaccguguguguguguguguguguguguguguguguggugcaugugcacagguaccugagagauguugaauuucccuggaauuggauuuauaggagguugugagcuacuauauggaugcucaaaucgaacucaggucuuccggaggaacaguguauauguauguguguauguauauuauauauaauauacacauguauguauauauuauauauauguauauuauauauuauauaauauaugauauauaguauaugauacauguauauuauauauuauauauuauaugucuaauauguaauauuagacauacuguauauuauacauguuauacacacacacauacacccuuuaaauauugaaccaccucucuaauuccaaauaucuuguucuuaugauuggccauuaaugauuuggugugaguuauauguucuuguggacccuguugucuauuuuguccauuuuacagaugagguaaccaaaacucugaggcucuaucugaauuauuuuccuaauuuuucauuucucuugucccugguuauaaacauccauuuucccagcugucuguagugguacacaccuuuaaucccagcacucaggaagcagaggcaggcagauuucuguuaguuugaggccaaccucgucuacaaaaaaguccaggacagccagggcucuguuccacagagaaaccaugucuugaaaaacaaaaacuuaagaaaaaaaauccauuucccaacaugcuugguggccuccugcaagggggguggggagggguccauggcugccaagaggaugucagcuugcuccuugccuccacuagcaguccaaaggagggagaagggaggaaggagauggaaagggccuuuguguuccacacauacauuucauaacccggaagaaaggugggcaccuggggcagcaggccuugauaacaugugacugggggaacucuucucuaggcucuccuccccaacagggaacaccccuaaaacccucccuguucauacauggcagcggcugcuauagggguuagguuuggguucugaggucacaaaauagauugucuuaccuggaguacagcauguuugguaugugcccaagacaagcuuagggcccagguaggguuguguugaagggcauuagagggacuuagaguuuucaauuuauuucccugucugcuucgcuccaggcuagaaauguuaacagggagaacauggauaaaguugagucuucguauucuuucuccuuucaggaguagccaguggcuccucuagcgcagggcccagucuaguacucugguucugcuccuucuuaugguuguuuuuguuucuuuguuuguuuguuucuguguagcccuggcuguccuggaacuaguucuguagaccaggcuggucucgaacucagagcugccugccucugccuccugagugcugggauuaaaggaaggugugucccaccccagcuggcucuuuccugugccuuuacauuaguauguucucagucaggccucccauuucuaccauggcucagagcucagcggaggcuggcucugugccgccccucagguuguaggguauagaugaugguguuuccuagguuuauuuguuccuggaguacagaaggugggagugucuuaagaucuggucucuccuuagaaaggucaacuucucucugcagcuuagaaaaucaucauccuaauuaugggagaaauugauccaagauauguguguguguguguguguguguguguguccaugucuaugucuguuugucuauuucacaguuuccuagcccccaugucccgggguguaggcaggcuccaguggccuggggauuugggcaguggcuccucccacaauucuuagagcuuauuggccaguuaucucuuagauauccgcagugaggaaagcauucuaugcuuucuccuugaccauauugggcuccccgaggcaccuggucccccagacugccuucccaggggugacccuagcccuggaagcgggcagguaaggguuaaaaggugugggccaaccccauccuguccagguagguugggccuuuaccuagugggagguagccaagacagcagucacugcuguucacuuguacugccaggaaagcuagggccuggacgagacaacuguucuuuuggaaauauuugaggcugccauccagcacuagggcauuggugaguaccagcgagcaauggggcagggccgugagauaggguaauggcacaggaacugaggaaguucccuucuagagauccagaucugaggaaggaggacccugagaauauaggguagcgauaggaggggugguguucaguaugggaggaucaggggaccagggcaaagccucacguguccauuuuccuuucuugauaucaaaauaauucuugguuggaaaauggaggaggaaggacggggcagagacucagccuucucuucucggccccucucccccuuuuuaucaggacuagugccucagagaagacgagcugaaccgauuagauaccacuguuguucaggcaucuguaucugcuugucccucuguuuguuuguucagccagaguaauugaagggggugugcuguauguuugggggagcaauggggaucagguccagacucugugugcauuugcucaagugguggcaggauguggaaauggggcucucauugacaguguuggagugccacccaggugaaguaucuugguuguaaacagucauuacagccaggaauuuuucucagccguggugucagaagggcagaccugaaaaaccugcugggccugccucuguguguguguguuuccccgcaugugcccucuguagcucgcuugcugcaaccuaagcccguaacaggaccacagaaugacaaggcaaagcucuggugugggcaggagggucucagagguucauaugagggcaugguagugaugcuggaaugugguagauugccuucuuacuaucucugucugaugucaggcagucugaaguuccaaguguacagaacauggaagaguagaagcaaagguuccugagucagguauggagguguggggcguugauccaugucuagccugccuagugacccaaugacucaugccauaacuaugucccugaggucagacugaugggguggagucgggguuccugacuggacccugugucgacuccgggauacucuaauuuucuaaagaaggaaggacggaggcccucugaugugaaacaugagacaauguuggugaacggguaaauggacccaaggugggaggaguuagcuuucuguugggguggagaaggguucaggcaagccuugugaaaguuuuccgaauuaaaauggguccugggaaaguagaaguuucgggggcugagggaccgaggaggcugaggugggacacuaaagacacccuaccaugccgaaagugcuggaccucagaugggugggcuugugagacccccugcaguguacaaacuuucuguacaaaaggcuuaugggauugccuaaccauugcaguggaggauaguccaugaguccuuugagggagggauacagacucugugggacaagcagaagacuguagagaaaacuggggggcggggguaccuuguagacagucugagcacacccuauagugugaaaauggggaaggggcuucuccuuggcguucuugguuuucugggucugcucuaccacaucaugacaagcuguggauuucaaggggucgggggggggggguguuaaaacgagaacucugcugucucugauaggccuuccuagucaccugccuuagaggcuaggacagguggugggaggugaugucaccugcuugcccagcuggggacugagcaggaugugggagggagggagcaaacuccagaaaagcacaagaagggcuggcagcucgccaacgcgugcuccaugaucagccagugcuucccgggacaaaaagaggggcagguaauguguuuucuguggcuguggauggcgcuucucgcccuucucagcaggguaacuucuguaugcuagucucagaacagggugggagggaagaggggcuggagggagccugaggucguggggcagcaggauggaauuaggaagauagaugcagagccaccccugaugccuggcuuggcuaccuugcaguuauucaccccgcuggcauccguuuguggacugcuugcugugugcagccgugcuugaggugccggggcuaugauacgcuggggcagacgugcuuccugucaaaaugacaauacagggaggggcagugucuuuuucaacaguagcugugagaagacaucacucaggggccaccucggaaaaggacauuuaagccuuagaaugagcugggugugguagugccugucucuagauuccuagcaugugggaggcuaagggaggauugccaugaguucaagaccaguguggguuacacagugacuuucaggcugaugcuacaagagcgagaccuuaugucaaaacaaaaacagccccaaaaugauaagcgagaaauaaaaaucaagugguaagaggcuggaaacagcacccuaggcuguggccacagccugggcaaaggcccuaaagcuggauggaugggucgaggcacucaagaggacauuauuaggguuggagcuguuccgugagaggggugguccuaggcucugcccuuuacuggggaauuauuucacuucugugugcuuuccaccccucaucucaaaaggaaaguuaauaaugauggaccuccugccugagggguuugaaagauucauuguaauauagcagguagcuguuccaggcacccaaggcugcgaaagugcuuacuguuguuacaccuaguugacucuacuguuaauucucucccuaggugagacuccuggcuguggccuaugggccucugaggagguguuguaagucugcccagcuucccacuuacuguguuagcacucaaugggaagggaaccaagguaccaggccaagcggguccagacauugacacagaaucugagaggaaaggccagguaggcaggugggaccuggguacuuuauauuuucagcugaugcaaggggaguggggauggccuagggguucuauggcauuaucuuccucagcgccucuugugcuguguuacugccaggcuuuauccagccaucagccacaagguccaagcggugcaaggauggaagucaaaggucagcugaucaguucuccuaccuucacggccccaggucaguggcugcuuccacuuacuacugcccucccccugccccagucucccugugccugcuugggagggguuggccccuggaccugcaguuguuccaggauguccuaucuguccuuaccuuugcuuccucugcagcugcccuguuuggagaggcugccccacuggugaagucagaccgucuucgagggcugcuugaccgccagcgagccuugcaagaggcccugagcguaaaacuucaagagcucaggaaagugugucugcaggaggcggugagggccuggccccagggcugucaugcaggagggggugaggagccaggcgaccuaggcaggcauacugcagugaugggugcccaaccucuugucucggcauuuaguaguuuuugguacauugugguuccucaaaguuugacuuagaggucacuuuaauuggauuccgaaaaugcagccccuguagugcaucauagggacugggcuuuuauaauugugaaaacuaagaacacgggccucccgauuuccaagauuccuaugcucagugacccagagacuuggcccgcuggagaacuauacgcccuaccccgggugcuagagaccuugagagguggcgaucuaauacauguggaguauugagcagggccaagcuccuugggagggcuaguuucuuacccuuauuacuuaaugucaucccucuaacucucagagucucuggccacauuccuuccaggagcuaacuggucagcugcccccugagugcccacuggagccuggugaacgaccucaguugguccgccggaggcccccugcagcacgugccuacccuccaccacacccaaacccagcacaccacuccuuguguccugcugaggugagcugaugcuggugaggggcggggacaagccagggcacaauggcgguuagggccaggaggagaagaagcagagaggagggcaaggauuugaauagguggauuuccccaugcacuaugggaacccaagucuauccagacaagccccucauccuguccccugaggaugaauacauuccuuccuuaggcaaacaggccagccccuaaaaagaucaugcuccgcuuccuguguagaugggcucugccaacugcccauuacugugcuuagucauuucuauuauuugguucugucccaccccccaccccuuuuggguugugcaggaacuggcucuugaggccuuggagagggagguaucggugcagcagcagauugcagcugcugcccgccgccuggcccuggccccugaccucaacggagaacagaggcggcgcaggcgccagguacagguugaugcacuucgaaggcugcacgagcuggaggagcagcucagggacuuccgggcccgucuuggccucccggugcuccagccacugccacugucugcaggagcacuagucaaugcccagggugucugccuggguacacgccuugcucagcucagccaagguaagcuaagucccagcaucuccccagugaaaaaaaugggccugagaauggauuauggcuaaugcauaugccauugaaggcagagaggccagcagggcuuaauggucuuagugguuaucaaggagaguugcaguaaccugacaugaggauaaaagagggcuugaacaguaggcaacaggaaggugaguacgcaagcucaccgcggucuugaauucagguaaagguagaugcuuuaaggcguggucggguugaaccuagccccuuuuagcagucuagguaagcauucuaccauggagcgacagcccugguugucucuuuaauuuuaauuguaaggguuuagucauguugauuuacaugcaugugcuccugcauguguuucuguuugcugcaugcauacaggugcucguggaggccacaggcuuuagaaccuuugcaacuggaguugcagacgguugggaggugccuggugugggaacugaagcccgguucucugcaaggcuagcaaguguucaagcaccaagccaccucucuagcaccuuguuuugguuuuacuuuuaauuggaaagaggacuuuugauaaguugcucaggcuggucuugaacuaacuccauaguccagacuggccuugaacuugugacacacacacacacacacacacacacacacacacacacacacacacagcacuccaugaaaccucuuagguagcugggauuaugaccuggguucuugggcaggguccgagucaguagucauuaggcaggcugcacagaagugccugucuauguccagugguguaaggggaugggacccagaccuugccugaugggucgccucuccauuucucgccuguagaggauguaguucugcacucggagagcagcucccucucagagucaggggccagccaugauaacggugagaaccaucccuguuaaaccugugcucagcccccuccuuuguccucucaaaauaccccuccuacuguaguuccgcuuuagccauccaugucccauguuccuauauguccuuaguuucuccugucacugccuccucucccccagccucuacaggucggccucugcacuaccuuuuuugccuugcuucaucccuuagcuugccgaucccugucccagcacaugccugucccuuuaagccugcccugccccuucugggcccucucauugaauuugacccuauuuucccuccuacacagaggagccucauagcugcuucccucuaacggagcgccccucaccaccaaaagcgugggaccaguuucgggcaguaucuggggggagcccugagcgacgagccccauggaaaccuccaccaucagauauuuauggggaccugaagagccgacgcaacucuguggccagccccaccagguaaagagaaaccuguuaaccccuuucccgggaccagaagugggauccugagccuggguuggcaggagggccuacugguggguccaguuucuaaccugggucccgaugugggccugccaucucugucuagccccacacgcucgcugcccaggagugccuccaguuuugaggggcgaagugugccugcuaccccuguccucacccggggcaguggcccccggcucugcaaguaaggggaugcuugaggguggaagacuguagauaccaagagaugugggacaugggcagcaagccuuugaagccagagugggaauugcaggcagaggugggaaagcgugggcuuucccaguuucucuuggauaagucauuuucuuucucugaaucuuugucuccucauuuguggaguauaauaucugccuuugaaagacacagguacagugcauguuggguagcauguaccaaaugccuccugucugcuaauaaucgauaguguuugugguggauagugacucacccuaagauugcugugaggagaugugguuguuugcauuauagaaacguagaaacggaagcacagaaagguuaguuaagucagcugcaagcaagccggacaucuuuugaaucuagugucagccuugaggcacuggacuguaauguuucuuaacugcuuaaaugucgauuuuucccaugcugugaacagaagccuugugcuuuggggggccugcauucugugcauggugggauaauuguuuggggaugguucauagacaugguggguuagaauucagcaagccuuuuaguccucggcauaaggccuaggacuuccuucgggaggcagcaaggagccauaaggauaaccuuagugggagacuaggagcgccccccuccccaacagaacagugccuggguguccccuuccuuagcuagugcuuccuucccagaaacauuugcguaacccuaagagcgcauaccccauuccugugugcauuuucaugcccugugccccagcuuuccugugagggagcgaaccccacuggcccauuccauuaccugcccuacuuagcagcuacagaaacacaacuucuaauacugguuccauuuucaagauaguggaggcucaaaaagagauggggcagucagggcacucaucaucugccuucuuugucugacucugcccuuguuaccucaccucugcucuccagaccggaaggccuccauucucgccagugguccgguagucaggacucccagaugggcuuuccucggccugacccugcuucggaucgggccucccucuucgcagcucguacccgccgcagcaauagcucugaggcccugcugguggaccgcgcagcugcuggcggagcuggaucuccaccugccccgcuggcucccccugcugcuggucccccaguuugcaagagcagugaggugcuguaugagcgcccgcaaccagucccuuccuucucuucccguaccacuggccccccagacccuccucgggcugccaggccuagcucagcugccccugcaucccguggcgccccccggcucccaacuguguguggagacuuccucuuggacuauccauuggaccgaggcuugccccgcgguaguggcggggcagguuggggggagcugcugccugcuccugaggucccaggaccccuuucccgcagagaugggcuccuugccaugcucccagguccuccacccauauaugcagcugauggcagcagcccccuccuccgcagcaaggaccccaacacccgugccauccguuccaagcccaguggcuuacccccagaagcuguggagggucuggaagugcauccaaauccauuacucuggaugcccccacccacucggauaccuccagcuggagagcgagguggccacaagaaccuugccuuggaggggcugcgggacugguacauccggaacucgggacuggcaguugguccccagcgcaggccaaugcucccgcacguggggccaacacacacccccuuccuccaugcccgcugcuaugaggugggccagucacucuauggcccucccagccaggcaccgcucccgcacuccaggaguuuuacagcgcccccugucucuggcagguaugggggugcuuuuacugauggguaggguuauugauucagaugcugaagguauccugaccggggagcaaggaccacaaggcaaugggcuauaguagcuaucagacauaacuuuuauuauuaguccuugggguccuggugaggaggaacuuggguguugguagcaguucuuucccaagcuuuagaagggguuuucuauucucccuaguguauggcagcuggcagugagccuugaaguccggguaaugggagaaagggacuugugcuaucccuggcuuucucuuccaagcuuaccccaugcuugagaaccugaaggugcuguccuguaccugucuccaccucuuuaacagcuucuuuuccucucucuguguguguccucuccgucuuuuccucucucaccuugucuucccuaccugucuucccgauuccugcuguccucccuuucuaaagauacuacacggauuuccuguaucccccggagcugagcgcucguuuaagugaccugacgcuagagggggagccgucuuccaguucugacacccagacaccagggacacuggucugacccuaagcccugugucggucuggacaaacuccagucugaggagcacacagucaaccucgcugagcccugagaugugguggcucuuuguccugagggacacuugccugaucucacaggaccccuggcuucuuuuuggcccaggaagauaucugauacuccugcuucucuucucauccugugcugggggaacuggagggccccagcuagcuucaaagacucuaccccucccuccauuucuguuuacaguugugauuuaguacucugucauugcccaacacuagguguuuuauaaaagggaaacugugagcucguuccugguuggguucauuccuguccccaugaccaaccuguuccauuccagagccaccaccacccugccucaacaaaauggaccauaaagagucucuggggcugggagacugcugggaacagaauucccugcuuccucccgcuagagucuuugagcagaugggcagcgggcuucuguccacauuuggaaggauggaagucuaaguggggguaccugaaggagcucugucucugucucugcccaaucagaaggccguacaagagguugucaagaaacagagccauuugaguauguugcauccugugaugcugcaguggcuaaaccuggcagcuaguacaugccagucaaacccucaggugacaucuggccauggguugcaggccacaucauguccuccuuggcauuccuucuuuuaccacuuuuuaaacaaauccacauaagcuguguuuucuauauugucugugacuuucuggagcuggggguuccccugcccccguuaccugguguuuaaaauuuucuuuuuguaccaauggaucugggcccaagacacuacucacacuggaaggggauuucuauaauaaauguauaaacugaacuuga

SEQ ID NO: 9367 - RNA, 12645 nt, Mus musculus
cuaccgcucgaagucguggcuuagggcgggcucuccaaucucccggcugcaacuggcugccuugcucaggagguauggcccaaccagacuuccauccccaguguggucacuuccuguggaguuuccccagcccaaggaggagggggaagaggacgagagggaggcgagcggucguucgggguuagguuggggggugucgguccguucagggcgggugaugacucacggcccaucccaucuucccgacgccgcccgcccacgcagugcuagcuccauggcuuaacggaggaggcagcggcaaacagggggagggggacucuuauuuuguuagggggaccgggccaaggcccgaccggccuggcagggcucgcccggagccgggcgucaugucucaugcagccgagccagcucgggacgccguagaggccagcgcggagggcccucgagccguguuccugcuauuggaagagcgcaggccagcugagucggcccagcugcucaggugcggggccaccucuggggccgggagugacaacugagguuccccggggacucaucucaggacacgggggguccucgacugggguuggagacucuuggccuaggcuugaaggacgucggagugcccaucuugggugggcgccucagaaaucugguacugaucugcuuggauagacgcuuacaggaguagugggagugcgugaggagggcagagucauauuugggggggugucuuugcugggucuagcggggcagaucguggaguauacagaaacugguuugcuguaguugaacuuggaaacugauuaaaagcugaauuggggauuguugacucggucgcggagggaugaaugugagggcauacauacugucaggugaggcacugauuuuaaggaaauccugggguuuccccccucccccuuuuaguguguguggggggaaaauucagggaggcagagguguuauuuggggcaccuagugauucccaguagccggugcuguguuuuugggaauagcacgagucuaaaggaguuagggggaggucuccgaucugccgggagugugugugaauaauugagcgaagcaacuugcugggcccaaucgguucacuguugcuaccccgcucagcuggcgucuguacagaaaggccgagauaguggaaaccccucuugucuuauccaaugggugauaaaaugugaugcggcagggcacacuggaaagauacaguucacuuuuuaggcgugggggguuggggggaggccuagagccuuauauggaagcccagaggagggucuuguuucuguugccacucgcccuagccuugcagccaagccggcccugcccacucccuacccacacacccccucuuccuuuuauuucgcccucccagccggucucucaguucccggguguaaucuugaaucagucucuagagcuggagugaguaccgauugcaccauucccgucuggguggguccucagucucuccuuuucggcuccucucaccuccaucagccuugcuuugaagcuccaggccuuccuuguccauagcccugcccucuccagcccccaccuuuuucaacuuaacgugcaguggugugugugaguaugggaggggggcugccuccucucugccugggauugugcugaacucagcuacucucggagcuuccucuucccgacuuccuggguggcuuuagagccccaucugcgcaaggagaggaaggaagaccaucgcuggggaggggaaagacuuuguacugagcggagucacaagcuuaguggauucuaaacuugacugaauucaagggugcauauuauuuggggaugcgguggguggaacccagggcuucgcacuugcuagacaagagcuguaccacggagcuauccucaucuaguaaggauguauauucacccucgugcguguuuugccgggacacuaggguccuuucucccuaacagggaggacugagcacaacuaucguggauugcuuauaacagccuugaucaucgcaguaaugggcacaguugaaaggagggauggauauugcuuugcugcucuagugcaaguccuagcuccuauggguuuuuugguugguuuguuuguuuguuuguuuguuuuuaugacuugagaugcaggcuccguauguaggcuagauugaccgcagcccucuuccuucaugugagguagggcuuguuuugugugcagguggaugcuguuacugaaaacggguguguguuuugaucucucuacaaaguaggaggaggaggagguuggguaguuucuccuaguaagaaagaugcucguccugcaaggcagcuugugcgcucaguuuuuugaagcugcucccuggaggagugaggggagccuuuccuagucccuucuuguauuugcugggaaggagcggccuaagaacucugccuggggcuggaagaacucauuugcaaagugguaacucuuaaugcaaagugaaccuggaagcccaggucucuuugugaugcauucaguugguguuacaauggaguguugggcugauggguaccucuguugugugcauguguacggacauggguucacuuucagcuaugggcaaaacaguagggggugugggggcugggagaacucugaaugcaaagcagccgggaauccuuauucaaagugaauuguuauucucaaaguccucuugugucgccccccccccccaucccugguuguugugaugguucaagcgagggaguuggggucccggccuuucuauuguuccgacccuucaagggccuguggguaggaagcaguauaggguagggggaggcaaaagauuugggacuuggucuaggcagugcccuucuggauaugagcccgcuucgcuucagugucuggggaagggaggguauuuagagcucccggcagucacugaucaccacuccuuccucccucccacccucagccugaauucuuugcuuccggaauccgggauuguugcugauaucgaguuagaaaacauccucgauccugacagcuucuacgagcucaaaagccaaccccuaucccuccgcuccagguacgacugucugaacugauccugcucccagucuuucuccuuacuccauggccagggacccucggagcccacccaaacccauucuccccuccuccguagccuauauuuuccccgugcugaaauuauaggcauggaggaggccagcagguggacaugucagugcgucucuggccaugccuuacccuuacuagaauucacguacagaucucgcaaaccugacuacuuggauaggcguggccuuccuaaacgcccgcccuccuguggguagggccaugcagccccugcucagcccuccucguaccugacaaacccacccucccgggccucuagagcguccagacuaguggguggaagccuaaaugugcugagucaucggccugggcucugagagaggggaggggaccuggaagaggggcaggaagagaggauugugaaaccuccgagauuuucuagacugacuagcuccuggcagcagagcccugggcagggaggaaauggagucuggggcuccucugcagccugaugcccacuuccaggagcuccagauuaggcuuggcaacguucuguuucacagugcagcuucgguuccaccugagcucagguuuuuaguaagaaaaccucuucuucucagaggccagcaucuagucacuccgugaaccugcucagagguuucaccaauaaggccaaaggcuacaaucuuguuuccucucgaggaguuggccagacugugaccuuugagugauggaacugugucuggucccagcgucuccugaggcccacauccaguccugguaccucugucuccuacccacacauuauggucucggaacaccgagaacaaagcugcuucuggauauaguccaggacacugugacccuuaagcuuggaaagagacuuguagcuuaccuauggccccauaucucccauucuacagccucccaauaucacugcaggccacaccgaccaccccagcuacacucucugcgucgucuucugcagggggcucccggaccccugccaugucaucuucuucaucacgggucuugcugcgucagcagcuuaugagggcccaggcucaggaacaggagaggcgugagcggcgggaacaggcagcggccgcucccuuccccagcccugcgcccgccucaccagccaucucugugauuggcgugucugcugguggccacacacugagucguccaccuccugcucaggugcccagggagguacucaagguaaggacagauccagaagcucugggacccagugacucaaaggagcuaagagguuacccaggguccucauggcuuuuggacccagugacucauaggagcuaagagguuacccaggguccucauggcuuuuggacaggaucuguaugguucuaaggacaauuugugauaguguuuaaauggucugcuguugugcccuggguguuuaugguuucuuaggcuuucuucuguaccugugaugaauauuuugccuauugggaugucuaggggaggcauugguguuauaguucaugguucuguuggguguugucugagacguagcagggagcccugaggauucugacaaggugaucuagaaacugacggaacuuaucagcccuggaaagauuuuggaggcuguaaaggauuucuggaaaaagaaguuuggggucuuggggagaucuaauauuucugcaauguucucaaauuccaggcccuguugguccacaugagccuaaaaauaguugaguuacaggcuggggcucagaguuccuucuuugagcucuuuugugccuucucuccuuccccauggccuuuuaucucacagguucagacccaccucgagaacccuacacgcuaccaccugcagcaagcucgccggcagcaggucaaacaguacuugucuaccacacuugggcccaagcuggcuucccaggcucucaccccaccaccagggccuuccagugcccagccacuuccugccccugaaacugcucaugccaccgguccuacaggcagugcuccuaacagccccauggcgcugcucaccauuggguccagcucagaaaaggagguaagaggcuguagauaaccucccuuuaugcccuucguccaguugcuuuauuauuguuuuguuugcgugugugugaaugccugagaugcugggauagaaccuagggccuugcccgugucaggccagcacucuaccauuaagcuacuccuacccccagccuccccucccaguucuucuaacccuguacaguauuuacuuuuucccccagauugaugaugucauugaugagaucaucagccuggaguccaguuacaacgaugagaugcucagcuaucuuccaggaggcacugcagggcugcagcuccccagcacggugaggcccuaagaagggagguggucugaaaauuauggcauucgucugucacuaagaccacaaccgcauuggcugcguguauaugagcgauccuugccaugcaucggacuaagagagagagaagggccuauauugagaaugggccucugguagacuucauggagagguggcccugguagacuuaaggauauauauauauauauuauauggggaguuuauagacauacuauuaaucugggcacuugaccugugcucuacuaaguaccaagaaguggaaaucauguagcaguuccaauaucccaagagauucagguacugccauguagugacuggaaccaaaaagcuugaauuauauauaacaaguggguggaccuugaacuguuuggaaugugccaggucccuugcaaugaauuaggcuaagaggcucaaaccuuguaaagaaaaauggcugugacuuugcagagcaagagaucuccuugcuguucuaacagucugauucugggccauucagagaacccuuaucacuugcuuuggcaaguuaucucauagcuuuuuccaacaucccaagaggauggaaccuuguauaaaaaugguaguagcuuggggcuggggauguagccgagcagagugcuugccucucgugggugagguccuagguuuuguccucagugccacacacacaaaaagauccacuucaucauaacuuuucacggguuuggacacaacuagaguuucugagggauugccguaucuggcagcuggucaaaggagaggaccgggugcacuuccggaugaauguauugcaccaagacugugucuaagauaggaagagagcgagacaaaaacuaggcugguagaaaagcagcagccgcugggagagaguuagacuggagaaucugagccaccagaauguguggguagaccuagagucaagaccuugcuaaaugaccgauaagagcucaugguguuuaaaguagggaucacacuuaaggcuggggauuagguuggaacucuccagaaagccaaauuuuggauggcguguugccaucauaauuuaccaaggucugaaaagauuugaguuggaguguugcaagaaugcugguuuggaaggcuaggcuggaagcagcgaauggccuggaaugccagaucagaaugggcagacaaccugacgauuaggauuuuugcagcauauuucuucucagaguuugggcuucagagggacugagugggcgauccccccacucaguucccacaaaccagggaaaguucauuugguuccguuccuacuguuaaguacuaugugaaacuucccugaagggaaaaaaaugcccuagaauuccccagacuuggcauuagggggugcuagcuuuuaauaugugagggucaggagccugaauuugaggaggcucuucuauuccuaugcugucuacagcugccggugucuggaaaucuacuugauguguacagcagucagggaguggcuaccccagcuaucaccgucagcaauuccuguccagcugagcugccuaacaucaaacgcgagaucuccgguaaguguuagggacuuggcccuuuaucccacccuguccugcccugucacaaccagagcuggagcuaggucuaguucuagggaagggguuugaacuuuucagaaacggguugaggcuggggcugggaggguagcuuagagucuguuagacucuacuggggugcuucuaucccaagcaccccagagaagcaaagacaguugcuuucccuuuuuuuuguuuuuuguuuuguuguuuuuaucucauggcucuuggucugacuuucacauuguuuucucugacuuccucuuaucuuggguguaacagaaggccugugccaccccaguuucauuuuaaaaaguagcaaagagagacauuuuacuuauuuauuuauuuuuugagacauagcuucacucuauagccuaggcugaccucaaauucccaacagcucucuugcuggggccucccgagugcugaaacuacagagcuauguacaaaugcccagcucuggaacucccuauauagcccaggcuggcauugaacuuggagcaaucuuccugccucuccuuacaaugcuuggauuauaggcaugaacuaccaugccuggcucaagacaucuuuuaaaacaaucaacaacaguauggugguccaugauuguggucccagcacuuggaagacaguaugggcuauggcuacguauugaggcccugucucaaaaaaagaagaagaaaaagaggagaagaagaaagaggagaaacagaaacaucaaaagaagaagaaaaagaagacaacaacagggcuggagagauggcucagagguuaacagcacuggcuguucuuccagagcuccuggguucaauucccagcauucacaugguggcucacaaccaucuguaacucaaguuccaggggauccacuguccucuucugaguuccuugggugccagacaugcacaugguguguauucgcaaugaaggcaaaacauccauaaagagaaaauaaaaauaaauguaguuuuuaaaaagaaaucacucccaagucuggcccugaggccaaacuguguaguuacagcuaauuuggagacugucaaggaggauggcuuaagucagguguucaaggccagccuggaugagaaagcaagaucccaucucagcuucugucccucucccacuagccccuaccucugcaucugcagugacucugcuuccuauauccagaagcccugauacccacccucacucucuuccagaaaccgaggcaaaggcccuuuugaaggagcgacagaagaaagacaaucacaaccuaaguaagccgcagagcaggcgcacuugcccacccgccacacagcccugccgugcuccugcuucaagggccgccuuccauggggagccucccagcgccccugauccucucccuuccuucacccauugaugacuccuacucuuucuuuuucucccccucucuugaaaguugaacgacgcaggcgauucaacauuaacgauaggaucaaagagcugggcacccucauccccaaguccaaugauccgugagucugggcuggggaccccaggccaaugggagguggaaggagcauccuggaccaggaaaguuguuccuugcugugucugccauguagucuugcccagacaaaacuucucugagccagagguugagacucauaccuguacucccagcuuuggggaggcuggggcaggaggauugccaugaguucaagaccagccugggcuauauaguaagcucuaggcuauccugggcuacagagugagacucugcaucaaaaaaaaaaaaauacuuccccacccccaaaagagcucucugucuuucuuaccuuagcuggggacgguagaccuuccgacuuugaauccacaguguuaaguucgucuggccuaucugcacgcuguggagcauaaacacgaguguucuguucauuuuguacuucuuuuggguagucaggguucaguuauugcgccuuugcuuuguaccagguacugugcuaggcucugaggacaccagagggaacaaaaggaaaaauaccauuguccuuuggaucugaugccuuuaauugaggcaacacaguuaagacaaaauccaugacauucguuucuaaugaggguuguggaacagaacggaaccggcccauggugguuuaugccuauuaauuagcccagugcucagcagucugaggcaggaggaucuagaguuugaggccagccucaaaacaaaaggacgcaggggaaccgaagagcacacucagcaguuaggaagacccggguuuaguucucguuccaaggcaucugauacccuucucuggccuccaggggcaucgggcaggacaggugcuaugggugcauacacauacaggcaagcagaaggaagaugaguggauggugugauggugacaguggcugcagcaagcauaguagggcugagcaggccucggcuagccaggacacacuugaauagagagcugaaaaaaacggagcucuguauguagcuaagcauagugcuugccuaccacgugcaaggcccuccguucauucccagcccagaacaggaaugggcaagauugaggaggccaugugguggagggaaagcacucuaggugcaggguuguauccgaguacagggcuugagaugaaaauaguuuccuauguuaacacuugagaggccagccuuggcugucauggaggaaacgagccaaaaagggucaggagggcuucuagguuuggggcuauaauggccgccacuggaugauugcaagcauaggguuuaucgaaagcacucuaacccuuugauuuaccucggauucugccauguggucagguauucgcucugcgugguacaauccccccugcgagucacgugugcaguauucgaucucucccucuucucgggccccacagggagaugcgcuggaacaagggcaccauccugaaggcaucuguggauuacauccgcaaauuacagaaggaacagcaacgcuccaaagaccuggagagccggcagcggucccuggaacaagccaaccgaagccugcagcuccggauucagguuugaggagagaaaauugggagggugacugacacuucugcagguagaggcaggcaaagcacugaccggcuuucccuuuagacaacccaauucaaaugaugaugacauaaauacacagcacagcauuaccaagaauaguuaggauaccuggcauggugcuucucugcuaugccuuucauccuaccauucaggagccagacagacgcugggggaucuguggguucaagggccaaggccagacucugccuguaaaaauuagaaguaagaaacagaugguuucauggcucacugggugcucuuccagagcacuuuaaaaaacaaaaacaaaaacaaaaaccaacugucuguaacuccaguuccaggggaucugacgcccucuucuggccuccacaggcauuguacccaugaugcauguaugugcaggcaaaacaccaauauacaacaaaaauaaauauuaaaaaaauaaaagagucucaucugggcaugguagcacaugccuuuaauuccaggguagcaggggaaggcagaucucuugaguucaaggccagacagggauacacagagaaacccugucugggggggggggguagcaaagagauucuccaaauaguagucuaauguaugucgcauauauguugacuugugcuguaauaagagcuguaugccccuuaacucauuuaauuuccagaaacagccauaugagagaaccuuccauuauuguaccauuuuacagaggaggacucuggggcucagagacuaagcauaaaauuuggcaaguagugagggccagaggaugcauuggaaccuaguagccuggccuuucaaugaagacacucuucuaccugugacgggcuuugcaccccaucuuacuuuguacccaccccuucguuuuuacaggagcuagaacugcaggcccagauccauggucugccagucccucccaacccaggacugcucucccuaaccacgaguucggucucugacagccucaagccagaacagcuggacauugaggaggagggcaggccuagcacaacguuccauguaucgggaggaccugcccagaacgcuccuccacaacagccuccagcaccaccuucggaugcccuucuggaccuacacuuucccagcgaccacuugggagaccugggggaccccuuccaccuagggcuagaggacauucugauggaggaggaggggauggugggaggacugucagggggugcccuguccccacugcgggcugcuucugacccccugcuuucuucaguauccccggcuguuuccaaggccagcagccgccguagcagcuucagcauggaagaggaguccugaucaggccucacuccucccccuggaugagacccugccuuuuuucccuacccuccugugagacuguccuguccaggaaaucugggggaagaggaguugcaaucaggccccaacccuguaauaggcaaggaggaggaaucaggugaggcccugcccccuuuccauucguggggaagaaggcaggagagagcugggaaaucacaguucaucacuugagcaucauagccuuaccccucgccccugguccuacuccugccucggugauagaaggaggcaggguaaggguaugccccuggccacuagagauccuuagaaacaggucucugaaggaaaggagaugccaggaugcuacuccauuccuucucugggaauugccaguccaacuuuuccuggcacuggaagaaaaaaaauaagugucccaccccuggaggguuaaucccuaucucuuccuuuugaccccugacuuguucuggcaaggaacagaaguaagggugugauccagcccgucccccugggacccaucccuucucuauaggaaaagcucagcgcagguauuacagguauggaggaauuacuaggcucugaucucccauguagaggccccaguccuaacccugacccuuagcaggacaccgugcaagcauuccauucggcagggaggaucaguuccuuagcucccugccuuaaccuaggaccaaccugggaccugaccugugaggacucugugcugaccuuauucuuggggaagggaacagauuuugaccuagaucaaguguaacuuagguccucacccuugggacgaccuugccuuuucugccuugaggggcaguuuugggagaugaaagggauuaguguggacccagucuaggcaccccaguacuucccuucaccuuguagaaaaugguaaugaaagggcaugcccaggcucuuuagcagcccagggaaacagagaagucucccuuaaaggcagggccugggaggaaugguggcaaagguauaauguauccguguuuuguuugugaauuuuuuauugaacccacccacucagaugcuaagucaacccugaccucugccccauccacaccauucuccauucgagagacuaccccuguuucagagccaguccccaccuagucccgucccugccaccuacacccaaggucuucagcuuuaaguugcuggggccaggccccgaggaggguuuacugaggggucuguagguuugacuaaaauaauaaaugcuaggcguguuugaugcgcuuuuaacuuuggcau

SEQ ID NO: 9368 - RNA, 12645 nt, Mus musculus
augccaaaguuaaaagcgcaucaaacacgccuagcauuuauuauuuuagucaaaccuacagaccccucaguaaacccuccucggggccuggccccagcaacuuaaagcugaagaccuuggguguagguggcagggacgggacuagguggggacuggcucugaaacagggguagucucucgaauggagaaugguguggauggggcagaggucaggguugacuuagcaucugaguggguggguucaauaaaaaauucacaaacaaaacacggauacauuauaccuuugccaccauuccucccaggcccugccuuuaagggagacuucucuguuucccugggcugcuaaagagccugggcaugcccuuucauuaccauuuucuacaaggugaagggaaguacuggggugccuagacuggguccacacuaaucccuuucaucucccaaaacugccccucaaggcagaaaaggcaaggucgucccaagggugaggaccuaaguuacacuugaucuaggucaaaaucuguucccuuccccaagaauaaggucagcacagaguccucacaggucaggucccagguugguccuagguuaaggcagggagcuaaggaacugauccucccugccgaauggaaugcuugcacgguguccugcuaagggucaggguuaggacuggggccucuacaugggagaucagagccuaguaauuccuccauaccuguaauaccugcgcugagcuuuuccuauagagaagggaugggucccagggggacgggcuggaucacacccuuacuucuguuccuugccagaacaagucaggggucaaaaggaagagauagggauuaacccuccaggggugggacacuuauuuuuuuucuuccagugccaggaaaaguuggacuggcaauucccagagaaggaauggaguagcauccuggcaucuccuuuccuucagagaccuguuucuaaggaucucuaguggccaggggcauacccuuacccugccuccuucuaucaccgaggcaggaguaggaccaggggcgagggguaaggcuaugaugcucaagugaugaacugugauuucccagcucucuccugccuucuuccccacgaauggaaagggggcagggccucaccugauuccuccuccuugccuauuacaggguuggggccugauugcaacuccucuucccccagauuuccuggacaggacagucucacaggaggguagggaaaaaaggcagggucucauccagggggaggagugaggccugaucaggacuccucuuccaugcugaagcugcuacggcggcugcuggccuuggaaacagccggggauacugaagaaagcagggggucagaagcagcccgcaguggggacagggcacccccugacaguccucccaccauccccuccuccuccaucagaauguccucuagcccuagguggaaggggucccccaggucucccaaguggucgcugggaaaguguagguccagaagggcauccgaagguggugcuggaggcuguuguggaggagcguucugggcagguccucccgauacauggaacguugugcuaggccugcccuccuccucaauguccagcuguucuggcuugaggcugucagagaccgaacucgugguuagggagagcaguccuggguugggagggacuggcagaccauggaucugggccugcaguucuagcuccuguaaaaacgaagggguggguacaaaguaagauggggugcaaagcccgucacagguagaagagugucuucauugaaaggccaggcuacuagguuccaaugcauccucuggcccucacuacuugccaaauuuuaugcuuagucucugagccccagaguccuccucuguaaaaugguacaauaauggaagguucucucauauggcuguuucuggaaauuaaaugaguuaaggggcauacagcucuuauuacagcacaagucaacauauaugcgacauacauuagacuacuauuuggagaaucucuuugcuaccccccccccccagacaggguuucucuguguaucccugucuggccuugaacucaagagaucugccuuccccugcuacccuggaauuaaaggcaugugcuaccaugcccagaugagacucuuuuauuuuuuuaauauuuauuuuuguuguauauugguguuuugccugcacauacaugcaucauggguacaaugccuguggaggccagaagagggcgucagauccccuggaacuggaguuacagacaguugguuuuuguuuuuguuuuuguuuuuuaaagugcucuggaagagcacccagugagccaugaaaccaucuguuucuuacuucuaauuuuuacaggcagagucuggccuuggcccuugaacccacagaucccccagcgucugucuggcuccugaaugguaggaugaaaggcauagcagagaagcaccaugccagguauccuaacuauucuugguaaugcugugcuguguauuuaugucaucaucauuugaauuggguugucuaaagggaaagccggucagugcuuugccugccucuaccugcagaagugucagucacccucccaauuuucucuccucaaaccugaauccggagcugcaggcuucgguuggcuuguuccagggaccgcugccggcucuccaggucuuuggagcguugcuguuccuucuguaauuugcggauguaauccacagaugccuucaggauggugcccuuguuccagcgcaucucccuguggggcccgagaagagggagagaucgaauacugcacacgugacucgcaggggggauuguaccacgcagagcgaauaccugaccacauggcagaauccgagguaaaucaaaggguuagagugcuuucgauaaacccuaugcuugcaaucauccaguggcggccauuauagccccaaaccuagaagcccuccugacccuuuuuggcucguuuccuccaugacagccaaggcuggccucucaaguguuaacauaggaaacuauuuucaucucaagcccuguacucggauacaacccugcaccuagagugcuuucccuccaccacauggccuccucaaucuugcccauuccuguucugggcugggaaugaacggagggccuugcacgugguaggcaagcacuaugcuuagcuacauacagagcuccguuuuuuucagcucucuauucaaguguguccuggcuagccgaggccugcucagcccuacuaugcuugcugcagccacugucaccaucacaccauccacucaucuuccuucugcuugccuguauguguaugcacccauagcaccuguccugcccgaugccccuggaggccagagaaggguaucagaugccuuggaacgagaacuaaacccgggucuuccuaacugcugagugugcucuucgguuccccugcguccuuuuguuuugaggcuggccucaaacucuagauccuccugccucagacugcugagcacugggcuaauuaauaggcauaaaccaccaugggccgguuccguucuguuccacaacccucauuagaaacgaaugucauggauuuugucuuaacuguguugccucaauuaaaggcaucagauccaaaggacaaugguauuuuuccuuuuguucccucugguguccucagagccuagcacaguaccugguacaaagcaaaggcgcaauaacugaacccugacuacccaaaagaaguacaaaaugaacagaacacucguguuuaugcuccacagcgugcagauaggccagacgaacuuaacacuguggauucaaagucggaaggucuaccguccccagcuaagguaagaaagacagagagcucuuuuggggguggggaaguauuuuuuuuuuuuugaugcagagucucacucuguagcccaggauagccuagagcuuacuauauagcccaggcuggucuugaacucauggcaauccuccugccccagccuccccaaagcugggaguacagguaugagucucaaccucuggcucagagaaguuuugucugggcaagacuacauggcagacacagcaaggaacaacuuuccugguccaggaugcuccuuccaccucccauuggccugggguccccagcccagacucacggaucauuggacuuggggaugagggugcccagcucuuugauccuaucguuaauguugaaucgccugcgucguucaacuuucaagagagggggagaaaaagaaagaguaggagucaucaaugggugaaggaagggagaggaucaggggcgcugggaggcuccccauggaaggcggcccuugaagcaggagcacggcagggcuguguggcgggugggcaagugcgccugcucugcggcuuacuuagguugugauugucuuucuucugucgcuccuucaaaagggccuuugccucgguuucuggaagagagugaggguggguaucagggcuucuggauauaggaagcagagucacugcagaugcagagguaggggcuagugggagagggacagaagcugagaugggaucuugcuuucucauccaggcuggccuugaacaccugacuuaagccauccuccuugacagucuccaaauuagcuguaacuacacaguuuggccucagggccagacuugggagugauuucuuuuuaaaaacuacauuuauuuuuauuuucucuuuauggauguuuugccuucauugcgaauacacaccaugugcaugucuggcacccaaggaacucagaagaggacaguggauccccuggaacuugaguuacagaugguugugagccaccaugugaaugcugggaauugaacccaggagcucuggaagaacagccagugcuguuaaccucugagccaucucuccagcccuguuguugucuucuuuuucuucuucuuuugauguuucuguuucuccucuuucuucuucuccucuuuuucuucuucuuuuuuugagacagggccucaauacguagccauagcccauacugucuuccaagugcugggaccacaaucauggaccaccauacuguuguugauuguuuuaaaagaugucuugagccaggcaugguaguucaugccuauaauccaagcauuguaaggagaggcaggaagauugcuccaaguucaaugccagccugggcuauauagggaguuccagagcugggcauuuguacauagcucuguaguuucagcacucgggaggccccagcaagagagcuguugggaauuugaggucagccuaggcuauagagugaagcuaugucucaaaaaauaaauaaauaaguaaaaugucucucuuugcuacuuuuuaaaaugaaacugggguggcacaggccuucuguuacacccaagauaagaggaagucagagaaaacaaugugaaagucagaccaagagccaugagauaaaaacaacaaaacaaaaaacaaaaaaaagggaaagcaacugucuuugcuucucuggggugcuugggauagaagcaccccaguagagucuaacagacucuaagcuacccucccagccccagccucaacccguuucugaaaaguucaaaccccuucccuagaacuagaccuagcuccagcucugguugugacagggcaggacagggugggauaaagggccaagucccuaacacuuaccggagaucucgcguuugauguuaggcagcucagcuggacaggaauugcugacggugauagcugggguagccacucccugacugcuguacacaucaaguagauuuccagacaccggcagcuguagacagcauaggaauagaagagccuccucaaauucaggcuccugacccucacauauuaaaagcuagcacccccuaaugccaagucuggggaauucuagggcauuuuuuucccuucagggaaguuucacauaguacuuaacaguaggaacggaaccaaaugaacuuucccugguuugugggaacugaguggggggaucgcccacucagucccucugaagcccaaacucugagaagaaauaugcugcaaaaauccuaaucgucagguugucugcccauucugaucuggcauuccaggccauucgcugcuuccagccuagccuuccaaaccagcauucuugcaacacuccaacucaaaucuuuucagaccuugguaaauuaugauggcaacacgccauccaaaauuuggcuuucuggagaguuccaaccuaauccccagccuuaagugugaucccuacuuuaaacaccaugagcucuuaucggucauuuagcaaggucuugacucuaggucuacccacacauucugguggcucagauucuccagucuaacucucucccagcggcugcugcuuuucuaccagccuaguuuuugucucgcucucuuccuaucuuagacacagucuuggugcaauacauucauccggaagugcacccgguccucuccuuugaccagcugccagauacggcaaucccucagaaacucuaguuguguccaaacccgugaaaaguuaugaugaaguggaucuuuuuguguguguggcacugaggacaaaaccuaggaccucacccacgagaggcaagcacucugcucggcuacauccccagccccaagcuacuaccauuuuuauacaagguuccauccucuugggauguuggaaaaagcuaugagauaacuugccaaagcaagugauaaggguucucugaauggcccagaaucagacuguuagaacagcaaggagaucucuugcucugcaaagucacagccauuuuucuuuacaagguuugagccucuuagccuaauucauugcaagggaccuggcacauuccaaacaguucaagguccacccacuuguuauauauaauucaagcuuuuugguuccagucacuacauggcaguaccugaaucucuugggauauuggaacugcuacaugauuuccacuucuugguacuuaguagagcacaggucaagugcccagauuaauaguaugucuauaaacuccccauauaauauauauauauauauccuuaagucuaccagggccaccucuccaugaagucuaccagaggcccauucucaauauaggcccuucucucucucuuaguccgaugcauggcaaggaucgcucauauacacgcagccaaugcgguuguggucuuagugacagacgaaugccauaauuuucagaccaccucccuucuuagggccucaccgugcuggggagcugcagcccugcagugccuccuggaagauagcugagcaucucaucguuguaacuggacuccaggcugaugaucucaucaaugacaucaucaaucugggggaaaaaguaaauacuguacaggguuagaagaacugggaggggaggcuggggguaggaguagcuuaaugguagagugcuggccugacacgggcaaggcccuagguucuaucccagcaucucaggcauucacacacacgcaaacaaaacaauaauaaagcaacuggacgaagggcauaaagggagguuaucuacagccucuuaccuccuuuucugagcuggacccaauggugagcagcgccauggggcuguuaggagcacugccuguaggaccgguggcaugagcaguuucaggggcaggaaguggcugggcacuggaaggcccuggugguggggugagagccugggaagccagcuugggcccaagugugguagacaaguacuguuugaccugcugccggcgagcuugcugcaggugguagcguguaggguucucgaggugggucugaaccugugagauaaaaggccauggggaaggagagaaggcacaaaagagcucaaagaaggaacucugagccccagccuguaacucaacuauuuuuaggcucauguggaccaacagggccuggaauuugagaacauugcagaaauauuagaucuccccaagaccccaaacuucuuuuuccagaaauccuuuacagccuccaaaaucuuuccagggcugauaaguuccgucaguuucuagaucaccuugucagaauccucagggcucccugcuacgucucagacaacacccaacagaaccaugaacuauaacaccaaugccuccccuagacaucccaauaggcaaaauauucaucacagguacagaagaaagccuaagaaaccauaaacacccagggcacaacagcagaccauuuaaacacuaucacaaauuguccuuagaaccauacagauccuguccaaaagccaugaggacccuggguaaccucuuagcuccuaugagucacuggguccaaaagccaugaggacccuggguaaccucuuagcuccuuugagucacugggucccagagcuucuggaucuguccuuaccuugaguaccucccugggcaccugagcaggagguggacgacucaguguguggccaccagcagacacgccaaucacagagauggcuggugaggcgggcgcagggcuggggaagggagcggccgcugccuguucccgccgcucacgccucuccuguuccugagccugggcccucauaagcugcugacgcagcaagacccgugaugaagaagaugacauggcagggguccgggagcccccugcagaagacgacgcagagaguguagcugggguggucgguguggccugcagugauauugggaggcuguagaaugggagauauggggccauagguaagcuacaagucucuuuccaagcuuaagggucacaguguccuggacuauauccagaagcagcuuuguucucgguguuccgagaccauaauguguggguaggagacagagguaccaggacuggaugugggccucaggagacgcugggaccagacacaguuccaucacucaaaggucacagucuggccaacuccucgagaggaaacaagauuguagccuuuggccuuauuggugaaaccucugagcagguucacggagugacuagaugcuggccucugagaagaagagguuuucuuacuaaaaaccugagcucagguggaaccgaagcugcacugugaaacagaacguugccaagccuaaucuggagcuccuggaagugggcaucaggcugcagaggagccccagacuccauuuccucccugcccagggcucugcugccaggagcuagucagucuagaaaaucucggagguuucacaauccucucuuccugccccucuuccagguccccuccccucucucagagcccaggccgaugacucagcacauuuaggcuuccacccacuagucuggacgcucuagaggcccgggaggguggguuugucagguacgaggagggcugagcaggggcugcauggcccuacccacaggagggcgggcguuuaggaaggccacgccuauccaaguagucagguuugcgagaucuguacgugaauucuaguaaggguaaggcauggccagagacgcacugacauguccaccugcuggccuccuccaugccuauaauuucagcacggggaaaauauaggcuacggaggaggggagaauggguuugggugggcuccgagggucccuggccauggaguaaggagaaagacugggagcaggaucaguucagacagucguaccuggagcggagggauagggguuggcuuuugagcucguagaagcugucaggaucgaggauguuuucuaacucgauaucagcaacaaucccggauuccggaagcaaagaauucaggcugagggugggagggaggaaggaguggugaucagugacugccgggagcucuaaauacccucccuuccccagacacugaagcgaagcgggcucauauccagaagggcacugccuagaccaagucccaaaucuuuugccucccccuacccuauacugcuuccuacccacaggcccuugaagggucggaacaauagaaaggccgggaccccaacucccucgcuugaaccaucacaacaaccagggauggggggggggggcgacacaagaggacuuugagaauaacaauucacuuugaauaaggauucccggcugcuuugcauucagaguucucccagcccccacacccccuacuguuuugcccauagcugaaagugaacccauguccguacacaugcacacaacagagguacccaucagcccaacacuccauuguaacaccaacugaaugcaucacaaagagaccugggcuuccagguucacuuugcauuaagaguuaccacuuugcaaaugaguucuuccagccccaggcagaguucuuaggccgcuccuucccagcaaauacaagaagggacuaggaaaggcuccccucacuccuccagggagcagcuucaaaaaacugagcgcacaagcugccuugcaggacgagcaucuuucuuacuaggagaaacuacccaaccuccuccuccuccuacuuuguagagagaucaaaacacacacccguuuucaguaacagcauccaccugcacacaaaacaagcccuaccucacaugaaggaagagggcugcggucaaucuagccuacauacggagccugcaucucaagucauaaaaacaaacaaacaaacaaacaaaccaaccaaaaaacccauaggagcuaggacuugcacuagagcagcaaagcaauauccaucccuccuuucaacugugcccauuacugcgaugaucaaggcuguuauaagcaauccacgauaguugugcucaguccucccuguuagggagaaaggacccuagugucccggcaaaacacgcacgagggugaauauacauccuuacuagaugaggauagcuccgugguacagcucuugucuagcaagugcgaagcccuggguuccacccaccgcauccccaaauaauaugcacccuugaauucagucaaguuuagaauccacuaagcuugugacuccgcucaguacaaagucuuuccccuccccagcgauggucuuccuuccucuccuugcgcagauggggcucuaaagccacccaggaagucgggaagaggaagcuccgagaguagcugaguucagcacaaucccaggcagagaggaggcagccccccucccauacucacacacaccacugcacguuaaguugaaaaaggugggggcuggagagggcagggcuauggacaaggaaggccuggagcuucaaagcaaggcugauggaggugagaggagccgaaaaggagagacugaggacccacccagacgggaauggugcaaucgguacucacuccagcucuagagacugauucaagauuacacccgggaacugagagaccggcugggagggcgaaauaaaaggaagaggggguguguggguagggagugggcagggccggcuuggcugcaaggcuagggcgaguggcaacagaaacaagacccuccucugggcuuccauauaaggcucuaggccuccccccaaccccccacgccuaaaaagugaacuguaucuuuccagugugcccugccgcaucacauuuuaucacccauuggauaagacaagagggguuuccacuaucucggccuuucuguacagacgccagcugagcgggguagcaacagugaaccgauugggcccagcaaguugcuucgcucaauuauucacacacacucccggcagaucggagaccucccccuaacuccuuuagacucgugcuauucccaaaaacacagcaccggcuacugggaaucacuaggugccccaaauaacaccucugccucccugaauuuuccccccacacacacuaaaagggggaggggggaaaccccaggauuuccuuaaaaucagugccucaccugacaguauguaugcccucacauucaucccuccgcgaccgagucaacaauccccaauucagcuuuuaaucaguuuccaaguucaacuacagcaaaccaguuucuguauacuccacgaucugccccgcuagacccagcaaagacacccccccaaauaugacucugcccuccucacgcacucccacuacuccuguaagcgucuauccaagcagaucaguaccagauuucugaggcgcccacccaagaugggcacuccgacguccuucaagccuaggccaagagucuccaaccccagucgaggaccccccguguccugagaugaguccccggggaaccucaguugucacucccggccccagagguggccccgcaccugagcagcugggccgacucagcuggccugcgcucuuccaauagcaggaacacggcucgagggcccuccgcgcuggccucuacggcgucccgagcuggcucggcugcaugagacaugacgcccggcuccgggcgagcccugccaggccggucgggccuuggcccggucccccuaacaaaauaagagucccccucccccuguuugccgcugccuccuccguuaagccauggagcuagcacugcgugggcgggcggcgucgggaagaugggaugggccgugagucaucacccgcccugaacggaccgacaccccccaaccuaaccccgaacgaccgcucgccucccucucguccucuucccccuccuccuugggcuggggaaacuccacaggaagugaccacacuggggauggaagucugguugggccauaccuccugagcaaggcagccaguugcagccgggagauuggagagcccgcccuaagccacgacuucgagcgguag

SEQ ID NO: 9369 - RNA, 30805 nt, Mus musculus
agucagugggugggcccgucuggccagaugguauuuuggccacauagucuuuacacacauacucacacacauacacacguugcuggaacauugaacauggacugcacccccacccaauacccccagucccgaaggcagaguuuagccaggcuuccagacauaaauuaaaaaauaaaauaaaaugaaacagaguuggucucuaggagggagaucucaugcagaguugaaggcggaugacccugggaaccagagccaaaaaggaaaagccuugcccuucccucagggucucuucuccccaagggcucugccauacaucagggucaccaacaccagccacauauaggccucuagccccuuuaauguccaucucccaaacuaugaaauuuggugccagccuccauauuuucccacaacagcccaagggagugagugacauucuggaaaggauugggaauaguugcauccuguaggucuuuaguuggcuucuccagguucuaggucugggucaggggaccccacacauuccuugcugagccgcacaauuuccugggauagaacuuccauguccuaagaaacaaaugagccaucaggagcuagaggaggggaagagaggggcagcucuguuagcaaaucugagcugugaucuguaguuagauggacugauggauucucggugcccagugguguccagccuugaacaggaagaucaaccaccuucucuuuauagcaaaugugagcuugcuucuucaaggcaaaaccuggcuaugacucccuuagugaggagggaguauuuggguggagguguggggaggaauuaauguguggguggaccuauggcaggcggauggguucacaaaugaacuuuguagaggucaagaaggcagguagguagcaaaugacaaauagguggugacugaugaguucgugaaaggacgaugcaucgggaaauggcuggcagccucggagaugauagucugacagauagguaggagagcagguagauggguaaacagggagcaagggcauacauggauggaucagugggcagagggacagauggcagacugaugggcuaaccugggaaguugauuggaggguaaaagaggugaacacaaaagggcgguagaugacuggaaggugguagcuggggggacaagggccaguuggaaggacacugccagggacuguguggguagggaagcaggugguuggagggaugggugggcaggcuggugguccacacucgccuugugcaagugcauguucuuggugaguugcuccuccaacauguucugcagcuucuuguucauuucucgaagguucucaucgccuggcuucacuaggucucucaggacacugcccagcccacuucggucuguguggccugcugccacagacacaucugcaaggguccaggcugagcaccgcccccucggcagagccgggguugguguagggaagacugggcagagccaaaggagagaggaggaaaacagagagcaggcaagaagggagaaaggccauguucuguuugggggcagaagcucugacauggggaagcccagcuguucuuaguuacuugacccugaaaacuagggucauugcuacuccuggggcacaggacacacaggacacaggacacagaguaaacccugagagcaugugagcagcucguacugaauagggaguaaaagcauggaggucagagaggagaagagggauggagauauaguggauagaaauggaugauagguguaggcaugcgcccuuggaacccuagcaccuagcagguuagcgcaggacugcaaaauccaguuucaaaaaaaacgcaaagaaauaaaaauagaaauagagcaacagcuauuaagagaagacaaagaaagggaacagaaaaaaaaaauacauagagaacuagaaagcaggggagaaggaaguguagacagaaagagacagagaaguccggggaaaauccacuagaggguggggggaggggagaagggaugaguacaaagccgaggccaggcaaaaaagcaacguuucccugcuuuccucuccauggcucaugagcuugucaguagcuucacugaguuucaagaggggaaaaggagcaauggaacaauggaaaaagaggggcaggugaagguuucacuguaggugagggcuggagacgggcacugaccaauccggcuguccaugacguaggucucaaugauggcgcuuuuccggcagagaucuuccgccauagaggcgcugcucaccuccagguguuucaccugcaagaugguccaccccaucucaggccccucaacuucccauuuucucccaugaggaggggcccagagcauucucaagacaacccuucccagccacgagcccaucccagggcauuucaugugaagacuagcaagagcgacggcaccuucuccucuagcauccauuuuuccugcugagucucggccagccucugaaacagcucagccacuuccucaucugacagcucugcuggccgagggggcugggccugaggacugcuggauagagacuaggagaaagaaagaagaaagagaaaaaugaagcuauucucagcaugagguaggagccggaggcacaugggcaguauaggcucuggggcuggaggcgcaggccacacacuuggcacucucagaaaacuccacauuuccuuuggcuuaaagggaggcagacaguguuaccaccaccaccacaagagcguugcugagaggacugagggaaauccagcagcaaaugacaucuaauucccagauggcaggaaauggaggcaacagugggaagagcuaaaugguaccauuaaagaagcgagcagaaaaaaagcuaaaggugggaggguuccugcaggucaaauggucugcuuuccuccaccagcggaugccaagaagauaggaccagaauagacacaagagucagacguaaggaaaacaaauaacaagcaaaaccaagggguacugugaacgugaauucuagccgguacaaagaaaagacacuuucgaugaaguggaaauuucccaccuggggaagggagaagaagcaaccaacaaaacuaggcuacucaccaucucaauuauuuuuuaaaauauacauaguuacuuuuacuuuacauauguguaugucuguuguguaugccacaugggaaucagaagcaaggguugguucccccggagacgggguuacagguaguugugaacugccuaauacagaugcuggguuugaacuuggaucuucuagaagaagagucagugcucuuaacugcugagccaccucucuagccuccuaguuguuucuuuauuuuauuuuaauugaaaaaaaaaaaagaauugguuuuagcuggguagugguacacgucuuuaaugcugucacuagggaggcagaggcaggcagaucucugaguuugaagccgguuuggucuacagaacgaguuccaggauagccagggcuacacagagaaacccuaucucaaaaaaagaacaaaaaauacuuucauacaauauauucugaucagaaaugaugauuaagaucacuugcuauucaugcaagaaacugucuagagcucaguacggagcguccacauccagaggcucguaccugacaagaaacgcagcucccuagaggacuccgccagccucugugggcaccugcaugcagaugcauaggccuaugcccgaguccaggggcucugacuccuucaucuagccucugugggcauaggcacaugugguacacaaacauacaugaaaggcaaauauccauacacauaugaauacauaaauacaaaaaucauggauaaaaaaauggagcuggagacacuuccugcucuucuagaggacucaagaucaauucccagcacccacaugaaaguuuacaaccaucuauaacuccaguuggagggacucugauacauucuucgggccuaugugggcacagggcacuaggcacaaaugcaguaugcaaauuacacaugcaggcaacacguauucauauaaaauaagaaaaagaauuuuuuuaaaaaggauuaauaggaaggguuggaaauguagcucaguacuagaauacucaccuacaauguaugaggacccugguagcacagaggaaauguauuuuuagacaggaccucauuacauugucuagguuagcuucaaacugcugaauuccagugauccuccugcacucugaguagcugggcucaaaggcaugggccacuaugcccaauaugaacuaagaauuuauuuuuaaaagauuuauuuacuuuauuacuguacacugucacuaucuucauuuacaccagaagagggcaucagaucuccuuacagaugguugugagccaccauaugauugcugggauuugaacucaggaccgcugcaagaggagccagugaccuuaaccacuaagccaucucuccagcagccccgaacuaagaauuuauaauaauauucuuuggguagugaaaauaugauacuuagucagguggugguggugcacacuuuuagccccagcccuugggaggcagaggcaggcagaucucugugaguuuaaggccagccuggucaacagagugaguucuaggacagccagggcuacacagagaaaccuugucuagaaaaacaaaacaaaacaaaaucuaaauaaaaagugguuggcaaggaacauggugcgacagauggcaauaguaacagugaucagucuaugcuguugaagggaaucagccaccaguagcucaugcuuaaaauccuagcacuuuggcugugcgugguggcgcacgccuuuaaucccagcacuugggaggcagaggcagacggauuucugaguucgaggccagccuggucuucaaagugacuuccaggacagccagggcuauacagagaaacccugucuucaaaaacaaaaacaaacaaacaaaaaauccuagcacuuuggaggcugauggcaggauuaugaauucaaggccagccuaggcuacauagcaagaauccaauaucaaaagugggggaaaacaaucaaauaggggcuggagagauggcucaggaguuaagagcacuggcuucucuuccagaggaucugaguucaauucccagcaaccacaugguggcucacaaccaucuguaaugggaucugauccccucuucuggggugucugaagacagcgacaguguacucacauacauuaaauaaauaaaaucucuuuuuaaagaaaaaguggggggaaacaaucaaauaggagcuggagagauggcucaggaguuaagagcacuggcuucagcagcgacgugacagcucccaacuagcugcucuaacuccagcuccgggggaaucuuccccccucuucuggccgcuuaggauacugcauacaggaggcacaccaacacacucccauucucauaaaauaaucaaauuaaaguaaauauuuaaggccaggcaugguggcacgucuuuaacuucccacaaugcuugcacuuuccagcacugggagcggugggauuaaccuacagacggugaaauagaggggcccagagaauaacuaacuggccugccuccugugcaucagucucaggcugauggguuuggggagaaggugacaaagugcucuagucagggggcugggguagcagcucaguagaacagcauauguugacaugugcucugcauauguguaaggcuccagguucaauccuuaguuggagagagacauagacaaacagacacauacauauagaaagagagagaaaacacagacacauaaagagacagagaagaaaugcucguccaaaggucaguguagucaauuuugagggaggaggaaauagggaauguccagacuuacuuagaaggugacccuuacccuggcugggauggcugaacucuccuucuccuucaagaucucccgguagcugaaggaggagacacuacugcuguccccugucuggguccugcuuggugaguucaucucagacagaaccagcuccucgaggccugaauguggaggaaaaagcaaccugcguucggaucccuuggaaucucaagacagcaaccaguaggaagagaccucaucaaaagacuugccagagauucaaagaggaaaagagacaccccccgggcaaacaaacucaaggacuggaccaggcagaaacaaggcugguaacucugucgguaaccaugcccaguggaagaagggaagugguggggcgaagggaaagggcaaggaguagacacaagauuccagcggcaaaaguauucaaaccuccaugcagagaaagggagacagggaguugcgagugcucauacagacacgcaggggaaagcgcagggacagggagccagcaccugcuggagacuggcaggcaccacagagaaagacauauuuagagcaaaaucagaacaaagauggagucguacucguagcuauuugccuagcucucagucccauguaauggagaagaacgagauauauauaaaacucuaggcuggguggugguggugcacgccuuugaucccagcacucgggaggcagaggcaggcagaguuugaggccauccuuuucuauagaguaaguuccaggacugccagggcuauacagagaaacccugucuuaaaaaacuaaacaaaacaaaacaaaaacacaaacaaauaaauaaaauucuaaucuauuccuagcuuguucaucuacuaaaacgagaaauuacuucagggaggcugaacaucucaggaggaaacugguuuggugagagagaugucacuugccaggucaguugaacacuugcugagcaugcuacacgcucgccgcuagauuaccugagcugagggacucagggucagucugggcaauggcgaaaaacaaaccagaaaacauugguacugaguuggugacacugcccuuacaagugcucccaggugucagggcaaagagggauccucagacagggugcagugccugaguggggcucuuccagcaccucaguugacagccagugcucucuaagucugucugugaucuaagacaagcaccagacccguuacugaacuugaguuauuccaaccaagaaaagguagaaacaacuccaguuuugcgugggcacgucuucugcuuuugguggcagaagcaucguggguugaguuagcuguauacugaaaacaguacaagccaaacauggugucggaugucaguagccaaacuccuaggaagcuaaggcaaagcgccaugaguuugaaaucagcaugggcuacaaagugauguugucuaaauaaugaugauagugaugguggugguggugaugaugauggcuguguugugcuguuaccuauggaaaacugucucccuugauucaccaugaaugucuggagggggcuggagguggggcuuguauccuagacuuauauggugaggauuucuagaauccaagaauggaaacagaaaaagaacuaaaggcaguuacaaagcaaacagaaagaacacaggcagagagaggaacacacacacacacaaagcaggcagugcagggagagaaaagacagccagcauucaggcaggacaaagggcuggagcaaggcucagggaggaaugaaagaucgccccaauucgcagcagcuuccgaguggccuggccucucaccugugcggcucuugcuguugguaaggaucuccugcagccguuccugcagcuuaucagcccguuuccgcuccaagugcagcugccgcuuaagaucuuugagcuaaauaaagguaaggggcagaguagcccaugagagcugugaccuggguggcccaugaagaaagggaaaagguccagggccucgcuagcuuaccacagcgcugccuuucuucuccaggaugcgcugcccgucuacuguguccuuuaccuccugugguuugagaaggcacagcugggcagguguuggcacaguugcccacagcguauccugucccucccuaucccgccucauucugcaagcuuaggccaggccugugucugggaccacagaccugcuucagguugcugauggucuucacguggccaucucgcuccuccugggccugcuggagcuguucccgaacauucugaagcucuucauccuugcccugcaaaggcaacagcagcucaggccacggcaugagaagaaggcccuguucuccugcaggggugcccagcgcccugagacaggaccaccaccauucaagagguaccuucagcucagcggcgugcuccucccggcacagcuugaggguuuccucuuguuccuguugcugcugcugcaaagauuccuggaaggagagucccagcucugcucaugguccccagaagaauguguguccaguuaaggacaagaacauuucagacaaguucuuuggguguuuaugaaaacaccuuuugauuuuguuuuuugguuuuuuguuuuguuuuguuuuguuuuucgagacaggguuucucuguguagcccuggcuguccuggaacucacucuguagaccaggcuggucucgaacucagaaauccgccugccucugccucccaagugcugggauuaaaggcaggcaccaccacugcccagcgccuuuugauuuugaaacgaggucucaguacauaacccucacuggcccugaacucuuaacgugaccucaaggcucccaagugcuccaauuaacagggaacucacugccauucuuguaggaaauggcauaugccuuuaaggcagaaauaagaaguggaaaacuaacuauacuauucacauaguagagcaagugauuugcauuuauauuuucuuucuuuaacaaaacaacacugcaugccaggaacauucacguaaccgccugcggccacacuaacuggguuccuaagugggaggccggagcuguauggaagcaaacggcgagagaaauaauggaggccaagacauguuucuguucaaggcccccaaguuuacuaagagucugugcuuauaaagggggguggcccauccccugccaauccauucuuggugccuguugccagccuguaggaugcugucuacugaauaucucaagggccucucagcagguagcagcgucuuggugaagagcagcagcaggugacagaacaauagagccaucuaagucagaagggucuaccccagguggucucauacucaguggcagcgaggucugaauaguuuugcuguuggaaauuaaaccugaggccucauucaugcuaaccauguggucuaccgugagcuaccuucagucucuccuguccccuuucugccaaagaugcaaauggccauagaaagauggaauacauuaccuaagaucacaccacuacgaaguagcccagucagcauucaagcugagagaaauacccagcuccaguguguucuucucugcuacacgacacugccucuuauuauugucuugaguuuuccagaaaaaaagacuauaaagguucuuuuguuuguuuguuuuuugguuuuguuuuuuuuccgagacaggguuucucuguaucacccuggcuguccuggaacucacucuguagaccaggcuggacucgaucgaacucagaaauccgccugccucugccucccaagugcugggauuaaaggugugugccaccacgcccggcuaaauguucuuguuaaaauaaaaauuaguauauuaccaaacauagaaagauaauguauucuauuuucuuuuuuuucuuucuuuuuucuuuuuuucuuuucuuuucuuuuuuuuuuuguuuuuuuuuuuuuuuuuuuuugcagaggacaccaugaacaaucuaagaggaaaaaaugccuguucaaaucuucaccaaaccagcuuuguagcuuuaccagguaccaccgacucaccucagcuuccuucaagcgccguucaaaccagcccuuggcuccauccauggaguguaccugagccuggaguucuuccacugugugcugaagauuuucuaauucccuuguucgagccuggaaggagaacccaggcaggaguugggcagcagaggacuggccaccuugcauaucacuuaccugccuccaugucaccagcagcaagcaacgccacgguccucagcuauuagaagagauaggcuauggcuacggcacccaccuucuccucacgaaucugcccccggagcuccuccuccugccgcuucuuguccucgugcaguucucgaagcucacgcucguaucgggcucgcacgcccagcagcuccuucucgugccguaaccggacggcccccaguucuucuuugugcugggacuucuccugcagcgucuccauggcuaguucauccagcaugaccuuccuuuucucggcacucuggggaccaggacggugggucaagagaggggcaauuuaucuuccaacaccacaaaaugaccaccauucgguucuaugcccaaggaacuagccagauuccaccucuuccccggcucuucaaacuggcugagucauucuccagucuuuuuggaaaugaucguuuguuucucucucucucucucuuugcauugccaagauuuggccauaacacucccuacccucauggacuaggccaucucguuccuuccucucaugaugccccaccuuccgagcuuccuggagauccuggguuagcugcuccuucuccugcccuauuucuugaaguuguuccagcagccggcuauuggcccuuaacgacuccuaauucaggagagaagaggaaguuggaaaagagucccugguuagguaccaaugaacuccaacacuucugguagaccgucccccgaauaaaguaggugcuauaaucuuaaucauaaugggagaaaugacagacauugcuuccugcuccucaguacuuucuucucugcuuccuuagcaacagaauuuauacuugggaauagucugaaguauuucucccuucacagacagguagggccaugugacucacuucuugcuucuuuguauucucucucucuuuuuuuuuuuuuuuugacacagggucccaguauguaucccuggcuugccugaaacucuauguagaccaggcuggccugggacucaucugccucccaagugccaagcuauauuccuuucuauuugggggaauaaaaugcuccaucaaaagucuuuuucuugagauaggaccuuauuucaaacuugcuugguagccagcagugagccuggacuccucaccugccuuuaccucccaaaugcuaagaucacagguccuggacaucguggcugggcuucuuccccccccccccuuccuucuuucuuucguuuuuguugguuuguuuguuuuguuucaagacauggcuucucuguguagcccagguugucuuagaacucacucuguagaccaggcuggccucaaacuuagagaucugccugccucugccucccaagugccaggauuaaaggugugugccaccaccacgugaguuuucucucucucucucucucucucucucucucucucucucucucucuucuuuaacaaguaagcaaauaagcucuggcaaguuuucuuaaagaaaaacuuuccaggggcuggagagauggcccagugguuaagagcacugauugcucuuccagagguccugaguucaauucccagaaaccacauaguggcucacaaccaucuguaaugggaucuggugcccucuucuggugcgucugaagacagauacugugcucauuuauguauacauacauaaaauaaauuaaaagaaaaagaaaagaaaaacuuuccagguuugcguuucaccagucuguuauaauaucagaaugccagggucaacaaaacuagugugcauacucuguaaugauuuuccacacauugugccacuguagugacacacaacaguuuuggccaccauggacuaaugguacucuauuucagaucgccucaaagauggguauguuggaaagaguaaccaauuuuauuuuucccuguuugguccucuucagagugugcucgucuccuagcaugcacuuucugcucuuccuaaccaacuggagacuggaguugagcgaccccagagccuuuucauccucuuuccagccacugcucuucugccugaagugcaggacagcccccaaccaagggcagcugcacagaggauugagacccacaacgcuuuucuuuuuuuuuuuuucuuucuuuuuguuuuguuuugagucaggaucucucuauguaacccuuguuguccuggaacuuauggagaccaggggggccucaaccucgcagagaucugcuggugcugggauuaaaggcaugcaccaccaccacaucuagccccaguguucuuuuuugagacugagucuugauuccuuaauggaaagaauccuaccucaguuucccaaguagcuaggaauagcaucacugggcacagcucaggugguuaaucuguaucuagaauuguuaaguauaacuuaagucuuuauuauuaugauuucuuuguuuuuaaacauugucagccaccauccacuuuuuuuuaaagauuuauuuauuuauaugaguacacuguagcugucuucagacacaccagaagagggcaucagaucccauuacagaugguugugggccaccaugugguugcugggaauugaacaaagggccucuggaagagcaguuagugcuccuaaccacugagccaucucuccagcccuuauuaacgauuucuuuguuuugagagagggucccccuauguaucuuuggcucaagcucaaggagaucucugugccuccaucucuuuggaauaaagaccaccuguuaugacuguuuugguuugauuuuauuuuuuuaaaccaagcuggccucaaaaucacaauccuccuaagguuuuuauuuuaauuuuuauuuaucuauuuauuuuacaugcacagguguuuugccugcauguaugucugugucccacaugcaugccuggugccuguggaggccagaggagggcaucagaugccccagaauuggaguucagacaguugugagcugccaggugggcacugagaacugaaucccgguucucuggaagagcagccagugcucuuaacugcggaggcaccucuccagcccugugugagcuuucugagugcugggauuacaggcaggaaccaccagagucagcagaacauguucucaaaagaaaggaagguucuccuuacuacuauucccuguucccuuuccuccuuccuuccuuccacauacgauguaaauaugaaagugaaacaguuucaacaacuguuccuggaagcaaaacacagguccgugucaaaggcuggaaaauagcaagaaccgaggucccuggugauuggagauccauaauucagaacagauguggaggcucaaaccuauaguagcagcucuuaggagacugagacaggaugacugccaugaguuagaggcuagcuugggcuacacaugaguaccaagccagccaggaacacauaacagacaacugucacaaacaaaauaaacaaaagaaaaaaaagaauccaccaucauugcuaucauuaaucccugaacagccuacuugguccauccuccucucacuuuugacuucauuuccuucagccaaggucucucacuaaaucugucgcucacaguuuuuggauaaucuggcuagccuccaagccccaacuacccuggcaucaccuugccaccuucccagcaugggacuuacaggcauacuucucccauggugcuggauucugaacucaggucuucaugcuugcucuuguuacuaagugcucuugcccacugaaccaucucuccaccugugccccacccccacccccugugcaccuugauacaagucuccuauguagcccagacuggucuccaucuuccuauguagcuaggauugccacgcacaguccgcugaaaucugcuuggcaggccgagaggccuggaagcgcucacgaggcaaagaguuucauggaaacucaccuccuggaguuuugguguucucauuaaacccauauacucauacccuauuuccgcguuagucugguguauggauccacaugcucucuuuuaguauuaucuuauuauaagugccuuuuaagauugaauucugacauagcuaagccuucgccaguguuccaacauccuagaaaguccuugagcugaccaugggcuuggaauuuaguaagaauguugccuauucagugauauugagaauugccucugguauuacacuaucacuuagaauaaaagccaaguugcucccauaugcaggaauuuacaaugguuuaggaaguagaucaggcugugguuuuagaguauugcauuauucaugagaugguuagcuagaucggaacucccuaaucagaaccaugacuuaugugugaaagcccuugcccuaggagugaaaagaucucacaccuggcuccuaaaacuauagcugaccuuagauagagcugacuuugucucaguuauuuuauugcccaguuccugccagucuuuguguuuacauuccucuguuuuguguaagagucauuaagcauccgguaaccucauuuguaccuugcccaugugucaccuaacuucccuauuuucuucuguauaaaaaguuugaugcgcaauuugacaaauuacauucagauucuacacaaccucuuguguuucgucugucugucauucauucgcccacucuuugcccaccugccccagagacucguuccacgcagacaaagggacccagagggucuguggcauaggaugacuuugaacuucuuuuuuguuuuuuuuuugguuuuuugcuuuguuuuuguuuuguuuuuucaagacaggguuucucuguguaguccuggcuguccuggaacucacucuguagaccaggcuggccucgaacucagaaauccaccugccucuaccuccugagugcugggauuaaaggcgugcgccaccacacccagcugacuuugaacuucugauccuccuuauucuguuaugugugugugauccuaagaacugagaucacaacauaaauaucacagagccugguuuaugcagugcuuugaacuaagcccagggcuuugugauauuauacaaguacucuguuaacuaagcuguaucaccagcacuaaaccuuugugugugugugggugugggugugugugugugugugugugugugugacagagagacagacagacagacagacagggucuuauuauguagccauuucuguccuggaauucacuacauagaccaagcuagccucgaacucagagaucugccucuuaagugcgggcauuuaaaggcuugugcugcuauguuuagccccaaauuucuuucuuaauccaguauuauucuaguuucuccaggcuaagcauccuucauccuaaaaccuaaaaucuaaaacguuuuuuguuucuuucagacaaggucuuacuauguagccuuggauggccuaguauucacuaugcaaccaauacuggcuuacagcauaugggaauccuccugccucagguacccgagugcuaggauuauaggcauaccccaguauaucuggcuuaaaaucugauuuuuuuugaguuagcacauaaagccacauaugggaauuccacaccugaccaccaaugcacaccuuugaucucagcagucgggugguagagacagguggauuucugugaguucaagaccagccugguguacagagcaaauacuaggacagcuaagguugcagagagcucuacuucaucucaaaaaaggcaggagcacuaaaaauauuuuauaaaauuaccuucaugcuauauguauaagguauguuuagauuuagguuucauccccaagauaucucaguaaguauaugcaaauauuccaaaugagacaaaaucugaagcaagcauaagcauuacauaugggagacauucaauuuguacauuacgguaccagaauggaaacccugacuaacugaagaagcucaguuuugcagaaguaaaauuacccaugucaggacagguacuaggauguuaagaagccagccaggaauucaggucuccuugacucccaagucuucucaccauuccucaaaagcaagucacugcacuaauacuaguaaacuacaccacaggucagaaaaaccuucaccuggagcugcgaguugaggucaucuuucugucccauaagcucuucauauucagcuugacgaugcuguaacucagaugccaauucacuggucuguucccgaagcauauucaguucuugugucuuugcugucuggaucuggagaacgugguaauggugggcaaaaggaacugcagggggcccuaaggcccaggaaccccggaccucccaguuccggggagacagagagagaaguauaaagggaggaagaaagacaacguuuaaaauggaaaagcaggaagaggagugaaagauucgugcaauaaauacuaugaagugauaaaagaaagccauguaacguggauaaaaccacagacauagagguaccagaaagcaggcaaggacagaugagcaucaguuccacuuauaugaaguuagagaacaggcaaaugaauuuauauuguuaaaggucagaauccugguuacuuccagggauaugcuaaaaguaagugagggaaucuuccaacauacugaaaaauauucuguaucauguucuggaagguagcuacccagaauuauaaaggaacacauuggacuuacugaguguacaccuaugauaauuacauuucaugcaccuuaucauaaagaaacgugaauggcagaaaagcaggaguagauggaaaagaaggcuagaagccaacagaaaggaggaacaaaaacagaggccacagaagagucaaggguccagaucacucuggccagacauggaccaaaagcgagagagacaaaagaaacagggagagauccucgagggaccccagguauccuguaccugcuccagagcagccaagcuaguccucaaggcacuguucucagccaagagcccuuccacuuguuccugcgcaucugcacucuggcuggacaccuggccccacccccacgacaggugagagcaaguccagaacagaggaacaggaaagaaaggagacagacgcacagacgcacagaccagggcuaggaagagcaggacccccugggccaugccugccuguaagacaccaacgcagccugcuggccacccucaaccccaacucccaggcccaccaaguacaacauaccugaucuuguagggcccgcaacgcugcugcaugcuccagacgcucccccugccgcugaucucuuagcucugccaaacucuguggaacagggaugucagguaaccccauuccagaucucguccuucucuggguggacacagauacacagacucccucugggaccaccuaaaagcauguucuuggcaccugugaaucuuggacuagcugucagagauuucauguuuacccagacuccaagugauagauacaucacuugcacacagagcucucaaacacauucccucccucuuucucagccuuugagcaucucggacacaccuaaguuccuaaaccuaacugcugaggggcucauacucauccagauuccagcuugggaacacuaggaguuucagacuguaacuuuacccaucuccagaaccuauccaccaggaguuguugcuauacuuaauuaaccucagugucccaagcgcaggagccucaguucacaccgacaccuagccccggauccuagagaucucaaacucacaaccucacuuuccagcucuugaagaagccucagacugacccaucuccacuaacguucugguuucccauugcuuggaaucuuuagaccuagaucaccaacagcuccugaggucuuuauccagaauugguccuugcucucacauugcaguuuucuagggucccugcaccauauucuccauucugagaaaccucagacuugucuccucuuagguaaaacccagaggcuacccaaggaccucaagaccacccaacucacaugagcaacucacuuccuaaacaucauagaaccagaccuugaagcucucaacuguacucugccuccagccccaacugccccauacuuggaaguccacugucuacccaacccucaugucuuugaccccuaaugaaacagggucucauuaugugucucuggcuagccucaaacucacagagauucaccugccucugccuccuaagcucugggacuaaaggcaugcaccacacugcccagcugauagcgcagcuuuuaaagguuucagcaucaccagacccacccaccuucccucccucccucucuuccuuccucuuuuuuuuuuuuuuuucaagacaggguuucucuguauagcccuggcuguccuggaacucacuuuguagaccaggcuggccucgaacucagaaaucugccugccucugccucccaaguacuaggauuaaaggcaugugccuuccuuccucuaagacaggguuucucuguguaacaacccuggcuguccuagaacucgcucuauagaccaggcuggcuuugaacucagagaguucucugccuccugcgugcugggauuaaaggcaugcgccacuaccgcccaccuagaucccauuacagaugguugugagccaccauguaguugcugggaauugaacucaggaccucuggaagagcagucagugcucuuaaccacugagccaucucuccagccuaucacccaauuucuaaugggagaguccacagcuacauucacccuaauuccugaucccagaccccaucgaaaguucugacucacacaauuugugguauacaaccagcgucccuagacucccacuucaggaaucucugauucauguaaucucuuaucccaacuccuaaggcucuugaguuucuauuuuucuagcuccuagagagcuuacuccuacuuuucagguugcuauaucucuaauucucagacaucccaaucagucucuaaagaccucauaccuccaccccccugguucuccacuuaggggaucuugggagucagccccaucaccugauuggcagccucaaguuccugcuguaguuuuugggugcgagccaacugggcuuucagaucagcuuccuuccgcuguugcaauucuucaauuuuguuucuaggggugacgaggauagggaugggauacauuaggcauggcuagaagcccacucuuccaucucuaccccuguggucuuugcuuaguuugccugggcauggucccuguuuuucugcuacugacaaccccaguaguuaccugcugucauuaaacaguguuuccuucucugucugcagacggcaaaaacugggcacagaaagacaagacauagauaugucauucccacaagcuacccucccccccccacaggcccccaaaaacccuggaaaggaaaaauauaccuuucuuguuucuuuuucaauuucucagagagcugagggagaaagaggaaggaguacagaaaauaauaacaguaagaauaaugacaaaacaaaauaaaaaauaacauuuauagauacuucauacugaguccuuccuacaagucggguuuuacuuaugauauucuugcagaauucucaggacauccuugaguacugaaaacuacugauuuuacaaguggauaaacugagucucagaaggguuaagcaauuugaaggcucaguugucagcagcagcagccacaucaucuccaacuaccucccuuggguuccaaaggcucccaaagcagugccaauggccacaucacagaauggcuaggcuggcaggccuggaaaguaggauccugacugguugucucagcacugggccccccagguucuaaaggcauucuuauauggaugaauugaggcaacagaagggauggggccuuccaugcacaagguagaaugagaccacguuagcuuauuccacaaugaaaggaacucugagauuugugagccucugcuucacacaugaucaaacugaagcucugaggaggcacaacacuccucugcugucaugagaaagccaggcggcagcaaaccccaccuuagcaaguuccuccuguagucuggagguuucagcuugcuuugagcucugcggaugguaggggggaagauaagggauggaguuguuaucagcaaggauggaggaaggccucuaauuuugccugucccgccccccuuuggcccaugagauggugaugucacagacaucuccauaggcccacaggugggagguagggcaucugcugucucccagcaucccagucccaagagacccagauuuaccucuaagccuuguagcugcucccagagcaauuuuuuuucuucucgcuccauuucccauuucagcuccacuucugccaauggcaugggagccaggggaguggggaguacgucuccugggggauccccuuggcccucaccaacagcagagggccucacagccucuuucccauagcguuccugcagugcuguugaguagaacaagaaugugugaugaaugacaucgucucugaagucccuugccacaucucaaauauagggagaacgauuuauccuucagcuccuuaggcugcacaggacccugucccagaggaagccucauucaggccugucacaaauaauucuuaagacccaccaacuucaaaaauccuaucuaccauguuucauaccauauuuacauauagaaccuaauuccuacucauauuggaccuggccucauuccugaucauggaaccaucacccacuaccacauaagccucagcuacucaacaaaggccaugugucagggccuucucacacucucccaagcugccucucugcuuucaucccagacccaauuuacaaucuggccucagaaucucccuaguguccuaguucuucuuaguuagcaccugcaucuccuuuucaacauucguucugcuauucucuaacauuugcuguguaccagacacggaaguaaggcagaaugaaauugcuuaauugcuccaucuuccuggcauagacauucugguguacugugcagaugagcauuagacccagaaagguaaaaugcuccccgaaauucaaaaucauacacuaguucagguaaggccaagucucccuccgaaauuucuucuuucucccauaagaggacuauacccauccuggcuccgcucaaggccugaagucgcuacauuccuggaaggcguccaugcaccugccauguucuucugcaaggcuguguucucugccugcagccucagcagcuccccguccacaugugcuccagcugcuccaggaacgccuuccuugaguugucgguuuuccagcuccagcugcuccagcuggcugcaaagcugagcagggggagagacaugacggagacagcaagucagaaccaacacacaaauagcauuugccccucaguguagaauucaucagauucccacaagaagccaauaaugugauugcccuuacacucuguggauaaagacacugagacauggugauaguaaacaauuuccaacugacacaucuuuuaaguaacaaaguccaaaaaaaaaaaagagagagaauacugaaaaccaccuucccuuuguugacucccaaccucucaucagaagcaaagaucucaggcugcuauggacgcuauuaccaccauggacagccucacuggcauaccuauauacccuucaucuguggaacaauaucccagaucccuggauccaagcucccucucgacacaggcaucauagacagcuugcaagccauuuccagaguaacuguaucuuacaggucuuauagucuuuagcuuugaaggggcacacuaugaaaaugaaauacagcaggcaugcaauccaaucuccugcuuaaaacugaagcucacuaaggcccacaaggaaaaaauauugccucggauaaaacaucauuucuuucacccauuuuuuucaccugacuggcuucuaugcauucuucaccgcuaugucaucuuuaaccuaggauuagccaacacacacacacacaaauccaguauuuuaccacagcauucucuguucacuccuuucugaccggauaucaaucacaauuaaauuuuauuuauuuauugaugugguuuauauguuuuuaaagauuuauuuauuuauuuuaugcauguaaguacaccaccauugcucucuucagaugcaccaaagagggcaucagaucucauuacagaugcuugugaaccaccacgugguugcugggacuugaacucagggccucuggaagagcaguuggugcuuuuaaccgcugaaccaucucuccagccccguauuuuauuuuuguuuuacuuuauuuuaugugucuguguacaggguuugcuuuuuuuuuuuuuggucaagacagaaucucaccauauagcccuagcuuaugcuugaacuuaaaaucuucuuaccucagucuucaaaaugccgggauuaaaggcacgcaccaucaccaugccuggcuaaauuuuguuuuguagcauggaaucacaaaacagagccuaaaacuagauugcuuguggcuggagagauggcguagcagguaagagcacuagcugcucuuccagagguccugaguucaauucccaacaaccacaugguggcucacaaccaucuguacaacuacaguauacucauauauauaaaauaaauaaauaaaucuuuaaaaagaaagaauuaaaugaauaauguagaacaauucaaauagggauagaagaaauagcauuaguaaacuaucacuauuauuauuucuucccaucccacccauaaaauauuaguguucugguccauuuguugucaacugcaccuaagcuaggguuaucugggaagagaaaaccucgucagagaaaaccuuauauccacuuggcauguaguugagucuauuagacauuuucuucauuuuuaaaaaagauuuauuuauuuaauuuauauaagucuacugucuucaaacacacuccagaagagggcauuggaucccauuacaaaugguuuacagaugguugugagccaccaugugguugcugggaguugaacuuaggacuucugaaagagcagucagugcucuuacccgcugagucaucucucuagucugacauuuuccugauuaaugauugauacgggagggcucagcccacugugagugcugccaucccugggcugauggacaaggguggaauaaacaagugagcugagugauccacagagaauaagcuaauaagccgggcuccuccaugaucugugcuucaguucccaccucuaguuccugccuuggcuucccuaaaaggauggacugugaguugucagccaaauaaacucuuuucucccuuuuuguuuuaggucacuguuuuauuacaacaauugaaaguaaacuaggggcuggugagauggcucaguggguaagagcacccgacugcucuuccaaagguccagaguucaaaucccagcaaccacaugguggcucacaaccaucuguaacaagaucugaugcccucuucuggagugucugaagauagcuacaguauacuuacuaauaaauaaauaaauaaaucuuaaaaaaaaaaaaaaaaaaaaagaaaguaaacuaacaguaaguuacccaagaauuaggaccauucugugcagcucacaacuuuaucccagaacacaggauauaaagcaggucccuuuaucugucaauggaacaacugagcugaugaaauaucuuggcaggcaggcucuagcaucaggccuuccgguaaguaccauuggggccugagaggaguagggaggggauuauaaaggaacccagagugaugcagaaaauccuuggcaguaguuuaugagagcaccagaaagcuccagggacugaggagagagcuucauaccagaagggauuaauuaaagaagcagugggcucagaucuagaggucagaauaacuucugcuaaauaguggaguggaucaauagagaaaaauccagguaagaagaucagaaagcugcagaaguagaugagaggugguagagcugaggcagaucaaaaccacggaaugaauacaaacaugacccauacucuuccaccgagugacaguccacauucccuaauauaagacuccucccucucauuuaccuucuuuuguucuccccaccuacuauauaaguacggaaugggaugaagauguggcacagugagagaacgcauguuuagcaugcaggauuccuggguuggaccuuuaucaccauaaacaagucaagacauaguuuagagggaaauugaacuaacgagauaaugucauuagugaacacuuccauagcuggucuuauguaggaggcuuuuagugacuuacauauguuugaauccucacaaaagcccgggaaggcaggugcuucuagcauuaccauuuccauuuuagacauuugagaaucaagaaagaggaggcucagugacacguuuaaaguuugaguugguaaacucuacagccaagauccucaucugggccuucuggcuccagagucccugcuuagaauuacugaccauuaaauggucucuccuggcauuguaaaugcuuaaagauuguuuucuguuguauuuuguuuugagcuucuuuuuaaauauuugccucuguucuuugauuugucauguagcccaguggccuggaacucacuauguaggugaggaugaccuuaaacuucuaagucuucugccucuaaagcccaagugcuaagguaauagguaugagcuugugcagugcuagggaucaaaaccaggguugcauucguacgacucaggcacuccagcaauuaagccguauuccaagcccuuguauggcuucuguuguuauuuuugaccauuucuuauuguauacaugcaucucgaucgcaguguucuuguucugcguuuaaaggcaguauauuccaaucaggcgaagucuuggaaauaacauuuuuuuuuccuacaguauauuuuuccuuaaaacccacugaaaacucacaaacugaucaaccauacauauagaagacuacuaggaaaaaacaaaacccacaggacuuccaacugcccagaagguuuagaaauagccaagauauuaaaaucaguaaggagauagaguuagccaauccaggauuaauuaccuggaagaaguggaaccccagauucauggcagaugaaggaaagaaaaagaaaauggaagcaguucaaauacuuuuccauccauguuaagcaauuaaaacuuuacuuaaagcuccagaauacacuggggcuccauagcaccagccaaaaacuauacaaauggagacuugaacuaaauaaaaggagugacuuaggaaccaaauaaacucagggcucagaggauuuaauuccaugaacguguuuggccccaccugucaauuuacugcccccagcaacagacuaaggccuguuucagcaccauggacaguguucagcgccagccccuguccaccacugagcuuucagccuagguagcuccggcccacgcauacacagaugcaccauucccauuuccccccucagcuaucccgggcaccagcaccuugcugaacucggccauaaguguacuguucugcaaacggaaguccuccuccuggcugugcagcuuugccugcagcaucucauuuucacucagcaguaccuccacuuccugcaguggcagacacgggccaggacuccaacagggguggaaaagauggggagguagguaaagaaggagagagaaggaaauaauggcauuggguaggaagcauauagguagaaagaaugcggcgauauauaggaauagaaacauagggaagugggggcaaaagagacaugaggaaguacggagaaggaacaagaagggagauauaggcaagggaaugagggaaaagagaaauaaugauggagagauauggaaggggagaaaagcgcaagaugagagguugaucaggaaagagaaaaggcaagaagagaggaacagagagguaucaacaggggaagaauacaguagaaagcaaagaaagaagggagauagaggagcgggagaaagagaaacaagaagucagacagagggggaaaacaaggaaagagacagaaacagguggggaagagacaaaaggaaaguugaagagaagcagcagagagggaaacaggaaggcagacacagauucagcgaggauaaaggaaaagaugcaaagaugcgaagaguagaagacaaacacagggaacaaagagagacagagaaacacacagcagugaggaaguugcagauacacagguguacauauaaaggccaguacaaugccaccaaacagaaauauccccacugugacagucuuguacacauacucacccaccaaagaccccuuaccugagcuuucuugcucuugcuuagugccuaaaaggaaggguggaagagagcuaaagugaacagcaauggaccccccugugggauauggagacuacugcagcagguguuaagugagggcaauggcggguugugggauggaaauauguuuaaacacagaacuugcauaacaacuggaagcccacagaaauaacagaagaaaugagggaaguacaguuggggauggugcugccuuggcgccacagcacucaaagucucccuuucuuuuaugcucuugagggcuugaggagagggcggaaaugugucucggaauguaacccuuuauauacuggaucuccaagcuaggaaauuguggcuucaucacuccaucuguucaagcacaucaaugcgcuucccucgcaugcaacauagcgacuucuacccuuuugcuuggcagccaaggaucgugucaggcuuugcaaagaaaucaacgcccuaucaaaaacucccauuuucuaacugcuggauuuuccugaauucugcauucauucacccaaaugaguauuuuaaaaaucuauuuauucacuauuaaugugcgugucugugcacaggaguacacaugucaccacuuacacauggagauaagaggacaauuucauggagucaguucaccuuccaucuuuuuuuuuaaaugguuauuuuuguguguaugggugcaugaaguacucuuggagaccagaagagggcaucauauccccuggaacuagaguuacagccuauuugugagcugcugcguggaugcugaggauggaacucugaaagagcagccagugcucuuaaccaaugagcuccagccccuccucauccaacaaguauuuauucagcacauacucuaugcaacaucguacuacauaugaacacagagcaaugaagaaggauauaaauaaggaucuagcuucucuuuagaagccaugcuaggcucuauucuaccuuaucuugaaaggauccaaaagguagguuuggucucaugucaccagcaggaccaggacaaguggaugggguaggagcaaaaagaagcaguguacauggaagacaggaggcagacucaaggcagauuuacugauagaccugacuaauucaaaguuaaugaaugaagccacgugcgguauacaugccuauagauucagguacucaagagguugaggaaggaagccaagcugaggccaggaauuggggaccagccugagaaacacagcuagauguccuuuucaagacaaaguuaaugaaugagggcugcagauggagcacgggaguagaggcagcuuagagcuagguguggugucuuacuccuguaaucccagaacuugggaauuggagacagaagggugaggaauagaggaucaggaauucaaggccaucuucagcuacauauaagcacaaggccagccuaagcuucaagagacucugucuuguaaacaacaaaaagaucccuuuuuagccuuuuggcuaagaucaaauauggagagcuugccuaacaugcaugagauccuaggcuugaucuguagcaccgcaaaaauaaaugaauaaauaaauaaauaaauaaauaaaaacaaauaagcaauugauauuagaauaaauuaaaauaaaucaacaaauuaggcaaagccaggcaugucagcacacaucuauaaucccagcacuugggaagcugaggcaggacaaucaagaguucaaggccagucugggcuacauagcaagauccugucucaaaagaaacauacaccgaaauuaggcaagauuagguuaaaauuagccaacugaagagacuucugugaaaaaaacaaacuucgaaugacuauaagaaagcagcaugugacauuaggucugcuucaguguggguguucacugggaaugagucagauggauaggggcgaagcaagugguggguggaugggguaggcggagggagguaccuuuugagcuuuacugaacuccuuauccagguaggcgaccuucugucgaagacuggaaaguucuggugcggggaaagcagggaaucucagccucaggcgguaacaaggaacugaagggucaucuuaucaggcuucuaaaggaaaaccuuugccucaauuccccccaaaaccaccccaucuauugacacucgcuuggcucaccaacaccauucuuccgaaguucauccgaaagcugguaguuauuuguccggagcuccaggagcugagucuuuggaaggagccaagaaacaaaaauauuuaucaggaaagcauuccuacccccacaugaggcaaccaagccccuaagcccuaaagacugaacugguauccccuaagcacuuccucaguugcuccuuaagaucuuuggauacuguauucuuaaaugggcaaccaagcccugagccccagcuccaccuuguccagccccauuuagaaccacagccagccucaacccaucauuuccccacugauccauuccccaccuggaccacugaaggguauuggaauaguuaggcugcuguucauaugaguucuugugacuauacacgcagaugaaaucauccuggcugaccuccuuacacccugaacacuguccuaccuagacccgggaggccccuuuggcgaggggcggggggcuuuaaaauuccuucccaaggaaagagaaucuggucuuuuuccuucccaacuuccaugagucaggggauguugcucaagguccuguggaacugccaagguuuucaaaacaagucaguguccccuuaaguauagaauuaagaggaagugcagcacaggccacuucacacaauacauguauauccaccagccuuggagagcccuaaaucugauucuucccagaaccacccacuguccacuaccccugguuuuaugucccucucaaaguaccagcuccaccuuucucagcacacugguuugcuccagaucagaucagaaggcuuagcuacuauaggaucuuucuuauucuguucucuucaggaccccaauagcauuucuccuaaucuuuggccaacuggaauaccuuucuauucaccuugaagucccucuccaaagcccaauaguaucuccuuacacauggcucaaauaggauaaacguuccuugcucaaguaucuaucuauccacuuuuuacaagaugucuucaaugggggugacauuaugucuguccuucaggaucucucaaaugcccuugggcgggccaguugaacuaguuuuauucagaaucuucugcaauuuccagugguccuccccauuuaugguccaaugagcucacucuuacaucuucagugucccucaagcagacuaacuagcucccaggccaaucgaauauuucugcucccucaaguguucugcccccaaccuauaggacucuaagguuuccccauuucagucuuucccacuaaggcucccucacuaaguguccauucauuaugcagugcuucuauucccucucgagaugccuggaaaaggaucaacaagucagaggaccaggucagacuacucccccaaacccagugauguccccuucccugaacucccaaaguaucaguuuauaaauauccuccggcccuuccucuaaucugaguuaaugguauuaccuacucagaaugcucaucacccugggucuaaaggaaucaucccaauccaugcaauuaugccaaccccuccucuuaggaucuucuagcaucaauggcacaacaacucuagggaagagauccacggucuuucccuacuccccuggcuuaguaguauugguaucucccacaaacuuuccaccucccaguaguucauggucuuguccugucaaauaaccagaggcuuccccccuccccaugacgcaaaugccugcuucuuuucucucccgaccaaauaauuucuccucagaaucuccauccuuuaaagucuaacaucaucaccauuuaaugguaugcccuacacauggacccaaagaucccaucccgauuccggacugagaaagguaucgccuaaagacguucuacauuccuuuugaaaagcuaaaagaauccaaccuucagaacccacauagaaucuucgaaaucacuaagaucgccacucagagccucgguuucccuucuccagaccacccccuuauacuuaagacccauuccaaccaaaucuucagaaccgauggcuggucuugucucuaccccgcccccagucuacuagacggguggucuuccccacauccagcggcaccugcauccguugaaacuccucuucagacagagcuugcgccauguuccuccccccaucccccgcaagcuuugugcgcagccgcagcuucugcggccugucagugcuaaggucggagcgaaccacugaccaguaauuggaggggaagaaaccuaauucaaauguucagcauuuuagagauggaaagaagagaaugaugcucaaaggucagacaaauuuuacuuugauuuuuacagaauuguaaauugucuguuauggcuuuugagcauuuauagauuacucauugcuaugcgacauuaugguauccc

SEQ ID NO: 9370 - RNA, 1601 nt, Mus musculus
gaugacacgacugaggcccaaccagcucuguaaggaggcggaguuuccccagggucccucucaagcuguccuaggggagggggcucugggagccacguggccccucccugccucucgcuucaucucccgacaagcuccagaggggcggggagagaacgcuggaggaggaggaacuccggcagcucugcagagggggccaggagcuccgguauuugguacccccagccccaacgcuguugcugcugcugcagcggggacacaggugaggacagcccuguggggcgagggagggacccaucaauagcucuguccuugucuuuuccugguccaguccccaugcccuaguccauccuggaacaguccccaggggucccacuggaccuuguccuucuagagccuccuuccaaggacccagaagccuccucccccugucucccaccccgcccccgcuugugccaccuuucccuccuaggccuggcuguggcugcucucuuccuccuccuccuccuccugcugcuacugcugcuguuauugcugcugcucccacugcugcuacugcuguggcugggcacacacagccaguuccucgguguguguuuaccucagaccugcgcucaacgaacggugggacccagccuucuccuggucuucucuaccagcauccugcaagguucagccgccccucucccggaagacacacccaacuuucuuccaauaccccgcccccucuccaaccuauuuugagggaauccccuccucuuagcagucuuuugaguuucccuugugugcuuagggggcuauauccaacuugaguacacuugaguaucagcccuuugggguuccccagacuccccguucucauccagagcucuucagauauggaccaggcuuccuaagcuccuccagguaaccucucgccggcuucuuaaaaauaagccagucccauauagcacuuuagcgauccugagcccuaauccucacgucuccuaccuucccuagaacuccuguagauuguaguuaauacccuccaggcucuccuugguagugccagucacuccugagauacuuuuuagcaucuuuuacaaccuccuggcucuagagcuacccuugagaugcuccaguccccuuuugugaucuacaagggggcuccaacccagggaucauuuccuguaagucuucuggguguggacagcccucccuucagccuuuuccaaacagcucugguuccaucuccaccgcucugaaugccccuaccugucuccucuccaacccaacugagggauugcaggccguccuuuacugagaacucuugagagugcacaacucccaaccuaguucuuggucccucuggacacccucagacaacucucaggaauguguugcguccucuagaaucaucucagacuuucuagaccugaggauccuucuugguuccucuggcucgucaaagccuucucagucccuuagaaagcucccccaagcccccuaaguuccugucugucucucuaguuccuccuccugguuccucuuggucuuuccuuucucucucucucccccuccccauacacacacacacacacacacacacacacacacacacu

SEQ ID NO: 9371 - RNA, 1601 nt, Mus musculus
aguguguguguguguguguguguguguguguguguguauggggagggggagagagagagaaaggaaagaccaagaggaaccaggaggaggaacuagagagacagacaggaacuuagggggcuugggggagcuuucuaagggacugagaaggcuuugacgagccagaggaaccaagaaggauccucaggucuagaaagucugagaugauucuagaggacgcaacacauuccugagaguugucugaggguguccagagggaccaagaacuagguugggaguugugcacucucaagaguucucaguaaaggacggccugcaaucccucaguuggguuggagaggagacagguaggggcauucagagcgguggagauggaaccagagcuguuuggaaaaggcugaagggagggcuguccacacccagaagacuuacaggaaaugaucccuggguuggagcccccuuguagaucacaaaaggggacuggagcaucucaaggguagcucuagagccaggagguuguaaaagaugcuaaaaaguaucucaggagugacuggcacuaccaaggagagccuggaggguauuaacuacaaucuacaggaguucuagggaagguaggagacgugaggauuagggcucaggaucgcuaaagugcuauaugggacuggcuuauuuuuaagaagccggcgagagguuaccuggaggagcuuaggaagccugguccauaucugaagagcucuggaugagaacggggagucuggggaaccccaaagggcugauacucaaguguacucaaguuggauauagcccccuaagcacacaagggaaacucaaaagacugcuaagaggaggggauucccucaaaauagguuggagagggggcgggguauuggaagaaaguugggugugucuuccgggagaggggcggcugaaccuugcaggaugcugguagagaagaccaggagaaggcugggucccaccguucguugagcgcaggucugagguaaacacacaccgaggaacuggcugugugugcccagccacagcaguagcagcagugggagcagcagcaauaacagcagcaguagcagcaggaggaggaggaggaggaagagagcagccacagccaggccuaggagggaaagguggcacaagcgggggcggggugggagacagggggaggaggcuucuggguccuuggaaggaggcucuagaaggacaagguccagugggaccccuggggacuguuccaggauggacuagggcauggggacuggaccaggaaaagacaaggacagagcuauugaugggucccucccucgccccacagggcuguccucaccuguguccccgcugcagcagcagcaacagcguuggggcuggggguaccaaauaccggagcuccuggcccccucugcagagcugccggaguuccuccuccuccagcguucucuccccgccccucuggagcuugucgggagaugaagcgagaggcagggaggggccacguggcucccagagcccccuccccuaggacagcuugagagggacccuggggaaacuccgccuccuuacagagcugguugggccucagucgugucauc

SEQ ID NO: 9372 - RNA, 4753 nt, Mus musculus
gauauguuccacaaaaaaagcuuuuauuaaacaacaagggcuuguuguuuacaaacaacacuaaaggggccgggaguguagcucacugguggaauaauaaugcagcacauagaagccauggcuccugucccagagccacaaggaagaaacacagaaacgcaaacugccaaagcuacagggaacaaggggucagucaguccugcuguuugguucgggaggcuucugcauuggcgcggagcacagcgcccggggaaggguaagggcgcugcuggaagaggggcccagcugccguggugucagcaccugucuuggccucguuccucuuggggaguccuguugaccaugugccccuggggacaagagagaauuagaguacaggaagaggguggaguggccagguguugguggcgcacgccuuuaaucccagcacucaggaggcagaggcagguggauuucugaguucgaggccagccuggucuucagagugaguuccaggacagccagggcuauacagagaaacccuaucucgaaaaaacaaaaaacaaaaaaacaaaaaaaaagaggguggagugggccucccuuaauugcccaagauuaaagcaugguggcaauccugaacaaaaaagacugccaaaggcuucacuuaccggggugcaucugaguaugagcugggguccauggggucuaauucuucaucuuugcggcucgucgcuauagaaauaaauagcaggauaaguucuuuacuugagaccaaggagccccuccucacaggaaaaaguaauaccagugauucacauggcccacagcacccuucagaagacuaggcaugaacuagacauucugugcccugguaccucauuugacucauguaagucccaaacucaugugcuuaccuuucuuucuuucucuuuauuuuuuuuuuuuuuuuuuuuuuuugguuucugagacaggguuucucuguguagcccuggcuguccuggaacucacucuguagaccaggcuggccucgaacucagaaauccaccucccucugccucccaagagcugggauuaaaggcaugcaccaccucguccggcugugcuuaccuuucuuguucuugggguaaggagccaguuccucucugcgaugguggcgucggucuuugcccucuucccggucugccuugucaaaugcccgcucucguucccugucccgaucucucucucuauccacuuugucguaguugcgcucucguucucugucauucuucucgugguuucggucugccuucucguggcuccugucuggcuucucaugacuacgaucugacuucucaugauuucuguccaccuuuucaagauuccgguccgacuuguccucagcaucuaugguaacacacaaauccugaagccucucucuuacacauauggucucucuucagccucucuccgagacugcaagaaucacuaaagcaucccugcaucugccaacucaccugcauuauuguuccugacuuucuuggcggauuugguaacgacaaaguuaggaucauguggugagagccacgacacaaggucugucuccacauuccaauaguaagggaguccgcugugggcagugagagggagggagugucagcucagaugucccuuauaccaccugucaccucaaccugcguccagaucugcuucauggucccacaugcacaucucgucccucucgacccacaguaagagagaacacaggaagggcaaggccaccauguuguccaugaaguccaucccaccauguugguaggcucaccaagaagggucaaacaccuuguaccagcucgguggcagacccucuauccggguggccucauagucaacaggaucaucaucguagucuucagcaauaaucucuuccucuggcucuggaagaauggggaaggagaaaagcaguugaauuacccgauagugaugguguguguguggggguucuccuccuauucucaggcauggagacaugacugaccacucacaucuacaccaccaugcagggaagacagaaguacaugcucagcguugauaaucuucaaaaauuugauauccaaucaauuccugaguucagauaccauguggcauuguauuaucccaacguauuucaaugaaauggcuuggaacaguagggggguugccuaaaauaauggcuaaucuauccauauccugaacuucaauggguuucuggcucaugaauauuggauaacaaggaauugauguaaacauugcuuugacucuauuccuaggggcggauauacagcaagcuugcagcagacaucuagugauaguagaauaaagauggugucucuuaucagcccagugccuggccaucaguaagcacauaacagauuuaagcucuggguauaauuaacaauaaaaugcaugugccuacaacaucauagugacaccaaaagagaugucagguaugauuguccauauugcuaauaaacacuaucagcagugggcucaguacucaaaaagauuuaaaagaaacacuaaugauaugggguuugccugaagcccuggauucauauccuaacacccccaagaaaacaaauaucaguggucauuauuaguacuguuaggcacaaagucuaugucuggcacaaaguagucuuguaauagaugucaguuguccauacaauaauaugauguacuuuuccagugccuagcacaccauauaggucaaaacucaugccccacuuuauuacuauuggcaauaauguauaauuagcaccuaguaauacaguaaaucuuauuaagagaucaucuuuuuuuuaaagauuuauuuauuuauuuauuauauguaaguacacuguagcugucuucagacacuccagaagaggacaucagaucucauuacagaugguugugagccaccaugugauugcugagauuugaacucaggaccuucagaagagcagucagugcucuuaacugcugagccaucucuccagcccccagaucaucuuuuuugacuguuagcauaucauacgugccaggcacuuaggcagccuuaaauaaauguuaaugguuauggugcccaucacccaaguaccucugcugagguaaacauagagcaucagcauccugucacuguauuuggcacauaggagacugcaggauagaucagaugccuuuuuggacccuuaauccuagcauuaggaaagcggagacaggcagaucuugaugaaugcaaagccagccugauauacagaaugggucccaggccugccagaaguacagaaugagaccaugucucaaacauuaauuaguuaaauaccaugcagucauggguuuauuuuacuuauuuucugauacacacacauauauauacacauauauacauguguacauacacacacagacacauguauaucuggccuagaauucaguauguaaaccaggcugucuccugugaucccuuuuaccugccccagccaugcuggggacuacagaugaaugccaccauacuuaugucuauuuguuuuuuauuuuuugaagacugggucuugccaaauugccaugucuggccuugaccuccuggacucaagccauguuuguagcucagccuccuuaguaccugagauauuuguaccugccaccguguccacuugauucaugacuuaaauuaaagcuaucccuccagccuuacacuucacacagcacccaccaaccacgaagaaguaaugaauaucagaaaaaauuauauugacaacgagaugccugccaggccaugcaagauaccaaguaucaaaaccaaggugccagucaaggagauauacuucaauagagcgcauccaagagcucuggucuaaccccagcaguacaagggggcgggggaagaugcacacuaggacggcagaagauggcagagcacuuacuuagcaaacaccuagguucgacaggggcgggagggggcggagaaaagggggaauaaagaauagaauaaacagcagaacgucuauuaacacuggcacaugauagaugcaucugcuuuuaguuuucucacccggcuccagauguuugaggaugccccucuucgccaagcgggucugcagcgcaacaggaagcggcauaguggguagcugaccagaccuagaaacagacaagacaguacugaagggcagaucugauuaacauuucaaucuggauagccaguaaccacgcguguguucacacacacacacacacacacacacacacacacacacacacacacacacacacaccuacguaacugcaacaguagcuggaagagaacaaaaaugcgugcuaaaagauaaaagagauauguagcaauauggccagaauuaggaucagcagaacucuccggacccaggcacuggagaccggauggaccaaagacccaguuccucucuagaccaaggcuccacccaucacccaagggaccaagugccacacacccgcaacccagaaaugggaucacccaacguuccucaaaguccgcacggugggcggaaccaaggcgcuaggaugggggagauacaaugccaacgccaucuccagcuuuaaaagaaagcuuacaccccagccuuaccaguacaacugugcgauuagucaaagucuaucuccuuacccuccucucccucauuggcacagugcuuaccaacaccgaagggcucuugguuuaaagcacaacaggcuccucgacucuccccaggugcaauuaacuggucgcauccgacgcuuacauggaacggauguggcc

SEQ ID NO: 9373 - RNA, 8319 nt, Mus musculus
cuuggucuacguacagcgccucagagcuugugggcguuucggagcgggagggggacggggggagugucucgcccgcgccaccgacugcgccaggccggacucuggcgccauggaggaguacgcucgcgaaccuugguacggcgaugggcacaggcuucgggacaguccgcgcgacgcucaggcggacaacgggaggcgggcggggaaggcaggggcugcagugucaagucccugacccgggaggcucggaaacuucacugccucugcgcauccggcauggccccucccacucggacuucgucaaaaaaccgccaccguggagugucccaguaugugcggugugggacaaacuaucgcacuguugcccuggcucuucuccuagacccccuuugugagccaaaagagaaacgcugggcagauccauuccggcggugagggaggagaggcguggagccaauauccacaggguuucuucgugucgcuuuucucaggcuggcuuuugacauaggauagggcaugugugaacucacugugggcuaagccagauggcaccuggcuuuuccgcacggucuuuugauuuguccgauuuagguuuuaaaaggacacaaggguuucucuggacgugcuuuuugugucgaaccgagugucagucacccuguuuauauuuuacuuaaauaacguuugcuaguuaacacuauugaagccugacacgacaacuccccccccccccucccagacacgguuacucugugguguagcccuggcuguccuggaacucacucuguagucuugaacuaagaaauccuccugccucugccccccaaguucugggauuaaaggcgugaaccaccccugccaggcacaugacaacucuuacugauuuuugauaguaacaaaaaccauuuuguuuuuggcuccugguucuaggauuugagggacucuguucuucaaaucuaguuucacguagaacucucugagaauacuguauugucagaaacagucauaggggcucagugguagaguaguugauuuaagcaagagacagauugugggggacaggggaccuagauuccaaagccauuugauuuuugauaaugacaaaaacaguuguauugacgcuugcuuguaaucaagagcacugcucugccaguaguaaacccaucguugcaaggcuauguggugagacaccucccccaucccaaauuguuuucucacuuuuguaccacagauagauuuacaaaccuuuucuuuugggguuuguuuguuuugagacaguaucucacuauagaacccuggcuggccucgaacugacuagacuaggcugaccucugaccucagagugcugguauuaaaaggcacaaacuuucuuugugggacagggucuccauuuagagcccaaguuggacugccaacuugugauccuccugucucagccuuccaaguguugaucacaggugugcagaaacacaucugguuuuccuuucuggcuuucuggggaauauaaaaagugucagaacuaauuuguugucaucuaagguguucugcaucaguccugagcuucccuguuugguucuccaagcagggcagggucucacauuaacccaaucuuuuccuuccugcuugcagcccauggcgaauuguggaugauugcgguggagcuuucaccaugggugucauuggugguggagucuuccaggcuaucaagggcuuccgcaaugccccuguugugaguugggccuuccuccaguggugugggaaucugcggucuugcugacauaggaguacugcucugagcauacugaacauucuguugauuguucaccuacuguguguugggccuggcuucuggauuuaggguuugagggauucuguucuucaacuauccagcuagaacucuggaaauacuguacugucagaaacagucuuaggggcuagaaguauuuagcucagugguagaacaguugauuuaagcaaguggguggguguguauguguguguggggugcccacaguuccauccuuagaauuagaauaaaaagaaaaggguuagcaucaaauuuucaauguguauacaccguagauuuuaccacaagacagucuuugggauaaaauucuauauggaugguggugccacacaccuuuaaucccagcccuugggagguaaaggcagucagaucugugaguugaggccagaucuggucuacagagugaauuuugggacaaccagggcuacacagaaaaacccugucucccccacccccccucaaaaaauccucuauacaggaaaaugacaggaguugggcagaaagaaccuuuuuuuuuucuuuuucuuuuucuuuuuuuuuuuuuuuuuuuuuuuuuuggauuuuuugagacaggguuucucuguauagcccugguuguccuggaacucacccuguagaccaggcugccggccucaaacucagaaaucugccagccucuaccucccaagugcugggauuaaaggcguacgucaccacugccuggcagaaagaaccuuuaaguugaaggagagaguaauauaauaccuuuccuuugagccccaccccuugaagauagaaggcucauuggauuugguagcaagcaugaggcaugcuuacuaugccucuaacagugguggaggugauggaacacaagacaggcauauauaucccuagagcuugcuggccagucagccuagcuagaaguugguucagugagauacucugacuuccacauguucacacaccugcacggucauguguauauuccacacagacacacacaaaccguuuuccgcagcacagguuggcacacaacuucaaauccuccugucccggcuuuccaaguacuagcauuccaggcaucuggcagcauaccugguucuguagccuuucugucuugcucggagucguccucagcuccuagaacucuccuuccugcaccuuuguccauaguucucauuuuugggaaucuucgcacguauugcgcccucuucuuuuuuucuucugcacuaaggaauggagucugguaccuccaucuucccauccugcaugcuaagaauauugccgagcugcagccucagccuccuucacagguuccucuaaugcagguucacuuugcuccuugcucacugucacucuuccuagggcgguuguucuuuuuuugguauuucgagacaggguuucucuguauagcccuggcuguccuggaacucacuuuguagaccaggcuggccuugaacucagaaauccaucugccucugccucccgagugcugggauuaaaggcguugccaccacguccagcagggcggugguucuuaaccuucauuuuuucuuucauuuauuuauuuaacuauuuauuuguguuuuccuauucacuuuacauccugcucacugcacuaccgauauccccccaccaccaccaaccuccgcaguucuggcacaucaaaugucuaugaggcuagguacuucucucccacuaaggccagagaaggcagcccagcuaguagaacauaucccacagacaggcaacagcuuuugggauagccccagcccuauuuuuugaagcaugauuucucuguguaucccuggcugucguggaacugccucuguagaccaggcuggccucaaauucacagagguccaccugcuucugccuccugagugcugggauugaaggcaugcgccaccccaggucucaaccuaauuaaaggguccaaguuuugugacccuuuaauacaguuagauccucauguaguggugacccucaaccauaaaauuucauugcuacuacauaaaaguucauguaauuuugcuacuguuaugaaucacaauguaaauaucuguguuuacaaugucauggucuugggugacccccguggaaggggguccaccaaaagggagucagaacccgugaguagaaaagcgcugcucuagauugcauuuugcugccugaagcuaucuuacuugccacuacuguguacacacucugagaccccugcauauaggauguaaccuggcaugugugccugcucauuguauauugagugagugaaugagugaagaaaugaaacugagcaaccucacucugagaauaucucuguuggauuuucucuccauccuccugguucuuuggcugcugcucugcaucuaguagcuuucccaugccuucuuuguugcagugcugggcauagacgaacccugagccuugcucauuauggacacaugcucuaccacugaggaccccagcaccccuuccuuuuuauaaagccugcaacccugccugccagugagugcucuuaccccuccucuaacaccucuccuugcuuucuccagggaauucgacaccgguucagagguagugucaaugcugugaggauccgggcaccccagauuggaggugagaucguggaaccauaaagauguguuaggaacuuuaaggguaauugauccuuugaaacuagacuguaaguuauagguccagauucuaacucaaagucugacugcaacuuccccacagucuaauaugaaagggcacgaauacguauugcgguugauuuguuuuugagacagggucucucuguauagccuuggcuguccuggaacucacucuguagaccaggcuacccucacagagauucuccuaccccuuucucuacuucuuccuucuaaguccugggauuaaaggggugcacucccaagccugggggcuucugcaguuuaaguccagauccuggcucuucucuguuaggggaccugaugcuaguagcaguccuccuccaaaccucaucugauaauugaccacccaauuggcagggguuuguugguuuguuuuuugguuuuugguuuuucgagacaggguuucucuguauagccuuggcuguccuggaacucacuuuguagaccaggcuggccucgaacucagaaauccgccugccucuaccucccgagugcugggauuaaaggcaugcaccaccacgcccggcuccaaagugguuuuuuuaaacacuauaaacauaugcaauuguuuccuguauuauaguagagauggauugagcaugcuagacaaguacucugucacuaugacagauuccuaacacugaauauuucauuuuuuauuaagagauggaaucuugagacugggaauguaguuuaguuuguagaguacuuaccuagcagcacaaagcccuggguucacugcauaaagucuggguaugauggugcccacauguaaucuuggcauuuuagcaauggaggccgaugaaucagaacuucaagguuauccuugacuacauagccaguuugagugcagccuugacuuaaucagauagugucucaaaaaagagggagagaugggggugucgggacgugguaaagcaguuaacuaaccugugaaacccugagguccaacgcuaccaccaagaaaacaaagcuaccugcuguagcuccuccaccucccauguagcuggggcuaccggugccuaccaccacaccagcuaguuuuauagcaacauguuugguucucuugcauuuuuuuacuguuucauguuauaugaggucagcuauggaacuguuucugguaucgugacaugcucaaagaguuguauguagcuuuugaagccuuuuggauuucuagauuaugacuguuuaauaauauauauuguguucuggcuuucugcccucuuuuccuucucccugaaaucaaaaccagaauuccaacuccacaugguauuuacagggugaaaguugcugcauugaaagcugugugaacacgccuuuaaucccaguacuugagaggcagagacagguggauuucucaguuugaguccagccuagucuauagagugaguuccaggacagccauggcuacacagagaaacuauguuuugaacugcccccucccaaagaaagcuguaugagagguuaaugugcauguguccauuucccaaauaaaagugaaaggauuaaccgggcgugguggcgcacgccuuuaaucccagcacuugggaaguagaggcagguggauuucugaguucgaggccagccuggucuacagagugaguuccaggacagccagggcuacacagagaaacccugacucgaaaaaccaaaaaaaaaaaaaaaagggaaaggauugcugggugguggugugguggcggaugccuuuaaucccagcacucaggaagcagaggcaggcggauuucugaguucgaggccagccuggucuacagagugaguuccaggacagccagggcuauacagagaaacccugucucaaaaaaccaaaaaaaaaaaaaaaaaaagagagagagagaaaaaaaaaagugaaaggauuuugaugauaauaacuacagccccaaucagauguggaaccuuucacagugagaaagauggacuauaccuaguucuauagcuggacuuucuuccuucuuguauuuggugcuaagguugugccccauggccuccuguuuuugagacagccuccacuguauaggugucuaagccuuugcgguccuccuaccugagcuucccaggugcuggcaucauacuauauccuggucauauuuauuuguuuaguggggggaggggaucacccuaugcaagcaucuaccacagagccacaucuccggucccagcacucuuucuuggccagucuucaggccuuggaaguuuccagauguugagcuacguggagucucagauugugugauucagacucuuauuuccccuacaggaagcuuugcaguguggggaggucuguucuccaccaucgacuguggccugguccggcuacggggcaaagaagaccccuggaauuccaucagcaguggagcguugacuggagcugugcuggcugcgcgcagugagugccgccagccucucaccccaguccuugcccuguccugccugcccuuccucagcugugugucuuuccgccucccaggugguccgcuggccauggugggcucugcgaugaugggaggcauccuguuggcccucauugaggguguuggcauccuucucacccgcuauacugcccagcaguuccgaaauggugagaacuuggugggcggugggcagggagagucaggaagcacugucaacccucuccaugcuuccucgccucauuaccucauucucccuucuccagcacccccauucuuggaggaccccagccagcuaaccccgaaagagggaucuccggccccagguuaucccaacuaccagcaguaccacugaggaagccgcugccugacccccgccaccgugggagccacuccucaguucccucccggaugaucuaccuccaagggaggacuggcuccuacauagcccugagaggccuucacagagggccucaauucuacucucugguuuugugguagggguggggacaccccagcagccuugucauauggguucccuuuuugugucuuagggcaucccagcuucauacguguaacaauucucucacccccagagcccucguguggcacccugaugaauguuuaaagccaguuuugaaaugucuguguaugucugccuucagucacccagauggcccucucucuccucagaaggggcuuggaaagucuagggcuugagauuucauggugaauggguuugaaggguuuugaugguuuuuguuuuguuuuguuuuuuguauugggaagugggagaaagaagcagggucucagcugggcaugguggcacacaccuguaaucccagcacuugggaggcagagacaggcagauuucugaguucaaggccagccuggucuacagagugagcuccaggacagccagggcuacacagagaaacccugucucaaaaacaaaaaacaaaaaaaaagaagaagcagggugucacuguguugucuaaacugaacuugaacuuguaugauacuaccacacccaaccucuaguaaagguuuacaaaaugaaugagcaagggagggaauagucaaaaagaugaauuagacacaugcauaaacgugguuaggugccuagacaugcuucgugcacgcaggaaagaaggacaaggauugcugggagcauguguaugcugugcaaacauacugcagacccuccugguacaggcuccccguggagagcaugggaaaccaggcgcgugagaaaagccuuugcccugggcgugguagugcacacuuuaauccagcccagagcagcacagaggccgaagcggagacacacagaucucugugagcugaaggacagccuagucuacagagcuuaucccaggacagccacggcuguuacucagagaacccugucuugaaaaacaaaagcaaacca

SEQ ID NO: 9374 - RNA, 844 nt, Mus musculus
cuccaaaaacaaaacaaaucuucaauucuggcacuugggagacaaaaggaugaggauuuugaagucagucuagacaauaauacugagaccuuauuuuuauuuuguuuuuguuuuuuuuuuuuuguuuuaaagauuuauuauuauauguaaguacacuguagcugucuuuagacacaccagaggagugcgucagaucucauuaugggugguugugagccaccauguggucgcugggauuugaacucaggaccuuuggaagagcagucaguguucuuacccgcugagccaucucuccagcccgagaccuuauuuuuaaaaacaaacaaacaaauaaaaagaaaaccacugguuccccauagcaguuaggaaucuaaggcaggaagaucaguucacaggacaagccacuguuauauagcaaguuggaggccagccugggcuacuugauacaagugagacccugucuugaaagacaaacagcaagcaagguguggaagcauaccccuuuaaucccagcacuuauccacagcccauucgcaccgcaacagucacaguggaaauuucuaugccucuauaugcaacuggaccccaagagacaagaguuaucccauccacuuaaggguuuacacaugucagaaccugggagcaguccaucuggauaacagagaaggcaggcagaccucugaguucgaggccacccuggccuacagagugaauuccaggacaggcagggcuaaaaagugagagccugucucaagaaagaaacagcagaagauaaaaugaaguggauagggaugaagagaagaucugaguggagguagagaagggaaagauacuaucaaaauau

SEQ ID NO: 9375 - RNA, 4334 nt, Mus musculus
aguauaaaggaagcuuugaauccugagaacauuuauuuaauuuugcauagaguuucauaaaacacagucaaugagggaugucccauguuaccacguaacuucucaccaaaugacaauaaaaagaugucugugguaacuuggucggagagggaaaucuuauuacaagagaauugucaccuugacaugagacaagggucaauuugcuagacaaagaucuucaggcuacagagcagccacagcuacacacggcuuucuggugucgggucuucuugcuugauucggccacagccuccugggcccucugaaucucauggacaagcagggcaaaggcuuccuccacaccuugccgcgucuuggcugaggucuucaccaagggggcccccaacuugugagcaaggagggcugcggcagcaugagcaucuccagcaguggucaccaggucacacuuguugcccacuaguaccagaggcugcuuguggugagggguccagguggaccauaucugcugcaacugguccagagacgaggggucgucaagagcaaagacgcccagcacaccaucaccagaugccaagcacuggucacgcagagcccggugaauauccugcccagauguauccagaacauuuagaauguagccuccguugucccuggccacuuccuuccaguaggaaucuuggauaguggggucauggucuuucacgaagcauuggugagucaucuggauggugagagcacuuuuaccaacaccacuugcacccaccaccacugccuuguacucggguagcugccugccagcaucuuugcacugugcccaagccucgugacuuuccucuggagaucuggugcauggggugccggagcucagguccaagaugcuagacuuuguaggcaaagccauuccccagcagcucaaggaagagguguaaagagcaggugcugugaaggagaaaucaggugagacuggcuggaagaaaggagacuccccaggugccgcugaaucaacaugguuaaguuaaaaacucuucucuccuuacuuugguggugggggugggggguggggggauagacaagguccuaacccggaucucugccuugcuuggaacuuguccugcaggucagcugaccuuaaaguuucagcaaucccccugcuucugccuucccagagcuagaauuacaggugugugccaccaagccucgcuacccucuucuuuccuauagagcuagagggcaguuuuuccuuugacaagccuagcgaucaaacccccagucucuaguguuaagcuacuucuucagcaccaagcagggcuauuuuuuuucacgcaugcuuuuuaaaugacaaauaacuguuaggguuuuuguuuuguuuuguuuuuuuugagacaggguuucucuguauagcccuggcuguucuggaacucacucuguagaccaggcuggccucgaacucagaaauccgccugccucugccucccaagugcugggguuaaaggcgugcaccaccaacugcccggcuugucaaauaacuucuaaauugcauuuauuuugcauaggggaggguuagguuuggguugaugagggcaacuuaacccuuccagggguggggugguguaagcgugccauagcauuuguauguaggucaaaggacaagcuaugggaguaggggagucggguuugguggcaaacaccuuuaucucugaaccaucuugccuguccugggauuuuucaagugcucccauugauaugaacaugaauccuaugaaguccacccuuuuaggaugugugauucggugaacuguggauguucggcuauaguaacuaucacuauagccgaauuggaggaaguuuuuaaauuuuuaaacaucauuaucuccuggaaaaguaucucuaagucccuuagcaucuccacugcacaaggagagugagauuugguuucugaacuccaacuuggcacaguagcgccugucuggugauuggcugcuuggaacuuucccacccaagggguuuauguccuaaaagaauuacguagaaagauaauagaucaaggcugaagaugcaugcauggagcccugaguucgacucucagcgccucaaaaacagcaggguagcucacaucuauaguuccaggauucaagucagggaggaaagaucagaaguucaaggucacccuugguuauguaacaaguuggaagccagauccuaucucaaaggggggggaaaaggcaaaacaaaucagacagucuaguaaccaccucuuccgagcagggacauggagauacacaaaagguaaagcaagacuggaggugugggguuuaucuagaccgcuucucuagccugcauggaguuccgguuucaauccuuagucugacuuaacaucaggcauggggccagcaagauggcucaguggguaauaaugauaaagauacgaaauaaauuaaaauauuaaauauaauaaugauaauaacgauuauaauaaccuaaguucuuuugcuaaguuccaaggucaugcacagguuuauuccagcagagguaggugaaucucuguggguugcaggccagccagggcuacauacugagagagaccuuuacuaaaaaaaaaaaaaaaaaaaaaaaccaaaaaaacccaacaauagcaacuaaaaccucaaaacaacccugcccccaacaaaacuagucgcaacugcugugaaccgaucgcuuuguucuacauuuuauguucuauuccacacucuauaaucucacauuguuuggcaccagauaacaaguucucaaaauuggguauuuuauuauuuaaucuuagcuaacuuucuaaaaacucucccuguaugcagcccagaacaaaacagacucaacuccagaggccuucaagagagauucugguugaaaagagagacaauaaauaugauaaguaagcaaauuaucuugcauaguagaagaggguucggcacacagcaggugcucaauuuguguuagcuauuacuagcaagucauuaacucacugaaugcaccuccauauccuguuuucacuagaaaagggaaggggcucggagggaggagccgcaguucaggggcagguaguggguuccaggggucccgaggagauucggcaguguuuuggauagugaggcguggcggggguugggggaaggucucagguggagggauccucugaaagggccuccgagagugcuugcccgcacaagggugaggagagaagcggccagagaauagaacuuuggaguaccucagaguuuggggacaucgacagggaagagucuguggaggcucgaucagagaaagaacugggaugaccucagugaggaggccccggguagugaaagaauccaagggcgggucgaggguggcaguagagccggugaaaaggagagagaggucagauuccgauauacucuggaagcgaacagcucccuuucaagaucgaaaggacucuuaaauuugggaggagagcagcagcaaaucuggggaaugcuaugaugggagguggggauaaauauaagaaggucgccucccuaggguacuggcgguuaaggagaggcugagugaguccucgguauggccacacuaaaccgggaccggcuucaggcgggcaugguacagacaccacaaaaggcaccucagcuuucugcucgaguuacagaaccccuauguggagcacccccaaagagcucaagggagcuugagguuuugagcggcuuugagcuuugagcagcuugaaucagucuucuggacuugcaucucugacccaggaaggcaggagcccaggaaggcacacagaagcaggcugggcacauagggucaaagagagagggaaggguacggagucgcuccaaauaagagacccuguagcuuccuugggguuagcuuggacaacucgccuggucucugugguuuuccgugucagagucagguguaaagcucgggguuggagaaggggaaggguaacccuaaccuguuccuguguuccacuucagacucaaguuagaccgguggcccuagugcuccuuccuaccucaagaaaguccgcuucccgcucagcgcuagcacucaguuaagugaaccgagugcaaggcucacuccccucaugaggcagggauggggaaggcggagccccugucccuggaaucccgcgcugagaaagaugucugaucuaaggaacgccagagcccugcuuaccugugcucccaggaguagcagucugaugaggggcaguaggcggaucugaccggacaguuggggguuaggaugcucccuacccccagaggcagcagagggcggagaugugagcuucccccucccaccugcccgaccccuga

SEQ ID NO: 9376 - RNA, 4334 nt, Mus musculus
ucaggggucgggcaggugggagggggaagcucacaucuccgcccucugcugccucuggggguagggagcauccuaacccccaacuguccggucagauccgccuacugccccucaucagacugcuacuccugggagcacagguaagcagggcucuggcguuccuuagaucagacaucuuucucagcgcgggauuccagggacaggggcuccgccuuccccaucccugccucaugaggggagugagccuugcacucgguucacuuaacugagugcuagcgcugagcgggaagcggacuuucuugagguaggaaggagcacuagggccaccggucuaacuugagucugaaguggaacacaggaacagguuaggguuacccuuccccuucuccaaccccgagcuuuacaccugacucugacacggaaaaccacagagaccaggcgaguuguccaagcuaaccccaaggaagcuacagggucucuuauuuggagcgacuccguacccuucccucucucuuugacccuaugugcccagccugcuucugugugccuuccugggcuccugccuuccugggucagagaugcaaguccagaagacugauucaagcugcucaaagcucaaagccgcucaaaaccucaagcucccuugagcucuuugggggugcuccacauagggguucuguaacucgagcagaaagcugaggugccuuuuguggugucuguaccaugcccgccugaagccggucccgguuuaguguggccauaccgaggacucacucagccucuccuuaaccgccaguacccuagggaggcgaccuucuuauauuuauccccaccucccaucauagcauuccccagauuugcugcugcucuccucccaaauuuaagaguccuuucgaucuugaaagggagcuguucgcuuccagaguauaucggaaucugaccucucucuccuuuucaccggcucuacugccacccucgacccgcccuuggauucuuucacuacccggggccuccucacugaggucaucccaguucuuucucugaucgagccuccacagacucuucccugucgauguccccaaacucugagguacuccaaaguucuauucucuggccgcuucucuccucacccuugugcgggcaagcacucucggaggcccuuucagaggaucccuccaccugagaccuucccccaacccccgccacgccucacuauccaaaacacugccgaaucuccucgggaccccuggaacccacuaccugccccugaacugcggcuccucccuccgagccccuucccuuuucuagugaaaacaggauauggaggugcauucagugaguuaaugacuugcuaguaauagcuaacacaaauugagcaccugcugugugccgaacccucuucuacuaugcaagauaauuugcuuacuuaucauauuuauugucucucuuuucaaccagaaucucucuugaaggccucuggaguugagucuguuuuguucugggcugcauacagggagaguuuuuagaaaguuagcuaagauuaaauaauaaaauacccaauuuugagaacuuguuaucuggugccaaacaaugugagauuauagaguguggaauagaacauaaaauguagaacaaagcgaucgguucacagcaguugcgacuaguuuuguugggggcaggguuguuuugagguuuuaguugcuauuguuggguuuuuuugguuuuuuuuuuuuuuuuuuuuuuuaguaaaggucucucucaguauguagcccuggcuggccugcaacccacagagauucaccuaccucugcuggaauaaaccugugcaugaccuuggaacuuagcaaaagaacuuagguuauuauaaucguuauuaucauuauuauauuuaauauuuuaauuuauuucguaucuuuaucauuauuacccacugagccaucuugcuggccccaugccugauguuaagucagacuaaggauugaaaccggaacuccaugcaggcuagagaagcggucuagauaaaccccacaccuccagucuugcuuuaccuuuuguguaucuccaugucccugcucggaagaggugguuacuagacugucugauuuguuuugccuuuuccccccccuuugagauaggaucuggcuuccaacuuguuacauaaccaagggugaccuugaacuucugaucuuuccucccugacuugaauccuggaacuauagaugugagcuacccugcuguuuuugaggcgcugagagucgaacucagggcuccaugcaugcaucuucagccuugaucuauuaucuuucuacguaauucuuuuaggacauaaaccccuugggugggaaaguuccaagcagccaaucaccagacaggcgcuacugugccaaguuggaguucagaaaccaaaucucacucuccuugugcaguggagaugcuaagggacuuagagauacuuuuccaggagauaaugauguuuaaaaauuuaaaaacuuccuccaauucggcuauagugauaguuacuauagccgaacauccacaguucaccgaaucacacauccuaaaaggguggacuucauaggauucauguucauaucaaugggagcacuugaaaaaucccaggacaggcaagaugguucagagauaaagguguuugccaccaaacccgacuccccuacucccauagcuuguccuuugaccuacauacaaaugcuauggcacgcuuacaccaccccaccccuggaaggguuaaguugcccucaucaacccaaaccuaacccuccccuaugcaaaauaaaugcaauuuagaaguuauuugacaagccgggcaguugguggugcacgccuuuaaccccagcacuugggaggcagaggcaggcggauuucugaguucgaggccagccuggucuacagagugaguuccagaacagccagggcuauacagagaaacccugucucaaaaaaaacaaaacaaaacaaaaacccuaacaguuauuugucauuuaaaaagcaugcgugaaaaaaaauagcccugcuuggugcugaagaaguagcuuaacacuagagacuggggguuugaucgcuaggcuugucaaaggaaaaacugcccucuagcucuauaggaaagaagaggguagcgaggcuugguggcacacaccuguaauucuagcucugggaaggcagaagcagggggauugcugaaacuuuaaggucagcugaccugcaggacaaguuccaagcaaggcagagauccggguuaggaccuugucuauccccccaccccccacccccaccaccaaaguaaggagagaagaguuuuuaacuuaaccauguugauucagcggcaccuggggagucuccuuucuuccagccagucucaccugauuucuccuucacagcaccugcucuuuacaccucuuccuugagcugcuggggaauggcuuugccuacaaagucuagcaucuuggaccugagcuccggcaccccaugcaccagaucuccagaggaaagucacgaggcuugggcacagugcaaagaugcuggcaggcagcuacccgaguacaaggcagugguggugggugcaagugguguugguaaaagugcucucaccauccagaugacucaccaaugcuucgugaaagaccaugaccccacuauccaagauuccuacuggaaggaaguggccagggacaacggaggcuacauucuaaauguucuggauacaucugggcaggauauucaccgggcucugcgugaccagugcuuggcaucuggugauggugugcugggcgucuuugcucuugacgaccccucgucucuggaccaguugcagcagauaugguccaccuggaccccucaccacaagcagccucugguacuagugggcaacaagugugaccuggugaccacugcuggagaugcucaugcugccgcagcccuccuugcucacaaguugggggcccccuuggugaagaccucagccaagacgcggcaagguguggaggaagccuuugcccugcuuguccaugagauucagagggcccaggaggcuguggccgaaucaagcaagaagacccgacaccagaaagccguguguagcuguggcugcucuguagccugaagaucuuugucuagcaaauugacccuugucucaugucaaggugacaauucucuuguaauaagauuucccucuccgaccaaguuaccacagacaucuuuuuauugucauuuggugagaaguuacgugguaacaugggacaucccucauugacuguguuuuaugaaacucuaugcaaaauuaaauaaauguucucaggauucaaagcuuccuuuauacu

SEQ ID NO: 9377 - RNA, 17772 nt, Mus musculus
cuucagguuuuguagcaacuccaacuuuauuaaauaugcugaccugcugccacugccccguugucuccuucaaugucauccuugugaucucagcuccuuccuagggcuacuaagcugucccucccuccuucuggguagaacagagguauuccucgagcaggcagugggcaggggcacaucaacaacugaacacuagaguccuuugaaaaggauuuguacuuaaauaagcaccuggcaaaggguauucaagauggguucaagugaggccccuuauccaagguacggacugcggugaacuaagcugcccugccuguggccucagaagggaaacaggcaguguggucugggauuuagugugaguggggcauguccuccccaaacuuguucuggugggcagcguucuucacaucuuggagauccugaggacaaaggaaggacaagguaggucaaagugaggguggcucuauuucagccagagagaggcugucaccaugguagcagcagcuuucaacuacugcuucuccuagacuacccuauacccuccugcaaauaucuauggggcagccaugcaaaauaguguucuccccuuaccaaaugguagaagggauacaggggacgggggacagggcucagugugcacggguuaagcaacuugccaggcucaccucgugguggacauaagccugacagacauaacaccagguagacaggucaacacagcugaggaccagcggguguucagaggcuucaugguggcagaccauaugggcauugacauagcgacugcaguacaccugagguuggaaagugauugucacaggucgcuuggcaccagcugaaguuugcugcugggcccaaucucuacccaauaccccucuucuguuccauaccugauagcaagucagacacacccaguucuccuggacuguuccacaggucuuacaagguugggacacaucuaggccugcugcaggaauggggcauacugccaucaaauggggacaccaggauaguggggucacagcauaaaauacauccuagagggggcagaaaaaugggguaaggaaaggauuucgucuucccguuauacaucaucugcuccucccugaaggcaggaauggccaagaagcaauagucauagcccuagcucccugaguucaccuggguauuaaaguccccaaauccuugugucagcaucaagcuguucauguccugaccuccagcggcuuccccuagcaggcccuccucagaaucaugggcuuccuggagacacagaaggaaaagauguaucugagaaagcccaguccuuagcccuucuaccuccuucccagaugugguggacuuuaccucugcuucucugcuuagcuccaaagugcugagaaccccaagcuguagggacugcugagccgugacucccugcagaggugaagccccuguggucugcuuguuuguaugcgaggcuggaggcguuggcucaguuucucccaaagccuccacagagguggucugguuagggaaguuuucaggagcagcugcugaggcccacagguccgucguggcuccucccacagucuccuuugagguagccagauccaguguaguucccuuagcagcuuguucugaggacuggcccugagcaagcacagccuuagccaucuuugauuuagccuggccuagaguagacucuuucccagguagugcugcuauggucuuccucacgcuuucuucaggaaccuuuccuuucgguguggucauuuccuuagcugauacaggacuggcuguugggggcaacuucuugaugacaagccuagaacuagagcauucuuccuugucuuccauuucuggaacaaugggaaagacguguaaguguggcugccgcccccuuucugaccucuuaaccccccaccccuauucuuugaguucccucaucucaggucuacuuacucaucaaccgcaaacugcgccaguauuugcgauggacuuggaugaccucacugauugaaaccagggcuccugacuguggcggucgcagcaaaguaagcugggguggugggucuccaaggagggaaugggugcaggcagccauagacucagagauagaugccaaauuguauccacccuuuguaaaggagaggaauggguuccaugacgagucaucagggaauuuggaggguuagauauccugacucuccaauuaguuccccuuugucuagggcacucaaaguccagagugcaggcuaguaccaggaacaaaugacugcaacacauuuguaagaagcgcaguagucacugugugagguggcuuugggggggaauguaaauugguggcugucacgugcaagguaacaauggcaguacagaucagaguauuaauaaaggauagcucacauuuauugcuugcuaugaaccugaccuuauuuuaaauccuuuaugcaugucaacacaguccucacaaugacagguguucaguggguacagaucugucuuuccauguccaagggccccccuggccucacaguauagaaagcacuaaucugacccauaccaaagcucaaggcagaucccaaaaggcccuguugugaccugggauaggaacaacuaguacucucucuguaugauccccuaacuugacuuucuucauacuugcuagagaccuguuuccacucauuuuacauguaaggagaccaaggcucagucagagcaggagaugacuugucugaggucccaagaguugaggaagcagugcugguauuugaaccugggccgacaaaauagucuguguuguugcuagcauuaccauggaacugauccuaggcccugcgugccauacaaguucugccacugaaugacugguucuucauugaacugguugauggucuuaaccacaacccuuagccuuccauaagcaauccugggcaaacuguaaggaggauuucuuuuucuuucuuuuuccuuuuuucaagacaggguuucucuauguagcccuggcuguccuggaacucacucuguagaccagacuggccuugaacucagaaauccaccugccucugccuccugaguacugggauuaaaggugugugcuaccacgcccggcuaggaggaugucuuguaagcccgugaguuucucugugacuuauuguccuugucuaugaaaauggcacccaagcucgcugaggguuaaguucaugucugaaagauggaacaguaggaagacaggguauuuuuacagugcacacugugacagggcauuuuuagagaccaggaaugccuccgugauuagcuagggccaucuguaggcucagaaaacacauguauaaggggagggaguacccaucccuuacagaaggucagugaauacuuugucucucuaacccauuagcagcaauuuggaagaugguggaaaccagacucaguucugccauuauuaaaugugugaucucaggcuacuuacuguuccucaacccccugauuuguuuugaugggggaaggcuuuuugaaacagggcuucauguagcccaggcuggccucaaacuugguauguagcugagggcaacccugcuccuccugccuccuccucuuccucccaagugcugggauuauaggugugugccacugcacccagcuaguugaucuugagaggaaaaugaguuaaacagacuuuaccucacagugcuauuuugucgagaaauuguagaagacagaagaaaguccagagaagcuauuuuguauauaguaagggcucagcaaagggucuaauccugcuacuauccuuauuaaaaucucauuugggagccgggcgugguggcgcacgccuuuaaucccagcacucgggaugcagaggcaggcgcauuucugaguucgaggccagccuggucuacagagugaguuccaagacagccagggcuacacagagaaacccugucucgaaaaaaaaaucucauuugggcaacuaucccagguauauucaaaggagauuuuagcaacuguccuaagugauauagccaacucuuccaaauggcccucccaccauggaagggacaucaaaagaguuaccucuagaauaagaauaauacggccaccagcaaggcccaucaguaggugggugaggugggcauaacccuccgguguuacuuggcagccccccagcggauccccuugugcagcaucaaagccagcugagaucagcaccaguucuggguuaaacugcaguaaggagagaagagaagaugcccugaggcuugaggaggcaauaagugaugggaggagcaagggcaaacgaaggcauccgaauucaagucaaaacccagaugaugugagacccaacaucuacagugaguuccaggacagcuagggcuauagggcuauaaagagaaacccugucucgaaaaaccaaagagagagagagagagagagagagagagagagagagagagagagggagggagggagggagggagggagggagggagggagggagggagggagggagggagggagagaaaccugacaucugaaaagcaggaguggaagacagggacacaaggagaaacaagacauggcaggccuggaaagagacaagaguauacccgccagaaacucaagacacugggagagaggcuggagagauggcucagcuguuaagagcgcuggcuguggaaacaggacuaggguucaauuccuagcaccuauauggcagcucacaacugucucacuccagucccaggggaucagauucccuuuucuggcuuccacagucaugaagcagacaugugguacacacacacacacacacacacacacacacacacacacacacauauaugggcaaaaaucucuugggagauacucuaaguugacagaaggcaagauauagaguuaugacauagauauggcucacagaaagaacauggagacuuggaaggcaggagauagugacaagagaaacagagacauaaccucucucucacauacaagggucaaauacgggacccacauucacaugauacaggcuuuuauacacagacuauagacaaauaaaagugucauacacuuccacucccaaccagacagguucauauugauagggcugcaaaucccaccacuuacgcuuggguuucucaugggacgauaauacacagccaccccugcacagucacaaagaugcacaguuacaaugcccacagcaggcuaucgcuugcaugcaguuacacauacacauaaaggguagccucugucgccugugcauagucacaugcaugcagauguaaaagcagagcccgauguucaggcuugcagaguuguguccucagugcauuaucacacacacacacacacacacacacacacacacacacacacacacacgccauuggcccuguccuuagcucacacacagcuaggucaccccugagucaaagcagccagcgagauucauauauagacacguggacccaguuagacgggugugggugacaaugucacuacggccuuccauauucagagucuuucuuaggcuaucacaagacagcagcauuuaaugacauacacuaucacacuuaucacacacagaaaggagaugacagccacuauauaacauuacauagacauauccauaauguauuuaaucuuaugcuucuauucuacacaauuccacaacaguaucucuuagggauacccuuacagccaugcacucagaagagcagacagaaucagaaggcacacacaugcauauauacacagagccaagacaguuguuuacguguaaaaugucacagagauaggccacucacaggcacccauauaugcauaggcagacagauacauaaggccauccccaccacccugucccaauagccaucauaggauuagucaccugguagucaaaacacacgucaaggaggcagaugugugcugccagauacagcaauguuauauaauaaccugagccuuaccucauaggcgaugggaaguaccagacgaugccaugcagccagguaaucagcaucacccaugcggggcccauuccagggcacauugacagugaagccuauaccugcaucucggccuacuuggcuacuggcacccucaucccccauggggaagaaagugccacggucauaccggugcagggacacguauaauacacugccagggagagggugggaugagaaaggggccacagcagguuagaggcuaugaacaucccugcaggaugcuucagcauccucucacaccauacucuuacccacagucccaucacucaccuagggucauccucaaauaugugcugaguuccauuaccaugaugaacaucccaauccacgauuaggauccuggggagggagauagcccuuuuuagcaccuugggacaguaaggccuaggagugggccacugcuagauuucuagggucuuuggaagcacuuguugcugggcaacaggaccauggaguuaaugagaaagcacugcuauuauucuaagaaugaagguccaaccuuggcuuccugaacuauggaccugaacaaguaauuaaggcuagggacucuucuaaugcuaggagcccaggcauggguucuguugggauaaccuguucaggaaugcuggugugauacccuggauccuaguuuauuaagcaucuagaugccauggcacuuaacacacccguccuggggcuuuuguagucaagugcugcccaguggaccuuugcuuguuucuguguaagcucccaggggugaccaugggucugccaaguaagacugaauggaaagaguagccagaucccugcaaagaucggguuuugggggucucugggggggcaggccuuaccgcagggcacguccagcaaugaucugggcauggcgagcagcuacagcuacugaguugaaaaagcagaaaccacaggcagcauuuggcuccgcgugguguccuggagggcgcacuacugcaaugccauuuagaaccuguagggaggagcagcgagacugccucuggcccucacucucuuuucaucuuucccaggcuucccuuucuccuguccgccauccacucggccauccacuccgugguuccccucccagcagacucuccuauugccucuggccuccugagugggagcagguagucccucucuauguucccaggaccucauuucuucagcuaaacuucacuagcacacagagaagacgcaccucucccgagagcacagcuuccaccaggcggcaggcagcgccuguggcaagcuuugcgcaggcaaaggugcuggggcagauguagauggagucaaaguuggcaccuucacggugcagaucccggguuuucaucuuuucuguggugcggagaugcuccacguacucagcacuggugaugcagaggaacaagagucgccagcuuguccucacauaagaacuugaaccugucuagguggcuccacccaucuuggagagcccuaggcccuacuccuggaacaucccuagaauccuacagccggccuccccccagcacggggucugaccuguggcagguaaggagcucagaguccagggcaggccgagcagguaggaugagacagcgagccgcaaggcccaccuccuccaggugacacaugaugcguaagaugcgcugaggugucucagggugaugacuaacaguguggagaagcagagccaaggguuuagugacugaggagagugacccaaacaccacccaccccagcccucugagcacacacuugucccagagguugcagugacucaucaucuucucaucauagaccagcccagugcgguucuggagcaguggccauguauccaugggcagugcaguggccucccagccaccuuccuccuccuccucuucuagcacggcuucuuccacuucaucuuccuccugggucucaacugaaaaggggguacucagaucaccuuauuuccugaaucuggaucccauuacacucuugagacaaaacauggccuggacauaaaaccuaaaauccacacagcccuucccaccgaggcaucccgggaaaacaagaggagagcuggaagaaaauagccucuaauagcucauuccaggucuagugcugaucacccccccccacgccccgccaccuaccugaucucuccaggaccucccagaaggguucaagggcuucuagagugcaguagauggaagucugggcgcuggggauggagaaaacagaaaugugacuaaagugccccucccagcaggcaguaagggcucuccuuuccccuggucccccccccaggcucaccuugcacaagguacaacacaggacuccagcauggggcaagggucuccaagaaggguguggagugaagcacugacucccuuagccagggcacggagguuauagccacccuggggaaggaguuguugggggaggcaagcagaggggaagaugcugagaagaguaacaauguucaggugcauacuaugucaagcaacaagaaaugucgauucacggaaagugauuaccauuagcacguugccuacuuacuauaagggaagcagaggcacaaagacuucaugaacugguaaagcugagccaagaacaucaguuuuaaaaauaaaucccaggcuggagagauggcucagagguuaagagcaguggcugcuuucccagaggucccgaguucaauucccagcaaccacauggugguucacaaccaucucuaaugggaucuuacacccucuucuggggugucugaagauagcuacaguguacucauagaaauagaaauaaauccuaaaaaaaaucccauuauuuuuuuuuuaaagaauuauuuacuuuaugaaguuuuuaccuccguguaauguauacauauauguauaugcaugggccucaugugugagccugugggaucuccugaacuggagucuguaagccaccaugcuagcaaucaaacccagguccucuauaagagcagcaagugcucucaacaacugagccaccccuguagccccaaggaacuccuuacauucaugaaagcucguguuuuuagugguccugagaauggaagcccuugcaguacauuagcuaaguauucuacauuuuaauucuauccccaaggccaaaaagaucugcccuucacccuucauguggccagugagauggaucggagcauaagaggccuugccagcaagccugacuucaaucccucaaaggaaucuacaccgugaaaggggagagccaaccccacaugcugucuucugaccauaugcauacugugcacacgcacacgcacgcacaccagauaaacacauacaaauauccuaagcccagcauuagguaacagugaguuacuuaccuccagggacagaaucaacuugccuccugccaaacccaugagcaaauggguuaggugggcaaauccugcuggcguggcagccaucucucccugaagggacagaagagugacauaaagcucaguguaguccccuuggucuaacaccccagagaaccugcccuaccuuggggucuccguggagggcaucaaauccagcggccaccaagaccaguugaggcugaaacugaggaaggagacauccuaugugugaacaccugcuuucagggaucaccccacagugucacucccucacccccaauagcccagaucugcgagaccuccgaggcaacuggcagcaggaugugcaggaaagcagcaauguagucagcgucccgcaugcccgucugcagacacaaaagcgggaugcaauugucagucaccuuucuugagccugugggaagguggcuaggcucacuugacaugggcagacacugaccugguuccaagguacauugaugguauauccuuggccuuggccaaaaccuauaguggaccaguuagaagccuuaagguggggccagaagcgaccauguucauaucgguggauggagaaauaaaggacacuagaggcagagaaaacaaagguugagggauugccuagcuuguguuaacccaaucccuggcauagaaaagaacaugggaacuaaagagucaaauguacgacucucaaccuacagcugcggggcuucauucuacaaguuguucuucccagcuacucaagucauucucaucagguuuccuuuuuuuaaaagaauguauuuacuuauuuuaucuauggauaugagcacacuguagcugucuucagacgaaccagaagaggccaugggaucccauuacagaugguuguggucacugggaacugaacugaggagcucuggaagaucagccagugcucuuaaccacugagcuaucucuccagcccuaucucauacauuuuucuaauucucaaucugugcucauauguuaagauacuuccuuuaugcuggagguucagucauugcagucucaacucugccucuccuggaugccaggggcguaagcccuuuucuacaucugccuccucuaaacagaccuuuucuguuucuuugcuacacauuuuuaaggugaagguucaucuuagggugacucacuuuacucuugcaauuuuaacuuuauuuuccuucucucuuuccaguucugacuuccugcucuaaauccucgguccuaagggcuagucuaggucuucucuuuuuuuuauuauuuuuuuaaauuaacuuugaauuccuuccugcuccuauuaacucuaccuccugugugcugggauuagaucacaggccacaaggccugguuuauacaacacuagagauaaaaccuagggccacaugcauucuuccaacugggcuacguccccaguucuacauggcuuuuuuuuuuuuuuuuuugcuuuuuugagacaggguuucucuguauagcccuggcuguccuggaacucacuuuguagaccagacuggccuugaacucagaaauccgccugccucugccucccaagugcugggauuaaaggcgugcgccaccaagccuggcuucuacauggcuuuuuacaaauaaguuucuuuuuaauuuuuuaaaaaauuuaugucuaugcuauuuugccucucuauaugucugcaccaugugcauggcuaguguucaggaggaaugcaaggaaauacucuacagccuuuuuuguuugcuuguucuuugagacaggguuucucuguguagggcccguuaucucaauccauagagcaggcuggccuugucacaggaauccaucugccuuggccucucaaguucugggauuaaagguauaugcuccagcaugcccaacucuuuacagaugaggggauacgugcaugcuaugguauguauauguggaggucagaagacaaccugcaggaguuucuucucucucauuccaccauguggguccuggggaucaaacucuaguugucaggcaagaacuuuaaccugcugagccaccuugccacccgacuaauuuuucagaauaguuugaaauguugucauaauugaaaaagacaaagcacuaaucugaggucccuuccagcucagggguaaauugcugaacaagcucuccaacacuaagucaaaccccacaucuuucacuucucugccugacacuggaaccuguaagguuguuugaccaugugugaaaugggaaggccacaguuuccgcuuuagagugaaauuaggagacaguagacaacaaggaaaagcauccacuuccugguuccaggacaacugaauguaaauggcuuccuagccccuguggcugggccugaugguuaagaauccaguacuuagggugagacaugggauguaccugggguccuggucgaagaugaacuguguuccuugaccauggugcacaucccaguccacgaugagaacccugugagcaggagagaggggagcucugugcagggggcuaagugaaacacagaggaacaaccuagaccacagcacccccuauuccaugcuacccacguuccgucugucacuggcuaccaaccucugaaugcggugcuucuuuugcgcauagcgggcagccacagccagaugguugaacaugcaauacccauccauaagauugugcugagcaugguguccaggaggccuaagcaggaaagggaaagcuacagguuugggagucuuccucuccagagguggacucuccuguguucccaauucuuccuagagagauucuauaagucugccagcaacugaguaacuguggcuuuugaagcuucacugcccccaagccaacacucucucaaccaaggagauuuaaacauaaccauccaaagguacccucacccauauuugcuauuguggcacaugcccgcaauacuaacacucagaaagaauuugaagcaggaggaucgauaguucaaggccugccuagaauguauagcaagcuccagucucaaaaaauaaaaaucaauuaagcuauccauaagaguaugaaagcauacucuuuaauacccagucauuuugcuacauaggcuuagcugagaccuauauaauaaaaagugcuaucuuuagaaauguaccacugguguaugcuaucaaagccugaagagaaccaaaauucccaccagcaagggggugacuagcuuaaaaguaugcuugcacaauggcaucucacacgaguguaacccauauacuguuaagagacagcuuucaaagauaaagauguccaaggguuuuuuuuuuuuuaaaugcacgguacggaaaggagugcugucaugugcuuacaaaaaggggcugaggaggacaaaggcuaucuucugcauuuuuaucaguucuaggaagucagcuguggcccaauguucugaccuuccaugggcaacaaugaaacagugaaaggcacaggcugaggcuugagaugucacgcacuguucgcugcaucugaauuucaagauguuccagauagaaaagaaauacaugucccugaagccaugaacugggauacuuauuacuuacuaacugaguaaaaccaucuguggaaggacacggaaguuacuggugacaaugagcaccuuucagggguccaucaacaaagaggagagagaauuuuauugaacccccuuuuuguaccacuugacucuucaaccacuugaagacaggguaccugaguuaacacauuucacauuuguagggcuuuuuuuuuuuuuuugagaaggugucuuagauagcccaggcucgccucaaauuuauauagcugaggcuagcccugaaccccccgagcauuccuuuaacauccaucucauaaguacugguauuacagacaugcaccuccacgcaccacuauguggaaaugcuuuuuaaaaaaauguaagaugcccaacgcuucagaguccuaccugaugacggccaugccauuccgaaucucagcccccaugagugcaucuaccagccggaggacagagccuguagccaggcaggcacaggaauaugaguucuggggaccguggaaaaccagagagaaagaguuagagagagagagaaagcauggcccuaacuauuuagcucuucauucccacagugagguuggcauggauacgguagacacccaagacuugcugccacacccugaccccacaguucucauccauaccggaugcagauacacugaaucauagguuucugccaguacucgaagcuccccuucauucauguacuggguugucuccaucagaucaauguauuccaggcuggggacacaagauagaggaaagauuuuacagcccuggucccuccgcagacagaccucgcauuaagucgggccuccauagucaaccuaggggguucagcuggggugcaggcuguagucccuuuuucuucucuagccucucccaucucuaguuauauauuuaguuccucgagacagccauuaacuugaaauucuaggccucugacuagauaguuaagaguucuguugauucucccuuuccucugcccuucucuuugcuggacucacccaccuuuuugccucuuggaacucagcucagauauucucucugcgaggcuaguuauucugugagccacauuguaccaggccucuuccuuugaguuucuagacucccccaggacucauucugaucauucuggcaaguaucugccaucaguuaacgaaccagauuauaauaacacgagcccuucacaggcuuaagaugcugucagguaccugauacacacacugacccuccugaaggacuuaagauuucuuuuucuuucgggauuggcuuuuucagacagggucucauaaacccaaguuaaaccugcuaugucgcugaggcugucuugauuuccugauucgcuugucuucaugucccaagugaugacauguaccaucauacuugucuggaacuuagggguuuguguuuuuuuuuuguuuuuguuuuuuguuuuuuguuuaaagcaauaacauauucagagaggcucagggacgugcccaaggcuggccacagagucuaugggauuccuucagucuguccugguugagccuggguauccuccuccccacccuaccaagcuccuaaguuuucaccugugaaccaacaucagcuccuccuucucagcgaaccgggccuggggaggcacaaggaaaaaaaaggggggcuagaagccaggccaggccuagguccucgcaggcccgcacccaccauccgaaggcuguggaggagucaccugaaaggacacacagcggcccaggaggcccuccaggaucaguugcucucugauggcauggagccgcucagggcuuucagggaagcugcaggaguggauggaaucacgcauacacacagauaggcaaaagugcuagggagcaugucugcucuugucccaucuccgccccucacccccauagcugcucaccccuuaccggcaacaucagccuuucuuugucauuucugaagucuuuauacuuguuuucuccgcuaccauucacgcuguuggaaccuccagucugagcugucugcuccaucaucuuuaugagaaccccucucugcuucuauacuuauucccccaacagccccuccuguauacugagccagccagugguuagaauucuacuacucaaaacccuuuuguagcuccgacuauguucccgguagaagccaaacuucucaucacaccgagaagggccuaagaaaacccgaaucuguucccaucccuauucugacucugucuuucuuaccacaccccuccucuuucaccuuguuucccugcaauguguuccuugcucuucaacgaaaccacauugucuucagcuaggccugaggacuucaacggucucucacgccuggaagucuuuucagugaugacucacggcucaguccuuuagccuccuccaacccucuguaucuuugcucaaauguuagcaauacccccuagcuauuguauuccaaagggaagcaccccuuccagucaaaccucacucucccucccaccugagcuccuccacucuaacacuggagaggucaccucuugguuacuuuugaaggcagcuuuguuuacggcuauagccucaacaaauguaccauaaagaaagccucuugacaucaugaguuaguuuuaggucgggaugggggaagacggcuacuauauuugcaaauaucaguguaaugauuaacagacaauggcagaggcuaguaaaauagcuaagaacagaugugagagagguaguggccagucaaaggcuucugugagucuccauaguugugaaaguucaaagaggaaucagucaaggguaaagacccaaggcgagagggugacuggcacacugaaagacgagaagguggccagcgugcguuaagugaccuggagcucgugaggagaggccuggcugaacaggucacaaaggccaaauccugugcaaccuuagaggccagucuaaagaaugccgacuuuaccuuaagagcaaaguucuggccuugaaguauuuuaagaaaggaaggaaacgucaucucaaauguauuuuuuaggcuuuaaugcgaaggcuggaagcaggggaccagggggaagaagucagauagcgaaucuauuuuaaagauagggccaaaaagaauaaacagauuucuuuaagaaguagagcgcaaauaagagguuuuuucagcauacaugucuccuucucaaggacggcuccugcuaguuaggcgaggacccucuaacaaucuaacgucuagccaaguguaguggcucguuugggaaaucugagcacucgagaggcuaagacaggaggcuuaucaaagguuugaggcugacauagacuacauagugaguuccaggcugccuaggcuacagagaccuggagugcccagucauuuggucuucauugaacaguuuauaccgcuguuggggguuuaaugaucucccugcacacucaccggccagcggagaagggacuuuucuauugcucacaucuaucacuaagucucggcacacaggagacucuugauaacuguuuauuggcuuaacagagaaaucuuucaagaaugauccccaucucccuaaaucaccugcuuccagacuacaggcuagaagcagcaaaaauucacucuuguuugugagaagaaaggggcacuuguggaaauguucuaguuuggggaucauuuggaggugccagccucacccaccugucaucccaaaggcaauggaagucauuuaguuguucaucaaacaccaauccaguaccaacuggcacucuugucucaggguucagauccugcaggggcaaagaaaagaaacccagauucacucuggacuacaaucagagaaaacacuucauaccaucgguccuggauggggggggggaggggggggaaucacuguuuuguuugguaaagaaggccaaguugcagccaggucucucucaccagcccuugaagccccacaacuagguccucuucagcugguuggcucagcuucuucauuuugccuuucuucuuuaccuccgcuagauuggggcuggagugggguacagcacacuucuuuccaccacgcuucugccaaucagacagaaaaaucagagucuggacauggcuggcuggcuucacccuccaccccccccccccaucagggcaggucuggggccucaccaagguggcgcuggauuccugaaggggugacuggggauugugccuacucuuucgcugucuaguagaagaaucuuggccgguggaggucauggcugaagagccucagcuccuggaaaggcucuagcaaagguguaguuggugaggcagcuggaguguccagaggaccccacaucccugucccuuccucggccccgcccccuagucuagaucgcagccuucaccggguccauucccgagccuucuaaaccgcccccaccccccaggccaucuucugcuagaggaaaccugguccuguccggucccccuggaccucgcugcuuuuauccgauucucuuuccucauuuugccuauucacuaaacgagguaaccccaggcucaaucaggcucuucuuaggccugcccuacccaaucaccgccccccccccauccacuucccacauccuuucauaccucuaaucugcgcccggaacgcuuggcuucugcaaccugcccgcuucagccuauuuccccagaaaaaucacccaccuuucuaguccgccagaccgggcugccgcggccucggcagcaccuuuaaagacucacucaacuccaccuccugcagggccgaaccagcgccuuccacucgcgcagaucucgccccgagcuuuccccgugccccgcugcuccgaggacugccccuuucgaucagaauccuucagaccccacccccuucccagacgccuaccguuuaaccaggcucccucagccccuuccaagccuccgccca

SEQ ID NO: 9378 - RNA, 18814 nt, Mus musculus
ccaugcuccacuugacacugacauuuauuuaaccaaauaccagcgcaugucuccaggugguuuuauuuuacaaaaucuuuaagggugcagggcaaggagaugguugggcuguaaaggccaguggcucuaagaggagggagaaacgggcacgguagcacaugccuguaaucccagcacucaggaacugaggcacaaggaucucaagcuggagcuuagucuggacuacauaaggaauucaaagccagccuaggcugcauagugaaacccugucucaaaacaacaacaacaaaccccacaaaacaaaacugaaaggaaggaaaaugucaggcauagcaauacaugccugaaucucaguacucgggagguagaggcaggagaaugggaaauguggggucacccuuaucuacauaguucauagcuacauagcuacagaagauccugucuccaaaaaaagggggggucuccucugccacaaggucaaggcuauucuguguaccuucaagaacugaguggggcgaucacgcuggugcugcuggugguaggugcaggaccgguggggaaggagguuguaggcgaucccagcagagguccaggaaaaggcauaagauggcugacaggcccugacaguaccacagguccuaggcccugauagaggugggcaguaccugcagugcccagugccaagccugaggccaccuccccacaauucccacuacugcugcuaccagcuaccaccaugaagccaccagcugguccuucagccgcucccgcuccagccagauucgacccccgcuucuuuuucccuuugccagaugccuugcgguuccucgucuggauuccaucuuuccucauggucagugggcgguucaccuguagaaacggagaccaccacagggguuaccagcuccagcccuuugugcugauguagcugggcuagggacagucucuuaacaccacuuuguuaagaauggggaauuaguucaauggcuagaguaauauacccagggugugcuagggaggugagaccugugcuuguguguggcccugaucucagcucagaauauccuccuacacugguaagagguagccaagacucaaaucacgggagguggcaaggaggaaagagaggacagauggaaggaggcuugagguggaagccguggaaauugggcaaggaggcgcaaguacacaacuucugagaagagaaagaggagcaaagagggaggaagcaaaggcagaggaagacagcucaagguagaugagggcuggaugaggagccgggagugugcuuggaggacaggaagcaacauggaggauagcauaccugauggagcuugaaauagaggccgcaggcauugcauaccggaucuccgcuggcauuccuccgccagaguguuguaguggucguuugacaguuagugcauugggugccugcccguuugcugacaaucugaggaauaaaaggacaggagauuagugcuggggguaggggagagguaggauucggggacagggccuuacagggccugagaaaagagcuuaagggaugagaguccuauuaaggaaaggcuuccuaucugggauaagaaguuuauucaucuauguaucuauguaucuguguauuuaucugucaagacaggcuuucacuguguagccuggcuuuccuggaauuuucucuguagaccaggcuggccuugagcucacaagagauccaccugccucugucuccaguucugggauuaaaggcaugcacuaccacugcccagcaaggaguuucuuuucuauagcuaugcaagacuucuucuaucucuaguuuuagacuuugaccacauaucagaaugucuuggaggaagacagggguguaacccuggcacucaagagacagagacaggaggaccauagcaaauuaaaaaccaguaucguauacauagcuccaggccacccagggcuauauagcaaagccccauuucaaacaaaaaacaaaccaaaucuaucaaucaauaaaucagacaacaaaacaaaacaaacacaagaaucccuugggaagcuguaaaaauuccuggccuuggaugggaguucuagguagguagcgggguuccugcaugggaaagggauggauggucccuauggggaaaggauaaggaagagggcaaguauaauagugccgggaccaguaugaguuggguggcguucuuuuuuuuuuuuuuuuuaagauuuauuuauuuauuauauguaaguacacuguagcugucuucagacacaccagaagagggagucagaucuuguuacggaugguugugagccaccaugugguugcugggauuugaacuccggaccuucggaagagcagucgggugcucuuacccacugagccaucucaccagcccagguggcguucuuaaauaagucuuuuuuaaauuuuuuugguuuuucgagacaggguuucucuguguagccucggcuguccuggagcucacucuguagaccaggcuggccuugaacucagaaauccaccugccucugccucccaagugcugggauuaaaggcaugcaccaccacugcccggcauuggaugggguucuuguaggaugggagaacauggguucuugucuugggcaggaacaagucuccaguccuaucaggccaaccuguggucuuacuuaccauucgcuucuugggccggaugagaggccgguucugaccauucaucuugugauacaagccacaggcauugcacagguagugaccuguccugucccuccgccacaguggaguagccguugcuccacaguucacacacucucuggccucugguagauggagagaaaaggaagcaaggcucggucagcuuagcuaugucuugagccaccuagcccaacucaaccuccuggucccuuuuugaaagccucaccacaaggggccaauggcaggcuuccaugaaacuugggggaagaauaggcugcugagcugagagggcucccagugggagagaagaaaggacugggaaagucagcucccccguaagcacugccggugacagggagcgaugcaggcagugcaguccccagcgucaggaggucuggacucagccgcuccgucuucaagguguccaagaacguguuguugcucuucccuuccuggucuuccagggccugggaaggggcauccucauggcuggggcacacaguugaggcaggguagagugccgucuugccauaggcccagcuagcauaaggugagcccccaggaauucccuccauacuguugagcaguggauacaccugaaagacuguugaagggguagagaggaaaaggaaagaacagcaaaccuuagguaguccuacuuuuacagugaaaugguguucgucugucccaacaugguggcuaguuuucuggucuuccuacaauagucucuugcugcuugggugacuucggaguucuaugucccucuggucacuauagcaaggacgauccccuccaucccuuuuugauauugagaccaagaggcugcaggucaagugacaaauaagacagcuucguacacacuuccagccuggcuucuccgugugcucacuacaguauggcagacagagacgaggauugguacaaauggggcgguacaccuauccacagagcuucuaacucuuuccaagaugaccucacagaacugugaacuagcuaaccaucucuauggcaacccugacagcuuccagccagugccaaggcagccacccaacaguuaccuggggagugucuguaggccucagcuucucuguaguaggccagugcugaugcugcggccguggcugcauuuggggaaguggaagaagaugcugcauccaaacccucuggcccagaggaaaagaaaccuguggaaucugauggugaggacaccagggcagaauccacaaacuggggcaaggguucugagguccccagggccccuagaccaggaaaauccaugggaacacugggguugaaccugugaggacagaaaggguugugagacacagaaacauucucuucccuccuuucuuuucuuuucuuuucuuuucuuuucuuuucuuuuuucuuucuuucuuuuuuuucgagacaggguuucucuguguagcccuggcuguccuggaacucacucuguagaccaggcuggccucaaacucagaaaucugccugccuccaccucccaagugcugggauuaaaggcgugcgccaccaccgccuggcucuucccuccuuuuuuuucucuuucuccgaaucugucacugagacucugugugucuccuuuugggcucucagauuauuuuucuccccuucccuuccaucccucccuaggcugucaugucucuugucuucuuccaucauccuuugucccuuucucccaucuuccucugaucucuccccauccuccuguugccucuugucugucauaccucuacuacuccaucaguuugcugccucugagucccucuucuuccucuccuaucccuccucccaucuuccucaucuccaggucucuccaggucuuccuucuucccucuuuucuuccccuuuuccucuuuccacugucuuguauucccuuccuuucucuguuggucccuucccucgcaccucuuuccuccugucccuccuuuucauguaccauauuucucuuccucuuucugugucuccucuuuccuuccuccuuuacuuuccuucuaaccuuccucuuucuccuccuccggcaagccuuugcuucucuuucucccauucuucaaggccuccuccauuuccucuuuuuauucucucuuccccuuccuuucuuuccuucugcagaggcagaaugcaggaccaagaucccuuggaccccuugacagcucccauaggaguuugggguucacccuucugugcuccccaacuucaucccuaucuguuguaucuugccaucugacuuucucagaaaccccgugguuuccggcuuuauccccucccccacuucacuugugucugcagacugugggccccguuaguuccucccuguucuauggggggggggucaguacuccugcccccacacugcuuaucucugccauccccgcccaacuuuugaaaucaccccaaagcuacuggcuuccucugagaagaguaacagguggguggggacaagggucuguuuucaggaaccuuugagucucaccacucccagaccucaguuuccccaucuguucuauuggaggugauaccugaagagcugagcaccgauccuuucccucugucuacacugcauggcuuuuucuauagcucugucuccuugggucucucccuccauuuccuuucagggcugacuguguuucuguguuucuccuaccuuucugugcuuuaccuuugaaaacaaagauuuuaucuuuaugugcuucugcagucaaucagucagucagucagucagucagucagucagucagucagucugucuaucuaucuaucuaucuaucuaucuaucuaucuaucuaucuaucuaucuaucuaucuggaggucaguggacaaacauggguguugguccuuaccauccacuuccuuuuuaaagagggucucauauuuuuccaccguguguaccaggacaggccugugagccuccagugagucuucuccaucucccauuucccuaaaacugugcugaugugccugcuaccaugucaguauggguucuacacauuagauccuuauucaacaaguaauuuauccuuggagcucucucccuagacuucuaggguguaucuugcccucucuuccugugcuuuuaugaaauugugugugugugucccacugccuucuuuggccguccaugucuauguuucucuaauaucuucccaucuuucuuuauauuuguuuaugucuuugugucuuucucagcuugccuucuguguuuccgcucuugcuuucuccuagacuauguauuucuucuagacuauguauuccuggauaucucucagucuuuccaagucuguaucucccucugacucccagugccucuuccuccuaguucuuuuucugagccaugaauucuuacuauucuuauauccucaaugugccuuacuacacacagcucggcggcagggaaaaggagucaaagaccgugucucuucccugaugggcugauggcucuacuuguagggggaugggagaauaccaucuucucuacccauggguagaucggaaaaggcugagcccaggcuuggggaccaugcuggggauaagacacuccugacucugucuaccauccccuucuugagcucagaaucuccaccuauuugggcaguggcugcucucucucucgacucucagcucaccuuuccccucuuuccucucucucuaauucugucucucuuuccaugauucauucuuccugucuauuuuuccuucuugccuuucugucucugccuucgccuccuuguuuucugcccaugacucuccucuuccuucucaugugaucagcuugcuugcuugcuuucuuucuuucuuucuuucuuucuuucuuucuuucuuucuuucuuucuuucuuccuuccuuccuuccuuccuuccuuccuuccuuuucuuuucucucccccccaaagacuguuucaucuuugcauguuuuaugccucuugcuuucucucucagugucucugucucuugcucccaguuuucuuuuucuuuucuuuuuucuuuuucuuuuuugguuuuucgagucaggguuucuuuguguaguccuggcuguccuggaacucacucuguagaccaggcuggccucgaacucagaaauccgccugccucugccucccaagugcugggauuaaaggcgugcaccaccacugccuggcuccaguucucuuuuuguaucucuucucucacugugugagguuggcuuccugucaccaauuccucauccccucacccacccuccgauucccccucaggccucagggccuggacuucucaccuuuggugggugcagagcuacccaccccuccugaaucaagggcccaccccccaccucaguuaucacccuccggacagagauaaaguuuaucuccaggcugggggaugugagaaguccuuaucagcugccucaguagagaaagugcugcucuaaccaggaggcacagcagcugcaccugcucucccgggcccagccccucaccccagguaacugcccuacccagcccucagcaaggcuacguggggccauuggagcagaggcaggaccuggggagcagaugugguaguuaggagguuagagguagaguuugagagucagaagucuggguauauggcuguggaguuuaagggaaggaaaaaauuggcucgacuucucugacccaaguucagagaucuguuugggguuuggaaguagguuaggaaaacagaugaauuuaggaaaccagagguaaaguuugacagucagcugccauguuagagauguacuuuaaagguucgaaaugagccgggcgugguggcgcacaccuuuaaacccagcacucaggaggcagaggcaggcgcauuucugaauuugaggccagccuggucuacaaagugaguuccaggacagccagggcuauacagagaaaccccgucucacaaaaaaaaagguuagaaauggguuuugggggacaugguaaaaugcgagagaguauuuuuuuuuccugggcagcauggguugaggagcagagggaccuggacagacaggacuauggcuguuauccagagacaaauucugggaacacggaaagagcggagaagucaagccaagagaugggguggagaaaguguggaaagaaugggguucagugggcagucaacccuagggcugacgggcaugggggacauugggacagaauaguuguggggagaaaacuuagcgucaaaagcaaaaaacacauuuuggccaacagguagggggaagggaaaaguuugggaaggucagagagaagacgcagggaacaagcaugcggucugacaggccacgauggggaugggaauuaaaguuaggcuuugacacaucagagacaggugugaucggccagaaaaaaaugggauagaaacagagguauucacuugagagcagaaauacgagucuugaggaagcgaaagugaguuuuguuuuguuugguuuuuuuuguuugguuuuccuuuuuuugggagaagagagagguggagacaaguuucaaucaguaaaaauuccgauuugagaugagauaggagcgugggggaaugaaggcauaggguuucucggggguugguauguauagcaggcaggccugggaggaugaagacagagguaaggggacauagauagcuuagaaggaauaggagaaugggaagaaguuggggcagauagaaguuuuggcaaggagagauggagguuggaacagaagucuggggauccgugggagaaucgggggacgacccccguuuuaggggcaaccuaugggucugaguagcaggcuggguguugccuugcuggagggguuuuuuugggaaucaagacugaccugggcuuguugaugcagaggauucagccaccuuagugguaugacgaguucagggugaucccaagggaguccucacuggccuuggccucugagucucccuucucucccuccugccagcccgcccgcccucccucccucccacucaccuucucccuccucuuuccuccccagggaguggcuggugccccaguggguggggcagugcaggggagggggugugccgccuccuuguggaggaccuuuuaggcucuagucccuccgcccuuccugucuauccugcagguuguuggauccccuuugccuuuggcuucuguggaguccaguguccagucaagucauaugagcaauuagucaagaucuaaguuucauguuuuacuacuaguuucuuucagugaggaaagccccuacuguguaccaggcuauguguggguuggaccuguaugcgcgugagcccuccugaaugcugggagaaagggggauauagcuguacccauuuugcaggugagaagaaugaggcucagaguuuugggagcauuucaagcagaggcugcaggccaccucuaugaagcagucugggguacuaggccaggacuaguggguaaggguacauacacuucuuuagugcuucggcucgugccuggggcuuacgccagcucuggccugcucuggggcagcagauaagucuuaucagauggacucgacuguggcuguuggugccgcaguaacaggcugucuuggggcuggggggcaggguaggggaugcacagggacagugccucaacuucuugcccgccauacuacguuagaggcgggaaacugaggugacacccagaguggacuccccugggagucccagaggauugggauaagaucacaaaaaaagaugguuaaguaaaagacagaaagcagcagggacaaagauauacagaaagaaauagaagugagaaggcaaagacggagaaguggaaggaggcagagggauggugccugggagggagggagggagggagggagggagggagggagggagggguugaagggagagggagggagagagagagagagagagagagagagagagagagagagauucagacagagccugagauguuaugaacacggagagguaaaagagauggacagaagaugaaggaagcuagaaaugacaaaggccuagggcacagauggaaacauaaaaggaagacagaaaugauguagagaaggagagagauuuagaggcagagucugagggagugagcuguauguguuuauguguguacgugugugugugcaugccaugcuagugccauuggugugaggauguggcuguugugaucuguguggcucugcucagcuguauugaagugauacccuuccagcccuagucacuggaugcugacaguccaucccuacuuuuuucuuuuggcccacuggugccuuguucucacauaaaccuucaccaguagauuuugagcgcugcuucugcaucacacacggcacugcacuugcauccucauucauaagacuuucugacauggcccuggaaauccguaggcuaggccucgccuacuaaccguccauucuacaguuggggagacugagaaccacugagggaaaggcagagaggaaguucugaggcagaacgcucagucagccugccuaccagccauugucccuccacaugggccuuaaaaaugggaggcuuguccacuuacugaaaauggaggcaaguauaccauacuggacuuuuuucuuaauuguaaaacuuuuagccgggcgugguggcgcacgccuuuaauccuagcacuugagaggcagaggcagguggauuucugaguucgaggccagccuggucuacagagugaguuccuggacagccagggcuacacagagaaacccugucucaaaaaaaccuaaaaaaaaaaaaaacaaaaaacaaaaaacuuuuagccucucucaggcugugaacagcgacuucucauucauugcuaucuaauuucauccuuucuuucaaccucguuaaauuccauagcaucacauacauuucuguagcauaaaaaguucauggccugcacgaaacgaauuaacaacuuugcacagcugauugcagucaccuucauccuggucuccuugcuaaacugcaaagugcacgagaggcgcacaggagccaugggauuauauuuagcccucuucuuuaucagaaacccaguaacaaacuucagauacacacuguacaugcaguuacuauuuguuugaugaaacagaugaguagucacagugaauaaguuaaagaauaguaauaaaaaaaugggaggcuuguuuaaauugugugagaguggcuaugugccgcuugccuuuguaaggacgcagaugcuggaccaacagcuagcacuauucuccacuaacccacccagcugcuaguggggagaccuagacagagucauguaugaguuaccguucucccuucuguaaugggguaacaaugacaacuacuucuguauugggggacaaugcacgaaguugaauccauguuaagugguccgacugacugaaucugaguucucaauauaucaaagauucuauuuuuuaaauugaguacucacaugaaucugagauguccaaguagaguauucugaucugucuacugagugcuuauugccuauguuagucccucucccuucccaacuagcacggcugugaauucccugugcaccuaugugugcacaccaauaacaaugcuaauauuaacucuaagccgauaggagcuuuaaugcugauccugauacuaauagcagugguuagcuaacacugaguucaagucuaagacuacuauuauuuuugucgugcuagggauggaaccugaugcaucuugaauacugggcaagagcuucacuggcaagcuauauccacagccuuaacgcuaauucuucuuccuucuaacucagaauaaccaccuccaauucucacccuugccccaugcuaggaauguaacucagggccuugcauauguacacuaggcaugugcucugccaaccucacuacaucccagcuccugauucagccagagcuuuuaggaagcugcaggaacauaccaauagcccaccacgagcagcaauauucaucggcaggacgcaggcacuacccuaaguacuuuuuuuucaggcaugguuuuauuauauucuagucaagucuuugugaucuguugccacucuccccugccagacuggagucgggccacagaaaggagacucuccagggccucagcgacucccuucaauucacagugauugacagucuugcacaagcaagucauccacuguguuucaguuggucgcuuggaaaaugguuauaaucauagaccguccuuacccuacaccaaauguaacuaaucugcacagugccugcugggcacaucauaaaugguaugcuucucaaacaauacuucucaucgcuguguaguacucuuagcggcagaaauugugcaucugcgggugagguaugggggagucucauugggaggggaaggcuagaggcaugugcaauaaaaugguguggugcuggacucauaucccauuucuucauuccuggaggugacaaagggcucaguaaaggaaaugaagggugccucuaaggacaggccucaccccauucccucccccaucccuguggagggggugcaaggcccagaagucuguggccacaguucagccagcagggaggcagcugggaaggcauagauaagggaaucagcgggggccaggcuaggcuugggggagcccauugcaggcgggggugggguguccggguugaagcgucuucucugucaggcuuccauuugagacccaugcuaauguccucucuuccuuggauccuucccugacuguucucaucaaccucuuuugagguucagaugccucuauuugauucaagccacagcacgagguuaucugggccucuuugagacuggaguucaccagagccgggauagaauaagacucacuucgguagcacuaccacaacagccaaaaccuuaccaaggagucauguguuugacuuaggagugaaacuauugcuuuuuaucucaagaauuauuuuuaaucaagacauaacaagaguauauguauguauguaugcauguauguguguauauauauauauauauauauauauacauggcauagcaugaucauuugauacgugcauauaauacauaaugguugaauugaagugauuagcauauccacuuccguaaacaccaaacaccaaugguuucuuagaaaugaaaaaaguuggucacagagaaagaagacuagaauaauggucuggacugagaagagaagucagauguguucuagugcguucgagcccaggaggguaacuaguuaccaacacucagcaaaauguaaaaguucuuauuauuuaauaaugaaagaaaauaacacagaaauguacaugguccuacguggaaucucaguacuggagauggaggcaggaggagcgaaguucaaggucaugcucugcuacauagugaguuugaggccaaccuuguuugagaccuuguuugaaaaaaaauaaaaguggggaccuggguucaauucccaguacucauaggcucucauaaacauccguaacuccaguuccaggagauccaaugcccucgccucaccuucauaggcacccacaagguacauguacauacaugcaggcaaaacauucauagccaugaaaauaaacguucauuagagcagccauaacaacaaauaaaguaacuaauauagugaguggucuguuuccaguggucuauacugcuaguguauuccuuucuaacagaacacauuucuuucaggucagaguugggucaggucaaagcuauccaaccccauaaagccaacagugguucucauagcucuuggaauucuucuguuugcuaauuuucuguuuuguuuuguuuuugaaacaaaguuucacuguguggcucugacggacuuugaacuugauaugugaacgaggcuggccuugaacucacagaaaucagccuuccccugccucgccuacugcuaggauuaaagacaugaggcaccuugcuugguucgucuucaucuuuuuaaagaauuauuuuagauuuauuuucuuuuauguauucuggucucuccaaaggccauaaaaaggcauugcccccccccaacccccaccucaaacuggaguuauggaugguuguaagucaccaugugguugcugagaauggaacucaggaccucuggaagaacagucagugcucuuaaccacugagccaucucucuaaccccaaacucuuucauuuuugagcucauuuuaaauuuagaaucuaaauuacauaaauaaauacguagguuucuuuuaagaagaaaaagugaaacuaggugguuacaaauaguagguaaaggguugacuacacuuuagauuuuaacaaauuaagaauaaacaugcugcagggcgugguggcgcacaccuuugaucccagugcacgggaggcagaggcagguggauuucugaguucaaggccagccuggucuacaaagugaguuccaggacagcuagggcuauacagagaaacccugucucaaaaacaaaaacaaaaaaaaaaaauaaauaaaaaauaaacaugcccacagaacuggaagggccagcugugcagcucagggauagagcuguugcuuagaauuugugagguucaacccucaacacauacacacaugcacauauguaugagauagguucacacaccaacaucaauucugagcaguuuuguauggcuuuucuuucaguaagaaacaaacaggccaggcggugguggcgcacgccuuuaaucccagcacuugggaagcacagaggcaggcgaauuucugaguuggaggccagccuggucuacagagcgaguucuaggacagccagggcuacacagaaaaacccugucucgaaaaaaaaaaacaaaaaaacaaaaaaacaaaacaaacaaacaaacaaaaaaagaagcaaacaguauugaagagaagccauuaugauucuugcuauuauuccuuugagacaagaucucaguggaguccaagguggccucaaacacagcauuuuccugccacugccucccaagugcugggaacacaggugugcaaccaccaugcccagcucugacuguaacuguccuggcaggggcugagauauucugagggccacuuguuccuguucuucuacuaucaggcuauugagaaaauugagucaaagaaacuggaauuuucccaggauucuaaccccaggagaaggaaaaagguaagacugacgccaagugaaagcuucucuccuggcaagaguuucacauaguuggaaagcauaucagacuaccacggaaaucagagcccagagccgauauagauaugugucaaagaugggcaggcagccccucaccuuugaccagaacugcuuaguuaaggguaaucuugaauucucuauaaacucaaaccuuuuggcaggacccugaaaacagacuugagccauuucuucagucccagaucuuuacuuucaguguguauuuuuguaucaugggccuguucuauucucuaccauuuuauuauuuauuuauuguuggucuuucaagauagggguucucuguguaucccuugcuguccuggaacucacucuguagaccaggcugaaccucagacuaacagagaucuaccugcauuuacuaccuccccugaauuaaagguguguaccaccaccacccggguuaccucuuauuucaguuuuguuuuguuuuguuuuccuaaauugccaagugaaguacagaacauacuacaauagugauugacacucaacaaucacaacugugucuuaaucucaaaaugguaagagugcuagugucagccgggcaugguggcgcacgccuuuaaucccagcacuugggaggcagaggcagguggauuucugaguucgaggccagccuggucuacaaagugaguuccaggacagccagggcuacacagagaaacccugucucggaaaacaaaaacaagaaagagugccagugucacuauucaaggaccaaugaccaagacacauaggucuggcucuuaaucaagugagcagacaauugagagagauauaucauuguuccaaucaggaguauguaaacugaugccuuucugucaaaacuucuuagcuagaaauagcucuaggaaccaaaguccuucauccuuacacugaggggcugcaaacugccguuaagguccaaaaaauaaguaagaccaacuauaaacagagcuuuuuuuuuucuuuuucuuuucuuuuuuugggggguuuuuuugagacaagguuucucuguauaguccuggcuguccuggaacucacucuguagaccaagcugaccucaaacucagaaauuagccugccucugccucccaagugcuggaauuaagggcgugcaccaccacgccuggcuuccuuuuuuuuuuuuuuccuauuaccauugucuguccuguaauuuaguaauuuagacauucuuuuuuuuuuaagacuuguuuauuuauaugaguacugucuucagacacaccagaagagggcaucagaucccauuauagaugguugugagccaccaugugguuggugggaauugaacucaggaccucuggaagagcagucagugcucuuaacuucugagccaucucucuagcccaauuuagacguuccuuuguuguuguuguuguuguuguuauuguugagacaggguuucuccguauagcccuggcucuccuggaacucacuuuguagaccagguuggccucgaacucagaaauccgccugccucugcuuccugagugcugggauuaaaggcaugggccaccacaccuggcuagauguucuuuucagaaacaguguuucauauaacauagacaggccaaguggugcuacugccugccccucacaaaugcuagaaguagagggcuacaaccaccauagcugauacaagucaccuuuuauaacaagauaguauagcaauucguuuuccaaaacauuuucuauacuagacaaggacaaaaagaauucuacuaaaauagcuguuacuaagcauagggguaggagguaggggcccuugcaacuuaaugacaaugagaaugaaaucaggccacaaaugggggggggacacuucaagcacauccaaauugaauaaggagaaggaaugggugagggaaguauggauguagaacaguucagaguucgacaccaggcuaggucuguaaacagagaggucucauuguagcccaagugagguugaaacucacuacaugggccacacacuagccaugaauucaguccugccauauccucaaguccugggauuagaggcaugcaguaucaaugcaucugccccuuccaccaugggcaccggggguggggggguggggggcaaucugcauacacaguacaggcugguccugaaguuaaaaucaccaaacaccccuuuuuucucauucagaagguuagagucugugguuuuucauuagcuaugggugccuguuuuuuuuucuuucuuuccuuccuucccuucucuuucuuucucucucccucucucuccuucucccucccucccucucucccucccucucucucucccucccucucacucuugcucucuuuugcaggaagggucaugcuaugaagcccugacaagcauggaacuuaccuuggauauggagcugguauaucucaaggagaacuugccaugacccuccugccucugccuucugaguacacaaaugacgauggucucgcuucacgacacccagucagcuuucucugccagaagcauucggaccaggaggaguggguuauuuucccaggagauguugcauuccugauugaacaugcuggccuugagauaagggcggccccgagauaacaguuuuuaaaaaauucauaaaaaggauggucuagaaauucuuuaaaaaaaaaaaaaaacaacacaauaacaaauucaaagaggccaguuugugguaggaaaaguauacaugacauuuucauacauacuaggaguccaggcuggcuuaaaauuugcucuguagcugacgaugacuuuggauuccugagccuuucuugucugcuuucagagaucugggauuguagucuuguaccaccaugccuaguuuuugugugauuuugaguguugacacuagccccacaguguauaaaaaguauaaacuuuuuaugucuuuuucgggggggcagggguugagacaggguuucucuccuagcuguccuggaauucacucuguaaaccaggcuggccuugaacucagagaucugucucugcuucccugggauuaaagaugugugacaccaccacccagcccaguauaaaguuuuaaaacuuauuuuauguguguuauguguaggugcaccagcugagcugagccaacucacuagccuucuuuauuaaaacuuauauuaguguuuggagagcuggcucagcaguuaagggcaccuacuguucuugcaggaguuggguuugggucccagaauccacaugguggcucacaaccaucaguaacccuaaaucugggguauccgacaccuucuuuuugccucuauagacacuggauaagcacggacuacgcagacauguaugcaggugaaauacucccagacagaaaauacaucuaaaaaugcuugggguggggaggagucuagacaggguuucucucucuguauagcccuggcuguccuggacucacuuuguagaccaggcuggccacaaacucagagaucugccccucuuugcuucccaaguguuaagaaaaacagguuucuugggcugguuccuuuccccuauccaccaaccccuuuucuucaauuaaaugaaaaggcaaagcugaaagccaaagagaaggcaaagaccaggaaaaggaauaagacaagcaaagugguaucuggggucuccuacccauggagucccuucuuggccccauccuuuaccuuuugcgaagggcuucacucccaggaauguaggugcugcauacuuccucucuagcuguucuccgucgugugccuaguagaagccaucaaagucaaacauggcgcagaggucuccaggagaggcccaagagccaucaugagggguguaauggaggagagcggggugagggaggcauccuagaaggcaggcuacuagucuaugcaugacccgguugcugagcagacucgcauucauaccucaaaccaacuucauacuugugacugacuggugaugguauuucucagaaccacaugagcucggaag

SEQ ID NO: 9379 - RNA, 18814 nt, Mus musculus
cuuccgagcucaugugguucugagaaauaccaucaccagucagucacaaguaugaaguugguuugagguaugaaugcgagucugcucagcaaccgggucaugcauagacuaguagccugccuucuaggaugccucccucaccccgcucuccuccauuacaccccucaugauggcucuugggccucuccuggagaccucugcgccauguuugacuuugauggcuucuacuaggcacacgacggagaacagcuagagaggaaguaugcagcaccuacauuccugggagugaagcccuucgcaaaagguaaaggauggggccaagaagggacuccauggguaggagaccccagauaccacuuugcuugucuuauuccuuuuccuggucuuugccuucucuuuggcuuucagcuuugccuuuucauuuaauugaagaaaagggguugguggauaggggaaaggaaccagcccaagaaaccuguuuuucuuaacacuugggaagcaaagaggggcagaucucugaguuuguggccagccuggucuacaaagugaguccaggacagccagggcuauacagagagagaaacccugucuagacuccuccccaccccaagcauuuuuagauguauuuucugucugggaguauuucaccugcauacaugucugcguaguccgugcuuauccagugucuauagaggcaaaaagaaggugucggauaccccagauuuaggguuacugaugguugugagccaccauguggauucugggacccaaacccaacuccugcaagaacaguaggugcccuuaacugcugagccagcucuccaaacacuaauauaaguuuuaauaaagaaggcuagugaguuggcucagcucagcuggugcaccuacacauaacacacauaaaauaaguuuuaaaacuuuauacugggcugggugguggugucacacaucuuuaaucccagggaagcagagacagaucucugaguucaaggccagccugguuuacagagugaauuccaggacagcuaggagagaaacccugucucaaccccugcccccccgaaaaagacauaaaaaguuuauacuuuuuauacacuguggggcuagugucaacacucaaaaucacacaaaaacuaggcauggugguacaagacuacaaucccagaucucugaaagcagacaagaaaggcucaggaauccaaagucaucgucagcuacagagcaaauuuuaagccagccuggacuccuaguauguaugaaaaugucauguauacuuuuccuaccacaaacuggccucuuugaauuuguuauuguguuguuuuuuuuuuuuuuuaaagaauuucuagaccauccuuuuuaugaauuuuuuaaaaacuguuaucucggggccgcccuuaucucaaggccagcauguucaaucaggaaugcaacaucuccugggaaaauaacccacuccuccugguccgaaugcuucuggcagagaaagcugacugggugucgugaagcgagaccaucgucauuuguguacucagaaggcagaggcaggagggucauggcaaguucuccuugagauauaccagcuccauauccaagguaaguuccaugcuugucagggcuucauagcaugacccuuccugcaaaagagagcaagagugagagggagggagagagagagggagggagagagggagggagggagaaggagagagagggagagagaaagaaagagaagggaaggaaggaaagaaagaaaaaaaaacaggcacccauagcuaaugaaaaaccacagacucuaaccuucugaaugagaaaaaagggguguuuggugauuuuaacuucaggaccagccuguacuguguaugcagauugccccccacccccccacccccggugcccaugguggaaggggcagaugcauugauacugcaugccucuaaucccaggacuugaggauauggcaggacugaauucauggcuaguguguggcccauguagugaguuucaaccucacuugggcuacaaugagaccucucuguuuacagaccuagccuggugucgaacucugaacuguucuacauccauacuucccucacccauuccuucuccuuauucaauuuggaugugcuugaagugucccccccccauuuguggccugauuucauucucauugucauuaaguugcaagggccccuaccuccuaccccuaugcuuaguaacagcuauuuuaguagaauucuuuuuguccuugucuaguauagaaaauguuuuggaaaacgaauugcuauacuaucuuguuauaaaaggugacuuguaucagcuauggugguuguagcccucuacuucuagcauuugugaggggcaggcaguagcaccacuuggccugucuauguuauaugaaacacuguuucugaaaagaacaucuagccaggugugguggcccaugccuuuaaucccagcacucaggaagcagaggcaggcggauuucugaguucgaggccaaccuggucuacaaagugaguuccaggagagccagggcuauacggagaaacccugucucaacaauaacaacaacaacaacaacaacaaaggaacgucuaaauugggcuagagagauggcucagaaguuaagagcacugacugcucuuccagagguccugaguucaauucccaccaaccacaugguggcucacaaccaucuauaaugggaucugaugcccucuucuggugugucugaagacaguacucauauaaauaaacaagucuuaaaaaaaaaagaaugucuaaauuacuaaauuacaggacagacaaugguaauaggaaaaaaaaaaaaaaggaagccaggcgugguggugcacgcccuuaauuccagcacuugggaggcagaggcaggcuaauuucugaguuugaggucagcuuggucuacagagugaguuccaggacagccaggacuauacagagaaaccuugucucaaaaaaaccccccaaaaaaagaaaagaaaaagaaaaaaaaaagcucuguuuauaguuggucuuacuuauuuuuuggaccuuaacggcaguuugcagccccucaguguaaggaugaaggacuuugguuccuagagcuauuucuagcuaagaaguuuugacagaaaggcaucaguuuacauacuccugauuggaacaaugauauaucucucucaauugucugcucacuugauuaagagccagaccuaugugucuuggucauugguccuugaauagugacacuggcacucuuucuuguuuuuguuuuccgagacaggguuucucuguguagcccuggcuguccuggaacucacuuuguagaccaggcuggccucgaacucagaaauccaccugccucugccucccaagugcugggauuaaaggcgugcgccaccaugcccggcugacacuagcacucuuaccauuuugagauuaagacacaguugugauuguugagugucaaucacuauuguaguauguucuguacuucacuuggcaauuuaggaaaacaaaacaaaacaaaacugaaauaagagguaacccgggugguggugguacacaccuuuaauucaggggagguaguaaaugcagguagaucucuguuagucugagguucagccuggucuacagagugaguuccaggacagcaagggauacacagagaaccccuaucuugaaagaccaacaauaaauaaauaauaaaaugguagagaauagaacaggcccaugauacaaaaauacacacugaaaguaaagaucugggacugaagaaauggcucaagucuguuuucaggguccugccaaaagguuugaguuuauagagaauucaagauuacccuuaacuaagcaguucuggucaaaggugaggggcugccugcccaucuuugacacauaucuauaucggcucugggcucugauuuccgugguagucugauaugcuuuccaacuaugugaaacucuugccaggagagaagcuuucacuuggcgucagucuuaccuuuuuccuucuccugggguuagaauccugggaaaauuccaguuucuuugacucaauuuucucaauagccugauaguagaagaacaggaacaaguggcccucagaauaucucagccccugccaggacaguuacagucagagcugggcauggugguugcacaccuguguucccagcacuugggaggcaguggcaggaaaaugcuguguuugaggccaccuuggacuccacugagaucuugucucaaaggaauaauagcaagaaucauaauggcuucucuucaauacuguuugcuucuuuuuuuguuuguuuguuuguuuuguuuuuuuguuuuuuuguuuuuuuuuuucgagacaggguuuuucuguguagcccuggcuguccuagaacucgcucuguagaccaggcuggccuccaacucagaaauucgccugccucugugcuucccaagugcugggauuaaaggcgugcgccaccaccgccuggccuguuuguuucuuacugaaagaaaagccauacaaaacugcucagaauugauguuggugugugaaccuaucucauacauaugugcauguguguauguguugaggguugaaccucacaaauucuaagcaacagcucuaucccugagcugcacagcuggcccuuccaguucugugggcauguuuauuuuuuauuuauuuuuuuuuuuuguuuuuguuuuugagacaggguuucucuguauagcccuagcuguccuggaacucacuuuguagaccaggcuggccuugaacucagaaauccaccugccucugccucccgugcacugggaucaaaggugugcgccaccacgcccugcagcauguuuauucuuaauuuguuaaaaucuaaaguguagucaacccuuuaccuacuauuuguaaccaccuaguuucacuuuuucuucuuaaaagaaaccuacguauuuauuuauguaauuuagauucuaaauuuaaaaugagcucaaaaaugaaagaguuugggguuagagagauggcucagugguuaagagcacugacuguucuuccagagguccugaguuccauucucagcaaccacauggugacuuacaaccauccauaacuccaguuugagguggggguugggggggggcaaugccuuuuuauggccuuuggagagaccagaauacauaaaagaaaauaaaucuaaaauaauucuuuaaaaagaugaagacgaaccaagcaaggugccucaugucuuuaauccuagcaguaggcgaggcaggggaaggcugauuucugugaguucaaggccagccucguucacauaucaaguucaaaguccgucagagccacacagugaaacuuuguuucaaaaacaaaacaaaacagaaaauuagcaaacagaagaauuccaagagcuaugagaaccacuguuggcuuuaugggguuggauagcuuugaccugacccaacucugaccugaaagaaauguguucuguuagaaaggaauacacuagcaguauagaccacuggaaacagaccacucacuauauuaguuacuuuauuuguuguuauggcugcucuaaugaacguuuauuuucauggcuaugaauguuuugccugcauguauguacauguaccuugugggugccuaugaaggugaggcgagggcauuggaucuccuggaacuggaguuacggauguuuaugagagccuaugaguacugggaauugaacccagguccccacuuuuauuuuuuuucaaacaaggucucaaacaagguuggccucaaacucacuauguagcagagcaugaccuugaacuucgcuccuccugccuccaucuccaguacugagauuccacguaggaccauguacauuucuguguuauuuucuuucauuauuaaauaauaagaacuuuuacauuuugcugaguguugguaacuaguuacccuccugggcucgaacgcacuagaacacaucugacuucucuucucaguccagaccauuauucuagucuucuuucucugugaccaacuuuuuucauuucuaagaaaccauugguguuugguguuuacggaaguggauaugcuaaucacuucaauucaaccauuauguauuauaugcacguaucaaaugaucaugcuaugccauguauauauauauauauauauauauauacacacauacaugcauacauacauacauauacucuuguuaugucuugauuaaaaauaauucuugagauaaaaagcaauaguuucacuccuaagucaaacacaugacuccuugguaagguuuuggcuguugugguagugcuaccgaagugagucuuauucuaucccggcucuggugaacuccagucucaaagaggcccagauaaccucgugcuguggcuugaaucaaauagaggcaucugaaccucaaaagagguugaugagaacagucagggaaggauccaaggaagagaggacauuagcaugggucucaaauggaagccugacagagaagacgcuucaacccggacaccccacccccgccugcaaugggcucccccaagccuagccuggcccccgcugauucccuuaucuaugccuucccagcugccucccugcuggcugaacuguggccacagacuucugggccuugcacccccuccacagggaugggggagggaauggggugaggccuguccuuagaggcacccuucauuuccuuuacugagcccuuugucaccuccaggaaugaagaaaugggauaugaguccagcaccacaccauuuuauugcacaugccucuagccuuccccucccaaugagacucccccauaccucacccgcagaugcacaauuucugccgcuaagaguacuacacagcgaugagaaguauuguuugagaagcauaccauuuaugaugugcccagcaggcacugugcagauuaguuacauuugguguaggguaaggacggucuaugauuauaaccauuuuccaagcgaccaacugaaacacaguggaugacuugcuugugcaagacugucaaucacugugaauugaagggagucgcugaggcccuggagagucuccuuucuguggcccgacuccagucuggcaggggagaguggcaacagaucacaaagacuugacuagaauauaauaaaaccaugccugaaaaaaaaguacuuaggguagugccugcguccugccgaugaauauugcugcucguggugggcuauugguauguuccugcagcuuccuaaaagcucuggcugaaucaggagcugggauguagugagguuggcagagcacaugccuaguguacauaugcaaggcccugaguuacauuccuagcauggggcaagggugagaauuggaggugguuauucugaguuagaaggaagaagaauuagcguuaaggcuguggauauagcuugccagugaagcucuugcccaguauucaagaugcaucagguuccaucccuagcacgacaaaaauaauaguagucuuagacuugaacucaguguuagcuaaccacugcuauuaguaucaggaucagcauuaaagcuccuaucggcuuagaguuaauauuagcauuguuauuggugugcacacauaggugcacagggaauucacagccgugcuaguugggaagggagagggacuaacauaggcaauaagcacucaguagacagaucagaauacucuacuuggacaucucagauucaugugaguacucaauuuaaaaaauagaaucuuugauauauugagaacucagauucagucagucggaccacuuaacauggauucaacuucgugcauugucccccaauacagaaguaguugucauuguuaccccauuacagaagggagaacgguaacucauacaugacucugucuaggucuccccacuagcagcuggguggguuaguggagaauagugcuagcuguugguccagcaucugcguccuuacaaaggcaagcggcacauagccacucucacacaauuuaaacaagccucccauuuuuuuauuacuauucuuuaacuuauucacugugacuacucaucuguuucaucaaacaaauaguaacugcauguacaguguguaucugaaguuuguuacuggguuucugauaaagaagagggcuaaauauaaucccauggcuccugugcgccucucgugcacuuugcaguuuagcaaggagaccaggaugaaggugacugcaaucagcugugcaaaguuguuaauucguuucgugcaggccaugaacuuuuuaugcuacagaaauguaugugaugcuauggaauuuaacgagguugaaagaaaggaugaaauuagauagcaaugaaugagaagucgcuguucacagccugagagaggcuaaaaguuuuuuguuuuuuguuuuuuuuuuuuuuagguuuuuuugagacaggguuucucuguguagcccuggcuguccaggaacucacucuguagaccaggcuggccucgaacucagaaauccaccugccucugccucucaagugcuaggauuaaaggcgugcgccaccacgcccggcuaaaaguuuuacaauuaagaaaaaaguccaguaugguauacuugccuccauuuucaguaaguggacaagccucccauuuuuaaggcccauguggagggacaauggcugguaggcaggcugacugagcguucugccucagaacuuccucucugccuuucccucagugguucucagucuccccaacuguagaauggacgguuaguaggcgaggccuagccuacggauuuccagggccaugucagaaagucuuaugaaugaggaugcaagugcagugccgugugugaugcagaagcagcgcucaaaaucuacuggugaagguuuaugugagaacaaggcaccagugggccaaaagaaaaaaguagggauggacugucagcauccagugacuagggcuggaaggguaucacuucaauacagcugagcagagccacacagaucacaacagccacauccucacaccaauggcacuagcauggcaugcacacacacacguacacacauaaacacauacagcucacucccucagacucugccucuaaaucucucuccuucucuacaucauuucugucuuccuuuuauguuuccaucugugcccuaggccuuugucauuucuagcuuccuucaucuucuguccaucucuuuuaccucuccguguucauaacaucucaggcucugucugaaucucucucucucucucucucucucucucucucucucucucccucccucucccuucaaccccucccucccucccucccucccucccucccucccucccucccaggcaccaucccucugccuccuuccacuucuccgucuuugccuucucacuucuauuucuuucuguauaucuuugucccugcugcuuucugucuuuuacuuaaccaucuuuuuuugugaucuuaucccaauccucugggacucccaggggaguccacucugggugucaccucaguuucccgccucuaacguaguauggcgggcaagaaguugaggcacugucccugugcauccccuacccugccccccagccccaagacagccuguuacugcggcaccaacagccacagucgaguccaucugauaagacuuaucugcugccccagagcaggccagagcuggcguaagccccaggcacgagccgaagcacuaaagaaguguauguacccuuacccacuaguccuggccuaguaccccagacugcuucauagagguggccugcagccucugcuugaaaugcucccaaaacucugagccucauucuucucaccugcaaaauggguacagcuauaucccccuuucucccagcauucaggagggcucacgcgcauacagguccaacccacacauagccugguacacaguaggggcuuuccucacugaaagaaacuaguaguaaaacaugaaacuuagaucuugacuaauugcucauaugacuugacuggacacuggacuccacagaagccaaaggcaaaggggauccaacaaccugcaggauagacaggaagggcggagggacuagagccuaaaagguccuccacaaggaggcggcacacccccuccccugcacugccccacccacuggggcaccagccacucccuggggaggaaagaggagggagaaggugagugggagggagggagggcgggcgggcuggcaggagggagagaagggagacucagaggccaaggccagugaggacucccuugggaucacccugaacucgucauaccacuaagguggcugaauccucugcaucaacaagcccaggucagucuugauucccaaaaaaaccccuccagcaaggcaacacccagccugcuacucagacccauagguugccccuaaaacgggggucgucccccgauucucccacggauccccagacuucuguuccaaccuccaucucuccuugccaaaacuucuaucugccccaacuucuucccauucuccuauuccuucuaagcuaucuauguccccuuaccucugucuucauccucccaggccugccugcuauacauaccaacccccgagaaacccuaugccuucauucccccacgcuccuaucucaucucaaaucggaauuuuuacugauugaaacuugucuccaccucucucuucucccaaaaaaaggaaaaccaaacaaaaaaaaccaaacaaaacaaaacucacuuucgcuuccucaagacucguauuucugcucucaagugaauaccucuguuucuaucccauuuuuuucuggccgaucacaccugucucugaugugucaaagccuaacuuuaauucccauccccaucguggccugucagaccgcaugcuuguucccugcgucuucucucugaccuucccaaacuuuucccuucccccuaccuguuggccaaaauguguuuuuugcuuuugacgcuaaguuuucuccccacaacuauucugucccaaugucccccaugcccgucagcccuaggguugacugcccacugaaccccauucuuuccacacuuucuccaccccaucucuuggcuugacuucuccgcucuuuccguguucccagaauuugucucuggauaacagccauaguccugucuguccaggucccucugcuccucaacccaugcugcccaggaaaaaaaaauacucucucgcauuuuaccaugucccccaaaacccauuucuaaccuuuuuuuuugugagacgggguuucucuguauagcccuggcuguccuggaacucacuuuguagaccaggcuggccucaaauucagaaaugcgccugccucugccuccugagugcuggguuuaaaggugugcgccaccacgcccggcucauuucgaaccuuuaaaguacaucucuaacauggcagcugacugucaaacuuuaccucugguuuccuaaauucaucuguuuuccuaaccuacuuccaaaccccaaacagaucucugaacuugggucagagaagucgagccaauuuuuuccuucccuuaaacuccacagccauauacccagacuucugacucucaaacucuaccucuaaccuccuaacuaccacaucugcuccccagguccugccucugcuccaauggccccacguagccuugcugagggcuggguagggcaguuaccuggggugaggggcugggcccgggagagcaggugcagcugcugugccuccugguuagagcagcacuuucucuacugaggcagcugauaaggacuucucacaucccccagccuggagauaaacuuuaucucuguccggagggugauaacugagguggggggugggcccuugauucaggagggguggguagcucugcacccaccaaaggugagaaguccaggcccugaggccugagggggaaucggagggugggugaggggaugaggaauuggugacaggaagccaaccucacacagugagagaagagauacaaaaagagaacuggagccaggcagugguggugcacgccuuuaaucccagcacuugggaggcagaggcaggcggauuucugaguucgaggccagccuggucuacagagugaguuccaggacagccaggacuacacaaagaaacccugacucgaaaaaccaaaaaagaaaaagaaaaaagaaaagaaaaagaaaacugggagcaagagacagagacacugagagagaaagcaagaggcauaaaacaugcaaagaugaaacagucuuugggggggagagaaaagaaaaggaaggaaggaaggaaggaaggaaggaaggaagaaagaaagaaagaaagaaagaaagaaagaaagaaagaaagaaagaaagaaagcaagcaagcaagcugaucacaugagaaggaagaggagagucaugggcagaaaacaaggaggcgaaggcagagacagaaaggcaagaaggaaaaauagacaggaagaaugaaucauggaaagagagacagaauuagagagagaggaaagaggggaaaggugagcugagagucgagagagagagcagccacugcccaaauagguggagauucugagcucaagaaggggaugguagacagagucaggagugucuuauccccagcaugguccccaagccugggcucagccuuuuccgaucuacccauggguagagaagaugguauucucccaucccccuacaaguagagccaucagcccaucagggaagagacacggucuuugacuccuuuucccugccgccgagcuguguguaguaaggcacauugaggauauaagaauaguaagaauucauggcucagaaaaagaacuaggaggaagaggcacugggagucagagggagauacagacuuggaaagacugagagauauccaggaauacauagucuagaagaaauacauagucuaggagaaagcaagagcggaaacacagaaggcaagcugagaaagacacaaagacauaaacaaauauaaagaaagaugggaagauauuagagaaacauagacauggacggccaaagaaggcagugggacacacacacacaauuucauaaaagcacaggaagagagggcaagauacacccuagaagucuagggagagagcuccaaggauaaauuacuuguugaauaaggaucuaauguguagaacccauacugacaugguagcaggcacaucagcacaguuuuagggaaaugggagauggagaagacucacuggaggcucacaggccuguccugguacacacgguggaaaaauaugagacccucuuuaaaaaggaaguggaugguaaggaccaacacccauguuuguccacugaccuccagauagauagauagauagauagauagauagauagauagauagauagauagauagauagacagacugacugacugacugacugacugacugacugacugacugauugacugcagaagcacauaaagauaaaaucuuuguuuucaaagguaaagcacagaaagguaggagaaacacagaaacacagucagcccugaaaggaaauggagggagagacccaaggagacagagcuauagaaaaagccaugcaguguagacagagggaaaggaucggugcucagcucuucagguaucaccuccaauagaacagauggggaaacugaggucugggaguggugagacucaaagguuccugaaaacagacccuuguccccacccaccuguuacucuucucagaggaagccaguagcuuuggggugauuucaaaaguugggcggggauggcagagauaagcagugugggggcaggaguacugaccccccccccauagaacagggaggaacuaacggggcccacagucugcagacacaagugaagugggggaggggauaaagccggaaaccacgggguuucugagaaagucagauggcaagauacaacagauagggaugaaguuggggagcacagaagggugaaccccaaacuccuaugggagcugucaagggguccaagggaucuugguccugcauucugccucugcagaaggaaagaaaggaaggggaagagagaauaaaaagaggaaauggaggaggccuugaagaaugggagaaagagaagcaaaggcuugccggaggaggagaaagaggaagguuagaaggaaaguaaaggaggaaggaaagaggagacacagaaagaggaagagaaauaugguacaugaaaaggagggacaggaggaaagaggugcgagggaagggaccaacagagaaaggaagggaauacaagacaguggaaagaggaaaaggggaagaaaagagggaagaaggaagaccuggagagaccuggagaugaggaagaugggaggagggauaggagaggaagaagagggacucagaggcagcaaacugauggaguaguagagguaugacagacaagaggcaacaggaggauggggagagaucagaggaagaugggagaaagggacaaaggaugauggaagaagacaagagacaugacagccuagggagggauggaagggaaggggagaaaaauaaucugagagcccaaaaggagacacacagagucucagugacagauucggagaaagagaaaaaaaaggagggaagagccaggcggugguggcgcacgccuuuaaucccagcacuugggagguggaggcaggcagauuucugaguuugaggccagccuggucuacagagugaguuccaggacagccagggcuacacagagaaacccugucucgaaaaaaaagaaagaaagaaaaaagaaaagaaaagaaaagaaaagaaaagaaaagaaaggagggaagagaauguuucugugucucacaacccuuucuguccucacagguucaaccccaguguucccauggauuuuccuggucuaggggcccuggggaccucagaacccuugccccaguuuguggauucugcccugguguccucaccaucagauuccacagguuucuuuuccucugggccagaggguuuggaugcagcaucuucuuccacuuccccaaaugcagccacggccgcagcaucagcacuggccuacuacagagaagcugaggccuacagacacuccccagguaacuguuggguggcugccuuggcacuggcuggaagcugucaggguugccauagagaugguuagcuaguucacaguucugugaggucaucuuggaaagaguuagaagcucuguggauagguguaccgccccauuuguaccaauccucgucucugucugccauacuguagugagcacacggagaagccaggcuggaaguguguacgaagcugucuuauuugucacuugaccugcagccucuuggucucaauaucaaaaagggauggaggggaucguccuugcuauagugaccagagggacauagaacuccgaagucacccaagcagcaagagacuauuguaggaagaccagaaaacuagccaccauguugggacagacgaacaccauuucacuguaaaaguaggacuaccuaagguuugcuguucuuuccuuuuccucucuaccccuucaacagucuuucagguguauccacugcucaacaguauggagggaauuccugggggcucaccuuaugcuagcugggccuauggcaagacggcacucuacccugccucaacugugugccccagccaugaggaugccccuucccaggcccuggaagaccaggaagggaagagcaacaacacguucuuggacaccuugaagacggagcggcugaguccagaccuccugacgcuggggacugcacugccugcaucgcucccugucaccggcagugcuuacgggggagcugacuuucccaguccuuucuucucucccacugggagcccucucagcucagcagccuauucuucccccaaguuucauggaagccugccauuggccccuuguggugaggcuuucaaaaagggaccaggagguugaguugggcuagguggcucaagacauagcuaagcugaccgagccuugcuuccuuuucucuccaucuaccagaggccagagagugugugaacuguggagcaacggcuacuccacuguggcggagggacaggacaggucacuaccugugcaaugccuguggcuuguaucacaagaugaauggucagaaccggccucucauccggcccaagaagcgaaugguaaguaagaccacagguuggccugauaggacuggagacuuguuccugcccaagacaagaacccauguucucccauccuacaagaaccccauccaaugccgggcagugguggugcaugccuuuaaucccagcacuugggaggcagaggcagguggauuucugaguucaaggccagccuggucuacagagugagcuccaggacagccgaggcuacacagagaaacccugucucgaaaaaccaaaaaaauuuaaaaaagacuuauuuaagaacgccaccugggcuggugagauggcucaguggguaagagcacccgacugcucuuccgaagguccggaguucaaaucccagcaaccacaugguggcucacaaccauccguaacaagaucugacucccucuucuggugugucugaagacagcuacaguguacuuacauauaauaaauaaauaaaucuuaaaaaaaaaaaaaaaaagaacgccacccaacucauacuggucccggcacuauuauacuugcccucuuccuuauccuuuccccauagggaccauccaucccuuucccaugcaggaaccccgcuaccuaccuagaacucccauccaaggccaggaauuuuuacagcuucccaagggauucuuguguuuguuuuguuuuguugucugauuuauugauugauagauuugguuuguuuuuuguuugaaauggggcuuugcuauauagcccuggguggccuggagcuauguauacgauacugguuuuuaauuugcuaugguccuccugucucugucucuugagugccaggguuacaccccugucuuccuccaagacauucugauauguggucaaagucuaaaacuagagauagaagaagucuugcauagcuauagaaaagaaacuccuugcugggcagugguagugcaugccuuuaaucccagaacuggagacagaggcagguggaucucuugugagcucaaggccagccuggucuacagagaaaauuccaggaaagccaggcuacacagugaaagccugucuugacagauaaauacacagauacauagauacauagaugaauaaacuucuuaucccagauaggaagccuuuccuuaauaggacucucaucccuuaagcucuuuucucaggcccuguaaggcccuguccccgaauccuaccucuccccuacccccagcacuaaucuccuguccuuuuauuccucagauugucagcaaacgggcaggcacccaaugcacuaacugucaaacgaccacuacaacacucuggcggaggaaugccagcggagauccgguaugcaaugccugcggccucuauuucaagcuccaucagguaugcuauccuccauguugcuuccuguccuccaagcacacucccggcuccucauccagcccucaucuaccuugagcugucuuccucugccuuugcuuccucccucuuugcuccucuuucucuucucagaaguuguguacuugcgccuccuugcccaauuuccacggcuuccaccucaagccuccuuccaucuguccucucuuuccuccuugccaccucccgugauuugagucuuggcuaccucuuaccaguguaggaggauauucugagcugagaucagggccacacacaagcacaggucucaccucccuagcacacccuggguauauuacucuagccauugaacuaauuccccauucuuaacaaagugguguuaagagacugucccuagcccagcuacaucagcacaaagggcuggagcugguaaccccugugguggucuccguuucuacaggugaaccgcccacugaccaugaggaaagauggaauccagacgaggaaccgcaaggcaucuggcaaagggaaaaagaagcgggggucgaaucuggcuggagcgggagcggcugaaggaccagcugguggcuucauggugguagcugguagcagcaguagugggaauuguggggagguggccucaggcuuggcacugggcacugcagguacugcccaccucuaucagggccuaggaccugugguacugucagggccugucagccaucuuaugccuuuuccuggaccucugcugggaucgccuacaaccuccuuccccaccgguccugcaccuaccaccagcagcaccagcgugaucgccccacucaguucuugaagguacacagaauagccuugaccuuguggcagaggagacccccccuuuuuuuggagacaggaucuucuguagcuauguagcuaugaacuauguagauaagggugaccccacauuucccauucuccugccucuaccucccgaguacugagauucaggcauguauugcuaugccugacauuuuccuuccuuucaguuuuguuuugugggguuuguuguuguuguuuugagacaggguuucacuaugcagccuaggcuggcuuugaauuccuuauguaguccagacuaagcuccagcuugagauccuugugccucaguuccugagugcugggauuacaggcaugugcuaccgugcccguuucucccuccucuuagagccacuggccuuuacagcccaaccaucuccuugcccugcacccuuaaagauuuuguaaaauaaaaccaccuggagacaugcgcugguauuugguuaaauaaaugucagugucaaguggagcaugg

SEQ ID NO: 9380 - RNA, 14295 nt, Mus musculus
cagagccagccucagccccaaccuaccugccuuccagucuaccaggaaagaugugugauccaacaucugaaagucagguaaguguggggucguggaggcuuuggggcaugaguauugaccaggcuggggguacccaaccugggucugcugacuugcuuuccuucucagggacacccuuguggcuuuagcuuccuugggcuuuucuuaaagauaaccagagggcagcagaagcccugcuugggcuuguggagggcucggguuuaaggguuggccgcucucucugggugcuucacuggggagacaguucagcuucagacacguagagacacccaaaggugguuccuggagaaugcccaugaggcacucaggacagagcugugucagaagggcccccgagaaacaaugaccuugaagcuggucaaaagacucagaggcccugaaaggcuggagggaaccuuuaagaggacucuggagcagaccaaaggagggaggccgugcuguccagggcacugacuacucagagaaauggaugagcuuauuuucuagacccucagcacugggggugccccaaaagcaguacuucgggggaaccaugcagauagaaaugcagauugcaaaaguaaaaauaaaaaauaaaaaauccuagcugggugugguggugcacuccuuuaaucccagcauucaggaggcagaggcaggcagauuucugaguucgaggccagccuggugaguuccaggacagccagggcuauacagagaaacgcugucucgaaaaaaauaaaaaacaaaucaaauaaauaaauaauaauaaaauaaaauagaaaauccugaaagucagugaccggaacugggaaaugaacagcuuugcuuaaaccauuaaaauaaauaagaggggagagaugagcacagagauggaaagagaaagcaaaugugcaauaaaaaucggcuauguucagggcugcugcuucaaucagauucagaaaauacuaguaauuucucuuuacaccauagacacgaggagaaaagcauaaaguaguuauaucaggaacuaaacagggcgcucauacagauucaacaaacauuuucaacaggacuauuuuuaauucauguguauguuagugcagcugccuauaguggccagaagagggcaccaaaucccguggagucggggguuacaagccuuuguaagcugccuagcaugaguacuaggaaucaaauucugguccuuugggaaagcugugaacacggagccccaaauaggauuggaaaaccuaaaacaaaauauacagcuuucucuuccaggggccugaaugccccuuaguuacuucuuugguuaguugguugguuuaggguuugggaaacugacuguuucccaaguagauaucugaauggcucgcaugcacagacauuuuuccuuuaaaacaauuaauuuugugccaggaggugguggcacaggccuuuaauuccagcacuaggaaggcagagguagguggaucucugaguuugaggucagccuggucuccaaagucagugugaacagccaggacugcacagagaaguccugucucaaaaaaaccagacaaacaaaacccccauuuuuuaugcuauguguaugaguaucuugccugcaaugaauacauguguaccacguguaugcagugauuguaggggccaguacaguuacagacaguuguggaccaccacgugggugcaggaaaccgaacccagguccagcaauauacccucguucuguaguuuuacuuuguuuuggagaaaaggucucaccgcagugcuuaguugaucuugaaacucgucauucuccugccucagcuucucaaguguugagauuacaggggcacagcagcacacuuggcgucauuuuuuuuuccgagacaggguuucucuguguagaccuggcugcccuggaacucacuuuguagacucagacaucugccuaccucugucuccgagugaugggauuaaaggugugcgccaccacgcccggcucuuccuuuucuugugacgugcguuuggguguuuugccuggaugugugucugugcauggauucccuggaacugcagauacagagagcugugagccaccaugugggcgcugggaaguugaaccccaguccuuuuugcaagagcagucagagcucucaccucugcaucggcucucuagcccuacccagcccacagcuauagcugcagaucagaaaaggagggagcugggggguugaggggugcucugaaucuugucuucacaagagauaaauuccacuuuccuagucuucuccuuucucuagcaggaggaaaaggaagggaaccccagccccugacuaaagcacuuugucaccuucagccccaaacccaucagccugagacugaugcacaggaggcaggccaguuaguuauucucugggccccucuauuuugccuucuguagguuaaucccaccgcucccagugcuggaaagugcaagcauugugggaaguuaaaaacgugccaccaugucuggccuuaaauauuuacuuuaauuugauuauuuuaugagaaugggagugugucggugugccuccuguaugcaguauccuaagcggccaggagaggggagaagaucccccggagcuggaguuagagcagcuaguugggagcugucacguggcugcugggaaucgcacccugaagccagugcucuuaacuccugagccaucucuccagucccuauuugauuguuuccccccacuuuuucuuuaaaaagagauuuuauuuauuuaauguaugugaguacacaguagcugucuucagacaccccagaagagggcaucugaucccauuacagaugguugugagccaccaugugguugcugagaauugaacucagauccucuggaagagcagucagugcucuuaaccacugagacaccucuccagccccuagagcaacaacuuuacagagauuuuucuugaaggaguuuuccccuuggaauaaggaugaggaggaucauggcgcuugggcaggugauggaaacggagaagaacacuuggaagugucugguggcaauuuggcuuuuuccgaguuuuaagguuuguuccuuuguuguuguuauuguuguugcuguuguuuuuacauuuuaguuauggagaagcagcagccagaucccuuccccgugucuuaucuguagacuugaccacauugugaugacuguaaagaacauugaagacaccaccauguuuuauuccaagauccugggcauggaggucacuacuuucaagguaaucaugucccuauauucaaaacuucaagugcauuaaaguguguguguguuguguguacauauauauauguauauccgcugcaucugcagguguaggccagagcucugauuuagcuagacagaaaggcuagggagcccaaggagacucccgucucagccuuccagcacuggguucagaguagaugcugccgcacugacguuuuuacacagguucugggaaucugaacucagguccucuuccuguguugcaaacauuuuacuaacuacgccaucuccccagcuuccuccauuaaagucugaugacauuuuauggcaaaggauaucacucagccaauagauugcccuauacacacaacacccuuguucauaccccaguaccccguaaaccaaguaugcagguaacuggagagauggacacaagagaauggaaaguccaagaucauccuuggcuauuuagcaagauggagaccauccugggauacaacauuggcuauuucuuugcuuacuuguuuuuugagacaggguuuuuuucuggauagcccuggcuauccuuaaguucugagaccuccugccucaaccuccuaaugcugggauuaaaggcauguacaacuacugccuggugagauacugucguaaaaauaauuuauaauaauacuauaaaucuaauuaaagggcuguggauuuguuguugcuuuaugacaguuucuuuguauauagcccuggcuguccuagaacuuacuuuguaguagaccagucuggccucgaacucacagagauuuguuacccuauaccucccaaguggggggaauacaggcuugacuguaccaccacugccuggcccugaggggacuuuuuuuuuuuuacacacaggugcuguauugaguauuugugauugauauuugccuagcaugcauuaaauacugagccuggcccaaaauguuuuauuuuauuuuauuuuauuuuauuuauaaacuccaagcccccagacacaggaaauaguagagaaaagguaaaaggaucaauggaagagauuucaaaauacaaacaaggagacauuuggagagagggucaaagcaccagagaacuaaagcgagaggucuuguuaguucaaggucccuggucuaaaaaaaaaaaaaaaguacaagagaacuuugcagccuuuauacacaaagcguuaacuauguauucagcguaucaacauucagauaugcccugugggaauuguagaacaccacacugaaaaagugaaucuuaagaguuggccaagagauuaaaaaguggcucaucuacaaaagaaaaagaaagaugcaaauguuaggguucuugagucccaccagaggccaggaaacaauagaacuauacuuuuaagauucugggaaagcacuccugccccgccuccagcucugccucagcaucucuccauguggucccuacucccagaacaaaagccguucccagccuuaaucagagaagccucucccuccaaagaaaggcgaugaauacauucaggcuuccuaagaugcagagaauaacaacagugcggagcccagcccugcacaagauauuccaccacacacacacacacacacacacacacacacacacacacacacacacacacaaacacacaccgccccccccccccauccccaccaggcuugggaauguugugggaaaagggauggaaaauuugcaagagccuucagggcuaggagguaccacucucuagaugcuauacaauuauugcaaguauuaacucacaguuguaguuaccuggacugggcccuuagagacuggcacuaucaacaggaagucaauggagggggaaggguucauggggcccuaccugcuacuucugagcuauuggcuacugauagacucuggggggaagggaccauugucuuuaauuguguacccccgacugagcccaccaggccccaaauggauagcuuuaaacccgggauuauagagacaucccuuguuaaucucaguggggcacuaaacaaaguagucuugaaagugagagagagauuugugaagaggaggaggugcugaagggguggcagggggugggggugagagcggcugcuaugcauugugaaguggaaaucaccuaaaaacaaauguaauuaauugaaaaaugauucgggguuggggggaggggaaucaaccuaaaauucuauauucaauugagcugcaaauccaagguaaauauggauuugcuaaguauccauaaguauugcuaggucaaaagaccugggaaaagugcucugcggagcugggggugaagcucagaaguagugcuuacuuauccagugagcaagagaaucuaaguuucauugccagcuucgagaugaacagagaaaacgaggcauaaaggcuggcaaggugacccagcagagaaacggaucugcugccgagucugaggcucuggguucgaucccaaaggagaaaagcaaaucccaagacuugucuucugaccuccacacaugugccacggcacacacacaugcaugggcacgugcgcgcauuugugcgcgcgcacacucaacauuaaaucaauaaauagaaaguagggagcaacagaguaagauaccugauguuuuccucugcccugcccccucccaauaaaaucauaauugagcuagaugggaacaagaaauacauacauugaaauagaaugguccccaagaagaaaaucccagcuaucuagaguaaagucaauuaagcaugggauaaggaaugguuccagauggaaggaaaaggggagguguccucagauuucacacugucuugagaauauggaacagcuucaaaaguaguaaaugcaaagagaaaaaaauacuuauaaagaugcccugaagcagauagcagugauguuugcuaugucgauaucauggauuacaguguuaaagagaagcagggccuggaagguucuuccaccgggguagcccgccagcacgcucaacaauggauaguacccauucugcuuuaaagaaaacaucuaugcuacuuuugcaaggacagaaaagagagguggagagugagacaaagagagacagacacagagaaagacagagacagaagauguagaaacagagaaacacacaaagacagagagaaaggagagagagagacagagacagagacaaagacagaggagagaggaaaccaagcuauaacaaacauggaggggcuggagagauggcucagcgguuaagagcacugacugcucuucugaagguccugaguucaauuccuggcaaccacaugauggcucacaaccauccauaaugagaucugacucucucuuguggugugucgggagacagcuacaguauauuuacauguaauaaauaaauaaauauuuuaaaaaaagaagcaugggaaaaaaugaaaccaauguaaaagaagcugcauauugccugauucccauaauauaagcaagaaaagacaaaauuauaaaaacaacagagggaaaugaagagagaaagacucagcaauuuucggaccuugacauuauucuaugacaguaauggugacaauguguccuuagagaaccaugaaagcacacagaauguccucugcccccucagggaugaacugugacagacacgauggaaugaugugugcuuuaucagcagugcuuacaggaauggcaacguguaucucagugcugagagggugcgaacagggaccucuguguaaaucuuggcgugggggaaagauuggcaccuucuucugcuuugcugggaauguaaaacaucucuaaaaauuagcauauaaauugaaaagggucauggaguggcagacuguaaaaauuuuaaaucugaagaggacccucugcaaagaggagcaucacacaagagcagguuggacagccuucagguccuaaaaggaucacacugaguaaaagaaagaagaccaaagccgggcgugguagcgcacgccuuuaaucccagcacuagggaggcagaggcaggcagauuucugaguucgaggccagccuggucuacagagugaguuccaggacagccagggcuacacagagaaacccugucucaaaaccaccucccccccagaaagaaagaaagaaagaaagaaagaaagaaagaaaacaaaccaagaguucaaauccccagcacccauaggagaagccagcacauguguauuagcccagugcuguggagggcugcugggauuugcuggccacuagccuagcucgaaguucugagagagacucugucuuaagagaauaagcacagaccagcugaccuccuuggccccuguauacauaccugugugcacacaaacacacacuaauauauaaaauuaaaaguaugaaaacaaauuagcauauuucauuuguuuuaaaugauuuauuuaauuuauuugguggggggauugagacccagucuuuuuuuuuuuuuuuguauguguagggguucgagacaggguuucucuguauaacccuggcuguccuggaacuuacucuguagggcaggcuggcaucaaacucacagagauccaccugccucugcuuccugaggacugggauuaaagacgugcgccaccauacuauaucuauaucuauaucuaguauguauauguauauguauauguguauauacauauacacacacaaauauaggccuauuuuuuguguaugaguguuucccugcauguaugcauauccacauguguguguacugcccacagaggucagaagaagucauuggauccuuuacaagauccuuuacaacuggaguuaggauguuugugagcuaccaugugggugcugggaccugaacuuggguccucugcaagagcaacaagugcucuuaacuccugagccaacucacaguccccccuacacacacacacacacacacacacacacacacacacacacacacaccagauuucuuaucaagcaagaccagauacagggaagauagcaaacaagauauuuccuucuuuuuuggggggggggggagguucgagacaggguuucucuguauagcucuggcuguccuggaacucacuuuguagaccaggcuggccucgaacucagaaauccaccugccucugccucugccucugccucccgagugcugggauuaaaggcgugcgccaccacgcccggcuuuccuucuuucuuucugacagucuugggacuggaaucuagggcaucaugcaugcuaggcaaaugcuacacugcagggaaacaccaccaguucugagauagauauuuacuaaaagcaacagccuugacagaacuauccauuggaccaaacuguccuuuggguguaaaaggacaauguagucuuuuacugacuguguggaugugguauucacuguaggaauggagaaagagauggggaaauuagaaaagaaaugcccagugcuuaaaaggaagggauguaaauaagacaagaugauagagguuauuuagaaaaauaagccuauuuuauuccuuagcacccuaaaaaauacacauggaaucaagcuauuuagaaacuauaaagaaggggauggagagauggcucagugguuaaaagcacuggcugcucuuccagagguccugaguucaauucccagcauccacaugguggcucacagccaucuaugagggaucuggugcccucuucaggcaggcagauauauaugcagcagagcauucauacauuaaauuaaaaaaaaaaaacuauaaagaagccaacagaggaucuacaguuaagacagacuagccgggcgugguggcucaugccuuuaaucccagcacucgggaggcagaggcaggcggauugaguucuaggccagccuggucuacagaguaacaggguuacucuauagaguuucucuauacagagaaacccugucucgaaacaaaacaaaccaaaccaacaaaaagacagacuaguacugggggaggggguagcaauacuaucgagcgaaacgcuccucugucuuggccgaaagaagacaaauauguggcagugguaaauggaaagauaggggcuggagcaauggcuuaguacauaagagcugcucgacuagaggacauuguuccguuucuagcacccauauggcagcucacaaucauuuguaacuccaguuccaggcaacucaacauccucuucugaccuccaggaguaucaggcacacacgugguccacacacaucccuagagacaaaacacccacacacuuaacauaaaaauaaauccaccuuuuaaacuggaauagugguacgucagagccugcacuuggggggggggggagagaagcuaccaugggguuaaaugagacagcugccuuuuucucucaauugaagaagcagccagaugaaaugugucauuaggaggaaaugaauaggcacaaagucccagcucagugggggcagggagguuccuagaagccccaccagcaagcaccucacugcagaaggcaaguaauaaggucucuaggacacaauggccuccuggggaggaaugggggcgggguggcgagagguaaugagugagcuuuguuugcuugguuugguuugauuuuguuuuguuuuuggaagaaggucauucuguguagcccaaggugaagucgaccuuucuguccuccugccucacuguccuaaaugcuggggcgauuauaaguguacggcacccuggcuugagaugaacuuuuuagaaagcuuggggacguaccguuggcuguuguucuuacaagaaaaaauaaaauacgauaaaauaaaauggugaaggaagacauguaguggguugaggcacagcacuugaagccaagaguuucaggauagucuaggcaacauaaugagaucccaaagaaaggaaagggacacagagacaggaaggagggagggugggaaaagggaaggaaggaagguagauuggguagacaaauugcuuucucugccauggguagguuuuaaucauuugauguuauggacacuuuaauaagaagcaaaacacacgauggccccaccccccccccucugucucaaauaagcauggugauuggcauacacugguaacaccagcacucaggagccuaaggcagaaaaauaacaaguuugauacuagccuggggcugugcagugagaugggguuucaggaaaagaaacagagaaggaaaaagaaaagaaauagaagcuggggugcuaaacaguugguacagcaguuuaaaaacuugcuauuuuuccagcugacccgaauuccaauaucaacuuccacauuguuuuuguuuuuguuuuguuuuuuuuguucuguuuguuuccaagacacgguuucucuguguagcccuggcuguccugaaacucacucuguagaccaggcuggccucaaacucacagaucugccuugcuucugccucccgacugcugggauuaaaggugugccuccaugacuggcuuaaaauauauauuugguugguugguuuuuuuuuuuucuuuuuuuuuuugauuuuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccgguuuuuuuuuuuuuuuuucaagauaggguuucucuguauaaaccugauugucuugaaacucauuuuuuaaaagauuuauuuauuauuauaucuaacuacacuguagcugucuucagaugcaccagaagagggcaucagaucuuguuacagaugguugugagccaccaugugguugcugggauuugaacucaggaccuucagaagagcagucggugcucuuaaccacugagccaucucucuagcccugaaacucauuuuauagaccaggcuggccucgaacuuaaagagauccaccuggcuccugagugcucagauuaaagacgugcaccaccacuacccucagcaccacaucucccagaggcauuugaugucuuucucuggccugugugagcucuacacacauguauguacauacauacaaucagacauaugaacacauuaaauaaaaauaauaaaucuuuaaaagcauuuaaagccgggcagugguggcgcccgccuuuaaucccaguacuugggaggcagaggcaggcagauuucugaguuugaggccagccuggucuacagagugaguuccaggacagccagggauacacagagaaacccugucucgaaaaaaaaacaaaauuuaaaaaugaagcuggacauuguuaugaaacauaacauacauaauacagcaaggggaggguaccuuugaugggccuguggcaagauguaccccugagaaaagaucaggucuaaaagaauuuuacuggggaaaaaaaagggaauggggaccuggagaagggauagaggcagacaacuggacagguagauagacagacggacagggaacagagagagagccaugccaugagggcagaaagaggggucaggggcacaaagaacaaggaaggaauacagagagcgaacugagguggcuggcauucuaauccacagcacaucgcugguggcaggugaugauggaagcaguugcuagguccccgagagcaggccaguggaauugccugggcuaacaggcauggcaugcauuucugucaucucaguauauggggauuggaagcaagaacaucaggcuuuuaaggccagucucugauagacaggaaguuuaaggcuagcccggaucaccucagacuuugucugugagaaaauggugguggugguggugguggcuaaaggcauucaucagcaagccugacuacccaccucccugaauuagaucccuggaacccacaaggccgaaggagcaaauggauccugaaaguuguccucuggcuucugcauauaugccauaacacacaacauccaccuucacacaaauacauguaaaacaauuuuuuuuugagacacaguggcacuauguaguccuagaugagcuggaacccucucuguagaccaggcuggccuuggauucagagagaucugcuagagagcuggcuuagauguugaaaagcucaauuaugaaguuuggguggaguuucacaaacacggccaccuccagcccuggggaaucugacgccuucuuuuggccucugcacgugcacacaggcacgcacagacugacacaaacuaguuguuuuuaaaccgcagucuguuagauggggcaagggcuauugcguagcagcccuuucuccuuuucugcaccgacagggugacuugacuucacucaucuuggcaguuuaucaucuccguuguuuucucuccuaaacagggaaaccggaaagcauuguguuucggagaccaaaaauuuaacuuacacgaggugggaaaggaauuugaccccaaagcagcucacccuguuccaggcucccuggauguuuguuugaucacagaagcaccccuggaggaggugaucgagcgccuaaaggugagcacagcgccgugccuacuaagagagcuacugcaaauacucuggagauagaaguaugacccaaagagccaggucuuccucaaaccucagacccgacagaucccauuacauccgcauccugccugcacacaauuaucuacuuguucuuuugaugaugucgcuuucauguaaucagauuuuguuguuguuuuuccgagacaggguuucucugcguagcccuggcuauccuggaauucacuuuguagaccaggcuggccuugaacucagaaauccgccugccucugccucccaagugcugggauuaaaggcaugcgccaccaugcccggcuguaaucagauuuuaaagggaaacacaacuuguugaacacccauacaguuagauuuauuauauguaaguaugcugaagcugucuucagacacuccagaagagggggucagaucuuguuacagaugguugugagccaccaugugguugcugggauuugaacucaggaccuucagaagagcagucagugcucuuaaccacugagccaucucuccagccccagaaucauagaguuuuacauucaauuuuucacauaaauugguauugaauauauuuuauacacuuauccacuaccaaaacuaaaacaacaaacaauucaauaucaaagauaucaaagaagucacauauaauguucuuaaccacugagccaucuuuccagucccuguguuuaaauucuuguucacuagcacugcuguugccccccauuuuacaaacuaggaaacugagguucauggcaaucacaccuucuuuacaaggccagccaucuggagguagugaggucgucugggucacuacugggaaugaguucuugguguagucguagcaugugugaggcccugaguucaaacuuuagaaccugggagaaaggaaggaaugaggaggagguuuuugguuuuguuuuguuuuguuuuuguuuuuguuuuuuuguuuuucgagacaggguuucucugcauagcccuggcuguccuggaacucacuuuguagaccaggcuggccuugaacucagaaauccaccugccucugccucacaagugcugggauuaaaggcgagcaccgccacugcccggcugaugaggaguuuuuaaagaacuaaguuuuggucuuacauaucugugacaaugacuuuuguauuuucuguugacuucauucaggcuuuugauguccccauugaagagggcccaguauucagaacaggagcaaaggggccuauucuauccaucuacuuccgagauccggacagaaaucuccuugagguguccagcuaugucacuucaugauugacacuggcuuuuucuucuauugugauccacaaaaugucauuuuaccuaauuuccuacaaaucccagagaccucgaagaacugagaacuucggcaacagguuuauggugcaaacguuugugucuagaaagccuccauucaagcuacuccaauaaacgacaaaucucuccauaugag

SEQ ID NO: 9381 - RNA, 471 nt, Mus musculus
cuuuuuuuuuguuccuaaauuuuauuuaugaauuaauacaaaacauugcagaccgaugugucuuaauccucguccuccucuuauccugguuagucuggaaguaacucguaagcagcucguaacucucuuugcuguuggcgacaacacgcagccagucuccgaggcuguucuucaaauauuuuuuggugagauauuucaaauaccuuuuggagaaaggcaccuccaaagugacaaugaucuugcucuugcuccguucgguggucacaacuccuccgccgagguugccagcuuucccauucaccuugauucucuccuggaggaacugcucaaaauuggcagcauccaugauuccaucuucaacagggugagugcaguccagggugaacuucaaaaccugcuucuuuuuuuuugccucccccuucgccacaagcuuuuucacaggcgccauggcggcagaggaggcagaaaggu

SEQ ID NO: 9382 - RNA, 9594 nt, Mus musculus
gucuaaccagcaacauuauuuuuuauucuuucuuguuugcucaguguuuauuuuccuucagguugugagacaaaagugucaccaagauaauuuaaaguagauaauuuaaugucaacucugccaccucaaaaauugcacaaggaacccccccaaaaucaugcaaacaauauucaucaccaaucauccugaaaccagacucauuaaagaaaauggagagagugaagaaaaggagaaaguuagagaaaacuguuauguacccaaauucuguugcuacccccagaccuuggcugaauaagugcauccauuugguacagaagagccagugcacaggucugaacugcuaaccuugggagggucuuuaaagagauuagcacuuaauugcugucuggcacccuuugcuauaguaaguuacaguccucauagaaaaaucacugacccugaagcuggauuagggauguuggcacacauauaugaucuugacuacaaugaccaguccagcucacuaacauuccaaucuaauaaccauuugccuaaaaucugacugauggagucagaaauguuuuggcuggaagugaccauacucuuaaacaagaaacgaaacaaauaggaaaucaucuuuuuuccucaaagagcugcuguuaguucuauagaucaccagguuggcaagacucagcgguuccaggauguuagccaaaguuccaauugcuacaaauguaguagcauaugggagcugcaagaacuccuggugauucuucaaaccuucacauuucgucaugaccuaauuaccaagagucauuuaguaauuuaucuccuugccaauacucaauaaugaacauuaguauuuggucucugagcagguccaggacugaaauaagggccccagauagacauggcaggagacaggggugagcuuagagauuuucuguuucuuccaccccacagcaggaacuguggcucagccccagaguucauggcuguaugcaugcuaaucuagcuccaagaacucgacacuucugcucacugcuugugggacacaacucaacgcacaggcaagugugggguccacccaaacaguagcugccaauguuggggaguuugacaaccuaaccuggugaaagccccgugguugaacuuaacauucugcaccuaauuucccuacugcugucugagccuuccucaccuuccucacucagggaauaaggaaagcuuccuuccuugcuauggcccaagaugucccaaagaccugucucccaucaucucauacacuccgcccaaucacauuauuccaggcucuauuucacucagaucuuuaaaacugucaucugguugggaacacucuuccugaugacuuugccccucccuuuugugcaagcucaucuggcccuuugcuuuucuuccuagcacucaucuuuaacucuauuauauacagaugugacuucaucacacgggguuagaccccaacaaaucugucuugaacugucuuauguugaaaaugcauaaauauaccuaaccuaccgaacacccuagcuuagugucaccuaccuuaaaugugcccacaacgcugacauuauucuacaguuaggcaaacuuaccuaaugcaaagucuauuuuauaacaaagugacuagcucacauaauuuacugaacaccauacugaaaggagaaaaccagaacuggguauaugcgugugguucgcuaccacuggaaggucaaaaauuuauaaaguugaaaaauuauaaagcaaauucuacaccaaggaauggcuguacuuucgucucccaugugcuugccucuauugggaugccagcccacagggguaggaauuucugucaguugaagccacagcuguaucccuacuucccagaacagcucagaacgucugucuccuguaugcuugccucugcugggaugccagcccacagggguaggaauuucaguugaagccauagcuguaucccuacuucccagaacagcuccugaccacaguugguacccucccuccuucuacugacugcaugccuacgugauacaucacagcagaugcucagcaagugcuuguugaauggaugagcacaucacugcacaaucgaggaacugguccccacuccacuggaggccugagagcucccuacugccuccuggugggagagcugagagcccuucaacacaaccacaggaauuuaauuuauaacgcaagacuggagugaaggaggagggaucagugggcagcacagggugacagaacccuacuuuugcucucgucuccagacgaugaccaugccacuggcaucacuggaggccagcagacucucgucacaguugaagcugacgucaagcacgggcgcgcuguggcccugcagcuuguuaacagcagccuuggcugcccgcuccacgucaaagaagugaacgcacauaucuucacugccugucacuguccggaugagagggaaaggcgaucagggggcuaggugacacccccacuaugaagucuugagguuaugugaggugugagggccucagguagcuugggguagucuacaaggaaccaucccuagauaggagcucaucugccuccuuugguucggugaggaguaugugagguuugaggacagugcgggcucugugucucagcuguggcguucucaaacuguuuguggcuccauguuuaaagccucuaggcauaacacuguuagggcacaagagaccacagggcccaggaaaucacgggugucaugcuguuggaaccaggcuggcugcagguccucagagccuaaguacuuacccacacaggcccccuggcggaaggacaugagggggcagaagauacugcguacagggugggaacucuguucaauggggaagcuucucuucagcuguagcgccccuucguuguccaccacucugaagagaaagcaaaagagaaggucagggcacagccucagccucaggagacgacgaguuaugggccaguauacgcucugaaucccgcaucucagauauuuacaauguacaaacaauuucgauuuuccuuuuccuuuggagacagagccuuauuuuguuguccaaguugagucugagcuccugcacucaaugauccuccugcaucaggccuuugagugcuggcaucauagguguguaucaucacgcuaacuuuucuuuauacuuauguauuuucacuuuauguguauggcuguuuuaccagcauugcgucuguucaccacguguguauaguacuagaagaggccagaagagggguuagauuccuggagcuggaauuacagacagguguaagcuggcaugacugcugggaacugaaccucagucgucugaaagagcaacaaguguucuuaacugcugcugagccaucucuccagccccuuagguuuuguuugcuuguuuauuuuaggacagggucuugcuguguaguucaggcuaaccugaaacuugcuauguagguaggucaggcucaucuugaauucacauagaucaaccugcuuccgccucucaaguacuguacaugagcuuauuaugcccagugcgagcagcacaccuuccaaaaggagcucugccuaucauuuuauacaccccagcugaagaaucguaccgugacagaagcgagugggaagagugaauucuguccccaaaucaaaucaacacaauaauauaggcuguggguauaucucaguggugacguguguuacuagcaugugcaagguucuggguucaauucccagacaaaagaaacaaaaauaaagaaagggaacuguagagaugacucaaguggauaaagacacacgcugccaggcugccaauuccuagaaccuuggcugccaauuccuugacuuccauuccuagaaccuacaugaagaacagaacagacugccacaaguuguccucugaccucccuccguauaugcuccaugguaugcaagcauacacacacacacacacacacacgugaaaaauucaaaacaaggaaagaggaauaggugcuggugguuuuuucuuuaguuauaauguugagaguggaacccacagccuuauacaugcuaggcgagugcucuaccacugauugugaagauuaaauaaggugauauauacaaagugcuuugaaugggaccuagccauagcaauguucauguagagucuuauuacugcuauuccuauuuauguugcuauugauaucaccauuauugcauaguauauauauauauaguagguaaggaaucacuauauaaauauauauauauauauauauguauguauauauauguguauauauauauacacacacaaauauauagacauagacauagauauagauauauaguguguguguguauguggcguguuucuggggauggaacacagagcucuguaccagcuagaucagcacucugccacuaaguuacaucuccgacccuauccucaucauauuaugagguccucuguccuuggugaaauuaaugugacagagacagguucuuguuccacucugggggaggaacccaccuguagaguagcagcuuguugaggcaggcauugaugagcagagaggggucccgugcuucacggcugacccaggaccgggcagaaaugcugguuacagggcugccuucaugcacuacuagucgcuuggcuuuggucagcuuuccugaaucaguggaggacaaggacugaguccugggagaaugaaaaccagggguaccgaacccgaagucuguggucugccuaccuguggccaugucaaagagaaaggagaagacacugccgcggucaucgccugcccagagcagccgaccaggggcaucaaaggacagggcgaggacgcggccggugagcuugcuggagccacccuucacuuucuugccuguggagauguucaugacaugcacguugugcuuggcguuccccaccugugggugacaggcauacaccaucauucugagccaucuaguccuuuguguuuaacacagugggaccaggccagguauaccagaaggugacccaggcacaauuccuacuccuuagcugugcccucaaaaugcccacaauaguuggucucacgagaccaaagcagucuuagucucugagucugaaaaccucgccuugugacaccuuuacaucuuucccuuauacccuggacuguccccuccugaagcccaugagcugcuaccauuacaaagagacagagccccaagcgcuagcucacucauggccuguuguuccccuauauuucaacucccuaccccccaggucaugccagacuuuccauguccuuccucugcccucuggccagucuguccuggagucugacaacaguggggcugccacugacagacuagaugagcuuucagccucaucauccugccccauagcagcagccccuguagacagaaaacugugagacugugguggaugggaccaguggaaucccagggcuaggagacaaccccuccaucccagcucgggagucuacacacaagucuacacagcaaggccauuccagaccacaaacugugcuuuucguuggucucuuucccuuugagucugaccacaggacggcugggauaggacuuggggguauuaagccuuauucucuagugccccaggacagcccuccagacccagcaugcccgcccuuggugagcagguguccuggagccugaccacagugagguuguuguugacuggcuggaaggugcagcagagcaauucggcgccaucagggucagggaucucacggaugcagcggccguccucggaggcccagaugcgcaugguggcaucgagggagguggacacaaggaugucauuggagagggaccaggcgaaguccgagacgccacguguauggccccguagcacauggagcacaguggguggggcaggcaccagcuggcacagggagaugcugccguccagggagcagcaggccaggcggugccggucgucauuggcgaagcgcacccuugggacugcaaaugccaaggagccauuugugggagucaacacauucacugagcacaaggaacaguagccucaacaaaggacuuuccuuggccgacaaaggcaguuguaaucuuagaaggccuacugccaaaaugcucucuaaaucuuagcagacacuuugaggacuacaaaagucuuuugcaaugcaaaaauuguacugucuuauugaguacuuuacaauaaucaagcucucaggaguuugcaaaaccauccacacauuguggcccacuguggccucuacaagggaguuaccaucagcaaagguuuugaacucuucuaagagacucaaacacucaggcagccugcuacaaaggacucucuuggguuuguguagcucuuuccaguaccuacauuaccaaaaccuucuuggaccacuuugcaagagggcuuuugcauuugcuaaagguuuuuuuuuucuuuuucuuuuuccgagacaggguuucucuguguagcccuggcuguccuggaacucacucuguagaccaggcuggccucgaacucaaauccaccugccucccgagugcuggaauuagaggugugcgccaucacugcuuggcuuugcuaaagguuuuaucagugcuauuuccuccuucugagguauggugucagaggccuugcauucuagaaaaggaugccuuggguaguuguuugaacaaauguuuggugaugggcccuaccacccauuagcucaccugccucauccacguguuggucaaaaacaugguacaugccugcaaaggcauaguucucacucagcgacguguccccggccauggcccgacuugccucugccaccgacguggguaccacacugccaggaggccugagccccaacaggaggugggaaggggugauaggagguagguauggguguucagacugccacgucccagggccccucuccuccuggugaaucuccacccccugccugccucugguauguaccuguccucauagacugcacgguucauuugugccugcagcugguaggaaccucggcugacagaucggcgguguccucgagcccccagggcucuggggucaucuucaaaguccugcaaagagaagaggguuggggauggugcauaccucuaauuccagcacuuugggaaacugaggcaggaaggucaccgugcucaaggccugccuuggcuacacagugaauuugaggccagucugggugagauccugucucaaaaagaagagaaauugggcuggugagauggcucaguggguaaaagcacccaacugcuuuuccgaaggucaggaguucaaaucccagcaaccacaugguggcucacaaccaucuguaacgagaucugacucccucuucuggagugucugaggacagcuacaguguacuuacauauaauaaauaaauaaauaaauaaauagaaauuaaucucugagaugagcuuaaaucuggggccugacuucucgucaccacacauggcgccagccaccacugucacugcucacuugugugguuucaacaguuucuucacuagugccuuuguuucuguccuuccuuuccuguuccaaacauccuuaguacauacaugcuuuccucacaagggaugacuacuuucuucccagagaagcacucaaaucagucucucacuucugucagguuucgguguucccuccccagacaagucuucccuauuaagcacagcucccuccuuuagcucaaagcagugacuuuucauucuucuuggccauguugagaauagaaccaucagucucauacauacuaggcaaucacgcuaguuacugaacuauauccaugcaccaaacacuuguguuccuuuuugcuuuuuaagucuguuguauguuacuaucuuugcauugcuuacuauaccaugguaaauuaucaacucaucagucuuaccugcucuguguuuaucuaauucacugucugcuuaucaauguucauugacuuggcuucucuauucccuuuuaguccucuacugaccuggaacaguacuuuguacaucacugauguuugaccaaaaacuauggugacuacagaggcaggggagauacauggcggguggugcagcuaggagcucaccuccauucgaucaaggguuguucggcugcugcggacaaugcuguugcuauaggcacgagcacugccugguucugagaguggcccguaccguuggcccaauagcuggccccguagccucagguacugccgacgcaaugcuggggggugaccagcuuuggcauucucccgaagcagcuggcugcgccggcggauauacuggguccgaaacuguggaaacguugguguacgguaggcguuguaccugugggguccaggaggcagggcaggcagcaggcacaggacagagggaauaaaucagcucgaggugguacaagguuuggcagugacugggaugguaagagugaacaagagcagcaaagggggauuucucuugggauugugauggggggcaauuaugcaauaauuagugguuaugaugaaaagaucacucuagcgacaauauagucaauuugcagcucuguuggggucagucugggccagcuguaauaucagucuagcaugaugacauacgucagauugguaauguacaacaauggagguuagggucagauaacgguagagguuaguaugggguagcaauuguaauaauaguaggguagugauaucgagaaaaguuggggaagaggauaagcaaugagggacuagauaggaagucaccagccugacuuccacuacccacucaaagacagucugcgcauguccauuucaaaccgcauuuucccagcaugcucuuuagaaccggcuccagcccaggccacuuaaccgcaggacuaucccacaccaagcuacugcgcaugcucacgcagccgcaccagccaacuucuccgcccagcugcacuuaucgccauugcucaugcaccacaguaaguuccucucccaugggcuccaaccccacgccucaccucgcguccacugcuaauacuugcugccacaccgcggccauucccuggcuuccuucuuugguuugucugccugcgggagccugcagggcaagggcuuggaaugucagcgucccaggcagagaaaaucuaguuccgcccaccaggugacaguugccauagacacgaagucccuccacacaggugaugucgcgaaaucccacugggucguuagcguggucaucaccccagcccugccuuuccugggcagcacuccggugacucacagcagcaguucagacaugaccccgcccucuccaguugccguagcaacgccccucccccccauagcaagucuuguuugacauuccccacccaucaagccuucugcccuccgccuucccuuuucuaguccuagagcauagcucaggauccaggaccaccuccggggcuaccccuagcucuugaggcgccccccccccccggcgacccugagcccagugucaccgguuccuucucucucuucucccugucucaagcuccaggcaagauggcugccugcaacgagaaagagcugcggagcacagagcaaaucgauaggaaccuuucccggggcgugggagccucgcag

SEQ ID NO: 9383 - RNA, 21778 nt, Mus musculus
ucaguugcauuaacuaaagagcccccaguaacuuuuauaacauucaagaaauagagaaauacacauaccacagugaccuuuguauauggaaaguauaguuuagaaacaacaaaaacagaacgaggcuguggccucuguggggcagugccaaggcugagccacacauacucaaaucuggggagagagggccucaggcuccaacaugucuggggauggcaggcagggaauaaggucucauguguaggcccucauggcaaagaauggaguaccauugggguuggagcguuggagggaguauaaucaagauggagcuguggccucagcccccuccucagagucccacacuucagacuguagguaaucagcaaagagugcuuuggcccuacgcaagacacgcccuagaugguguuuacgaaccaggcggucaaaaugcauggcuagcucauuguaauccagcccauugcgcaugauguggucacgaugcuccagcaggauagccaagcagaggaagagcaugaauggguucccucggccaaacuccuggggugggggaaggcccauuggagguggaggugguacaggcuucccagggucucugggagaaccuaccucuugcauuaagggggauccuacagcuaugucaccagaaggagaagccuccuggguagauggaggagaugacgaagauggggaaucgggccgagaagagguggagaggaguggaucuggggaauucagcaagggcucagagagggacuuagagcuaaugaggguagcugggugggauaguuggaccagaugguccuuccugaggcccauguuaucccugaguuguuggagaccauccagacuggcuugucuuaggagacgccccccaccacuaggucccuggcuagaugcagcuaaguggacaacagcaucuucaaaagcaccgccuccuccaccagcaggccucagcaugugccucugacguacuggccguccccuguggcuaccaaagccagugucugcuacuuggcugggagguccgacgagcuccacuucguguucaggagggucagggggcagugaacuccaggugacuucuagcauucggagagcaucaucgaaggcgaauucacgcuugagcuccagcagcagccagcgguaacagaaaaagaggucaucggcaccugcuucuugcagguacugauagaagucugggucagcaugucucaauagcagcuugaggugggcaaacuugguggccauggcacggccaucaggguggaaguuggcagcuaagcgcuucaugaugccacagaagcauacaaaggcauggccuucaugguccaugacagcaagaauuggugaggccaggucacucauccccuggcaguaugauaccuguggauggguaacggcauagguggugagcaagucguguagggcccguaggugugggccauccucaggcccugcguaguagggaugggcucggucugugcggagcacauccuugaggacugugcugcggaugaauuccagguccucaggguucacucgcugggcccacucacuuuugagcugcucguacucucggcucuuacguuucauguaguccauccgcucacggccagucagcccaucuggguacacauuaaggagguaccgccauacuaccugccagagacagaagagauggggcugaguuucaacuagugugcugccguacguacccauguacgucaacuaguuaccacccaucucuugugaccucuguccuccuugugauaggucugccuuccugccacugggacauacccgacagagacccuccuucccugggauuucucuaucccaccuaugacuguguucuacugaacauuugauagagugugauggguucggugacggacugaggcggcucacuuuucgaagugaaggcuccacaccgccgugguagauccucaaacgcaacuccucaggccgggagagcugaccuucaugauucagguacguguggaacucagcaucacucagggggggcuuaaaaggcuucacaucuuccccauaagaccaacucagcaccugcuggaccuuagacaguguacgacccaccugggaaggaaaaagggaaagaagcuacagguccccugugcaggauagggcaggcaucaaccagcgggcucuggaaugguauuaucagauaagcccuucccuucaaccacagcuggaaaccacacccccaagucuccugaaaucaccugagagaggauggacuguguaaaaggcaaggcagcugucgucagugaugaucgcuucucagccaguagcacaucagauccaaugacaucuuuggggcuaauuaugucccagucuuccagcaaugggccugagcacacagaguaaagaacuaugagaacacgggugugaaccaugugagcccagauuacagggcgggguuccuuucuaaaagcuuagcuaccugcagggcaacaagcagccucgaucuccuccucccuguuucauccaaauaauaauaauaauaauaauaauaauaauagaucacucaugaucugucuuacaugggaacuauuucacaaaauagcugggaagucuuuaauauuuuaaugauuuaaguaacauuuaaacaauaauaucuauugagccuggcaguuacucuggagaccaagguaggaaaaucaggaguucaaggucagugccugggcuauauaauaagacucuauaucucauuaaaaaaauacuugaaggccugguaguacacgccuuuagucccagcaccugggagucagaggcagacagaucucugaauuuguagacagccuggucuacaagugcguuccaggacaaccagagcuacauagugagauccugucucaaaacaaaaacaaaaacaaacaaacaaaucuugaggaccagugugaguaaagacacuugccaccaagccugaaaaucuaguuuaguauggaacauacuuggaagaaauuguucuuugaucuucacaaugcacugugauaauguguaccccugcccccaguaaaaccaaaucaguuccuuauacucaguccuauggagauacuagcuauauauauaauuuuuuaaaaaagauuuauuuaucagacacccagaagagggcaucagaucucauuauggauagcugugagccaccaugugguugcugggaccugaacucaggacccuuggaagugcagucaaugcucuuaaucgcugagccaucucuccagccguuaaauauauauuuuuugugccuggagguaauaguccuggggaauccaaacccagggugucacaugcgcucgcuacccaagugcucuacugcuaagcucuaucaugagaccuucuacaaaacaacucuuuaaggcagugucauuaaguugcccaggcuggcccugaacuuauuccaguccucuugcugccucagccucaugaguagcaggaaugaaaggacuacagacaugugccaccaccuuccuuggcuuucucaguagcuuugaugaggaaacaggccuauagauauuuguucaaggcuccauaccuagugaaugaaagaagugggauaugaagccugugcccuaagucugugagccagcacuccucaucuuacauucgugauaguguuccccacugaaaugauaggaaaugcuacugccagucuuccuugacagaaaaagaccaaagagguuuggaaaaacuaguuagugaccaagauucuacagcugggaaaugguagguuuccauuucuaggagcacagccccauuuaccuuuccccagaggucagucauaucuuagaacaaggguucgugaggaaguauguuguauguguuagacaaaggauuagcugcuccuggcccuaacuaucuacuucucuaccauuauuuccccuggaguccauuuccuuuuuaaauuaaguauuuuaaguuaccauacaaaguaaugggcuucauuaugaaguuuccauaaacauggaucaaaauccuuucuucuuauucaccaccacccuguuuguugcccuccccuauucuuuauuuauuuucuuuuuugguuuuccaagacaggguuucucuguguaucccuggcuguccuggaacucacuuuguagaccaggcuggccucgaacucagaaauccaccugccucugccucccaagugcugggauuaaaggcgugcgccaccaccgcccagcuguccuccccuauucuuacccccucucacugguccccuucuguuuuaagccacauguauuccauuaucacuaccccuucccuuaagaugucuuccucaguccggagagauggcucagcaguuaaaagcacuggauguucuuccagaguucauuucccagcaaccacaugguggcucacaaccaucuguaaugggaucugaugccuucuucuguguuugaagacagcgacaguguacucauaugcauaauuaaaagaauaaguaauuauuuuuuuaaaaaucucuuucucaacacaauucuccccuucaaguaugugguugcagcagcaauggacaccuauggguaaguucaagaauucuuguuuauuuauguuuucuuuaaaauuaaaaauaaacugggcaguaguggugcaugccuuuaaucgcagaaaucaggaguaagagacagguggaucucuugaguucaaggccagccuggucuacagagugguuccagaccagccaaauugacagagaaacccugucuuggaaaaaauaaauaaauuuauguguauggguuuuugccuacauguaugucugugcaccauaugcaugccuggugcccagggcgcccagaagagagggcaugagauaucucgggacuggaauuauagaguugugagcagucauguggguguugggaacugaaccugggucuucuggaacagcagccagugcucuuaacugcuuagucauggcuccaacccaggaagauuucccuuuccuuuuacuuuuaauugugugugaguauaucuuuauggagguauauguaccugcagaguccuacugaagccuuggauuucccuggaauugucgagauugugaaccaccauaugugaaugcuaggaauugaacucagguucccugaaagaauagcaagcacucuuucauagaagcauuuauuuuauuuugaaugauguacauaggugugcuguguuggguuaugugcaugugaaauggagcugcacucggaauucagaagaggaucucauaugcccuggaacuggaguuagcagcaguugggagccccugacaagggugcuggcaacuaaccccugguccucuagaagagcaaccugcugcucuuaaccacucagccagcucuccagucccauuuuuuaaauuaaaaaauuacauuuagggggcuggugagauggcucagcggguaaaggcacugacugcucuuuugagguuccugaguucaaaucccagcaaccacaugguggcucacaacaagaucugacacccucuucugaugugucugaagucagcuacagugaacuuauguauaauaauaaauaaaucuuuauuuuaaaaaauuacauuuauugcuagacaagguagugcaugccuuuaaucccagcagggggcaggaauuuuuuuuuuuuuuuuuaguucaaggccacccuggucuacagagcaaguuccaggccaaucagggcuacaaagagaaacccugucucaacaaaacaaaacugaacaaaaugauucguuuccuguguagguacauguaugugcuauggugcauguguggagguuacaggacaacgcaugggagucacuuucucacucugccagucaggcuuaguggcaacugucuuuaccuuacuggcugacccaucuuaccccaguaggcacucuuaacugcugaaucaucucagcuaccgugaacccugugcgagcaugcgugugugugugugugugugugugugugugugugugugugugguagggcuagaaaccaaggcccccaugcaugugaaagguacuccauuaaccuaacuauacgguugaaaaucuuguuugagaaaaggucuugggcugagagauggcucugcgguuaagagcacugacugcucuuccagagguucugaguucaagucccagcaaccacaugguggcucacgaccaucuguaaugggaucugauacccucuucuggugugucugaagacguugacauuguagucauauacaugaaauaaaucacacacacacacacacauacacacacucacacacacacacacacacacacacacacagacacacacacacauauauauauauauauauauauauauauauauauauauauauauauauauagagagagagagagagagagagagagagagagugucucacuguaacccaggcugacuuggaacuugauucuguggcucaggcuagccuugaacucauggugauucuuauacuucaguuucuugaggguuauaggcaugagacuccagguccaaaaaucuuaauagacaucaacugacauuacaguguugcaaaagguaacaacauccaaugaucauuccauuaugcugauaauuauaugaaacaaauaguuacaggagacaaagcaacuucuauuuaagucacuaucaucugcaggccaaugguaccccuaagcaucauuuucacggacucagcccuuucuugcauagagcuguagugaggccgugacuagauaccucuaucucuccguguaugucccugagcauacuccaaaacaauagucacgaaggagaggcagagaucugcucccagcacagcuguuccauuuuguuuugcuucaucuguucaauugucaaaaccugacuggucccugcucccccaauucccucaguccucaaguccaaaucauugccaagccccuguggcuuaucuauacaaaccaauauuagccaacauaccuaguuucucauccaccuugugaucccaucugagucaccagcgcagagaccuuagacugcugcuuucuuucugucccagccccuaacagccuccaguguggucuugcuacgacauuaaucagagcauuaaaacacuuccaggugcgauggagacuguaccacuuacugaauuaagaagcuacuggaccuggucuacagagugaguaccaggacagccagggcuacacagagaaacccugucucaaaaaccaaaaacauaaaaaaagucaagagcccugaggccaagcuugagagacccaauaugcccaauaugcacagagcaaaaacugaagagaauaaaaagaucagacaguucugaauaaauagauggacacuuuucugauguaaagaaauggcucaccaaggggcuggagagauagcuccucaguuaggaguauuagauggacuuucagaggagacagguucaaaucucaguacccacaaggcacagcucacaacugccuguaacuccaaucccaagucaucugacccugucuucuggccucuaugagcacagugcaugcacaugguacacaaaaacgugcagacaaaacaccauacacauaaaauaugaauaaauuccagaaugaaagccaaacacaacuuaagaccauuuuaggccagguguggugccacaugccuuuaauccuagcacuucagaggcagacgcagaggcaaggggaucucugaguuuguggccacccugguccaacaaaguuccaagacaucagggcuacacagagaaacccugucucaagagguggugggggagaaagaaaaagaaaacagaaauggcucaucaauuggccagggcuaguuagcauacaguguagacaacuaggcucccucagagcccauucacaugcugaugagggugguggauagcuacaaauacauucacaggaaauaauacacauagauuuggggugcuuuuuuuuguuuuuuugagacuggaucucuguauagcucuggcuguccuggaacucacucuguagcccaggcuggucucaaacucacagaaguccaccugccucugccuccugagugcugggauuaaaggugugugcuaccacugccugacuuauaaaaucauaaauauauauuuaaaaaguggcucauauuugugagccagauaggcacaaguugacagucagcaugggcuacacaguaaguccaaagcugauauaggauauauugugagaaccugccucaaaaagcaggagugagccgggcaugguggcgcacgccuuuaaucccagcacucuggaggcagaggcagccggaugucugaguuugaggucagccuggucuacagagugaguuccaggacagccagggcuacacagagaaacccugucucaaaaaaacaaaaacaaaaacaaaacaaaacaaaacaacaacaaaagcaggggugggguggaguugaaaagaaaagaaacuuuaagauaaaccuggcacacauaaauagaaagcuccagcaacaguaugaccacaaacagugucagccagccaacucuacuaguagcccauaccuaaaaccuauaaugcugguacuuggggggcagagaaggaaggauuguaugagaccaagagaggaagcagggagaagagaggaaacaaagaaaaacgggggugguacgaggaaaggagguagggagugagagaacaaauauacuuucaaaggcuaaaaggagucaacggggaaagagaaaccauuuaugaaauacugauaaacaguagggaaauugaaaguguguuuaaaaacaggcacaggauuucugcaaacacaaaccugucgagugagaaaaccuggcaugggcuaacagaggcuauaaauagucuuuacauaacccacuuugggugagugugcacacauuuccugcagacacauccaagcauuucaauaugggcuucuggcccagacccuaucugugguauuauauaauauauaugauacauacuacauuuucaucauaaaguugucaaacuugccaaaccuuaaacuaauauagaaaucagaaaggccgggugugguagcccacgccuuuaaucccagcacucgggaggcagaggcagguggauuucugaguucgaggccagccuggucuacagagugaguuccaggauagccagggcuacgcagagaaacccugucucgaaaaaccaaaaaaaaaaaacaaaaaacaaaaacaaaaacaaaaaaacaaaaacaaaaaaaaaaaaaaccccagaauucuaauguuuucccccugaaacugcaugaaauuauuuuaagauucacaagaacaaauucauguuuaagaauagcuaagaaaaagaacaucaggaggaugacaaaggcuuuuuuaaaaauuaaaacugaccacaaaaaucacugucauuaaacauaauaguguuagcccuauguaaaucccagcacuugggaagaagaggccggugaaccucuguaaguuucaagccagccagggcuacauaguaagaccccaucuaaaaaaaaguguguguuauauauauauaguuacacacacacacacacacacauacauacauauauauggcuagagagauggcucagugauuaagaccacuagccaggcgugguggugcaugccuuuaaucccagcacuugggaggcagaggcagguggauuucugaguucgaggccagccuggucuacaaagugaguuucaggacagccagagcuauacagagcuauacagagaaacccugucucaaacaaacaacaaacaaacaaacaaacaccacuaacuucuucccgagguccuuguacuuccagggccuacacaguggcucacaaucaccuuaauuccaguucuaagggguccaaugccuuccucuggccuccaaggacaccaggcauguaggugguacacacacacacacacacacacacacacacacacacacacacacacacaccccuaagggguauaaagaagguauaaaagucuuuggagcuagaguuacaggcagccaugagcugcugcauuguuggugcugggaagcagcagaacucagauccucugaaagcacuaugaguucuuaacugcugagccagcuuuccagcccauaccuuuucuuucuuucuaaaauauauuucucucuauguguaugaguggauuuaccugcacgcaugcuuguacacuuugugcaagccuggugccuauggaggcuagaagaaggcagcagagccccuggaaccugaguuaaagacaguuuuaagcuagcauaugguugcugggaacugaagccagguuucugcaguagcagcgaguccucuuacugagccagcauccagccccagcccuagagcuuuuuguuuuuuguuuugagauggccucacuaagcugccuaggcugaccaugaacccacugcgcaggcaggucuuaaacuugucaucucugccucaaucucgcaacuaucucaauuguuuucccuuuguguugggggagaaagagggagaaaguuucugauuauguagccuaagcuggccuugagcucacagaaauccuucugucucagcccgauugcaggggcuuacaauaauccuccugucuuugcuucuuucugcuucuugauugcuaggaucacagacaugugguccucuacccagcuguuucggugagcauuguagaggacuuaugcauacuacuacuguacaagcauucuuuuuuuuuuuuuuuuuuuuuuuuacuuauucauuuacuauaugugaguacacuguagcuguuuucagagacuccagaagagggcgucagaucucauuacagaugguuaugagccaccaugugguugcugggauuugaacucaggaccuucagaagagcagucagugcucuuaaccacugagccaucucuccagcccuguauaagcauucuuauacuauuaaguuacaucuccagccccagacaguuuuuuuuucuuucuuuuuuuuuuuuuuuuuuuuuuugcuuuucaaggauuucucuguguaggccaggcuggccucaggaagcagaggcagacagaugucugaguuugaggccagacuggucuacagagugaguuccaagacagccagggcuacacagagaaacccuggcucaaaaaacccagauagauagagagagagacagacaaacaaggaaacuauuaguagcaauaauaauaauaauaauaauaauaauaauauaaagaaaauuaucacaaauguccaaauugguucaagguccuggcuugauaaucuaccaaguguagaggcgaaaugggcuccucagagagacucaaccuuccacugagucacaugcuuguugcuuucagagccaugaaaauggacucaaggggcuggagagauggcucagcuguuaugagccacugggcucauaauagaggaccuuaguucuauuccuagcacacacacugcagcccacaacuaucuguaacuccagccccaagaucucuaauccucuucuguccucccugggcaccaggcaugcacauggugcacauauucacaugcaggcaaaacaccuauacacagaaaauaaauaaggaaagcaauaugaucucaagaaugccauuaacagggcugcagagauggcucaguggguaagagcacuggcugcucuuccagagguccugaguucaagucccagcaaccacauggugacucacaaccaucuauaauuagaucugaugcccucugcugcagguguacaugcaggcacaaggcuguguauauuuaaguaaaucuuuuauuuuuaaagaauggcauuaacaauauuauacuacacaguccauauacucgacacuuaagaguauaucauggucuuccaaagcauuuggguucaauucucagcaaccauguuggagcucacaacuguuuguaauuccaguuccagggaauccgacacccucacacagacauacauguaggcagaacaccaauguacauaaaauacaaauagcuuuaaaacguuuuauaaaaagaguauaacauguagaucauaagccaauuguauauaaauaugaauauacucucaugucccuacauaugacuaaauuuguuuguaaagaguaaaggaccuguaagguuauacagcaaacugaucacucaagcagaaggugugugugugagagagauguauaaaguuaagcauaguguucccuagaguauguaggacuuuuguguuguuuuguuucgcuuuuugaggcaagguuucucuguguagcccucgcuguccuggaacucacucuguagaccaggauggccucgaacucagaaaucugccugccucuguuucccaagugcugggauuaaaggcgugugccaccacugcccggccuagcauuguuuaaaaacauuuucauuucuguuuauuuucugugauacugugaaucaaacccagggucucccgaaugcuaggcaagugcucuaucacuaagcuuuaucgcuggcccucacgcucauuucugauuauuaucgcaauacuaggcacugaauucagggccuagcaaauguagcucaaauccugagcgcacuguuuacuugcccacacuggccuugaacucaacuacagcacaggacccucugaucuuacaaacuuucaguccccugggccucauuuuuuuauuuuuaauaaggugaauguguuuaguagguuacuaaacaguuucaugucaguuuccccaagaaauuccuuuuaccaagaucaggcauuuagacagaagccagaauucccucaggggcuugaagaguuauuuccuccuagacaaaaguguuuauuuucuccuuaccucuggccaaagagaccugggcucuugcuuuaggucuugguuagcgagucagaucugugcuagucuccaggcucccuccaugaugguauccuuucgcuuuuaaccaaggggcucccccauggcaccucacucacuccucucugcucuccugagacagacuuggcaauuuggaaaacacacacacacacacacacacacauauauacauacacacacacacacacacacacacauauauacacacacacauacacacacacacacauauauacacacacacacacacacacacauacacacacacacauacacacacauacacacacauacacacacacacacacacacacacacacacacacacacacacgcucucacgcgcgcucucucucucucucucucucucucagcacuccauuaauuucucuuuuacauauuaaaaagcuuuucaguugaaagucuaugaggugccggugcucacugagaccagacacuucaccugaccugaguguugggaacugaacuuggguccucugcuacaaauguauauucucugagucacuaaacauuccuguaggcccugaauuuuaacuucgcuggggcaguggcggcacaugccuuuagucccagcacucaggaggcagaggaaggcaggggcuggcagaucucugaguugaaggccagccuggucuacacagaaacucagaaauccgccugccucugccucccgagugcugggauuaaaggcaugugcuaccacaccuaguccucuccuuagcauuuuaauggagacaaauuaaaaugacaaauuaauucaguuaaauaagaauaggcccugggaaguuggcugaauuggugaagcacuugcgguauaaguauaacaguuuguaucucugcugcaggcuaaagccaggggugggcuagugagauggcucaaguccagugaccugacuucuagccucaaaaagacagauguugugguaugcauucccaucuauaaucccaguacuccuguggcaaaauaggcuaguagagaaaagaauugccugaaauugccgggccagcuagccuaggaguauacaguauagcaagagaaaaagagacccggccuuaacgaagaggaaggaaacacugacucuugaaaaacuguccucugacuuccacauguguuucacacacacacacacacacacacacacacacacacacacacacacacacacacacagauucacacaugcaaacagaugauaggcgaaagccuguacuuggagcagugaaguaauaaaagcagaagcaucuuacuucugcuuccuggccagccauggagccagucagcaggcucaacuuuuaguaaaagacccuguuggcagaguuacauggacaagugauggaggaagacgagcaacacugaucccuggucuccaaacuccugcacauguacaucacauacucacacaaaugcacaccuaugaacacauaugcaaacaagaagaaaacccuuauaagacuuucaugaaacauuuuagggcuggggagauggcucaguggaaaagugcuugucuaccaugugcaaggcucuggcuuccauucccaguacugaaacaaauccagaaaguaacauuuuuaugaaaggaaacacuaaaacuuucauaaccugaaugugguguuuuauacuuggaaucuuagcaccuagaaggaaggccaaggcagccugaacuauacaguuagagccuguuaggaaacaaaggaaaggaaggccccacacagccagugagauggaccaacaggcagaggugccuguuaccaagucuagugaccugguucaaccugcagaacccacaugguggaaggacagcaucccacaaguuguccucuguguaccaugcaugccauggcaugcaggugcaugugagcccaugcagcauggcucaguagguugaugagcuaaauucaauccccaagacucccacgagagaaggaagaacugacuucugaaaguugucuucugaccuacacaugcauucuuugguaugucuguggacacacacacacauauacaaaauaaguaucauacaaguuuaaggcagcucauuuuuguguccucccauggcuucagggagcuguuuuuuucucuccaucaauuuugcuugcuaguccuuuuaaggacauuuguaaaugaagagaucagaauaagaaaauuuuuaaaaauucagaaacagaccacgcuuacccuggaaccuggcaaguaagagauggaaauagugaggggaaaacugauucgucauuagcuggagaguuaauuuuaugagagguuuaucugcacacaugcuugcaaggcuugucaaggucccugggacaagaguuacagacugguuugaauugccauguggauacugagaaccaaacccagguucuauagaagaguagccaguacucccagcugcugagccaucucucuaccuuauggaaaagcaucuuauagguaaguuuaugguuaugaagauaucucaguggcugccauauaagcaaugagggccugggcauggaucccuaguaaguuccagaaccgacauaaaaaacgagagacacgguaguguacacauauaaucccagcucuugggaggaagcuaggaggauccaugggcuugcugaccagccaaucuagccaaauggugagaucuggguucaaugagaaacuaucucaaauaauaagguggauaccaggcauggugacacaugccuuuaaucccagcacuuggaaggcagagggcagguggauuucugugaguuccaaagcagccuagacuguagagcgaguuccaggauagccaaggcuauacagagaaacccugccuugaaagaacaaaccaaccaaccacaaacaaaaaauaaggcgaagggugauugagaaucucaacguuaaccucuggucugcucacaggcacacccaugcauccacacacgggcacccauaaacauauagacauggagaaaaggacuuuucaaaugaguuucugugaaagagacaggugucaucaccucugcuccacuggcguccucucagcucuuacacagcuggguuggccuugugcuuauucagccaggaagacuuuauguguuuaaaugacacuacuguuuccacuuuagaggugaagaaauggaggccgggaaauaaguuauugacacauuuuccugugcccuauuaucuuuccuuucuuucaacucuuucuuccucuguuuccuccugcauuccucuuuuuguccuucucuuucuuccucuuuuucaagguugccauguaguuuuguuuuguuauuuuuuuuucuuuuugacaggcuuucucuguguagcccuggcuguccuaguacucacucuauagaccaggcuggccucaaacucccagagaucuggcugccucugccucucgagugcugggguuaaaggcgugcgccacucuagcucuguaagauuauggggacaauuaacucuauucauuaaauguccagguauuccauuuagcuacacgaugugaauaaaaugccucagucauuccaaguagguacaaaaguucucuaaggguacgaauuguacggcuccaacauauguuauuacaaaaaugaaacaaaaacuugcugaguuggcaagacguuucagugguucuuuaaggcaccugcugccaagccugagaacccgagugugaaccccaggauuuacaugacaggagagagcugacucccacaagcuguucucugaccucugcauaggugucauggcacacaugugcacaugugcucaugcauacaugcauacacacacacacacacacacacacacacacacuaaauaaacaaaauugauuuuaaaaacuugcuggguguugagcagugcugagugugucggguggaagaacuguuagguuuuaggucagcccaggaaauguaguaagaccuaucucaaaaaacaaaacaaacaaacaaacaaacaaacaaacagguauaguucagugguauaacacuugccuagcaaacauauggccuguagucaauucuuagaaccaaaccaaaaccaagcaguaacacagugaagcauggugggcuauguuauccuagcacuagggaagcacagacagaagguaucuuuguaaguuugaugccagcaaaauuuacaugacaaguucccagcuacccagggcuauauaccacaacuauuaaaaaaaaaagccacaaacaaaaacaaauucaaacccauaaaauguuaaaaacgaguacaauguguggcgcuggaaagauggcucaaagaaacuggcugcucuucaagaagaccagaguuugauucccagaacccagaagugggcucacagccaucuguaauuccaggucaggagagccuauguccucuuguggccuccucgggcaucaagcaugcauguagcacacagacauacaagcaggugaaacacccuuuauguuuaaaaacaacaacaaaaacaaccaaccagacaaaagcccaccacaaccaacagaaaccuaccagaaugcacacuggagguggcucuauagcuccguggcacagugaaggccugaugugagugagcaaggccuggcuuucuugcauugcaaaagcgagcagacugacagacacccugugccuauagcccucaccagaagccauuagcuuuucuaccacauuugcuucaucuuacccuuucuccauggaaacacacucuccuacaacuccuucaaacaccuuguacuauaccccuucacguguaaauggguuuuucccaagagcacagauauuuuccuccaguaacccugaaaccauuaccauacugcuaugcuuucaaauuaauuaccaaugcgauaauauaggcugaauauuccuaacaugaaauuuuaaaacccaaaaccugaauuauuuuguaguucuguuuggagacaggguugcuuuauagcucaggcuagcuuugaacuugaguuuaaaguguacaaauaccauuacuauaauaaaacuuuugggggcaguacugaugauugaacccaggucuucugacauaauuaaaaaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaaauugugucccuguggccuaccaagaguggaagguguggaauuaucauccuauaggaaacguucuggguacucacuguccucugagggccgaaugucuacacgcaacugcagauaagguuuggaggcaguggcgaaagcugugcugaggucccaaucagaaaggagggagaggaaaguuuccuguccuagccggucucgagccagguagcugaugccaaaguucuucuuccuggacaaaggauauaagggagcuuuugggauccccaguuccccagcauuggcuucaagaucagauuuacaaaacaaggcaggcaaugugaaagguacugaaaacaacuuccuucucucugcugggaacucugcuaaggauuauggguauccugagguuaggucauuuauauccacuuuguuacacaaacacagaaacagauacacaccugcuuauaucuggaggguacacugaaaacugguagaauguugguuccccucuggggaugguaacaguguaguugagggauagaaguggaagaaagcagccuucuuacuacauaaaaaaaagcagucuguaugguuguuauuuuuuacaagauguaaacgcacaaauguucaacugcaacuacaaaucuauucagauccacuugugcaacuauauacacagauauuuuacuugaugaucacuguaaaccaaggaucauccuaaauauggaucaauuucacacuauuuaaauucagucccccacaacaagauaaccaacccaccugcccccaagugauaucaauucucagcuaucagacuggcaaauuuugcgaaaccauugucugggaggacaggaagaaagaaagugauuuuauacuucugaggcaguuucauuauguugcuuagaguggccuugauccucuugucccagccuccauaguacugauaucaccaugcuuggugaaacaaauguuuucuuuugucuuguguguguauguguuugagaggucucucuguguagcccuggcugucuuggaacucacucuguagaccaggcuggccuugaacugucagagaugugugugccucugcuuccagaguccccggacuaaagguguggaccaccauauccagcaaaaccuuuucugugcugugcagguaaaaccugucuggagagucauuuugaaaacauuccuugaaggauuuuguuuguuuguuuguuuuugagacaggguuucucuguguagccuuggcuguucuaaaacuuguucuguagaccaggcuggccuugaacucacagagauccaccuaccucugccuccuaaaugcugggauuaaagguguguacuaccaucacccagcuauuccuugaaaguuuuuaaguagcccagaaauacuacugcuaauuuuuucuuaggacuuuucucacagauuccaagcaagauacaccuauucacuguggaauuauuuggaaaaaaaagcagccaaacaacaaaaccaaaccccagaaaccuggcagugacuuuuaagaugagcgcccugcuucaucuucccacucacccauuuaagucaaaggcucggaugaggaugugcugcaacacguccagcgaggugaucugaggauccaccgcaaaagagcggaacucaggggacaagaagcucucacauuucuguggaaagaggacagggggaggccaugagggggcacaucaccguguggaaaggguggguaagguaaagaguggcagaaggcaggagucgaagacaggggagggaccagguuuuaggugagauguucuugguuuuuguucugggcgaggggaagucacaggaagucucugcgcagagaaaagaugauauguccuuugaauuuacaggguccauguuugcucugccaaagcagacuggcaggaacgaaggcuaaugcaguaguccagguguccaguccuuccagagucccuuaaauaugguugccagaaucaccauguccagcuugacacaaucaaaucagugacucccccccaccccccauagugcaaaucucccuguaacacuguuuguugcucagauccuucuucaacagcaaaccuaggugcuggagcuagcccucccuccacucugagauguauuuauggcucuacugguaucaaacuguugagaguuccuuugaguacaugcuuuccagacuucugugugcugaccucucucagagugaacauccuucccacuucaucuggcuuacuaaaaccuuugccuuagagcgcuaacaccccaaaagugaucucuggcacuccagucugagccaccggucacugcuugcagguaucacaacggguuccuuccucagaguguguuauaugucacaagcuguccuaugugcccuucucccuccugauugucuauuacuuuugcccccaggcuuccuucuccaacaauaugggaaccuacaggaacauaccacacucaucuagguguucccucuaccuagaacucuucucccauccuaaaugcauaugcuaacauuuuguuauuauuauuauuauccaggucucugugacuugaguccucuuuaggggauuuuccuauacagcuuuggguaaaguaacucccuagagauccuaaccuuuccuaucacuuucuccugauauucaccaauguucaaaauaucucauuuaauuguuuuugucccccucccacaagcacgugggcucaggggugggacauggacaaaagugaacucucaauagcuauuuguugacugacuuuaggacuaucccuucugacagcgacagcaccuccuuccuuccucuggacuccagaggccccuccgguaacccuacaacccaccucucuacccguaggcuccacccauccacuccauuggcccugucuccucuacaguuccacacccaacgacaaguccccaaaacccacgccuucauucuaucaauuccgcucuccagccucgcccccagucuccaagucacgccccaaauuucaggucugaugcucuauccuaggacaguuacggucuuuucguccacugggcgcccaagcaggcuagccucaccuugacucggacccguaccaccucacgcuccuccuccucaaccgccgcggccgccugggcaccuccgacgggcgggggcgcugccgagcacgccgaguccgaggccgcggaggugguugccaucccgccgcugucgucucuguccaggugauaaccgauaguuacccguacccuaacguacacccaacagugcgggcgcccgcggccccaccuugcaccagagcgcaggcgcagaggugcuguaggacccugccccucccaccuggcuugggcuggaggucgcaucugagcaugcgccuagagugcucuugccuggaaccccgccucccagaguggagaauuuuacuuuuuacugccuguguguaagugccuguccagguccugccuggcccgguccguggcgccguuguuuuggcaguuuacuuccggauucaugaaccgccgcguuaaacggacgagcuugagagagaca

SEQ ID NO: 9384 - RNA, 21778 nt, Mus musculus
ugucucucucaagcucguccguuuaacgcggcgguucaugaauccggaaguaaacugccaaaacaacggcgccacggaccgggccaggcaggaccuggacaggcacuuacacacaggcaguaaaaaguaaaauucuccacucugggaggcgggguuccaggcaagagcacucuaggcgcaugcucagaugcgaccuccagcccaagccaggugggaggggcaggguccuacagcaccucugcgccugcgcucuggugcaagguggggccgcgggcgcccgcacuguuggguguacguuaggguacggguaacuaucgguuaucaccuggacagagacgacagcggcgggauggcaaccaccuccgcggccucggacucggcgugcucggcagcgcccccgcccgucggaggugcccaggcggccgcggcgguugaggaggaggagcgugaggugguacggguccgagucaaggugaggcuagccugcuugggcgcccaguggacgaaaagaccguaacuguccuaggauagagcaucagaccugaaauuuggggcgugacuuggagacugggggcgaggcuggagagcggaauugauagaaugaaggcguggguuuuggggacuugucguuggguguggaacuguagaggagacagggccaauggaguggauggguggagccuacggguagagagguggguuguaggguuaccggaggggccucuggaguccagaggaaggaaggaggugcugucgcugucagaagggauaguccuaaagucagucaacaaauagcuauugagaguucacuuuuguccaugucccaccccugagcccacgugcuugugggagggggacaaaaacaauuaaaugagauauuuugaacauuggugaauaucaggagaaagugauaggaaagguuaggaucucuagggaguuacuuuacccaaagcuguauaggaaaauccccuaaagaggacucaagucacagagaccuggauaauaauaauaauaacaaaauguuagcauaugcauuuaggaugggagaagaguucuagguagagggaacaccuagaugagugugguauguuccuguagguucccauauuguuggagaaggaagccugggggcaaaaguaauagacaaucaggagggagaagggcacauaggacagcuugugacauauaacacacucugaggaaggaacccguugugauaccugcaagcagugaccgguggcucagacuggagugccagagaucacuuuugggguguuagcgcucuaaggcaaagguuuuaguaagccagaugaagugggaaggauguucacucugagagaggucagcacacagaagucuggaaagcauguacucaaaggaacucucaacaguuugauaccaguagagccauaaauacaucucagaguggagggagggcuagcuccagcaccuagguuugcuguugaagaaggaucugagcaacaaacaguguuacagggagauuugcacuauggggggugggggggagucacugauuugauugugucaagcuggacauggugauucuggcaaccauauuuaagggacucuggaaggacuggacaccuggacuacugcauuagccuucguuccugccagucugcuuuggcagagcaaacauggacccuguaaauucaaaggacauaucaucuuuucucugcgcagagacuuccugugacuuccccucgcccagaacaaaaaccaagaacaucucaccuaaaaccuggucccuccccugucuucgacuccugccuucugccacucuuuaccuuacccacccuuuccacacggugaugugcccccucauggccucccccuguccucuuuccacagaaaugugagagcuucuuguccccugaguuccgcucuuuugcgguggauccucagaucaccucgcuggacguguugcagcacauccucauccgagccuuugacuuaaaugggugagugggaagaugaagcagggcgcucaucuuaaaagucacugccagguuucugggguuugguuuuguuguuuggcugcuuuuuuuuccaaauaauuccacagugaauagguguaucuugcuuggaaucugugagaaaaguccuaagaaaaaauuagcaguaguauuucugggcuacuuaaaaacuuucaaggaauagcugggugaugguaguacacaccuuuaaucccagcauuuaggaggcagagguagguggaucucugugaguucaaggccagccuggucuacagaacaaguuuuagaacagccaaggcuacacagagaaacccugucucaaaaacaaacaaacaaacaaaauccuucaaggaauguuuucaaaaugacucuccagacagguuuuaccugcacagcacagaaaagguuuugcuggauauggugguccacaccuuuaguccggggacucuggaagcagaggcacacacaucucugacaguucaaggccagccuggucuacagagugaguuccaagacagccagggcuacacagagagaccucucaaacacauacacacacaagacaaaagaaaacauuuguuucaccaagcauggugauaucaguacuauggaggcugggacaagaggaucaaggccacucuaagcaacauaaugaaacugccucagaaguauaaaaucacuuucuuucuuccuguccucccagacaaugguuucgcaaaauuugccagucugauagcugagaauugauaucacuugggggcagguggguugguuaucuuguugugggggacugaauuuaaauagugugaaauugauccauauuuaggaugauccuugguuuacagugaucaucaaguaaaauaucuguguauauaguugcacaaguggaucugaauagauuuguaguugcaguugaacauuugugcguuuacaucuuguaaaaaauaacaaccauacagacugcuuuuuuuuauguaguaagaaggcugcuuucuuccacuucuaucccucaacuacacuguuaccauccccagaggggaaccaacauucuaccaguuuucaguguacccuccagauauaagcagguguguaucuguuucuguguuuguguaacaaaguggauauaaaugaccuaaccucaggauacccauaauccuuagcagaguucccagcagagagaaggaaguuguuuucaguaccuuucacauugccugccuuguuuuguaaaucugaucuugaagccaaugcuggggaacuggggaucccaaaagcucccuuauauccuuuguccaggaagaagaacuuuggcaucagcuaccuggcucgagaccggcuaggacaggaaacuuuccucucccuccuuucugauugggaccucagcacagcuuucgccacugccuccaaaccuuaucugcaguugcguguagacauucggcccucagaggacagugaguacccagaacguuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuccuauaggaugauaauuccacaccuuccacucuugguaggccacagggacacaauuuuuuuuaauuaugucagaagaccuggguucaaucaucaguacugcccccaaaaguuuuauuauaguaaugguauuuguacacuuuaaacucaaguucaaagcuagccugagcuauaaagcaacccugucuccaaacagaacuacaaaauaauucagguuuuggguuuuaaaauuucauguuaggaauauucagccuauauuaucgcauugguaauuaauuugaaagcauagcaguaugguaaugguuucaggguuacuggaggaaaauaucugugcucuugggaaaaacccauuuacacgugaagggguauaguacaagguguuugaaggaguuguaggagaguguguuuccauggagaaaggguaagaugaagcaaaugugguagaaaagcuaauggcuucuggugagggcuauaggcacagggugucugucagucugcucgcuuuugcaaugcaagaaagccaggccuugcucacucacaucaggccuucacugugccacggagcuauagagccaccuccagugugcauucugguagguuucuguugguuguggugggcuuuugucugguugguuguuuuuguuguuguuuuuaaacauaaaggguguuucaccugcuuguaugucugugugcuacaugcaugcuugaugcccgaggaggccacaagaggacauaggcucuccugaccuggaauuacagauggcugugagcccacuucuggguucugggaaucaaacucuggucuucuugaagagcagccaguuucuuugagccaucuuuccagcgccacacauuguacucguuuuuaacauuuuauggguuugaauuuguuuuuguuuguggcuuuuuuuuuuaauaguugugguauauagcccuggguagcugggaacuugucauguaaauuuugcuggcaucaaacuuacaaagauaccuucugucugugcuucccuagugcuaggauaacauagcccaccaugcuucacuguguuacugcuugguuuugguuugguucuaagaauugacuacaggccauauguuugcuaggcaaguguuauaccacugaacuauaccuguuuguuuguuuguuuguuuguuuguuuuguuuuuugagauaggucuuacuacauuuccugggcugaccuaaaaccuaacaguucuuccacccgacacacucagcacugcucaacacccagcaaguuuuuaaaaucaauuuuguuuauuuaguguguguguguguguguguguguguguguguaugcauguaugcaugagcacaugugcacaugugugccaugacaccuaugcagaggucagagaacagcuugugggagucagcucucuccugucauguaaauccugggguucacacucggguucucaggcuuggcagcaggugccuuaaagaaccacugaaacgucuugccaacucagcaaguuuuuguuucauuuuuguaauaacauauguuggagccguacaauucguacccuuagagaacuuuuguaccuacuuggaaugacugaggcauuuuauucacaucguguagcuaaauggaauaccuggacauuuaaugaauagaguuaauuguccccauaaucuuacagagcuagaguggcgcacgccuuuaaccccagcacucgagaggcagaggcagccagaucucugggaguuugaggccagccuggucuauagagugaguacuaggacagccagggcuacacagagaaagccugucaaaaagaaaaaaaaauaacaaaacaaaacuacauggcaaccuugaaaaagaggaagaaagagaaggacaaaaagaggaaugcaggaggaaacagaggaagaaagaguugaaagaaaggaaagauaauagggcacaggaaaaugugucaauaacuuauuucccggccuccauuucuucaccucuaaaguggaaacaguagugucauuuaaacacauaaagucuuccuggcugaauaagcacaaggccaacccagcuguguaagagcugagaggacgccaguggagcagaggugaugacaccugucucuuucacagaaacucauuugaaaaguccuuuucuccaugucuauauguuuaugggugcccguguguggaugcaugggugugccugugagcagaccagagguuaacguugagauucucaaucacccuucgccuuauuuuuuguuugugguugguugguuuguucuuucaaggcaggguuucucuguauagccuuggcuauccuggaacucgcucuacagucuaggcugcuuuggaacucacagaaauccaccugcccucugccuuccaagugcugggauuaaaggcaugugucaccaugccugguauccaccuuauuauuugagauaguuucucauugaacccagaucucaccauuuggcuagauuggcuggucagcaagcccauggauccuccuagcuuccucccaagagcugggauuauauguguacacuaccgugucucucguuuuuuaugucgguucuggaacuuacuagggauccaugcccaggcccucauugcuuauauggcagccacugagauaucuucauaaccauaaacuuaccuauaagaugcuuuuccauaagguagagagauggcucagcagcugggaguacuggcuacucuucuauagaaccuggguuugguucucaguauccacauggcaauucaaaccagucuguaacucuugucccagggaccuugacaagccuugcaagcaugugugcagauaaaccucucauaaaauuaacucuccagcuaaugacgaaucaguuuuccccucacuauuuccaucucuuacuugccagguuccaggguaagcguggucuguuucugaauuuuuaaaaauuuucuuauucugaucucuucauuuacaaauguccuuaaaaggacuagcaagcaaaauugauggagagaaaaaaacagcucccugaagccaugggaggacacaaaaaugagcugccuuaaacuuguaugauacuuauuuuguauauguguguguguguccacagacauaccaaagaaugcauguguaggucagaagacaacuuucagaagucaguucuuccuucucucgugggagucuuggggauugaauuuagcucaucaaccuacugagccaugcugcaugggcucacaugcaccugcaugccauggcaugcaugguacacagaggacaacuugugggaugcuguccuuccaccauguggguucugcagguugaaccaggucacuagacuugguaacaggcaccucugccuguugguccaucucacuggcuguguggggccuuccuuuccuuuguuuccuaacaggcucuaacuguauaguucaggcugccuuggccuuccuucuaggugcuaagauuccaaguauaaaacaccacauucagguuaugaaaguuuuaguguuuccuuucauaaaaauguuacuuucuggauuuguuucaguacugggaauggaagccagagccuugcacaugguagacaagcacuuuuccacugagccaucuccccagcccuaaaauguuucaugaaagucuuauaaggguuuucuucuuguuugcauauguguucauaggugugcauuugugugaguaugugauguacaugugcaggaguuuggagaccagggaucaguguugcucgucuuccuccaucacuuguccauguaacucugccaacagggucuuuuacuaaaaguugagccugcugacuggcuccauggcuggccaggaagcagaaguaagaugcuucugcuuuuauuacuucacugcuccaaguacaggcuuucgccuaucaucuguuugcaugugugaaucugugugugugugugugugugugugugugugugugugugugugugugugugugugugaaacacauguggaagucagaggacaguuuuucaagagucaguguuuccuuccucuucguuaaggccgggucucuuuuucucuugcuauacuguauacuccuaggcuagcuggcccggcaauuucaggcaauucuuuucucuacuagccuauuuugccacaggaguacugggauuauagaugggaaugcauaccacaacaucugucuuuuugaggcuagaagucaggucacuggacuugagccaucucacuagcccaccccuggcuuuagccugcagcagagauacaaacuguuauacuuauaccgcaagugcuucaccaauucagccaacuucccagggccuauucuuauuuaacugaauuaauuugucauuuuaauuugucuccauuaaaaugcuaaggagaggacuaggugugguagcacaugccuuuaaucccagcacucgggaggcagaggcaggcggauuucugaguuucuguguagaccaggcuggccuucaacucagagaucugccagccccugccuuccucugccuccugagugcugggacuaaaggcaugugccgccacugccccagcgaaguuaaaauucagggccuacaggaauguuuagugacucagagaauauacauuuguagcagaggacccaaguucaguucccaacacucaggucaggugaagugucuggucucagugagcaccggcaccucauagacuuucaacugaaaagcuuuuuaauauguaaaagagaaauuaauggagugcugagagagagagagagagagagagagcgcgcgugagagcguguguguguguguguguguguguguguguguguguguguguauguguguguauguguguguauguguguguguguauguguguguguguguguguguguauauauguguguguguguguauguguguguguauauauguguguguguguguguguguguguauguauauauguguguguguguguguguguguguuuuccaaauugccaagucugucucaggagagcagagaggagugagugaggugccaugggggagccccuugguuaaaagcgaaaggauaccaucauggagggagccuggagacuagcacagaucugacucgcuaaccaagaccuaaagcaagagcccaggucucuuuggccagagguaaggagaaaauaaacacuuuugucuaggaggaaauaacucuucaagccccugagggaauucuggcuucugucuaaaugccugaucuugguaaaaggaauuucuuggggaaacugacaugaaacuguuuaguaaccuacuaaacacauucaccuuauuaaaaauaaaaaaaugaggcccaggggacugaaaguuuguaagaucagaggguccugugcuguaguugaguucaaggccagugugggcaaguaaacagugcgcucaggauuugagcuacauuugcuaggcccugaauucagugccuaguauugcgauaauaaucagaaaugagcgugagggccagcgauaaagcuuagugauagagcacuugccuagcauucgggagacccuggguuugauucacaguaucacagaaaauaaacagaaaugaaaauguuuuuaaacaaugcuaggccgggcagugguggcacacgccuuuaaucccagcacuugggaaacagaggcaggcagauuucugaguucgaggccauccuggucuacagagugaguuccaggacagcgagggcuacacagagaaaccuugccucaaaaagcgaaacaaaacaacacaaaaguccuacauacucuagggaacacuaugcuuaacuuuauacaucucucucacacacacaccuucugcuugagugaucaguuugcuguauaaccuuacagguccuuuacucuuuacaaacaaauuuagucauauguagggacaugagaguauauucauauuuauauacaauuggcuuaugaucuacauguuauacucuuuuuauaaaacguuuuaaagcuauuuguauuuuauguacauugguguucugccuacauguaugucugugugagggugucggauucccuggaacuggaauuacaaacaguugugagcuccaacaugguugcugagaauugaacccaaaugcuuuggaagaccaugauauacucuuaagugucgaguauauggacuguguaguauaauauuguuaaugccauucuuuaaaaauaaaagauuuacuuaaauauacacagccuugugccugcauguacaccugcagcagagggcaucagaucuaauuauagaugguugugagucaccaugugguugcugggacuugaacucaggaccucuggaagagcagccagugcucuuacccacugagccaucucugcagcccuguuaauggcauucuugagaucauauugcuuuccuuauuuauuuucuguguauagguguuuugccugcaugugaauaugugcaccaugugcaugccuggugcccagggaggacagaagaggauuagagaucuuggggcuggaguuacagauaguugugggcugcagugugugugcuaggaauagaacuaagguccucuauuaugagcccaguggcucauaacagcugagccaucucuccagccccuugaguccauuuucauggcucugaaagcaacaagcaugugacucaguggaagguugagucucucugaggagcccauuucgccucuacacuugguagauuaucaagccaggaccuugaaccaauuuggacauuugugauaauuuucuuuauauuauuauuauuauuauuauuauuauuauugcuacuaauaguuuccuuguuugucugucucucucucuaucuaucuggguuuuuugagccaggguuucucuguguagcccuggcugucuuggaacucacucuguagaccagucuggccucaaacucagacaucugucugccucugcuuccugaggccagccuggccuacacagagaaauccuugaaaagcaaaaaaaaaaaaaaaaaaaaaaagaaagaaaaaaaaacugucuggggcuggagauguaacuuaauaguauaagaaugcuuauacagggcuggagagauggcucagugguuaagagcacugacugcucuucugaagguccugaguucaaaucccagcaaccacaugguggcucauaaccaucuguaaugagaucugacgcccucuucuggagucucugaaaacagcuacaguguacucacauauaguaaaugaauaaguaaaaaaaaaaaaaaaaaaaaaaaagaaugcuuguacaguaguaguaugcauaaguccucuacaaugcucaccgaaacagcuggguagaggaccacaugucugugauccuagcaaucaagaagcagaaagaagcaaagacaggaggauuauuguaagccccugcaaucgggcugagacagaaggauuucugugagcucaaggccagcuuaggcuacauaaucagaaacuuucucccucuuucucccccaacacaaagggaaaacaauugagauaguugcgagauugaggcagagaugacaaguuuaagaccugccugcgcaguggguucauggucagccuaggcagcuuagugaggccaucucaaaacaaaaaacaaaaagcucuagggcuggggcuggaugcuggcucaguaagaggacucgcugcuacugcagaaaccuggcuucaguucccagcaaccauaugcuagcuuaaaacugucuuuaacucagguuccaggggcucugcugccuucuucuagccuccauaggcaccaggcuugcacaaaguguacaagcaugcgugcagguaaauccacucauacacauagagagaaauauauuuuagaaagaaagaaaagguaugggcuggaaagcuggcucagcaguuaagaacucauagugcuuucagaggaucugaguucugcugcuucccagcaccaacaaugcagcagcucauggcugccuguaacucuagcuccaaagacuuuuauaccuucuuuauaccccuuagggguguguguguguguguguguguguguguguguguguguguguguguguguaccaccuacaugccugguguccuuggaggccagaggaaggcauuggaccccuuagaacuggaauuaaggugauugugagccacuguguaggcccuggaaguacaaggaccucgggaagaaguuagugguguuuguuuguuuguuuguuguuuguuugagacaggguuucucuguauagcucuguauagcucuggcuguccugaaacucacuuuguagaccaggcuggccucgaacucagaaauccaccugccucugccucccaagugcugggauuaaaggcaugcaccaccacgccuggcuaguggucuuaaucacugagccaucucucuagccauauauauguauguauguguguguguguguguguguaacuauauauauauaacacacacuuuuuuuuagauggggucuuacuauguagcccuggcuggcuugaaacuuacagagguucaccggccucuucuucccaagugcugggauuuacauagggcuaacacuauuauguuuaaugacagugauuuuuguggucaguuuuaauuuuuaaaaaagccuuugucauccuccugauguucuuuuucuuagcuauucuuaaacaugaauuuguucuugugaaucuuaaaauaauuucaugcaguuucagggggaaaacauuagaauucugggguuuuuuuuuuuuuuguuuuuguuuuuuuguuuuuguuuuuguuuuuuguuuuuuuuuuuugguuuuucgagacaggguuucucugcguagcccuggcuauccuggaacucacucuguagaccaggcuggccucgaacucagaaauccaccugccucugccucccgagugcugggauuaaaggcgugggcuaccacacccggccuuucugauuucuauauuaguuuaagguuuggcaaguuugacaacuuuaugaugaaaauguaguauguaucauauauauuauauaauaccacagauagggucugggccagaagcccauauugaaaugcuuggaugugucugcaggaaaugugugcacacucacccaaaguggguuauguaaagacuauuuauagccucuguuagcccaugccagguuuucucacucgacagguuuguguuugcagaaauccugugccuguuuuuaaacacacuuucaauuucccuacuguuuaucaguauuucauaaaugguuucucuuuccccguugacuccuuuuagccuuugaaaguauauuuguucucucacucccuaccuccuuuccucguaccacccccguuuuucuuuguuuccucucuucucccugcuuccucucuuggucucauacaauccuuccuucucugccccccaaguaccagcauuauagguuuuagguaugggcuacuaguagaguuggcuggcugacacuguuuguggucauacuguugcuggagcuuucuauuuaugugugccagguuuaucuuaaaguuucuuuucuuuucaacuccaccccaccccugcuuuuguuguuguuuuguuuuguuuuguuuuuguuuuuguuuuuuugagacaggguuucucuguguagcccuggcuguccuggaacucacucuguagaccaggcugaccucaaacucagacauccggcugccucugccuccagagugcugggauuaaaggcgugcgccaccaugcccggcucacuccugcuuuuugaggcagguucucacaauauauccuauaucagcuuuggacuuacuguguagcccaugcugacugucaacuugugccuaucuggcucacaaauaugagccacuuuuuaaauauauauuuaugauuuuauaagucaggcagugguagcacacaccuuuaaucccagcacucaggaggcagaggcagguggacuucugugaguuugagaccagccugggcuacagagugaguuccaggacagccagagcuauacagagauccagucucaaaaaaacaaaaaaaagcaccccaaaucuauguguauuauuuccugugaauguauuuguagcuauccaccacccucaucagcaugugaaugggcucugagggagccuaguugucuacacuguaugcuaacuagcccuggccaauugaugagccauuucuguuuucuuuuucuuucucccccaccaccucuugagacaggguuucucuguguagcccugaugucuuggaacuuuguuggaccaggguggccacaaacucagagauccccuugccucugcgucugccucugaagugcuaggauuaaaggcauguggcaccacaccuggccuaaaauggucuuaaguuguguuuggcuuucauucuggaauuuauucauauuuuauguguaugguguuuugucugcacguuuuuguguaccaugugcaugcacugugcucauagaggccagaagacagggucagaugacuugggauuggaguuacaggcaguugugagcugugccuuguggguacugagauuugaaccugucuccucugaaaguccaucuaauacuccuaacugaggagcuaucucuccagccccuuggugagccauuucuuuacaucagaaaaguguccaucuauuuauucagaacugucugaucuuuuuauucucuucaguuuuugcucugugcauauugggcauauugggucucucaagcuuggccucagggcucuugacuuuuuuuauguuuuugguuuuugagacaggguuucucuguguagcccuggcuguccugguacucacucuguagaccagguccaguagcuucuuaauucaguaagugguacagucuccaucgcaccuggaaguguuuuaaugcucugauuaaugucguagcaagaccacacuggaggcuguuaggggcugggacagaaagaaagcagcagucuaaggucucugcgcuggugacucagaugggaucacaagguggaugagaaacuagguauguuggcuaauauugguuuguauagauaagccacaggggcuuggcaaugauuuggacuugaggacugagggaauugggggagcagggaccagucagguuuugacaauugaacagaugaagcaaaacaaaauggaacagcugugcugggagcagaucucugccucuccuucgugacuauuguuuuggaguaugcucagggacauacacggagagauagagguaucuagucacggccucacuacagcucuaugcaagaaagggcugaguccgugaaaaugaugcuuagggguaccauuggccugcagaugauagugacuuaaauagaaguugcuuugucuccuguaacuauuuguuucauauaauuaucagcauaauggaaugaucauuggauguuguuaccuuuugcaacacuguaaugucaguugaugucuauuaagauuuuuggaccuggagucucaugccuauaacccucaagaaacugaaguauaagaaucaccaugaguucaaggcuagccugagccacagaaucaaguuccaagucagccuggguuacagugagacacucucucucucucucucucucucucucucucuauauauauauauauauauauauauauauauauauauauauauauauauaugugugugugugucugugugugugugugugugugugugugugugaguguguguaugugugugugugugugugauuuauuucauguauaugacuacaaugucaacgucuucagacacaccagaagaggguaucagaucccauuacagauggucgugagccaccaugugguugcugggacuugaacucagaaccucuggaagagcagucagugcucuuaaccgcagagccaucucucagcccaagaccuuuucucaaacaagauuuucaaccguauaguuagguuaauggaguaccuuucacaugcaugggggccuugguuucuagcccuaccacacacacacacacacacacacacacacacacacacacacgcaugcucgcacaggguucacgguagcugagaugauucagcaguuaagagugccuacugggguaagaugggucagccaguaagguaaagacaguugccacuaagccugacuggcagagugagaaagugacucccaugcguuguccuguaaccuccacacaugcaccauagcacauacauguaccuacacaggaaacgaaucauuuuguucaguuuuguuuuguugagacaggguuucucuuuguagcccugauuggccuggaacuugcucuguagaccaggguggccuugaacuaaaaaaaaaaaaaaaaauuccugcccccugcugggauuaaaggcaugcacuaccuugucuagcaauaaauguaauuuuuuaaaauaaagauuuauuuauuauuauacauaaguucacuguagcugacuucagacacaucagaagagggugucagaucuuguugugagccaccaugugguugcugggauuugaacucaggaaccucaaaagagcagucagugccuuuacccgcugagccaucucaccagcccccuaaauguaauuuuuuaauuuaaaaaaugggacuggagagcuggcugagugguuaagagcagcagguugcucuucuagaggaccagggguuaguugccagcacccuugucaggggcucccaacugcugcuaacuccaguuccagggcauaugagauccucuucugaauuccgagugcagcuccauuucacaugcacauaacccaacacagcacaccuauguacaucauucaaaauaaaauaaaugcuucuaugaaagagugcuugcuauucuuucagggaaccugaguucaauuccuagcauucacauauggugguucacaaucucgacaauuccagggaaauccaaggcuucaguaggacucugcagguacauauaccuccauaaagauauacucacacacaauuaaaaguaaaaggaaagggaaaucuuccuggguuggagccaugacuaagcaguuaagagcacuggcugcuguuccagaagacccagguucaguucccaacacccacaugacugcucacaacucuauaauuccagucccgagauaucucaugcccucucuucugggcgcccugggcaccaggcaugcauauggugcacagacauacauguaggcaaaaacccauacacauaaauuuauuuauuuuuuccaagacaggguuucucugucaauuuggcuggucuggaaccacucuguagaccaggcuggccuugaacucaagagauccaccugucucuuacuccugauuucugcgauuaaaggcaugcaccacuacugcccaguuuauuuuuaauuuuaaagaaaacauaaauaaacaagaauucuugaacuuacccauagguguccauugcugcugcaaccacauacuugaaggggagaauuguguugagaaagagauuuuuaaaaaaauaauuacuuauucuuuuaauuaugcauaugaguacacugucgcugucuucaaacacagaagaaggcaucagaucccauuacagaugguugugagccaccaugugguugcugggaaaugaacucuggaagaacauccagugcuuuuaacugcugagccaucucuccggacugaggaagacaucuuaagggaagggguagugauaauggaauacauguggcuuaaaacagaaggggaccagugagaggggguaagaauaggggaggacagcugggcggugguggcgcacgccuuuaaucccagcacuugggaggcagaggcagguggauuucugaguucgaggccagccuggucuacaaagugaguuccaggacagccagggauacacagagaaacccugucuuggaaaaccaaaaaagaaaauaaauaaagaauaggggagggcaacaaacagggugguggugaauaagaagaaaggauuuugauccauguuuauggaaacuucauaaugaagcccauuacuuuguaugguaacuuaaaauacuuaauuuaaaaaggaaauggacuccaggggaaauaaugguagagaaguagauaguuagggccaggagcagcuaauccuuugucuaacacauacaacauacuuccucacgaacccuuguucuaagauaugacugaccucuggggaaagguaaauggggcugugcuccuagaaauggaaaccuaccauuucccagcuguagaaucuuggucacuaacuaguuuuuccaaaccucuuuggucuuuuucugucaaggaagacuggcaguagcauuuccuaucauuucaguggggaacacuaucacgaauguaagaugaggagugcuggcucacagacuuagggcacaggcuucauaucccacuucuuucauucacuagguauggagccuugaacaaauaucuauaggccuguuuccucaucaaagcuacugagaaagccaaggaaggugguggcacaugucuguaguccuuucauuccugcuacucaugaggcugaggcagcaagaggacuggaauaaguucagggccagccugggcaacuuaaugacacugccuuaaagaguuguuuuguagaaggucucaugauagagcuuagcaguagagcacuuggguagcgagcgcaugugacacccuggguuuggauuccccaggacuauuaccuccaggcacaaaaaauauauauuuaacggcuggagagauggcucagcgauuaagagcauugacugcacuuccaaggguccugaguucaggucccagcaaccacaugguggcucacagcuauccauaaugagaucugaugcccucuucugggugucugauaaauaaaucuuuuuuaaaaaauuauauauauagcuaguaucuccauaggacugaguauaaggaacugauuugguuuuacugggggcagggguacacauuaucacagugcauugugaagaucaaagaacaauuucuuccaaguauguuccauacuaaacuagauuuucaggcuugguggcaagugucuuuacucacacugguccucaagauuuguuuguuuguuuuuguuuuuguuuugagacaggaucucacuauguagcucugguuguccuggaacgcacuuguagaccaggcugucuacaaauucagagaucugucugccucugacucccaggugcugggacuaaaggcguguacuaccaggccuucaaguauuuuuuuaaugagauauagagucuuauuauauagcccaggcacugaccuugaacuccugauuuuccuaccuuggucuccagaguaacugccaggcucaauagauauuauuguuuaaauguuacuuaaaucauuaaaauauuaaagacuucccagcuauuuugugaaauaguucccauguaagacagaucaugagugaucuauuauuauuauuauuauuauuauuauuauuuggaugaaacagggaggaggagaucgaggcugcuuguugcccugcagguagcuaagcuuuuagaaaggaaccccgcccuguaaucugggcucacaugguucacacccguguucucauaguucuuuacucugugugcucaggcccauugcuggaagacugggacauaauuagccccaaagaugucauuggaucugaugugcuacuggcugagaagcgaucaucacugacgacagcugccuugccuuuuacacaguccauccucucucaggugauuucaggagacuugggggugugguuuccagcugugguugaagggaagggcuuaucugauaauaccauuccagagcccgcugguugaugccugcccuauccugcacaggggaccuguagcuucuuucccuuuuuccuucccaggugggucguacacugucuaagguccagcaggugcugaguuggucuuauggggaagaugugaagccuuuuaagcccccccugagugaugcugaguuccacacguaccugaaucaugaaggucagcucucccggccugaggaguugcguuugaggaucuaccacggcgguguggagccuucacuucgaaaagugagccgccucaguccgucaccgaacccaucacacucuaucaaauguucaguagaacacagucauaggugggauagagaaaucccagggaaggagggucucugucggguaugucccaguggcaggaaggcagaccuaucacaaggaggacagaggucacaagagaugggugguaacuaguugacguacauggguacguacggcagcacacuaguugaaacucagccccaucucuucugucucuggcagguaguauggcgguaccuccuuaauguguacccagaugggcugacuggccgugagcggauggacuacaugaaacguaagagccgagaguacgagcagcucaaaagugagugggcccagcgagugaacccugaggaccuggaauucauccgcagcacaguccucaaggaugugcuccgcacagaccgagcccaucccuacuacgcagggccugaggauggcccacaccuacgggcccuacacgacuugcucaccaccuaugccguuacccauccacagguaucauacugccaggggaugagugaccuggccucaccaauucuugcugucauggaccaugaaggccaugccuuuguaugcuucuguggcaucaugaagcgcuuagcugccaacuuccacccugauggccgugccauggccaccaaguuugcccaccucaagcugcuauugagacaugcugacccagacuucuaucaguaccugcaagaagcaggugccgaugaccucuuuuucuguuaccgcuggcugcugcuggagcucaagcgugaauucgccuucgaugaugcucuccgaaugcuagaagucaccuggaguucacugcccccugacccuccugaacacgaaguggagcucgucggaccucccagccaaguagcagacacuggcuuugguagccacaggggacggccaguacgucagaggcacaugcugaggccugcugguggaggaggcggugcuuuugaagaugcuguuguccacuuagcugcaucuagccagggaccuagugguggggggcgucuccuaagacaagccagucuggauggucuccaacaacucagggauaacaugggccucaggaaggaccaucugguccaacuaucccacccagcuacccucauuagcucuaagucccucucugagcccuugcugaauuccccagauccacuccucuccaccucuucucggcccgauuccccaucuucgucaucuccuccaucuacccaggaggcuucuccuucuggugacauagcuguaggaucccccuuaaugcaagagguagguucucccagagacccugggaagccuguaccaccuccaccuccaaugggccuucccccaccccaggaguuuggccgagggaacccauucaugcucuuccucugcuuggcuauccugcuggagcaucgugaccacaucaugcgcaaugggcuggauuacaaugagcuagccaugcauuuugaccgccugguucguaaacaccaucuagggcgugucuugcguagggccaaagcacucuuugcugauuaccuacagucugaagugugggacucugaggagggggcugaggccacagcuccaucuugauuauacucccuccaacgcuccaaccccaaugguacuccauucuuugccaugagggccuacacaugagaccuuauucccugccugccauccccagacauguuggagccugaggcccucucuccccagauuugaguauguguggcucagccuuggcacugccccacagaggccacagccucguucuguuuuuguuguuucuaaacuauacuuuccauauacaaaggucacugugguauguguauuucucuauuucuugaauguuauaaaaguuacugggggcucuuuaguuaaugcaacuga

SEQ ID NO: 9385 - RNA, 8198 nt, Mus musculus
aguguuauaguaaaagacauuuuauuuccugguuugggaaguugccaccgucacggacuugccaccuucucauccaucuuuucccucagguuccuagcaguagcucaacuuguucccuuccuuuucugacucuggcccuuugugugcucacucaucauguuugagugggacaaguccgauaguucugacccccccaaccugugcgaggaggaagaagauuugagucuucugggaagugaggagagcgccucaucagcagggacucagcccacucuccggcucuuuaguuaugcuugcucuuaauuuucaugacuuugcuguccagcacgcucugggcacuagugagaugcuuuauggcaucaagcacaaggaugcuugguaucaccaaccauacagcauucaggaaaacaaaauagaaccagaaauaaacgggguggccuaucuccccaugcuggaguccuucguguagcucugucaggaaguacagcacauccccguauaucuggccugugggaggcaagagaaggaaaaguccucgugaggauaaggaaaacaagccaggcucuacuccaugguauuccccaaggcaauucuucaaagaauucaacccacauucugaaaccaaaguuggaaaucggacauaacgagguacaaauuucagaaaucaagagucuggggaucuuuuuuuccuuucuugccuucuucuccccaacccuccuucccucccucuaccccuaccuccuacccaccccaccgugugugugugugugugugugucagagagagagaaagagagagagucuugcuauguagccuagguugaccuuaaccucgcaaucauccugccuuagccuucugcaugguaggauuauaagcauguacccaugcaccccgacacccagcaagagcauggagacuuuaacucagggcagcucauaauagaacugaaggcaagcuuaaaauccuagaaugcaugacaacucaggauuucagaaugaaagagagcucaaguaagcaaacaaaagaaagcuaacacuccggggccugcuucuggaggacccaggaguguugggcagcaucgaauacaucacaucguaaccuuuguaggaaacugauggagaaagaagagaaauauacauuucggcugggaaggcaagcacggagagggauugaggugugucaagacaccaaggagccuauaacucagcaugucucaucccugaauggacacuuaggagcucucacccauggggaugugccugugucuauggauuuccccaggaacccuugaagugccagguauauaggcuuucuuacccauagacaccacaagcuguaggacaaagcggaagggcuguuggcggagaaaggcaaucacuacccauaggcugagugguccccagagacaagcugugacagucuccauacagacgacgaagcugucacuacugcaagagaaaagaggacacuggcaucauugugcucucauuaauguccccaacucaccauugucacaaaccaaugcagguuuccacuaacacaggccaaauacuuacaggauauaucggcuaucucccuuggaauacucuuucccugagggaaacagagauacaugaagaauuaagucaggaaacagaacuuguaucuaugauaaucacuguaagacagcaaacauuauaauacuguguacaguggagguaguacuuuugcuucugaaguguguguuuauauagucuguguaaagacugauauggaacaauguugcagagguuacaugguaugcaguauaaaaggaaguauaaaugauggagcauguggcucaggcguaauagugcaugucuguaaucuuagcacuggggagguagaggcaggaagcugagaaguucaaguucauccuuuaauuacauagauacuuaggagccagcccagacugcaugaaacuccgucuggaaaaaaauagaagauggagagugagguggagguuggagggggaccgagcaaguuugugcacacauacauaugaacacauacauaugauaggugcaugaaagagugagcaguuaauuggaagauccaagaguguagcucacugauagagcauaucugaggcccuggguucuauccccaacaccucuuccaaaccauaaccccagaacaggcaagggguuuaaauagguucuucccaaagaauuuccaaauggccaaugaacguauggaaggugcucacagcgucauuaguccucaaggaaaagccaucacaucuacuacagggacuaauuuaggaaacacaugauggcaccaaguggauguggaggaaccagagcucugcugucaugaugggacugugacuguacaaucauuucugaaaacaguuugguaggguucucucgcaaccuaaaugaaguccaaggccuugaaugugccaaguaagcacuagagugcugagcuucgccccuaaaacuguaaccauagcuaccauaaaagccagccauucaccugucuauaguuauuuaagguaaaugagaacagcuguguguauguauauggauggauggaugcacauaugugugugcauguaaaauagaaugcucauagcaguuuuauuccuggggccaaaaagacauugucaagaauauagaauucuugggggaaauacccuucaguacuguacaagccaauaauuuuauaauguuuaugcuuuaugaaaugagugaccccacuuuuuuugagacagggugucucuguguaguccuggcuguccuggaacucacucuguagaccaggcuggccucgaucucagaaaucugccugccucugccuccugagugcugggauuaaagccaugcaccgccacugcucagcugagugaccccauuuucaaaagcaacauuuggaagugcaggugugccacacuaucauuuauaugaugacucaucaaacaauuaacaggcugggugugaugguagagaccuuuaaucccagcaucugggaggcagagaggcaggagaauuucugaguucaagacuagccuugucucucugggcaguggugguacacguauaccuauacauacauacauacacacacacacacacacacacacacacacacacacacacacagauaagaucauugacugcuuuucagaaggucagggcaugcacauugugacucauaauccuuuuuagcucugguccuagggggucccaauucccucuuuugaucugcagguauugcauacauggauuauacagacauuuauguaggcaaaacacucauguacaucaaauuaaaauaaaaaauauuaauuaaaaaaaagauugggccgggcgugguggcgcacgccuuuaaucccagcacuccggaggcagaggcaggcggauuucugaguucuaggccagccuggucuacaaagugaguuccaggacagccagggcuaugcagagaaacccugucucgaaaaaacaaaaacaaaaacaaaaacaaaaagauuagggcuggagagauggcucagcgguuaacagcacucacugacugcucuuccagagguccugaguucaauucccagcaaccacaugguggcucacagccaucuguaaugggaucugauacccucuucuagggugucugaagacagcuacaguguuuuauacauaaaauaaauuaauguaaaaaaaaauuaaagauuaaaaaaaaaagcccagccaggcgugguggcacaugccuuuaaucccagcacucaggaggcagaggcagguggauuucuaaguucgaggccagccuggucuacagagugaguuccaggacagccagggcuacacagagaaacccugucucgaaaaaccaaaaaaaaaagaaaagaaaagaaaagcccagccauccuuaauuucaguuucaggggaucuggugccuucuucccuccuccauggguauguacaaggcauaaacacuuaugugcaggcagaacauucauaaacacaaaaugaaaauuaauaaauuugggcuggagagauggcucagugguuaagagcacaacugcucuuccagagguccugaguucaauucucagcaaccacaugguggcucacaaccaucaguaaugggauccgauguguacuggcuaguuuugugucaacuugacacagcuggaguuaucacagagaaaggagcuucaguugggaaaaugccuccaugagauccaacuguaaggcauuuucucaauuagugaucaaggggagagggcccauuguggguggugccaucuuugggcugguagucuugguucaauaagagagcaggcugagcaagccaggggaagcaagccaguaaagaacaucccuccauggccaucagcuccugcuuucugaccugcuugaguuccaguccugacuuccuuuggugaugaacagcaguauggaaguguaagcugaauaaacccuuuccuccccaacuugcuucuugacaauguuugugcaggaauagaaacccugacuaagacacaaugcauucuucugguauggcugaagacagcaacacuguauucauauacauaaaauaaaucauuuaaaaauuaauaaauuuaaaagauaaaaaugaagaaucccagcacagaaaacaacugcucaggguuuaaaaaaaaaaaaaaguuaacaaaauuagaaaaaaaagagaaagcauuggugaguggguaacuaucaaagugaaucucuacccagaaaauucccucccacaauacaagaacucaggacucacagaguugggauaagaaggcuuggucuucuaaaaggaugccauuguagagagagaaccagcccucgaucacaaggugaaugaagguacacacagcaaaccagcacaaggccagucgccgcccagcuccaagugggacgacggaagcucggcuagacaacagccacgugaucacaauuaggcccccagagauggagaagaggccaaccaggauaugcgaagucgggaggucauuaggcacgaaguuguccagcuucaggugccugggccaguacgggugcaaggggaccguauugguggucauguuucuauggcccgcuggcagcuucguacauaaacgaggacaaagggacagaaaaaccugggcaaacagaaagcacguggugagauaaaccaaauccaaauacuuuucaacaagaaauguaagugaacuguaucuauuauuugaccgaauaacuuauaagccuggauuuuaaaaugaccaaguuuagcugaagcuggugucacacgcacuuaugcaaugaggcccagacuuugaaggcagguggaucucuguaaguuugacgacagucuggccuacacagugaguuccagguuagccagggcuacaaaguaauacccugucucagaaggagaaguggggaaaggaaagguggggggggggggggagaaagggaucuaauuuugaggcauuucaagaauauaacugggggggggggaaguggggggcugaaaacauggcucagagguuaagagcacugacugcucuuccagagguacugaguucaacucccagcaaccacaugguggcucacaaccaucuguaaugagaucuuaugcccucuucuggggugucugaugauagcuacaguguacucauauacauuaaauaaauaccauuuuuuaaaaaaagaauauaacuggggauguauccgugauuuagagcacuuucucuugcaaaggaccugaguucaauuccaagcacccacaugguggcucacaaccauuucuaacuccaguuccaggggauccaacaccuucuggcuucugugggcacauacauacaugcagucauaauacucauauaaaauaauacucauaauagucauaauacucaaauacacauauaaaauaaaauaaaucuuaaaaagggaccauagcucagaucugaaaccuuauaaagaauaaaggcuuggcugaggccccuggcaaguauagcaacaagaagcgggccuggcuugugacaggagagcuagguagaaaaucgaguagccaugagaaggaaaaagguccuccucacucucucgguaggaauggcagagauguugacguauuugacaaggucaccuguaaaagaacuauaaacccuucugcgaaacaaacagcacaaaccugucaaaacuggguaauggacucaaauccaaaguccuugccaaacaugcauaaagauuucuuugaucaacaaguuuucucuaccaucuucaccggcaaguaaguacugaaaucuacugcuuaagcacagugcauuaaaaaaaaaaaaaguccccaaccacacacuuuccuuuuuuuuuuucuuuucuuuuguuuuugguuuuuucaagacaggguuucucuuuauagcucugacuguccuggagcucacuuuguagaccaggcuggccucgaacucagaaauccaccugccucugccucccaagugcugggauuaaaggcgugcgccaccaccucccggcucacacuuuccuuaauauuuccacucaguuauauaacacugcaugguagcacauaccugaaaucccaacauucugcggggcgaagcugaagcauugccauagcuagccuggucuaccuagaaaguucggggaagcugggcaugguggcgcaggucuuuaaucccagcacuugggaggcagaaaguucaggguagccagaacuaaauagcaagauacuacauucaaacaaacuuagacauuaaguagcuuccaagaccuccaagucagauaaagagcuucugcugggugccuaggugcauuccuuuccuuugucaagugcagcagaaacucucuaacuuugcuucauugugauacccccuaucguuuuuuucugacacagcggguuucaaggccgcugguacaccuaggcagaggcuccugaggcucuaaagaggaaucaucagauuguacugccagcaucaucgaguuguacuucugguugcuagucacagaguaugaucacagucuggugggcgagucacugucaacaagccagguccuagcacuuuggggcucaguuuguuggaaagacacaggaauguagucggggugcacugcaggguccaguggcugagauuuaacuggacgcuacucccacccgcagggggcugcagagaugaggaaucagagcugcggccccaagcaccacguuucaaaagcaagaguccaggcaauuagugugccacccugcaacaagcuagaaguagcaaaagcaggggucucacgggcggcgcuaaccaagagaaaggaaaacaaagcccagagaccaccaaucacaaccagaacccuccacuguagcugcccaacgagagggcgagucuuccgucgucuggacaaccgauuuagggcccgggucccgcgcaagcgcaggguagggcaggacucgcaggcaaaccgcugucguggagggucugggcacguggaggggcucggacaagcuggcuggcacucaccccaggcggcgcgaucgcagggcgacuuccuaacacaggcuugcgacuuuccaggaagaccugcaggcucccuaauagccccaguuccgcucagcucuagcgcuuccccgcccgauggagcggaccaauagugaaguggagaagguggcuucugccaauaggaguccuccgaaugucgcaggcccuguccucgccuauggugucaucuucccuguuggcugagaccaagucaggaguaggguggagaccuccaaggucugugggcgcuuucucccgauagcaaaucuaugcuauucugagcuucaauuucccugcccucuuaucaaucgcacaagaugaggcugaaauuugaaacccucaacauuugcuagugaccggaguugcguggucuucuaaguuuucuaggcaaccaaucaguucccggacccauucuuagcccaaaugcagagaauacgacagguggauuacauucaguacaaacaaaccuagcgcccaccagagcucagaacucuccaguccuaacagcaucggucaccuucaaacccucacuccugcugagcaguugguguagacucucaacagugccaguucuuaaaagccaaacagaaggcaugacgguaaacaaguuggcaaacagaccucgucagcauuuagucagaauauugaucaucucaaacugucauuuuaauuauuaccuacggaccaguaggcaucaacccuucuu

SEQ ID NO: 9386 - RNA, 8198 nt, Mus musculus
aagaaggguugaugccuacugguccguagguaauaauuaaaaugacaguuugagaugaucaauauucugacuaaaugcugacgaggucuguuugccaacuuguuuaccgucaugccuucuguuuggcuuuuaagaacuggcacuguugagagucuacaccaacugcucagcaggagugaggguuugaaggugaccgaugcuguuaggacuggagaguucugagcucuggugggcgcuagguuuguuuguacugaauguaauccaccugucguauucucugcauuugggcuaagaauggguccgggaacugauugguugccuagaaaacuuagaagaccacgcaacuccggucacuagcaaauguugaggguuucaaauuucagccucaucuugugcgauugauaagagggcagggaaauugaagcucagaauagcauagauuugcuaucgggagaaagcgcccacagaccuuggaggucuccacccuacuccugacuuggucucagccaacagggaagaugacaccauaggcgaggacagggccugcgacauucggaggacuccuauuggcagaagccaccuucuccacuucacuauugguccgcuccaucgggcggggaagcgcuagagcugagcggaacuggggcuauuagggagccugcaggucuuccuggaaagucgcaagccuguguuaggaagucgcccugcgaucgcgccgccuggggugagugccagccagcuuguccgagccccuccacgugcccagacccuccacgacagcgguuugccugcgaguccugcccuacccugcgcuugcgcgggacccgggcccuaaaucgguuguccagacgacggaagacucgcccucucguugggcagcuacaguggaggguucugguugugauugguggucucugggcuuuguuuuccuuucucuugguuagcgccgcccgugagaccccugcuuuugcuacuucuagcuuguugcaggguggcacacuaauugccuggacucuugcuuuugaaacguggugcuuggggccgcagcucugauuccucaucucugcagcccccugcgggugggaguagcguccaguuaaaucucagccacuggacccugcagugcaccccgacuacauuccugugucuuuccaacaaacugagccccaaagugcuaggaccuggcuuguugacagugacucgcccaccagacugugaucauacucugugacuagcaaccagaaguacaacucgaugaugcuggcaguacaaucugaugauuccucuuuagagccucaggagccucugccuagguguaccagcggccuugaaacccgcugugucagaaaaaaacgauaggggguaucacaaugaagcaaaguuagagaguuucugcugcacuugacaaaggaaaggaaugcaccuaggcacccagcagaagcucuuuaucugacuuggaggucuuggaagcuacuuaaugucuaaguuuguuugaauguaguaucuugcuauuuaguucuggcuacccugaacuuucugccucccaagugcugggauuaaagaccugcgccaccaugcccagcuuccccgaacuuucuagguagaccaggcuagcuauggcaaugcuucagcuucgccccgcagaauguugggauuucagguaugugcuaccaugcaguguuauauaacugaguggaaauauuaaggaaagugugagccgggaggugguggcgcacgccuuuaaucccagcacuugggaggcagaggcagguggauuucugaguucgaggccagccuggucuacaaagugagcuccaggacagucagagcuauaaagagaaacccugucuugaaaaaaccaaaaacaaaagaaaagaaaaaaaaaaaggaaagugugugguuggggacuuuuuuuuuuuuuaaugcacugugcuuaagcaguagauuucaguacuuacuugccggugaagaugguagagaaaacuuguugaucaaagaaaucuuuaugcauguuuggcaaggacuuuggauuugaguccauuacccaguuuugacagguuugugcuguuuguuucgcagaaggguuuauaguucuuuuacaggugaccuugucaaauacgucaacaucucugccauuccuaccgagagagugaggaggaccuuuuuccuucucauggcuacucgauuuucuaccuagcucuccugucacaagccaggcccgcuucuuguugcuauacuugccaggggccucagccaagccuuuauucuuuauaagguuucagaucugagcuauggucccuuuuuaagauuuauuuuauuuuauauguguauuugaguauuaugacuauuaugaguauuauuuuauaugaguauuaugacugcauguauguaugugcccacagaagccagaagguguuggauccccuggaacuggaguuagaaaugguugugagccaccaugugggugcuuggaauugaacucagguccuuugcaagagaaagugcucuaaaucacggauacauccccaguuauauucuuuuuuuaaaaaaugguauuuauuuaauguauaugaguacacuguagcuaucaucagacaccccagaagagggcauaagaucucauuacagaugguugugagccaccaugugguugcugggaguugaacucaguaccucuggaagagcagucagugcucuuaaccucugagccauguuuucagccccccacuucccccccccccaguuauauucuugaaaugccucaaaauuagaucccuuucuccccccccccccccaccuuuccuuuccccacuucuccuucugagacaggguauuacuuuguagcccuggcuaaccuggaacucacuguguaggccagacugucgucaaacuuacagagauccaccugccuucaaagucugggccucauugcauaagugcgugugacaccagcuucagcuaaacuuggucauuuuaaaauccaggcuuauaaguuauucggucaaauaauagauacaguucacuuacauuucuuguugaaaaguauuuggauuugguuuaucucaccacgugcuuucuguuugcccagguuuuucugucccuuuguccucguuuauguacgaagcugccagcgggccauagaaacaugaccaccaauacgguccccuugcacccguacuggcccaggcaccugaagcuggacaacuucgugccuaaugaccucccgacuucgcauauccugguuggccucuucuccaucucugggggccuaauugugaucacguggcuguugucuagccgagcuuccgucgucccacuuggagcugggcggcgacuggccuugugcugguuugcuguguguaccuucauucaccuugugaucgagggcugguucucucucuacaauggcauccuuuuagaagaccaagccuucuuaucccaacucugugaguccugaguucuuguauugugggagggaauuuucuggguagagauucacuuugauaguuacccacucaccaaugcuuucucuuuuuuuucuaauuuuguuaacuuuuuuuuuuuuuuaaacccugagcaguuguuuucugugcugggauucuucauuuuuaucuuuuaaauuuauuaauuuuuaaaugauuuauuuuauguauaugaauacaguguugcugucuucagccauaccagaagaaugcauugugucuuagucaggguuucuauuccugcacaaacauugucaagaagcaaguuggggaggaaaggguuuauucagcuuacacuuccauacugcuguucaucaccaaaggaagucaggacuggaacucaagcaggucagaaagcaggagcugauggccauggagggauguucuuuacuggcuugcuuccccuggcuugcucagccugcucucuuauugaaccaagacuaccagcccaaagauggcaccacccacaaugggcccucuccccuugaucacuaauugagaaaaugccuuacaguuggaucucauggaggcauuuucccaacugaagcuccuuucucugugauaacuccagcugugucaaguugacacaaaacuagccaguacacaucggaucccauuacugaugguugugagccaccaugugguugcugagaauugaacucaggaccucuggaagagcaguugugcucuuaaccacugagccaucucuccagcccaaauuuauuaauuuucauuuuguguuuaugaauguucugccugcacauaaguguuuaugccuuguacauacccauggaggagggaagaaggcaccagauccccugaaacugaaauuaaggauggcugggcuuuucuuuucuuuucuuuuuuuuuugguuuuucgagacaggguuucucuguguagcccuggcuguccuggaacucacucuguagaccaggcuggccucgaacuuagaaauccaccugccucugccuccugagugcugggauuaaaggcaugugccaccacgccuggcugggcuuuuuuuuuuaaucuuuaauuuuuuuuuacauuaauuuauuuuauguauaaaacacuguagcugucuucagacacccuagaagaggguaucagaucccauuacagauggcugugagccaccaugugguugcugggaauugaacucaggaccucuggaagagcagucagugagugcuguuaaccgcugagccaucucuccagcccuaaucuuuuuguuuuuguuuuuguuuuuguuuuuucgagacaggguuucucugcauagcccuggcuguccuggaacucacuuuguagaccaggcuggccuagaacucagaaauccgccugccucugccuccggagugcugggauuaaaggcgugcgccaccacgcccggcccaaucuuuuuuuuaauuaauauuuuuuauuuuaauuugauguacaugaguguuuugccuacauaaaugucuguauaauccauguaugcaauaccugcagaucaaaagagggaauugggacccccuaggaccagagcuaaaaaggauuaugagucacaaugugcaugcccugaccuucugaaaagcagucaaugaucuuaucuguguguguguguguguguguguguguguguguguguguguguauguauguauguauagguauacguguaccaccacugcccagagagacaaggcuagucuugaacucagaaauucuccugccucucugccucccagaugcugggauuaaaggucucuaccaucacacccagccuguuaauuguuugaugagucaucauauaaaugauaguguggcacaccugcacuuccaaauguugcuuuugaaaauggggucacucagcugagcaguggcggugcauggcuuuaaucccagcacucaggaggcagaggcaggcagauuucugagaucgaggccagccuggucuacagagugaguuccaggacagccaggacuacacagagacacccugucucaaaaaaaguggggucacucauuucauaaagcauaaacauuauaaaauuauuggcuuguacaguacugaaggguauuucccccaagaauucuauauucuugacaaugucuuuuuggccccaggaauaaaacugcuaugagcauucuauuuuacaugcacacacauaugugcauccauccauccauauacauacacacagcuguucucauuuaccuuaaauaacuauagacaggugaauggcuggcuuuuaugguagcuaugguuacaguuuuaggggcgaagcucagcacucuagugcuuacuuggcacauucaaggccuuggacuucauuuagguugcgagagaacccuaccaaacuguuuucagaaaugauuguacagucacagucccaucaugacagcagagcucugguuccuccacauccacuuggugccaucauguguuuccuaaauuagucccuguaguagaugugauggcuuuuccuugaggacuaaugacgcugugagcaccuuccauacguucauuggccauuuggaaauucuuugggaagaaccuauuuaaaccccuugccuguucugggguuaugguuuggaagagguguuggggauagaacccagggccucagauaugcucuaucagugagcuacacucuuggaucuuccaauuaacugcucacucuuucaugcaccuaucauauguauguguucauauguaugugugcacaaacuugcucggucccccuccaaccuccaccucacucuccaucuucuauuuuuuuccagacggaguuucaugcagucugggcuggcuccuaaguaucuauguaauuaaaggaugaacuugaacuucucagcuuccugccucuaccuccccagugcuaagauuacagacaugcacuauuacgccugagccacaugcuccaucauuuauacuuccuuuuauacugcauaccauguaaccucugcaacauuguuccauaucagucuuuacacagacuauauaaacacacacuucagaagcaaaaguacuaccuccacuguacacaguauuauaauguuugcugucuuacagugauuaucauagauacaaguucuguuuccugacuuaauucuucauguaucucuguuucccucagggaaagaguauuccaagggagauagccgauauauccuguaaguauuuggccuguguuaguggaaaccugcauugguuugugacaauggugaguuggggacauuaaugagagcacaaugaugccaguguccucuuuucucuugcaguagugacagcuucgucgucuguauggagacugucacagcuugucucuggggaccacucagccuauggguagugauugccuuucuccgccaacagcccuuccgcuuuguccuacagcuuguggugucuauggguaagaaagccuauauaccuggcacuucaaggguuccuggggaaauccauagacacaggcacauccccaugggugagagcuccuaaguguccauucagggaugagacaugcugaguuauaggcuccuuggugucuugacacaccucaaucccucuccgugcuugccuucccagccgaaauguauauuucucuucuuucuccaucaguuuccuacaaagguuacgaugugauguauucgaugcugcccaacacuccuggguccuccagaagcaggccccggaguguuagcuuucuuuuguuugcuuacuugagcucucuuucauucugaaauccugaguugucaugcauucuaggauuuuaagcuugccuucaguucuauuaugagcugcccugaguuaaagucuccaugcucuugcugggugucggggugcauggguacaugcuuauaauccuaccaugcagaaggcuaaggcaggaugauugcgagguuaaggucaaccuaggcuacauagcaagacucucucucuuucucucucucugacacacacacacacacacacacggugggguggguaggagguagggguagagggagggaaggaggguuggggagaagaaggcaagaaaggaaaaaaagauccccagacucuugauuucugaaauuuguaccucguuauguccgauuuccaacuuugguuucagaauguggguugaauucuuugaagaauugccuuggggaauaccauggaguagagccuggcuuguuuuccuuauccucacgaggacuuuuccuucucuugccucccacaggccagauauacggggaugugcuguacuuccugacagagcuacacgaaggacuccagcauggggagauaggccaccccguuuauuucugguucuauuuuguuuuccugaaugcuguaugguuggugauaccaagcauccuugugcuugaugccauaaagcaucucacuagugcccagagcgugcuggacagcaaagucaugaaaauuaagagcaagcauaacuaaagagccggagagugggcugagucccugcugaugaggcgcucuccucacuucccagaagacucaaaucuucuuccuccucgcacagguugggggggucagaacuaucggacuugucccacucaaacaugaugagugagcacacaaagggccagagucagaaaaggaagggaacaaguugagcuacugcuaggaaccugagggaaaagauggaugagaagguggcaaguccgugacgguggcaacuucccaaaccaggaaauaaaaugucuuuuacuauaacacu

SEQ ID NO: 9387 - RNA, 14024 nt, Mus musculus
uuugggaaauguaguacauagguuaaauaaccgucccgauguaaaagggaaaaggcggccaaguaaguuaucuugucugagugagcgggcgaugggggagggguggaaguuucccacgucaaggucucuccguguagccagacuagccgagaacucaggaucuugcuccggaucgcagcuauaggacccuggccuugaaacaaagaacaaagagccgguucacaagccuugcaaaacuauuggccagacgaugucaguugcauucugggaacugaaguuccugugaccgggauaugucgacacaagaugacgagacuaacgucauacguugugcuccggucuggaucuccguggaacugaacuguuuuacaaagcaaacuuuaccgcguggcgacaaccucuaggcguguacgacaggccuucggguccacuccgaacaccaacuggagucuguaauuuucaguuugcaaacuguucucgaggcuggugaacagccacgcucuguauccaagagcugagguagguccuagggcacugaugacuugaaagggaccgagacuggaggcaugccugcccugucuccaacucgggaugaggggauucacucucgguacugcagcugcauaguucagucaagccccgagaagcuugccuagagcagggaacuagauuguuaggugaacucgaacggggugcagcauagagcuacacaacugaucugcuaucugcugggccgacuugaaggguauuuggcgguucugaugggcugauggucuuugaggcucugcagauggucuuagggauguuacuaaaagaugggucuugaagguauuacacucguggugcugugucugcuggaaaauuaaugaaggcuaauaauaaaagugguggcuauuuggcaguuuacauaguaaucguauuggugagguucuggagagaauaacaggugcguaggcagagugcuaaacuaauggggucagugacgaaagacaaaauagaagcuauaugagugacagagguaaucuuuguauugaugcaaaggaucccaaaggccacucgugugaucuuugagagguugguuggagggcugaguuaauggagcugguaaauugguguaauggagcccuaacaggucaugguccuccaggcauuaguggggauuaaggugguaguaacuaaugacuggaagcuuaaucuaugauggaauugguggacugcagaguggagagagagagagagagauuaggcuaugggagauggaaugagguugugucggguaauaggugugaaaagcaaggacuuaauggagggaguaguaggguucugugacucuaaagauaauggaaauaacuagagacggucagguguugauagagaugaaaugggcagagaaaaugguugcgagagagauuacuuguguaguguguccgugacaguaguuggaagagagcagagucaguaguggguccucugucaguuaacuguggagucugugaugucccucagagauggggaccuaaaugugaucagaaaaagggccugagaguucaugauaagguccugggcuucggguuccauguguugaaugagcugacugucgugugggacccaugaacucaguuagcuguacuuuguuuucuuugaccugcgcaggacagcaucagcacacacugucugccagcagacugagaugggacggacaucuaaggauaaacgggaugucuacuaccgccuggccaaggagaauggcuggcgggcccgaagcgcuuucaagcuccugcaacuggaugaggaauuccaacucuucaaaggugccuaaucugggggcuaagugaccugggaguggaagagcaggcugcuucugaagaacucacuguaguagcugggcugacuuggagcacggagacggggaaggagauagaccacaaaagaggaggaggaggagggcacaggggcaguggguagacauagguucuccacaggacagaggugacuuuugccgcaucuucuggucaugcagcugagcaguaugucuucacugugugugcacaggugugaagcgagcgguugacuugugugcagccccaggcagcuggagccaggugcugagccagaagguugggugaguggaggggcuagagggugaccuggggggcgggggaggcguggggcgucaauccgaugcugacaugugcuauccacaggggccaggguucuggucaggugguggccguggacuuacaggcuauggcuccacugccaggugugauacagauacagggcgacaucacucaggugagugagagcaugccuacgaauauugggguuauccugagugacugccuucguuugggggacaguagaaaggagaagagaaacaagacaauaaaaaaaugagaaaggcuauuuaauccucgaauuuuaaaaagcugagggugaaggauaauaagaccaaagcuggccugaguuaucaaaggacuucgagauggcuugagcaggcaaagcuggccugaguuaucaaaggacuucgagauggcuugacagcaaaccaggugacugaguucaaucccaaaugguguccucugaccuccacaugcguauguacccagacacgcacacaauuaaugaacaaauaaaugcaguuuuaaaauaucuaaggggcuggagagguggcucagcaguuaagggcaaucacugguugcucuuccagaggauauggguucaauucggaacacccacacaguggcgcacaacugucugcaacuucagucccagggaaucaguugcccucuucuggccuucccccaguuccaggcacacaugugaggcacaaacaugcauaaaggcaaaauacccauauaccuuaagaaaaacaaaggaagaaagggagagagggaaaucgagagcauuucuaauuaguuuauuaauguuguuauuaguuguuguauguguguuugggggaggggucgggugccaugguguucguauagaggucagagaucacuuggaggagucaguuuucgcuuuccacucugaguuccaggaguggaacucugggucacaaggccuggcagcaagugcuuuaccuaccaagccaggucaccagccccuuaaaaauguuuucuuuuuuuuguuuucuuuuuguuuguuuguuuguuuguuuuuucgagacaggguuucuguguagcccuggcuguccuggaacucacuuuguagaccaggcuggccucgaacucagaaauccgccugccucugccucccgagugcugggauuaaaggcgugcucuuaaaaauguuuucuaaaagaguaaauaagaaagaggaggggacuggauauguagcuuagugcuagaacccucaugugguauaaacagagcauacuggguucugucccaguaccaaaagacagaaccugagaaagacggagauugacccccugugcguagacuguauugcagagacaccaaaagauggugaggaugguuccccagagauccaacuacgucuuagucagacaaagccuccagaacauggcuguccccaaggcuuugaggcgagggcuguaggcaggugggauuugagggugagggcagcagagggguacuaaggcuguucaccccccuuucuccauagcuuuccacugccaaggagaucauccagcacuuugaaggcugcccugcugaccuaguagugugugacggggcuccugaugguaaaugcgcugugagggugaccucugucucuuagcucaguuuuuuuucucccucuuucccucuguucuuuccauuuccccccuuucuggcagucucucccuaucuccgcccucauugcccauccuccuccucccugccuuucaaguuuguuuggguuugguuuuuuuuuuuuuuuuggacuguuuuguggugcuaaaaauagaugaacccucaugugugcgaggcaagucuucugcugcuaagguuuacccccgcccgucagcuucgugcuagacugugugucaagcccccugccuucucaucugagagccuggccaauccugugcuugguuuuugauuuguggguugguuguuuguuuguuuguuuguuuguuuuugccacccauuuauucaaaacauuuucugaccacacguuguguugggaaagugugcauaaauaaauuccacuggucucuggccuugugaagucaauguuuccgugggauugcauagaaaagacacaguugagggcuggagagguggcucagcaguuaagagcacugacugcucuuccagagguccucaguucaaaucccagcuaccacaugguggcucacaaccaucuguaaugggaccugaugcccucuucuggugugucugaagauagugacaguguacucauauacauuaaauaaauaaaaucuuuaaaaagagagacaguugaucugauggcucaaugccuguaauugcagaucuugggagacugaggcagaaagaucacuggagcucaaggucagcccauucucaaaaaauaaaaaugggggggcgggcuggcuuaaugguuaagaaugcuuguuauucuuccagggaacugaguucauuugagagccauccaugccuggugacuugcaacugccuauagcuuaaacuccagaggaucugacacucuucuuuugguccccaugggcacacgcaugugacauacaaaaugcagacacacauacauaaaauguuuuaaaaauacacaaaaugaauagcaauucacaauuuuuuaaaauuuauuucuguuuauaugaguacacuguagcugccuucuucagacauaccagaagagggcaucagaucccauuauagaugauugugagccaccauguaguugcugagaauugaacucaggaucucuggaagagcagucagugcucuuaaccgcugagccaucucuccaucccuacaauuuuuaauaaaaagauaaacuuuuuaaaaagauagaacagguaauagaucauguagggaagucacuaagacaggcugaggaaguaaaaacuaccugcugagauuugaaauaaaauagauaggaaaggcuguauugacuuaucaucagaaagaauugauagcgaaggggcuaacagggcugucaguuacagcacugcccuugauagugcaaacuuggagaaagccugaggguuguagaccaaggaaguaucccuuaggcuucuugagcagugugaggggcagagguggaagcagacacacacacacaccaagaggagcuggccacugcaguagugcaaaagaguaacuuauaacagugggggcuccagucacagguaaggagagaauggucccacuuugaaaauagaaugggcuggaucugcuaaggucuggaaugugaguaugaugcgggccaaaguuggucacagggacuaagguuuuugacaugaguaacuagaagaucggaugagcugagaaacaucaagaaacugguaauagagaaggaaguagaaaucugcuuuugaacugguugcaccuaugggguugguuuaucaauacagccccacgaagccaucuggguagagguagacauacuagugcugcuuguaggacaaguaguuuuccaggauuaaaaugacuucccagguugcuaagcacucggggcucaaacucuaguuggaagacaaugcucuuuccagaaccuucacaguaagaaggccugaaaaacauccuugguuuucuaaucucugguauaagaagacaugucaagucagagaguccccuaaugcuguucuucuugcuacagucacuggucuccaugauguggaugaguacaugcaggcccagcuucugcuagcugugaguaacccugguggcugccucugcccuccuuuggccccuucuugccugcuucugccuccaccauacccgccuuuccuuuuugcaggcucucaacaucgcuacucaugucuugaagcuagggggcugcuucguggccaaggugagccuuggggauccugcaggaguggugagaaaggucccugccgggaaagggcccccuuacuucuauagcuugccuuccacacccuacagauauuccgaggccgggaugugacccugcucuacagccaacuacguaucuucuucuccagugugcucugcgcuaagcccaagagcagccggaacucuagcauuggucagugggugggugacauggaggccugauuggcaagggggugauuggccaugugucugcacaagguugaggugacagagagucaccccucacuccagguuuucccccacagaggccuuugcugugugucaggguuaugacccuccugagggcuucauuccagaccugaccagaccccugcugaaccacucauauggugagagccagagcugguggugacccaugccugggaaaacuuuaccagcuccgugugccuugugucucuuuuuuuuuuuggggggggggggguuauucggcuuacauuuccauacugcuguucaucaccaaaggaagucagaacuggaacucaagcaggucagggagcaggagcugaugcagaggccauggagggauguucuuuacuggcuugcuucaccuugugucuguugagagcccucugccucacacuccgauggcaguuguacccccuuagggauauuucagauagucuuccaaugguagccuugguccugguagaaauucuguugcagcaaacuaagcauucacccagggaagauccuaagugucuaccuuagggaaccccucagguagaaagcucaccuguauuaaacauguccccuguggaagucuguagccucuaaccugauaggcaaagguggaaccugucucuguagauccuauuugcaugagacaagguagaauguacugguaaaacgcugagcgggcaugguacagugaaaaagccaggccacaggcugacauuuuagcaacagugaucagaagggaaugugcaccagagggaaaaaggaccaugaugguggggagggggacuucagugcugguguagacuguaucuucacucugccucuuucuaagauacagauuucaaccaguuggauggucccacccguguuauugugcccuuuguggccuguggggaccucagcgccuacgauucggaccgcacuuacucucuggaugugaguguccagccagcggggcagggggcaggagauugucuuggacuggcagauccucaucaucucuuguguccuacagcuagacgguggcucugaguacaaauauacuccacccacacagccccccaucgcacccccauaccaagaggccugcagguugaagaagaauggacagcuggccaaggaacuccucccccaagaaugcuccaucaacaguguggacaaguugccccagccucuggcuauccauacccugcuagaccccaagguauggauauguaccucugagcccaccaugacaucuccccagugugcccguuucuguccugacugacucccucuccugguccuuuccugccuugcaaucucuuuaagaaucccuagcucagcccacugacaaauggaaaaauguagccaaauagcugaguuccuuuucucuuucuuuggcagguggaagacaaugaaauucauuguugaccuuaacacauuaagguaaauuugcuuuuuuccccuucuaaaguucaaguaaaggguaccuuuaagaacaaucugaauagggacugcaggcuggcucucuaguuaagagcaaggauugcccuugcagaagaucugaguuugguuuccagcaaccacgugugggagcucacaacugccuaugacuuccacaggagcagacaucucuggccucucaggauaccuacauucacaagcacacacccaggacacacauacacacacacacaacacacaauuaaaaauaauaaaaauaguuuggucauggugucacucacuuuuaaucccagcacuuggagggguggggugcaagcaagucucuacaaguuugagguuagccuggucugaauaguuccaggccagccagugcuacauaaugagacccugucuguuaaaaaggaaagaaggaaggaagaaaggaaaggaaaggaaaggaaaggaaaggaaaggagaggaaaggagaggaaaggagaggaaaggagaggaaaggagaaaggaaaggaaaggaaaggaaaggaaaggaaaggaaaggaaaggaaaggaaaggagaaaggagaaaggaaaaaagaagagaaaagaaaucccucaguggguugaaaauauaacucaguuuguagagugcuuaccuaaaaugcauaaaacccagguucaaucucuagcuaccacauaaaagucgaggcagaguaaucuuagcacccagcagauacaauagaagcagcagaguuucuagagcauccucagauccuuagcagguuugaagccagcaugagcuacacgaaaaccugucucaaaaaguaaaagaccucaguacaguuuuacggggguuuuuuuuugaaacaggguuugucuaacacuagcucuguaaagcaggcuggccucaaacuuaucagagauccaccugucucugccucgaguucuggagugaaaggcaaacacugccaccacccagggacuuuaaaaaauaaaguuuauuuauuagguauacacucauacacauacaauuuuuuuaaaaucuuuaaaggguuaaaagguuccaucuucaaugcugccaagaaaauaaaacagauaaauuaagagcuggggauguagcuuaguuaguaaaaugcuugucuggaacagacagagcucggagccccaguaccauguagcccaugccaguaauccugugguaggaaguugucuuaguuacuuuuucauugccgugauaagacaccaugaccgaggcaauuuauagaagagaaccuucauuggggauuuacaguuucagaggcagagcccaugaucaccguagcagggagcauggcaguaggcuggcauggcucugguguaauuguaauuaguaauugugagauauaaaccacggggcagacacaaacggggguggggggggagauuacugguaauaaccugggccuuugaguccuuaaaauuuguccccagugacaacgccucuuccaacaagacuguaacucuuaaucucucccaaaacacuucuaccaacugggcaccaagcauugaaauauaugagccucuggggaccauucucauuuaaaccaccacagacauucagaaauacaaggucauccacaacucuauaccaaguuguauguccaagaggacagccugggcuccaugagacccuaucuucaauaaaaacaaaguuggagcuauggagguggccaaaagaugguagcagguccccuggaacuggaguuacagguaguugugagccaccauguagauucugagaaucaaacccaagaccucaggaagaauaggcagugcucuuaaccacugagccauuuuuccagcuccuggcccccacugcuaaguugguuuugguuuuguuuguuuguuuguuuguuuuuucucaguaaaugaaugugcagagagcgucugaagaacuugaagcauuucgcuacuaccuguugaggggguugauaaauauuuacugaaugaauauuuugcaggcacucuggguuuagagaaccagcaggagacaaagagccgggauuuauacguuguaauuuguauuugccuguguguacagugugcuacagaaacaauggucuccuaagauaccggcuuauuuuuauacaauaacaaaaacacccaagguguauuucccacagagacgcccugucacugaaaugcauggcugcacauguaaaaggaauacuggcuauggaaggcaggaaaaguagaacaaaauggaggaagucagagaaugcagacaggaguuuagaauuuugaaagucuuuuucuagccaggcaggugggaggcaggggcaccaggauugcuauuucaaggccagccuagucuacaugcaaguugacagccagggcuauguagagauccugugagaaaaggaaauaaaaaauaaaagcauguuuucuuuuuuuuuuguuuuuucgagacacgguuucucuguauagcccuggcuguccuggaccucacuuuguagaccaggcuggccucgaacucagaaauccgccugucucugccucccaagugcugggauuaaaggcgugugccaccacugcccagcaagcauguuuucuaaaagaccuuucugagguaaagaaaccauggaggggauugagguguggggacuuguggguuuaucuaggggaagaacauugcagggaaaagggcacagcagaauucaagguuaaaacuaccugaaauagaagaagccagcugcucuguaguaggguggacuuagucuagccauuaggagacauccuuuucugaccauggcuuagcaaguuacccacauuuaagucuucugguauaaagggcaccuuaaaaauuugaaacaugagcuggagagauggcucagcaguugagagcacugacuguucuuccagagguccugaguccaauucccagcaaccacaugguggcucaguaccaucuguaaugggauccaauucccucuucuagugugucugaagacagcuacaguguacucauauaaaaauaaauaaauaaaucuacuaaaaaauaaaaaccaacaaaaaauugagacaccgaccagggauggcgguacacaccuuugaucccagcacccagguggcagaggcaggcggaucucugaguucaaggccagccuggucuauauaguaaauucaggacaaccagggcuacagaaugaaacccaggggcucacaccuaccuaaugcaccaggcacaacaugguacacagauaugcaaggcaaaacacccaugcacauaaaauaauuaaacaaguaaucucaaaaacaaaaaaaacuuaauuagaaagacagcucagugguuaagaucacuugcugcccauucagacaaucagggugcagugcccagcaccacauggcagcucacaacugucuguaauucugauuccaggauaucaggugcuuucuucugcccuccauauuuaccaagcacacaugaaaugcauuuacauacauguauggaggcaagacagucauacacauaaaaugaacauaaauaaaaucuuuuuuuuuaaacugaagcaggccagguguggugacacaggccuuugacccuaguacauaagcgacaguccagccuaggcuacauaguaagaccccgucuuaagcaaaacaaaaacaaaccaaacuccaaagcgggugggcuguaugucagugauggggcuugcccggggaaggauccagagaugaaguagaaggaaaagacucccugccaagcccaauggccaaccaguuuaauccuuguaacccauacaguagaaggagaacugacuccccagcauuguugucggcacuugcacacguauacaaaauaaauaacuguaaaagaaaauuuuuagacaaauuaguucuuuuaaaauugagggguuuuccccuuuuuauauuauuuauuuauuuuauguacaugaguacacuguagcucucuucagacacaucagaagaaucagaccccauuacaggugguugugagccaccaugucguugcugagaauugaacucaggaccucuggaagagcagucagugcucuuaaccgcugagccaccucuccagcccaacaaauuaguuccugaaugccuauggcccuccuguucaguccuugccuggucacagugaggagcuacacagcaaugagaaugaaguacuacuuguaguuaaccuuugacacguguggguuuuuuuaaauauauauauacauuucccuuuauguuagaguuugcaggaaaaaucaaacuaauacagcccaaaagcugcugccugccaagacaacuagaagcuggcuugaugaguuuguuugcagaugucaucuauggggacugaacagaccgaccuagagugagaaucuauaacaccuccaucaugacaaagaaauggugaagaaguccucagaacugcaggaaggauuuguugagacugugagcacauuccucuucuccaaaccucuccuggaauguccuagaaggcccaggaauucccccaaagcacugguucuuccuauggucaaacgucagcaaccuccaccaaacaugauggaggaaagcgugaauguugucacuaugacggaaguucagcuuuagucccaguuaacaaauauuggcaauaaaucaaaacaggaaaaacccuacauaugcacguugcuuacuuuuuuauaugacaguucacagacaucugaaauacugcucauauuucucaccacuuugaaugauaguugauuuuauaaauuaauccuauaauuagacaucucaucuauuaccgcaucccaauugggugauuggcugggcagguauuuguaagacauccucccauauaggcuacaccgcccuuaaaacucaaaauccuccugugucaguucccugagugcugagauuacaggccugugccaccaaaccuagcuacugucuuccaguuuuauucaaauguaaggugauaacuguauuucagcauagucugcuuuccucaucauucagacguguuugugugcauaugcaggugugccuucaaagacguccugugaugggcugaggaugcggaugcgguagguagguccuugccucguaugcauaaggcccuggguuccaauuucacuagcacacacacaaagccugauaguuggauguaguacuaccaccaccuauaguccuagcuacuugggugccuaaaaugaaaacccucaagccuagaacugcaaggccaauguggacaguauagcuaggcccuuuucaaaaacaaaacaaagcaaaacaaaaggugaagccaaauguaguaguacuauaaucccagauuuccaaaggauuucucaaacaauuuuugcucuaguuuugcuuuauuuuguugagaaagggucucauguagccaaggcuggccucaaacucacuguauacccaagaaugacauugaaauacagauccaagcugagcgugguggcgcacgccuuuaaucccaguacucggcaggcagauuucugaguuugaggccagccuggucuacaaagugaguuccaggacagccagggcuacacagagaaacccugucucaaaaaacaaaaaaacaaaacaaaaaaaaaacaaaaaaaaaaaaacaaagaaacagagauucucccucccauccguaccucccaaguccacauuaaaggcauguuucgcgaugccugauuuuaccagaccaaaguuuuuuagguugacagucuuuucuucacgcuuagcuaacauguacaaguccuugaauuguaugcccagcacuaccaguauaagcgggugugggagggagacuuguuuucuagucucccuagagcccgacaggcagcagcugacaugcacgcccuaagcuacagggugccgucuucuguggccuaauccaaugucuuuacaaacccucguauuccugugcgccugcacuuuggucucugaccacgccucucucugugaugcccggaaugucugcaccccacucugucuagagguguucacacuacaaugguuuaauccaagaugaugauuuucauuccaaucaaugugaccacaggaauguccacagcccaggcuaucugaccucaggaaugcaugucuggaggguccacaggaagggcauucaaucacagaugcuucuacgcccacacccauugccacagcaacuccgcagugcccgggaaagagcuccacaagugucccuguucugggcuuugacucuuaggaguuguaucgguggggcaagugauccaggcaaaggaaggggaaaccuugugcuugcccuauuccaugagcagcacgcagagaugagggauggagcuggaacagucaaccugaggaccaguggugcgacaugagaucagagagggccuauaggaggagcaagaaaugccugaauggaacccaauagca

SEQ ID NO: 9388 - RNA, 8765 nt, Mus musculus
cagcugcuguagaucuuguggcgggaaguucuuaugguggugaucgagacaggaggagugugcacugagcgacacggcccugaagagugcaaagcuccacgaggucugguguccagagaguuguguggccaucaugccucaaaccagaucccagacacaagcuaccaucgguuuuucgaaaaagaaguuauccaaucccuggaagaaaaccaacuccugggacugugaaguaaaauuuagaaacguccagccuguacccaccacuccgugugcugauguaaaacuucugccucucaguccccgaaaaaguuugggugaugacaacuugugcaacacuccccgguuaucucccuguucuccaccaaagcugggcaagaaagaaaacagaccccccccccucgcucacauacguggaaggggugcagauuaguauuugaugaugagccgacaguuaaggcuuccccccaaaagaacaaaacagaguucacaaacaccagauauguuccuccucugcucacagaaguccagagagcaaaacagauccuaagcagaaaugucugccugagaaggagucuguguguauaagacuguucaagcaagaaggcacuugcuaucagcaagcaaagcucguucugaauacagcuguccaggaucggcugccugccagagagcaggagaugggugucaucaggaauuuucugaaggaguacaucugugggaagaaagcuggcagucucuaccuuucuggcgcuccuggaacuggaaaaacugccuuuuuaagccggauucugcaagacuucaagaaggaaguaaaaggcuuuaaaucuauccugcugaauugccugucccugaggagugcccaggcuguguucccagcuauugcucaggagauuggucgggaggagcugugcagaccaacugggaaggacuugaugagaaaacuggaaaagcacuugacggcggagaaaggccccaugaucguguugguguuggacgagauggaucagcuggacagcaaagggcaggauguauuauacacacuguuugaguggccguggcuaagcaacuccugauuggugcucauugguauugcuaauacccuagaucucacagacagaauucugccgagacuugaagcuagagaaaacuguaagccgcaguuauugaacuucccaccuuauaccaggaaucagauagcugccaucuugcaggauagacuuaaucaggugucaaaagaccagguuccggacagugcugaaauccaguucugugcccgcaaagugucuucuguuucaggagacauccguaaagcgcuggauguuugcaggcgagcuauagaaauuguggagucgcgugucaggagccagacaguccucaaaccacucuccgaaaguaaaucacccagugagucgccgguucccaaacagguuggucuugcucacauaucccaagucauuuuggaaguugaugggaacagggugacuuugagccaagaaaacacacaggauucccuuccucuccagcagaagauucugguuugcucuuugcugcuuuugacccgugggcugaaaaucaaagaggucaucuggggaaguuauaugaagccuacaguagcaucugucccaaacagcaggugacagccauagaccagucucaguuuugucccuuucaggacuccuggaguccaggggccuugugggauuaaagaaaaauaaggaguacauagggaagcagacuacccgggccugaccuggggcacaagccacuuccgcuccacucaagccccgggcuaccuugccagcugagucgcccaacacccgcaagggcccaaacaggauuccccacgggauccuaagaccucuggugaguggaacacagcgccugccccaauccaaucgcgcggaaccugagacugcgguacauagggaagcagacuaccugggccugaccuggggcacaagccccuuccgcuccacucgagccccgggcuaccuugccgguggagucgccugacacccgcaagggcccacacaggauuccacacgggauccuaagaccucuagugaauggaacacaacuucugccaggaguccaguucgaacaccagauaucuggguaccuuccaugcaagaagagagcuugccugcagagaauacucugcccacugaaacuaaggagagugcuacccucccaggucugcuuauagaggcuaacagagucaucugaagaacaagcucuuaacagagacaacuauaacagcuaguuucagagauuaccagauggcgaaaggcaaacguaagaauccuacuaauagaaaucaagaccacucaccaucaucagaacgcagcacucccaccccaccuaguccuaggcaccccaacacaucugaaaaucuagacccagauuuaaaaacauuucucaugaugaugauagaggacaucaagaaggacuuucauaagucacuuaaagaauuacgggagagcacugcuaaagaguuacaggcccuuaaagaaaaacaggaaaacacagacaaacagguggaaguccuuaaagaaaaacaguaaaacacauccaaacagguaauggaaaugaacaaaaccauacuagaacuaaaaagggaacuagacacaauaaagaaaacccaaagugaggcaccgcuggagauagaaaacauaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccaggaaauccaggacacaaugagaagaccaaaccuacggauaauaggaauugaugagaaugaagauuuucaacuuaaagggccagcuaauaucuucaacaaaauaauagaagaaaacuucccaaacauaaagaaagagaugcccaugaucauacaagaagccuacagaacuccaaauagacuggaccagaaaagaaauuccucccgacacauaauaaucagaacaacaaaugcauuaaauaaagauagaauauuaaaagcaguaagggagaaaggucaaguaacauauaaaugaaggccuaucagaauuacaccagacuuuucaccagagacuaugaaagccagaagaucauggacagauguuauacagacacuaagagaacacaaaugccagcccaggcuacuauacccggccaaacucucaauuaccauagauggagaaaccaaaguauuccacgacaaaaccaaauucacacaauaucuuuccacgaauccagcccuucaaaggauaauaacagaaaagaagcaauacaaggacggaaaucacgcccuagaacaaccaagaaaguaaucaaucaacaaaccaaaaagaagacagccacaagaacagaaugccaacucuaacaacaaaaauaaaaggaagcaacaauuacuuuuccuuaauaucucuuaauaucaauggacucaauuccccaauaaaaagacauagaauaacagacuggcuacacaaacaggacccaacauucugcugcuuacaggaaacccaucucagggaaaaagacagacacuaucucagagugaaaggcuggaaaacaaauuuccaagcaaauggucugaagaaacaagcuggaguagccauucuaauaucggguaaaaucgacuuccaacccaaaguuaucaaaaaagacaaggagggacacuucauacucaucaaagguaaaauccuccaaaagaacucucaauuaugaauaucuacccuccaaaugcaagggcagccacauucauuaaagacacuuuaguaaagcucaaagcacacauugcaccucacacaauaacagugggagacuucaacacaccacuuucauuaauggacagaucguggaaacagaaacuaaacagggacacagugaaacuaacagaaguuaugaaacaaauggaccugacagacaucugcagaacauuuuauccuaaaacaaaaggauauaccuucuucucagcaccucacgggaccuucuccaaaauugaccauauaauuggucacaaaacaggccucaacagaaacaaaaauauugaaauugucucauguauccuaucagaccaccauggccuaagacugaucuucaauaacaacauaaauaauggaaagccaacauucaaguggaaaaugaacaacacucuucucaaugauaccuuggucaaggaaggaauaaagaaagaaauuaaagacuuuuuagaguuuaaugaaaaugaagccacaauguccccaaaccuaugggacacaaugaaagcauuucuaagagggaaacucauagcucugagugccuccaagaagaaacgggagagagcacauacuagcagcuugacaacacaucuaaaagcucuagaaaaaaaggaagcaaauuaacccaagaggaguagauggcaggaaauaaucaaacucaggggugaaaucaaccaaguggaaacaagaacuauucaaagaauuaaccaaacgaggaguugguucuuugagaaaaucaacaagauagauaaacacuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaaccggaaaaccgggaagaaauggacaaauuucuggacagauaccagguaccaaaguugaaucaggaucaaguugacuaucuaaacagucccauauccccuaaagaaauagaagcaguuauuaauagucucccagccaaaaaaagcccaggaccagacggguuuagugcagaguucuaucagaccuucaaagaagaucuaauuccaguucugcacaaacuauuucacaaaauagaaguagaagguacucuacccaaaucauuuuaugaagccacuauuacucugauaccuaaaacacagaaagacccaacaaagauagagaacuucagaccaauuucucuuaugaauaucgaugcaaaaaucaucaauaaaauucucacuaaccaaauccaagaacacguuaaagcaaucauccauccugaccaaguagguuuuauuccagggaugcagggaggguuuaauauacgaaaauccaucaauguaauccauuauauaaacaaacucaaagacaaagaccacaugaucaucucguuagaugcagaaaaagcauuugacaagauccaacacccauucaugauaaaagucuuggaaagaucaggaauucaaggcccauaccuaaacaugauaaaagcaaucuacagcaaaucagcagccaacaucaaaguaaauggagagaagcuggaagcaaucccacuaaaaucagggacuagacaaggcugcccacuuucucccuaccuuuucaacauaguacuugaaguauuagccagagcaauuccacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaguaaacucaaacaagucaauggccuaucucuauacaaagaauaaacaggcugagaaagaaauuagggaaacaacacccuucucaauagucacaaauaauauaaauuaucuuggcgugacucuuacuaaggaggugaaagaucuguaugauaaaaacuuaaaaucucugaaguaagaaauuaaagaagaucucagaagauggaaagaucucccaugcucauggauuggcaggaucaauauaguaaaaauggcuaucuugccaaaagcaaucuacagauucaaugcaauccccaucaaaauuccaacucaauucuucaacgaguuagaaagggcaaucggcagauucaucuggaauaacaaaaaacguaggauaccaaaaacucuucucaaggauaaaagaaccucugguggaaucaccaugccugaccuaaagcuuuacuacagagcaauuguuauaaaaacugcaugguacuuguauagaaacagacaaguagaccaauggaauagaacugaagacccaaaaaugaacccacacaccuauggucacuugaucuuugacaaaagagcuaaaaccauccaggggaagaaagacagcauuuucaacaaauggugcuggcacaacugguuguuaucauguagaagaaugcgaaucgauccauacuuaucuccuuguacuaaggucaaaucuaaguggaucaaggaacgucacauaaaaccagagacacugaaacuuauagaggugaaaguggggaaaauccuugaagauauuggcacaggggaaagaauuccugaauagaacagcaauggcuugugcuguaagaucgagaauugacaaaugggaccuaaugaaacugcaaaguuucugcaaggcaaaagacacugucaauaagacaaaaagaucaccaacagauugggaaaggaucuuuaccuauccuaaaucagauaggggacuaauauccaacauauauaaagaacucaagaagguggacuucagaaaaucaaauaaccccauuaaaaacuggggcucagaacugaacaaagaauucucaccugaggaauaccgaauggcagagaagcaccugaaaaaauguucaacauccuuaaucaucagggaaaugcaaaucaaaacaacccugaaauuccaccucacaccagucagaauggcuaagaucaaaaauucaggugacagcagaugcuggcguggauguggagaaagaggaacacuccuccauuguuggugggauugcaggcuuguacaaccacuauggaaaucaaucuggugguuccucagaaaauuggacauaguacuaccggaggauccaguaauaccucuccugggcauauauccagaugaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggaggguaucauccugagugagguaacacauucacaaaggaacucacacaauauguacucacugauaaguggauauuagccccaaaccuaggauacccaagauauaagauacaauuugcuaaacacaugaaacucaagaagaaugaagacugaaguguggacacuaugccccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucuaaaggacccagauguagcugucucuugugagacuaugccagggccuagcaaacacagaaguggaugcucacagucagcuaauggauggaucacagggcucccaauggaggagcuagagaaauuacucaaagagcuaaagggaucugcaacccuauagguggaacaacauuaugaacuaaccaguaccccggagcucuugacucuagcugcauauguaucaaaagauggccuagucagccaucacuggaaagagaggcccauuggacacacaaacuuuauaugccccaguacaggggaacgccagggccaaaaagggggaguggguggguaggggagugggggugggugggcaugggggacuuuugguauagcauuggaaauguaaaugagcuaaauaccuaauaaaaaaugggaaaaaaaagaaaaauaaggagagccaccucaccaaggugucucugaagauugaaaaaaagguaauagagcauguccugaaaggcaaagcuuucacugggaacauccucacugcuggucugcccugaauggcucucuuacucauggcacuugcaggugucccucccacuggcauuuggcagcccccggaaucuucauuuuaguaaggucguuuggaaacaguuauggcccuuuuuacuccgaaccaguaaauuuuaguguauggauucauggguguuagcgcuggcuaauaucuuugguucuuacuuguuuuacccauaaaaaugaccgaguggcuggguguggugacuuuuaugccugugaucccagcauuugggaaacagagucaagaguuaaaggccauccuuugcuacauagugagcuugagcuggccuggacuacaugagacucuguaaaaauaaaaacaguggcccuuuuuaaagcaauguucaguacuuuuccccuuucacauuccuaaacacaguaccuacaaguauauacggacuuguguugaagaguguguguauguauuaccucuaucuacaaaggauauauuuuguaaagaacuuugaaguuuagaaggaugaaauggaaugauccaggaaaauuuacaagccuccguggaagggcauuguguucagaggaugccucauucaugugacaaauguugcugcacuggacuuuuuaaggacugaugaagagucucccgugcuccccaccaguaugggggugacgaggagaauaacuacagauugugaauauauuuauuuucaaguuucau

SEQ ID NO: 9389 - RNA, 1965 nt, Mus musculus
ggacccguuuuuuuccagggccgaaccaggauguggggggggggggcggguccugggcuuggguagcuugcagucccucggcuacagccaugagugaaggggaucggcgaggggggaggccuggggcgucuuugggcgauggguggcuccgaagggcuggcaggccggagagccggcucuaggccggccaucugaccccgugucuugcccgaacucgcagagcggcggguccuguccucgccaugaggccgcagcaggcaccgguguucauucagcuagacuacagcagcggcacgcgcugccaguuccagaccaaguuccacgcggagcuggagaacaggauugacagacagcaguuugaagaaacaguucgaacucuaaauaaucuuuaugcagaagcagagaaacuugggggccagucguaucuugaaggcuguuuggcuuguuuaacagcauacaccaucuucuuaugcauggaaacucauuaugagaaggucuugaagaaagucuccaaauacauucaagaacagaaugagaagauauaugcuccccaaggccuccuccuaacagaccccauugagagaggacuuugaguuaugaaaucaccaucuaugaagacagaggugugagcaguggaagauaaaccacagaguuacagguccugccuccagcugggaccuucgucuauccacuggccgauggcagagugucccuaccuccucuccagagcguuauucucuugucucugcugccagagccacggugccacaccuggagugaccgcucuucacucagcauccacuuugucucccaauuguguaggacucugugaucuuuugauuuguuucaaagaaaauaaaggaagcaauucucuuuauaugccauuuaaaccauuuaaaacacaggcaguuggccagcccaagacagagucguuuucuuaccagauaccagugucacugguucuucuugucccuugggucaguuuccuagguggcuuuaugaucccacaagucaugucuuagcucagucccucccccagauuaguaacaggcuuugagggugugugugccugugguccggcugauccgccgcccgaguccccaagcuaccagccuugaccugcuucagaucuucagauugauuucugcuguucaauuucagaggcuccuugagagaauaauauauguuacuuguuuuaguguugcaguuauuauuaaggcaguauuuaaugcaauuccgguuguuucuuugaaagcauuucuguuaaugugcguuaccucgagauguuggggagauguuguguguguugcuuguucauuccacagauaaguaagcacaaugagcagacccacagccaucagcucugccugccccagcucugcccaguguggaagaagcaaguguccuaagcaccuaacucuaguuuuguuacaaguauaacuuaggagaaaaaauugguagaaauaauacaguauguugcuaauuuguaaccuacuuuaaacucugauuuauagccucacauacaguauucagggcacagaaaucuuuugauugacucaaguaaguuucggcuuccguguaacuucaaguuaaaguuaauuuuuuucagcucuucuuuaucucuauacucucuuaguaucagaauuucuuauguucuuucuuuuaggaauuugagagcacuguguuugggagaaguuaggaaacauaagggaugaaugaagcaguugaacuuggagauacuguaggugcuaauacuggaucuaaucuuucagauuuaauuuguuuucugggccuuguaguuacucaguaaaccccuuagaucuguguaauaauuuaauuguauaacgcucauuuguuccuuuaaagccuauucuagucugucugccuuuuaaacuuguugcaauaaugucgccaagauauaaacacauuaguaaaacuuuucuuaaaaaaaaaaaaaagaauagg

SEQ ID NO: 9390 - RNA, 512 nt, Mus musculus
agguugguuauuuggagagccucgggccaacagagaaggccaucugagccaaaaccuccacacagacaucauggccaagaaaaugcaaaggcgaagaagacagaaaagaacccgcucccagagaggugagcuuccucuuagccuuguagaucguuuccuacgagaggaauuccauuccagucgccugagcucuuccgcacuuucauuccucacgagugugcucgaguacuuaacaucgaacauccucgaacuggcuggugagguggcccacaccacuggcaggaagcgcauagcuccagaggauguacgucuggugguacagaacaacgaacagcuccgccaacucuucaaaccagguggcacaucagugaaugaggaugacaacugaugaugccugggucucaagagucuggagguucaccgcaccuucagccucacccugccccaguguccuacuagcugggggagcaaaucaaauaugcuauuaaagcaucuagaucgaaccccauuga

SEQ ID NO: 9391 - RNA, 2298 nt, Mus musculus
agaagcaagccaguaaggaacaccccuccauggcuucugcaucagcuccugcuuucugaccugcgugaguuccaguccugacuucuuuggugaugaacagcaguauggaaguguaagcugaauaaacccuuuccuccccaacuuguuucuuggucaugauguuuuguccaggaauagaaacucugacuaagacaaauugguaccagcauagugggguauuccugugacagccugaccauguuuuggggaggacuguggaaggacauuggaacuuuggaccagaagauccauucgguguuaagagcucugucgaauguuguauaggagcuuggaagauaauguugagaacagugcagaagaugaaggccuggcuuaugaaauuucagagggaagauuaaagacuuuuuucagggccauugcuguuuuugauugugaagauucuguaguucugguuagcuggggcugaagaaucagcugugauuaacaagauaccagaacuacuaaagcaaaaccuuuggauuauugggacuauugaugcugguuagcuggagcuaagaaauuagcggugauuaagaagagaccagcaucguugaggugacaucuucugggaaguguuuucugaaagcacaaagaggcuguguuccagagauagccaagguuauacuccugcugcagcgggacuugguaauguguaaggguuacccagguggcacugguuuugaaggcaugaaggggucacgcagagcagcugaggcuuggcacugugagaggccauggaaggccauuggugaaggugcagccucaguugcaauugauggcccaggaaugaaggggucgugcaguguuuuggagaugccaguaccaugagaugaccaccaagagcagcagcagcaguggaguacaggcaucugaagccuagaagacaaggugugugcuacaaauggcauggcugaagaagugacccaagcccuuggaggagcccagaagaucgugaguuggaucccagacauuagacaguuggaguuuaauuuuugcuuuugauugugaguaugcccuaauauuuuucccucuugaaggaagaaaauauuuuaguggaucccacaguuaagagacuuuuaauuguaaaagacuuuggauuuuaaaagauaucggauauuuuaaaaguauugaauuuuuaauguauaaagacuaugggacuuuuaaaguuauuuaagaucuugggaaugaaugaaaacuaaggguugaggcuuacuagugauguguuugugugucaaguugacaaggggucaauuguacuggcugguuuuaugugucaacuugacacaggcugggguuaucacagagaaaggagcuucaguuggggaagugccuucuggagacccagcucugggguauuuucucaauuagugaucaagggagaaaggccccuugugggugggacuaucucuggguggcagucuuggauucuauaagagagcaggcugagcaagccaggagaagcaagccaguaaagaacaucccucuauggccucugcaucagcuccugcuuucugaccugcgugaguuccaguccugacuuccuuggugauaaacagcaguauggaaguguaagcugaauaagcccuuuccuccccaacuuguuucuuggucaugauggauguucuguccaggaauagaaacccugacuaagacaccuucuuacucuguuuuuguucccauguuaaagauacaguauagcuuaugguccuccagcgucaauagcaaucuauaguuaagauagaaaaagaguaugauuucuauucuccacauagagauauagacuucugaaauucuaagauuagaauuacuuagugggagaagaagaggggaaugaaagaaagaugaaauuucaagaccuguaagucauauaaaguacucagaaauugcugguuguuugugagccuagaggcugccuggggcugagaaaaaaagaaagacaaaccuggguaugccccguaguuaaaacauuccugggaacagcuugaccauaagauaaagaggaaugugaggacauaacugggauaucugaacugagucaacaacucacagaacucugacacccugcacguacauguaauuuuucugcugauguuugaauaagccaauagugugucgcuaugcugaauuccacacccauaagccacuuaccccauuaaagccccuagcuucagagccuuguggccgacauccguuaucuccugugugggaugcaugucggucuggagcucugucauuaaacugccucaugugauuacagca

SEQ ID NO: 9392 - RNA, 2583 nt, Mus musculus
aggaaggucugggaauauauauguauuuuauuugauauagauaucaaucacccagccauccaguuacauguaacuacuuuauagaaguagauauguauaugaggaaugagcacauagaugccuguauuucugaaagaucagaaacaaagcaaaaucaaugaaaagaagugugaaauucacacacuccagacuuuuucuguuuuucuguuucuaguuauugcuugcuccuucuuuucuaacucugauaauucucagcagaacuguuaacaucuacucuuuggagcucuuucuccuugauucuauacuacuuucaugauaauauaugcuuacaacuucaaacuugcauauccagugaagauuuacuucucagcccuagacacugagaaaaucuaucaacccaguauaaguuauuccugucacugcguaggauaaagcugaaaaaucacggggaauaacauguaggucacagauaucuguucuguaggaugccuugcaagccuuaugcaaccaaaagacccacuaugacuuuaagacaaaauuuaaacagcaguugaugcuaaucaccaauccaagcuugcaaacuucuaaaagacacuaucugacauaugagcuugcuuccaaaaugaucuguguuaauaccucuuuccucaauaaaacaccaauauuuucguuuguucucuggacacaucagagacugcucagucugguguaucugauuacauauucagucugcuaucauucuaucuuuccacucuuuuucauguaggguuuccuuucucaaggauuuauuucuauaauuuuauuuagugaugacaacgugaaucgaacugccaguaugacaucucagucgggguacuuuauuugaaacucuauucaaacuaagcauucuguuaucauucuuguucuggagucuuguucuaggccauucuaccucagcacuuagagcguucguccucucucaagugacagcaaacaggcugauugcugaguuuuaucucuugcuuuuccuucauccugaggcaaagucaaucaaagauuccuaagucuacuuaaguguccuuauccccacgauaccaaccaaguccaaacuaacauuacuccuuuucaugacuaguucagcaagucuccuaacauuaaucauuuaaguauuuuuauucauugugugcauauaugauguguguguuacaugcacaugucagccagggaaaaguucuguggagucaguucucucuuuccacuuuacagggacucuggggauugaaccuaggcaauugguguugugcugaaaguauguugcuaaaaugagauaucacucuggcuguuauuuuuacagcccuucuuguucuguaucauuccaauauccaccauauaagauucaucucaaaauaguaucuuaaauguccaaauauacagaaaaauugaaagaacuuuauaggaaauacuauuguauccaugaccuagcauuagcacaugacuguacuugccugucauuauagagguuauaucugaccauccugagugaucuauacaacuuuccaugggcuuucaacugaaaugaaaacaaaacacaaaguauuguauauggcccagccuaagaaggccacugccuuuuccccaggcugugcccccccucccuguccucccuuccucuuuaguccccuuguguacucuucuggucuucaucuccauaaauaaucccagucuugaaugcuacuuccucaggaaaaccuucuugauccuguucugaagcuggccuuuauuuccccuccacugcaccuaucacaauuacaauaaauuauucaugcaauaaaucugaugccuaugucugcuaccuucccguuauguaagauucauguaagauucaugagggcuggagcaacacauguucguaagucuauccccagugcuuagcugaaaguagcugauccaaacuuuuguuaaauaaauaaaaagagaacaaauauaacaucacaaaaccuuacauuagcaaacacauuuuucuuuucuguuaauuaauuuauuuacuuacuuuacaucccaaucacauuuuuuuaaaccaccauuucaaagugagugugggaaggagcaaacggagcaagggugguuagggaccugcauaacuagggauuugggucacugacugcaugaaauggggacuacugagaauucugugcugaagaaagacaaaauagcauguauuuuaacagcaucccucugacugcuguauccaguauuugggggagagauagcaacuuucaggacucaggccauuuucuccuacaaguaacaaaauaacaaucuaaagguuauagaagaauguaacuggccugucacucaaaagccuagaaggagggcuuuuacuuuaguuugcacagcuguguucuucauucaggcuagcuauacccuggauuaagacuacugauguuucaucaccguuagaggcacagugcuuaugguuagcaggguaucugggugaaaguuguggaaggcagagaauguuggcaaacuaucuaaaaguaaaugacagacauuagcuaaguuggugaacugugucaaugcuuacuaggaaaucuguagauacua

SEQ ID NO: 9393 - RNA, 178946 nt, Mus musculus
cagaaguagaugcgcuccagagucugcagcauggccgcuuccaaucgcgaccgcuagagggugugcggucgcuuaccgccgcgaccauggcaucugcgcuugcgccucacugacacagcuuccgccagccuccuuccaaaagccuuucgccccuccccgccccgcaaggcuccgccuccguugccccuagcgucuguuuguugacuuccgggagcacaguaguggucuaugccaagagggucgcgaugggggucccaggggguagggcagcaccuuaggcucaaucgagucgccccugcuaucuuuccgaagcaggcacagauuccguucgcaggcuucggcauggcggaaucugagucacuggugcccggugagucgcgcgcccccagucguggcggcuggccuggagggaggguccgcgggcgggcgggcgggcgacaggccaggccccgccuccgagccggccccguagugguacaggccgcaaccugagccucagucaaccgccuuagauuugcguuugggaauaaauaaauucccuuugucgggcuggaggaagggacagggacaugagggacccuguguguguuauuagcaagcugaaauaauggcuuuucuuggaggcggcggcagccauuauucucucgcgaagcaucccagggucucuaaacauuugagcaagcggauguccccaggacccgguuagguacagaauucaguaacgaguggaaugcggggugaaagguuaaaaagaauggaagaaacgaacuggauaaagagaggagggccuucggugaauuuuuuuuuuuuuuuaagacugacugucgugaagucuuuuaaaauuaugacuccguacggcuuccguaccggguagcccagguagacauuuccuggagcagcauuuauuauaagcguagaguuauagaguuguucagcuaaaaugguggucauaaucuacugaacugguuuuugcauauacucuaaugggcuguuacuagcauuaugaaaaauaaccacuauauuugagcagaauuggacauuuaaauauguauugcacuuucugcuguggucuuggcucaaacagaauuugauucuacaccacuuggagcucauaccuuagugagggugcaagaaaauaguuacaauaggcuugacauuaguuggcagaggacagaaaggaaccacccaaccuugguuuuuggguuaggggagugucugaagagagauucuggggagccagaguaaacaccguuaaauaauuccuuguagggaagccuugaaucauuucgagguccuugccucccaaggcucagugacuugagucgaacuggcuugcuucaagcuuguucucaagugguuuagucccgugcacauugauauauauuauuaauauuuacauucaguaugcuuucucuggaaauuucccccaaacugggucugacuuucuauuugagugguguguguguguguguguguguguguuuaaauaguuacuuggaaauguuaauggauauuuagucuuuugaaaaugauacugguccaagucugugaauauuccucagaucagacaauggcaguugaagaaugucaaaucucagccuccaucuccaauccccauggacugauccguagcuugaacucucauuucuucucaaugggaacaggaauacccgagguguuuccguaguaaaaccuggguaauaugcuaucuuucacacugaaaguauugaaagcuguguuugauuuccuacucagcauucuagugaugugaaaauggugguagagugauaaauaguguagaagggaaguuuucuguuugaaacuuagcacaaacuucaguguaacugauauuuccuagaggaacgucuugugcaauggguauaaguagcaaggaaaaccuacacuaucaguaauacaguugagcaaauaaaauacuuaucaauaaauauuuugguagcgaaucaauuagagagauugcuguguagagcauaauuaauugccauauggccucuauucauugcaagauucugagaaaccaguaauuuccaauguuuguaauaggacuuuacagagguagccaucaguuaauacauuggagauuacagauucuguacuagauuccuuauuauaaaagagagaauacaacccuguguuuacaauauuguaaauagauuguguacaacaaaccuuuucguaccuguguuaaauucaaggcauaagaauguguauugguauuuuaaacaccauuuagaaauaaccauaaugauuaaaggaggaaguuaagguuggguaaaguaacccauugaguauuguauuaaguauuagauuaggaauuugaauacaugauuacccucccauuuuaaaacauuuucucucucccuuaucucacugugugugccaaauuucugggagucuuuucauucuuauaugggugcuggggcucauacucugauuguggucuauugacuuuuaaagccuuguauagguucccauagugcaagugaaacaguauguaauaauaugcuuaugucugcccugcaccuagcuuuaauggacagucgcaagcauugucaguaagaguuuggcauuuguaguaacaucccucccuuguaugcaaacacuggcaaucccuuggaagggguaaagaaauuccaaacucacuuagacccuucccaugaauuuccugugguauuaacgaaaaaaugugauacuguuucaguucugaguguggggaaaauguccuuagucagggaccagacuguggggucuuaaccagagugaguagaguuguguuuaauaaaauucuuuucugccuaauguuaggaacuuuuacacuuaacagagucagcucauacauagaaggacaaaguaacgugcuucaacacagaaagauacauuugaaaagucugauuuuuuucucuuacuucuaguuuuaugucuaaaaaauaucagcucauucgggaguuggcuguccaucgagugucagcagaacaauuaguaauggaugaugcuuaucuugucauuguauauauuuacgucauaucacucaaggaauagcacauauucaaauuaacagaugucauagaugaaacuaaaaugaagucugagaauuagaacugaauuaaggugaaagaaugaagguuuaaacuguuuagacagauucaaagcugucagggaagaaagcauuuauauguguguaauuggaaauguuuuaauaacagacaucgugguucaaguugugaaguaaaaacugucuuacauuuguagauacaggugcuguguuuacguuuggaaaaacuaaauuugccgaaaauauuccuagcaaauucugguuuaaaaaugacauacccauaugucuuucauguggagaugaacauacugcuauuguuacagguuaguauuauaaucuuaaauggagacaguaauucuuagagaaaccuaauuauuacuagaguuguguuuaauaaaauuuucugccuaauguuaggaacuuuuacacuuaacagagucagcucauacauagaaggacaaaguaacgugcuucaacacagaaagauacguuugaaaagucugauuuuuuuucucuuacuucuaguuuuaugucuaaaaaauaucacugauuugaaacccaggaaccccaaagaaggugauggucuaccauuucacuugacuauauuuuuacuuuuaaaaugacuuaaacguuacuguuauuguauauguagagaagaggauuuacccuguguuaaacauauuauacguauauagaaugugguuuuguacuugucagagaauucuuuauaaauugauucaagaggcuuuucaccuuuaaacuacuuuuguauaguuaaauggcuuuucuccaugcauaucuuucuuggaaucuauuucauuacaagagaaaauuguuaacauaagucuuaaaaacucuauacugaauugaaugugcccauauagagacaagauuuguuuuuuaaaaauaagagacacuuauuuuuguccuuugauauauuuaaguguauuuucuuauuuccuugugauucauucauuucuuguuaucuaugugaggauugcuuuaauuuguuguuucuuuuccccucccacuaggaaauaauaaauuguacauguucggcaguaacaacuggggucaguuaggauuaggaucaaaagcugcuaucaucaagccaacauguaucaaagguuugggucuuuuuuuuuucuuuauauuguauuauuuauauucuuuuaaaaaauaucuuccagauuacaagaaguaacuuuaguacugauucuuugacucuuuauuuucauaaaugaaacaucuuuaauguuuuuauuuuguaaguuuuacuugaauguugcuagcaccuacauuuaguaggcgguggagaguucugccgguguggucagaauagucuucuuuaucuucagggcccaaauuucaauuucagcuuaaaauguuggugugaacuuauccuaaccaaugcuauuuauaugauuauuauuggacuguuaauguuaugguuagaaagcauguagcugggcacagacgacuaaacaccauggacuuagaaauaccuaguagaacauuacugcagacugugagauccaugaccauagagacaauuagucaaccaauuaauuaggcgauauuuguaaauguuuaaaaauauguagaugagcaacuuggacucaagugcgugccuaugauuguuaaucuuaugcccuuugugaagugggccagcuggugagaagcaacacaggagaauggacuggaccuuggugcauuaauuuuaugaugugcaauaaacuguggauaaaccuggauuaguagugaagaacacugauuuagagucacauauguaggguuuuaaaguucaguuguagguuacagauauaguuaaguuucugaguguguauagcauccuccaagcuuuggguuccaucccuggaaguacaauaaaugaaugaaucucaguuuuaccaguuacuuaucauuugaccaggaguacuuaucauuuucauauccauaaaauauuguaauugucauauucucgugucuagcucuuaagccugagaaggugaaacuugcugccuguggaaggaaccacaccuuaguuucaacagguacaguauuuacccuguacaguuucucuccagccuugaggacugaggucucccuuugguaggacgugugguccugcaaaauggaugcaugugauacuuuguugguagguagacuagaguuuuaacaauguagguguuuaguacaugcgcuugccuucgcaaacauacaaagaagugcugaguaccuaaagaucaagggguagcaguagugcauuguuuccucuugugucuugcucuuguuccuucucugugacguguuuuguggaagccauaggaaauucuacugauagcagucaucuccguuuuaaucaaaaucuaacuaggcaguauaauguaucuagaaguugauaaagugauucauaaauuuguauagaaaaucaaaggagagacacacuagucaaaacaauuuccaaaaacaacaaaauuuggggcuaacaguauucugaauucagucucugucauaaagccacaauggcuaugaaaaugcaguacugagggagauuagauaaaguggaaugcagcacaguaguguugagaagcaagccaacacagauuucugacgaauuucugcuuuuagguucucgccuccuaagcuguagccgcaagaguugauuucuaacuaauguuugaggacaguugcguggaggccaugcugcugaggacaggagugccuuauucacuguccccucugcuccccggcuuccucgcuuuucuucugucuccuagcuagucucugcuguagcuucucuauaccucucuuaccuagcuagucucuuugcuguagcuucucuauaccucucuuaccuagcuacucucuuugcuguagcuucucuauaccucucuuaccuagcuacucucuuugcuguagcuucucuauaccucccuuaccuagcuacucucuuugcuguagcuucucuauaccucucuuaccauugcuuauaugcuuuuaacuauuaauacaggagauaugugcuguuuaguagugugucucagaagcaggguggcuacaguauuaauuaauauuucuuccauaugugcagauacugguggcguauaugcagcugguggaaauaaugaaggucaacuggggcuuggugacacugacgauagagacaccuuucaucaaauugucuucuuuacaccugcugauaccauuaaacagcucucugcuggcgccaauacauccgcugcucuuacuggugaguaagacuugcuguguugcuggcuggacacaucuuuucuuucaaauaggaugcagcaacucaguaaauacaugacagugccagcucucuguguacauccaaaagacuaaaagugcacuguuagagcuauauguauauuuugagagggagauaaaugcacauguagaaggugauugauaaauaaguucucagcucugcuagcuauucauuauucuuuuugauauuauuaaacguuaucaucauugcauauucaggcauucgcugaaccuaggaugagaacuacugauuggaaucaguugggauguauguuguuaaaguguggcuuggcacggucaucacaccccugcguucuccuuuucuaaaggagagauaagaacuugucuuucagauuccgagccaggacccaugugaccugaggaagcugcugccuugcagugcucuucaagcaggagauucucugcagaucugcuguggguuugggccacugggaaaaccaguucuauuugauucaccaacuguaauaauuuacuauucagucuuacuccuucaguuuuuauuucuaguuuuaauuuuggcuuaucauuaaaucagcuugaggauccacguuuuaacucaaaugaacuugcugaguauuguugcaguauuagucucuuuaacuucaaggucagaggcaugauggucaucacuacuucauggcuagcucgugcuacaaaguaagaugcuguuucaaaaaccaauagaaguaaacaaguauugauaaucccuaaaaaugcuucuccuccauuuagcagaacuauucaccacacugaaaccucaucaacaggacaggaguuaagauguuaagcuguuacaugcuaauauagcucauucgcugaagccggagaagcuguauuucagacauacagucauuaggaaacagguuagggagagucacuguguccauuguggcugaagagcacgcuugucaagcugggcacucgcuccucugcccuggagacauggaggugcuuucuguugucucucaguucaguggcaggcagacuaccuagcagaggugauuguuucugugugaugacauuaaaaggaugcaaaggaaaugacguccuguuuuuaauauugagaaaaauaugguaacuaaagugauuuagcauccuucucggcuuuuucuccuuguagagcauaugacauuagaaauuaaacucccaggucacaagcuaguguaaaugucuugggacuuuuaugacauaucauuuccaguacugaguuaauguuucaaaggaggagcaaaauaauaauguaguguggauuauuuuuucucuuuuuguuuauuuugagacagucuuacuuuguaaaucuagcuggcuugguaugucucacauagcucugacuggcuuuaaauucacugccauccuccugucacaggcccuugagcucugguauuagagacgugagcugauacaccuggcuguauuguuuuuuucagaguuacugccagaggauuuugaguguuuucaacccaaggaaagaauaauacuauacaaaugacccugauaugaccauuacacacacacauacacacacacacauauacauacauugaaguaucaucauauuguauuccauaaacauucuguaguuauuauauauuaauaaagacuaaaauaagacuaaaaaauauaauccagaaggcaaaugauagucuguaggaaauguuauagcuugggagcuggcuagcccuuuaaagacuuuucucccuuuaugcuuucuucauagaggauggaaaacuuuuuauguggggugacaauucugaagggcagauuggucuagaagauaaaaguaauguauguaucccucaugaagugacuguuggaaagccaauuuccuggaucucuuguggauauuaccauucagcuuuuguaacaaguaagaugaacaguuuugauucauuuccaaguuauuacugcuaauaaaauuauuuacaguucacaaauuguucaacuacugaaguaauauguguuuuaaugaaaaccauuucucuguuucuguauugacaauuuauaauuucaaauguucucugacaugccaacuucuuagaaagugaauacuaggccuauuauaaaaauuuuaaauugcuauuuuagaaaccuuucuaaauguugguucucaacuuucauagccuuguaugguguuaagaacaagacucacgagccauuuuccccuggauucacuucuguacuuugaccugcucuauuuguccuguccugcuaacuucuuuuauuguuucaaauaagugagccauagaguauucuugugagaaccagaaugaagauuugauggagaaggauguggccuugauccuuugguaauacauuucuccauaucugcagcuuuuucucauuccugggucuauucauagucucugcuuggaaguguugagcuguuagagucuaauucuauguugacaucuacauucauagcuguacuaguuaacaauggaaggaggauuguggauugccuucugaccaaucguuucuuaauaaucagaugcccagaugaaacaguucagugaauuuuuuuagaacaguaguuaauucagagacucauaacugaaaaaagugcugagacuaagugauuggcagguacccagcccuaaaucacugccucaaaagcuuaggaagagaaaauggaagagcuggaagauaggaggaguguaugaaaugccgucuucuggacaugauguagcacugcaugugugugcugugguuacugacauacaagaucugcagaagguggggugcccaucauggauugggggaccugaugaggcaccaucccuucucagcaauuucaugguuacagccagaggggaagucaguuauucucaauggaguagccacuaguagguggccaguguuccaggaaacaagccuuuaccagugcucaugcaagaauccccaguuaguggaucaacaaacaaacagaagaaaugagcacagggguggaaaugggagaaaggccuugguggagggggaugagagaggguuauacaggcauguaacugucaagaguaagaaucaaguuucaaguguuuuguagaaaauuaaguugauaaaagcauaguacuuaccauuuagagguuuauagcuacaaaauauauaauguuuguccaucuagaaggcauuuaagacuccaaagauauuuuauugacucucccaacaacuuugugugagacuugugccgucugucguuucauauaucagcuagagucaaggugaugcugcgcccuuuacaguuuauagaccgcgugguuucucucagcgugggguuuccugacauacacaaggaaguggaagacgcagcagcagcagcaaugacugaaugacuaggcacugccaagaucuccucaguacuucucuagucucuauuuuguuucucuguaugaaacagcaacuccaugaugugggcucuuuucuucugaucucagaacaucagugauuacuaguggacucagagaggaaguuagaggauuucagaaguaagagaauaagaaagucccugcuuucaagaagcucacacucauguggguaacuaaugcaaaggaaagaaaguaguguugcuguggacaagguggaaauaguuggucuugcuaucugauacaauguaaucgucauagugauuugauguaugcauuucauacauagccaagcuuucuagagcaaguaucauuaaaaaacaaaggcaaacaaucuugaccuggcugcaaagaucuauaguuguagcuacuuaggaagcuaagggauaaggauuccaaguucaaggcaugcuacaagagugaguucaagggcagccuggucaaccuacuaaaacccacucucaaaacuugaaauguauagaggugcugggccuugaacuugcacuccagcucuggacuaacgugugaggcauuaauccccagaaccaccauccauaucucucucucucucucucucucucucucacacacacacacacacaaagguauagggaauauguaagguagucuuugcuauguuuucugaaaaagcaaaaaugauuuucuaauucuuuauaguaaugaauucuuuaugaaagguacuagauuaaaauaacuaggaguaaagaggaaaacaauccagucuuuuuuuuuuuuaaccuugcaauggcagacaucuuaggaaagaucagauuuucuuaauuacuggguaacguuuuauggagccugagaacauguggcagagcaucuguauucuguuucucuauguguccccauuaaucauugugcuucuccuccaacaguggauggggagcucuacacauuuggagaacccgagaaugggaaguugggccuucccaaugagcugcugaugaaucacagaucaccccagcgugugcugggcauuccugagagggucauucaaguggccugugguggagggcacacugugguucucacagguauguggggaacgugcugcuccauucccuguauuaaguaaggacauuuuaaugauccuuuuuacugugccaagauacgaacacucagggcuggagagacggcccagugauuaagagcacuuguucuucuaucaugaguccugaguuggacuccaccacuggaguugggcagcucacaaauggcuguguaauuccagcucuaaaggacccaacacccucuuuuggucucagugggcaccuccacacacaacacauaaaucauaagguaagucuaaaaagaggagaauuuaacaugagcuauaacuucuaaagagcuuuuaaaguguaauguaggaucuuuaucucuauaucugaugcuguuuuuuugaaaccuugcuuagauauaacagacaggcgccugcuguccagugcauccucaugcacuucuuggcugcugggaacuaccauucuccacgacuuugacuccuguagauccuguauggaagcaggcuugaauggcuuuugguuaugauccuugccuuucauuuauauagauuauacauacuucuggcucagggaagaccuuuuuaaguaggaaaagcugaauucugcugaauuauauucaucuaaaauuaauauuuuuccuaaaauaauuugauuugaagaagcugucuucauacuauuuucugauguuaauaauguuuuauauauuuauaauguguaaacuuaaauaauucuuuguguuuuuuaaaaauuuuuuauuagauauuuucuuuauuuacauuucaaauguuauccccauuccugguuuccccuccaaaaaccccuauuccccuccccuugcuucuaugaggguucucccccauccacccacccacccacccacucuugccucacccccuggcauuccccuccacuggggcauagagccuuccuaggaccaaugccugacaaggccauccucugcuauauaugcaguuggagccaugggucacuucaugugaggucuuugguuggugguuuagucccugggagcucugggggcaucugauuaguugauauuguuguuccucuguuauaauaauaauucauuaaaaaguguggguuuguuuuguuuuguuuugguuugguuuugguuuuucgagacaggguuucucuguguagcccuggcuuuccuggaacucacucuguagaccaggcuggccucaaacucagaaauccgccugccacugccucccaagugcugggauuaaaggugugcaccaccaccaccccgagguuaaguuuuauauuacaggugaaaaagaaauuugaaaccuucaaaauagugucaauuugacuugugaauuucucuuuuuuuuaauuagaauuuucuuuauuuacauucaaauauuauccccuuuccuaguuuccccucugaaaauccccuauccacucucccucccucugauccccaacccacccacuccugcuuccugggccuggcauuccucuauacuggggcauugaaucuucauaggaccaagggccucuuccucccauuggugaccaacuaggccgucuucugcuacauaugcagcuagagacaugagucucuccguguguuucuuauuuagugugauaugcuagguuauuuggguuucuagucaauauguuaaauuauucucagcaauuuauaauaugaaaaccaaauaguugucuccaaauuuguuaagcaucagauuuaauuuacauaaguaguauuguaguaauauauuuagauaauacauuuuuauuauggauuuuuaaauuaaaaaacuaauaagagcuggagagauggcuaagugguuaagagcacuugcugcucuuacagaggaccgggguaccguucugagcacacacauuggacaucucauuagugccuguagcuccaguuccaggguaucuaguacacucucuggccccuggagacacccgcaugcauauggugcacaagcacacauagucauugcuuaaucugcagcaacccagaauuggaaaugcucucgaaaaaaaauuuuuaauuagguauuuucuucauuuacauuuccaauguuaucccaaaaguucccuauaccccccccccccggcccugcucuccuacccacccacucccacuucuuggcccuggcauuccccuguacuggggcauauaaaguuugcaagaccaaggggcuucucuucccaaugauggccgacuaggccaucuucgaccacauauacagcuagagacacaagcucuggggaguacugguuaguucauauuguuguuccagcuauaggguugcagaucccuuuagcuccuugguuacuuucucuagauccuccauuggggucccugugauauauccaauagcugacugugagcauccacuucuguguuugcuaggccccagcauagucucacaagagacagcuauaucaggguccuuucagcaaaaucuugcuggcguaugcaauggugucuauguuuggaggcugauuaugggauggauccccaggugcaacagucucuagauggccauccuuucaucucagcuccaaacuuugucucuauaacuccuuaauuagccauuuccuaugugucuggcuguggcaggcaagauugaauggggagguacaggagaagauauugugauacaggaaaaguguagauaaaacuaguacacuuagaacaggcaauaugauauauaaccuacuaauuaggagaucagcuauauuaaaauaagaaucucuugucauugccucaauaugccuuuauauccuuguuaugaauguaguuucuguaaggaguuuuaucucuauauuuccagcauucuuauuggagagaauuauuauuacguguucaucaguagcccucguucucagaggagcugauuagauauuuugcaaaauaauaauucuuuacaacugaauauuuuaaaacuuaccuggauagauuuuuuauaggauuuauuagcuaggguuuuaacaucagaugaucugaggaacuugcccacuggcugcagcuagcaauaagaauauuugcuucuggcuuuagugagggauucauuucugcucuccuuucuaugagaguccgcauaagaaaguaacaugaccaucauguuucuccgaacauugacuggugagauuguuucaucaguaacuuucgucaucagucacauauccuguuuuguacuucccaucucuagaugauaagugagcucaauuuacugaaauacugaaggacauuugcuguugccucaguauagcagcaauauagagaaagauuuuccccuccuguauuguaaagaaaauuugcuuaugaauacauacaucuagcauaucuacuguacauuuuaauucuucaucaaauaauuuucugauauugugugugccugggugugcaugcacacauguucauguauguguguccauguucaugugugucuguguguguucaugugugucgguuugcacaugcaugcuguguucaacaggucaaaccuguggcuuuguguaugcuaggcauguguucuaccuccagcucacaaguuguguuuccuggaauuuuauuaacccacuuuuacaaguaagggauuaucuguguaggaaauuucucguuuucuaauuuguggcagugaaaggaaauaguuuaauaucagaggagaguuucugaacugauguaauuauaaaugcauuuuagguuauucucugaauuaucuaucuuauaagauaccugaugauuacaauaauuccuuuuaugguaauucauaaaagacuaaaucagacccacaucauuauuuuauaacuuauuuuucuucuccuucaucauugaaaacuucuacuucauaucaguauuuuuaugaacaguucuuuugcaggcacuuuauguccauucuaaaaguucgaaugccaguuauuucagauaugauguacuuccaugcaacucuuuuuauguauguguucacuuccucucagagaaaguuguguaugccuuugggcuggggcaguuuggacaacugggccuuggcacuuuucucuuugaaacaucagaacccaaaauuauugagcguauuaaggaucagaaaauaugucauauuuccuguggagaaaaccauacagcuuugaugacagguaugggauaauuuuucuuauuuuuguuucuagaauuggauauaguuuaucauaauaugaaugauaaugugggaaugaguguaucuaacuucuuagggaauuuuugccugagaaaauggaauuauguuauugauauuuuaaauauaagguuauaaauaaguuuaaaaauaaauuaagguauaauucagauuacaaugaauauggaugcuguaguauagcucagugggaucacauguucuuagcuuuaugaggccuuaagcucaaucuccagcaccccccaaaaaauuacccacauuuagaaccuuaaaguagaccuuugcucaagaguaagaccauaaaauccuuuuaaaauuguauuugcuuaaaaacucuuaacuuuuccaaaauucucucaagccagagagaaaaaucauacaagaaaagcuuauuuuucuaucuccucaguagagaaaagcuguagucauguccagugagaguuuagguugcuuugaccacuagggggcguuucaggauugacucuuuccuucucuuuggaaaguaguagacagagaagggcauugcagugaccaccaaggggcguuguacacugacuccuuuccuuucuuggcaaaguaguagggagaagagcacugcaaaaacuacugagcagauacaucuccucuuuguuguuuucucuguuaccaaaggagauguuccuuuggccugcuuacuucucagugucauaaacuagaugcuguugauaauguggaacucaauaaaaaucucccuugaacccugauauagcugucucuugugagacucugccggggccuggcaaauacagaagugaaugcucacagucagcuauuggauggaacacagggcccccaauggaggagcuagagaaaguacccaaggagcuaaagggaucugcaacccuauagguggaacaacaauaugaacuaaccagugccccccggagcucuugacucuagcugcauauguaucagaagauggccuagucggccaucaguggaaagagaggcccauuggucaugcaaacuuuauaugucucaguacaggggaacgccagggccaagaagugggaauggguggguaggggaguggaggggaggguaugggggacuuuugggauagcauuggaaauguaaaugaggaaaauaccuaauaaaaaaauuaaaaaaaaaucucccuugaaaugaccuagcacuuuguaacaaaaggaccuauuacucaacuuuuuuaucuaaaaacaaaguaaaacaugaaaaagucagaaauaguucuaguauauuugaauaauccagacucuggcauuccugucuucuuuccuucuauccaaaccuucuccaaaaagagcagagcucaugaaacaguguuuuaaaaaguagaaauuggaaaacaugaacuacuaccauaaauaguucuuaugguaguuuuacuaccauaaagcguucuuucucacagaacucuucaagaaaaaugaccugccccuuaucaaguauugaugaucuccuuugccuagcauguagcaacacuauguaguauauaaaaaauguaucauccauucauuguccuuccuguaggagcuguugauaggcgcuccuuaacaguggugcccuaaugauagcugcucuguccuagugccauuuuucauugacuaaauuaucacugaugggcacuguacuuuguaugaaucaugugucucacuauagguuauuuaguuaaguuugcagaguacuuuucuucccugaugaaaagagucuggcacaaauaacugcauuuuaaguuuguucaccguuuugcucgugcauccuccccagggaacaaguguuacagauuuuguucucucauacaaugagauauguguagugugcugguuguuccccagcuugaagcucuauacuuuuuuuaaaaaagcuaaccacucuccaaauauaauacaaaaagguauaauuuaaacaaauucuccuaucccuagugugggucuaccugcuuuagaccccgaaucucuaacaguucuauucauuuggcuugcugauuaucuuuuagcuucuugucuaaucuguggucucuauuauacaaaccuucccauguaguacugacucugccuggaggaugcuuucucucugucucucugucucucugucugucucucucucucucucccuuccuuucuuccuuucuuucuuccuuucuuccuuucuuccuuucuuccuuucuuauagugaaauucuaucuuuuaugauucacugugacagccuucucuauuccccugacuagagugaaauuccccuucucugugcccugaugggcuucugcuuccauggcauuugccccacacccauuaaauguaggauaugcuggaggggcuagcgaagaagugcaaaaguuaaauguaacugcugggccaauaugugacaggguuaguuagaagugcuaggauugcuuaucauuguaugcccaccaggauggaacccagauacugaugugggaauuagucagaaugguugguucaccucugacauugcuugggcagcauuccacagcccaagagcuaaccuaaugaaagagacagccccauucuaagugacauagcucuccaccagcgacaaauuugcaccccuaggagacauaaaugaugucuagggacauuucugauuuucauugcuggagaaaggaguuauucuacugacaaguaguggacagaggauaguaauggugcuaaauagacggcaaggcauagggcagacacacaaggauacuuuguccacuaagauguaguggucuauucucaguucgauuaccuacuguuguauguagaaccauaaacacgauacacugcuuggcucaguagaccagagugaauuuaauuuacaauucuaugacaagguuauaauuguaguagaacuuaauguauuugucucuaaguagaaauggaccuuguguaacaucaguuuuguuugcauuuuagaacuaggccuccuguauacuuuuggagacggccgacauggaaaguuaggacuugggauggagaauuucaccaaucaguucuuuccuaccuugugcucuaacuuuuugagauuugcaguucaauugguaaggguuucauauccccucuuguauauuuuauacuucuagauuugagacucugguuauuucauagaaaaugcguauuuuuaucuuugugugaggguuuccuagguacagcucauaauaacuguaagagccaaguguuagacauuguauuccucuggaaaaaaaaaacucuccuuuucuaauuuucuuccuuuaacaacauuuuucuacaaauuugaguuuucugcuuccuuuuaacuuuucuuggaaacuaggacugugccaugucuguaagcuucguaucucauguagcaagcaccaguagggcucacaguaacuacagggcaaaugaaaugucacugguugaacacucuccaacccagcccaagaagagacuugauacuaaaugaagaauguugcauauugguugaacacugagauaagaauuacucuuuucagugccacaggaacaucaccaucagucuuucuguuuuauuguuucuaguauuuuugcaaguuaagaacuauagacgugggcuggagagaugguugagugguuaagagcacuggcuguucuuccagaggacccaggcucaauucccagcaaucacauagcagcccacaacuuucugcaaauccaguuccaggggaugugacacuggaauauaugugugacaggacacuggcauaugugcaucaaaacaucucuacauaucaaauaauuaaaaaaaaaaagaacaguggacauguaagcucuuguuacuuggugguacucuuauugccucuccaaagacaucgugccucacgcugugguaccucucuuuuucauuucauaacugggauaguuuuaguugccagcuugacacaaucuagaaucaccuggggagggagccucacuuggagauugucuacauuaaguuggccugcaggcuugccucugaggaauuuaaacuagguucuuuguccucugaagccacauccugaccugcagcagcuguuugcuggcugggcccuaacuggcauggaugcucucugcuccuggcuuaccuccccgaagcuccugucccugggaccugcuugcuuuggugggccugaaucugcaaccaagagugaaaauaaacccuuucuccccuaaguugcuuuuuucaggguauuuuaucccaagaacaggaagagaaaauaagauaauaaccauuuaaugaaagccuacuguguauaagauauugguguaaauauuaggaaugcaaguuacucagugaugaacaaaauaccaacugcuaauuuggugaccuuuauggagaggaugcuuugaagguaugcaguucuucugucaccaggaagagcccugcaaaguggcuugaaucugagugugacuucuauuaacaaguuaagaccauuuacauuuagaauuauuauugagauagauuuguaguuaaaacauuaauaaaaauauaauuauaucacuucuccuuuauccaaccacacccccuuucuucaaaauuccuauccucuccuucuuuagucuuauauaugcacaaaugcauauguagguauaacuugcugaguuauucuauguugccugcauguacauaguguaggguuggcuccuuggcauuggauaagcaaucagagggcucauuucuaaagacgacuaauucucuuucucccugcaguuauuaguauaggguuuuugcaacauuuuuauaaaaagauuuauuucuuaaaacucauuggugguuauauuuuuuauuauuucccccaauguguuuguauuuuacucuaaagacuuauaagccuuuaauuuagaaaguguucucauaaaggaaaaggcuuggagacauaaucuuuucuuuuuauuucuuuuugacaauuauauauauuauauauauauaugcauauauauguuaugauugcauucaucucauuacucugucauauucucuuccuccuccuuccuucuccuucuuaaugcuuuccucucaacuaguacaucucuugcucucaugccuuuuuuuuuuuugguucacugaauuuaggguuguuuacauaagcaugaugagaggcuguuugcuagaacaugaccaacacacuacuuaaguguuucuuaaguggcgacaucacuuacgcgaaugucucccucucccucaggaaccauuaugugcuaauaguuccuuagaacagggugggaguucauggauaccucucccucuuccuuaaccacauguggaagggccuacucuuaugcagacguuuuacagauauguauaacugcuauauauuuauuauaauggucagacacauaguuauuccuaaguaauuucccuacuaauuauucuuuggauauuugugacuuuaauguucuuccaagaucaaacguaacauuuucaaaguuaugagauaccugugacaagggcauuuucucuauauuaaauugaaaguaaaugguggaucaaacugauuuuaauuuucagccaguguuuaaggaauauuuguuuaauucauguacauguguguauguuuauguguguguauguaugugugcguguauguaucuauacacacacacacacacacacacacacacacauauauauauauauauauauauauauauauauauauauauaaaauuuggagagugauagagaaaagcugugaaucagucagucucugaauuuugcuucuaagaaaaugucuuggugcuaaucugguaaguguuagcccauuuguguuugguguuaacauugaggaauucuuuuguggacuuaugcuugcagauugccugugguggaugucauaugcuaguuuuugccacuccacgacuugguacaauagaugaaccuaaauuugaagacguauaugagccuuauauaaguacagguucuuuuuccaucaaugaccucuccccaagaaguucacugaauagaucuuuaucagcacgucugcggcgaagagagcggguacaguguggcugcauucuguaugauagcauuagcggguacagcggguauagucuuaucuaccacugcaaaagaagcaggaacaauccuguuuacuuuuuaagucaaaggagggucuuucaagaugaaagugguaauaaaauggucagagauaaaggcuuugaaguucaaaguuaagcuauuaaacaauacaaaugauuaucauggauagccuuuguuuauagaucauuaucaagcacacagcauauuuuuauagaucuuccuuaucucagaguggucucuugauuguuuuuaagcuguaugucgauugauuguuccauguuuuguucugauacugugguaagaacauuccuauccauguaacacagcuuuuagaauguagaguacaguauuagcaugaaagaugcaguguacuauuauacagcagauacggaggacuuaaucauuugguguaacacugcugccuuuugugguaagcuuccugagcaguagaaguuauagacuuaaaugaugaaccacggaaaacaaagaaauaagccauuuacuuggcgacaagaaaggcuuccuacuaguuacauuuagagacccucuugcuguucuuuauaauugcuauauaaggcgcacaucuuuugaaagaaaauauuaauacuuaaaaucuuugaaauuauuuuaaguucuaaaauauguuccuuuugaagggaaaaggucaagucuauauuuuauuauggaaaaguauguauggaaauacugaaaacuguccccagucuguggcaaguuuguuucuuaugagcaaauuuuuguuucucggaguagagagaugaaacacaaacacacuuccuagcacaccaucuaagauauaaagacaaagaacagaagggacauuggcagaguucgaagcuuucuuuuaauuauuuucaguaagugcaagaaagugugugcagauguuacauagaauggcauuugacagucuguuuaaauuauuuuaaaggagagacccccaugcucagcuucaauggugggaacacugccuccauuagaggggacuucugccuccacuucagcuuauuuuuaccccaguucaccccccuuccauuugucugugaauaacuacccagagaaaagccccucugaaucaauggagccacuggacucagguaauguuggcugcuuucaaaggacacgagcccugcaccugccauuuucaugcuuuucuugagauguuuucuccugggccagggacauagguuagugguauaauauaguacuuguguaauguagguuagacccuaggauugaguccuaggguccuaggaaauuaaugaagcauguggaccccccccccccgcuuuguuauacuauccuguuccuagauagaaucugacaucucuaauuggagccaaaaucuagauguaccauccagcccucagcacagcaacucuggagcaauggguacuauacauagucauuuuaggccugcguauuucaugaaguggauggggaugauagucuuuauuuucuugguaagugaagcgaggcucaaagagauggaguagcuuucaugugaucauugagcuuaugaauguaguggacaggaugcagauggagauucuauaaugcagcugcaacgcaucacagugguucugugcuuaccagggcuuaugcacuucaguugaucuaaguggcaugcuugguuggguacuucuaaacuaugggaccgacguaauuucccaaagcuucaguuucuuuauuuuugaaauggguuuaauaauacuaaaguaaaugucugggaaagaaucacagaagcuaaagguccuuccuauguaugacugacaaccuccuuuugaucuguagaaccacauagagguccaaagagaaaacugauugacugcauaaaauugucuccugugacacacuguauaucauaugcugugcauaccuaauaaucauaauucaaaaaaauuuuaauaaguacacaauuaagagagaaguuguaugaguuaagagauccagcaugaaaaauacaugguaacguauucagcaccucuauaaacgcuuccuauauacacuuaaccucauuccguauaaccuacagguguuauuauugaaauuacaacuucagcucuuuuacuaguguauaucucuuauacucuacuuucucuucagaucauauaaauccuuuuuuauaugaauuugauuauuauuuuuauuauuauugauauucauuauugauauucuuuuuauuggauauuuuccuuuauuuacauuucaaauguuuuccccuuucaggucucaccuuugcaaacccccuaucucauccucccucccccagccucuaugaaggugcucccucacccacccacccacccacaucuucuggcccuggcaguccucuacacuggggcaucaagcaccaucaggcccaagugccuccucucacugauguccaacaaggcuauccucagacacauauguggacagcgccaugggucccuccaugcauauucuuugguuugugguccagucccugggagcuccagggggcagggaaucuggccuuuugacauuguugcucccucugugggguugcaaacccccucagcuccuucagucccuucuccaacuucugaaucgguggcccccacacuaaguccaauuguuggcugcaagcuucauccucuguauuugucaggcucuggcagagccucucagaagacagccauaucagucuuccaucagcaagcaguuccuggcauccaaaauagcaucuagguuuggugguuguaugugggauggauccccagguggggcagucucuggauggcuuuuccuucagucucugcuccacaaauugucuccauauuuccuccugugaguauuuuguucacacuucuaagaagcacugaagcauccacauuuuggucuuccuucuucuuaggcuuuauauggucuaugaauugaaauuuggguauucugaacuuuuugucuaauaucuacuuaucagugaguacauaccauguguguucuuuugugacugagguaccuuacucaggaugauauuuucaaguuccauucauuugccugcaaauuucaugaaguuguuguuuuuaaaagcugaguagcauuccauuguguaaauguaccacauuuucuguauccauuccucuguugagggacaucuggauuguuuccagguucuggcuauuauaaauaaggcugcuaugaacauaguggaacaugugcccuuauuacauguuggaacaucuucuagguauaugccaaggaaugguauagcuugguccucagguaguacuauguccaauuuugugaggaaccaccagacugauuuccagagggguuguaccagcuugcaaucccaccagcaauggaggaguguuccucuuucucugcauacuugccagcaucugcugucaccugaguuuuugaucuuagccauucugacugguaugaggugaaucuuaggguuguuuugauuugcauuucccugaugacuaaggauguugaacauuuuuuaggugcuucucagccauaugaauuuccucaguugggaacuguuuagcucuguuccccauuuuuaguagaguuauuuaguucucuggaguccuaacuucuugaguucuuuguauauagauacuagaccucuaugggauguaggauugguaaagaucuuuucccaaucuguugguggccuuuuugucuuauugacaguguccuuugccuuacagaaguuuugcaguuuuaugaggacacauuugacucuugaucuuauagcacaagccguugguguucuguucaagaacuuuuucccugugcccacguguuugauauuuucucuucuuucucuuauauuagauucaauguauuugguuuuauauggagauccuugauccacuuggacuugagcuuugaacagggagauaagaauggaucgauuuccacucuucuacauguugaccaccaguugagccagcaccauuugcugaaaaugcugccuuuuucccugggugguuuaagcuccuuugucaaacaucaaaugaccauagaucuguggguucauuucugggucuucaguucuauuccauugaucuuccugccugucacuguaccaauaccaugcaguuuuuaucacaauugcucuguaguacagcuugaggucaggcauggugauuccaccaaagguucuuuuauuguugagaagaguuuuuauccuggguuuuuuguuauuccccaugaauuugcaaauugcccuuucuaacuuggugaagaauugauuuggaauuuugauggggaauacauugaaucuguagauugcuuucaguaagauagccauuuuuacuauauuaauccugccaauccauaagcaugggagaucuuuccaucuucugagauuucuucaguuucuuucuucagauauuugaaguucuugucauacagaucuuucacuugcuugguuagagucacaccaagguauuuuauauuguuugugccuauugugaauggugucaauucccuaauuucuuucuuagccuguuuauccuuugaguaguggaaggcuacugauuuguuuuaguuaauuuuauauccagccacuuugcugaaguuguuuaucagauuuaggaguucucugguggaauuuuaguggucacuuucaugucaccugcaaaaaauauuuuuugacuucuuucuaauuuguaucaaauggauacaaauuagauauuuuugacuucuuccuuucuaauuuguauccauuugaccuccuuucuugucuaauuacucuggcuagaacuucaaguauuauauugaauggauagagagggcagccuugucuagucccugauuuuagugugauugcuucaaguuucucuccauuuaguuugaugauggcuacugguuugcuguauauugcuuuuacuauguuuagguaugggccuugaauuccugaucuuuccaagacuuuuaccaugaagggguguugaauuuugucaaaugcuuuuucagcaucuaauaaaaugaucauguguuuuauugguuuuuuuuuuuguuuuaguuuauuuauguaguggaucacauugguggauuuccauauauugaaccauccuugcaucccugagaugaagccuauuugauccuggugaaugguuguuuugauguguucuuggauucaguuugugagaauuuuauugaguauuuuugcaucaguauucauaagggaaauuggucugaaguucucuuucuuuguugggucuuugugagguuuugguaucagcauaacuguggcuucauagaacgaauuggcuaguguuccuucuguuucuaguuuguggaauaguuugaagaguauuauugcuauuaggucuucuuugaaggucuaauaaaauucuauacuaaauccaacucauccugggauuuuuuugguugggaaacuuuuaaugacugcuucuauuucuuuagaaguuaugggacuguuuagauaguuuaucuaauccugauuuaacuuugguauuugguaucugucuagaaaauuguccauuucauccagauuuuccaguuguguugaauauaggcuuuuguaguaggaucugaugacuuuuugaauuuccucuguuucuguaguuauaucucccuuuuucauuucugauuuuguuaauuuggauacucugucuuugcccucugguuaaucucgcuaaggauuuaucuaccuuauuaauuuucucaaagaaccagcuccugguuuuguugauucuuuguauaguucauuuugcuucuacuugguugauucagcccugaguuugcuuauccugucaucuaauccucuuggguguauuugcuucuuuuucuucuaggugcuuuuggguguacuguuaaacugcuauuuaacacuaguaggcucucuccaguuucuuuuuggaggcacucagagcuaugaguuuuccucuuagcacugcuuucauuguaucccauaaguuuggauauguuguaccuuaauuuucauuaaauucuaaaaaaucuuuaauuuauuuucuuauuucuuccuuguccaaguuaucauugagucgaguguuguucagcuuccauguguguauaggcuuucuguuguuuuuuguugcuauugaagaccauccuuaauauguagugaucugauaggaugcaugggauuauuucaguugaagucuguuguguggucaguuuuggagaagguaccaugagguacugagaagaaaguaucuuccuuuguuuuaggaugaaaugauuauagauaucuguuagauccauuugguccacaacuucuauuaguuucacuguguuucuguuuaguuuguguuuccaugaucuguccauugcugagagugggauggugaacucuccuauuauugugugaggugcaaugugugcuuugagcuuuaguaaaguuucuuuuaugaaugcgggugcccuugcauuuggagcauagauguuuagaauugagaguucuugguagauuuuuccuuuggugaauaugaaguguccuuauccuuuuugauaacuuuugguugaaagucgauuuuauccaauaguagaauggcuacuccagggaccauuugcuuggaaaauuguuuuccaacccuuuacucugagauaggguuugucuuugacacuuaggugcauuuuccugaaugcagcaaaauccuggguccuguuuauguauccagucuguuagucuaugucuuuuuuauuggggaauuaaguccaucgauguuaagauauauuaaggaauagugauuuuugcuuccuguuauuuuugguguuacuuucuauguuugucuggcuaucuucuuuuggauuuguugaaagaagauuacuuucuugcuuuuccuaggguguagcuucccuccuuguguugguguuuuccaucuauuauccuuuguagggcuggauuuguggaaagauauuguguaaauuugguuugucauggaauaucuugauuucuccaucuaugguacuugagaguucugcugaguauaguaaucugggcuggaauuuguguucucuuaggguaugacaucugcccaggaucuucuggcuuuuauagccucugguuagaagucugguguaauucugguaggccugccuuuauauguuauuugaccuuuuucccuuacugcuuuuaauauucuuuuuguuguuguuguuuuuugcuuuugguguuuugacuauaaugugacagaaggaauuuuuucugguccaaacuguuuacaguucuguaggcuucuuguauguuuauggccaucucuuucuuuaaguuagggaagauuucuucuauaauuuagcugaagauauuuacuggcccuuuaaguugggaaucuuugcucucuucuauaucuauuauccuuuuguuuggucuucucguuguguccuggauuuccuggauguuuuggguuaggagcuuuuugcuuuuugcauuuucuuugacuguuguuuugucaauguuuucuauaguaucuucugccccugagauucucucuucuaugucuuguauucuguugaugaugcuugcuugcaucuaugacuccugaucucuuuccuaggguuucuaucuccuggguuguaucccuuugugauuucuuuaguguuucuuuuuuuuuuuaacauuucauuauuuuuuauuagguauuuuccucauuuacauuuccaaugcuaucccaaaaguccuccauacccucccccccaauccccuacccacccacucccacuucuuggcccugacguuccccuguacugaggcauauaaaguuugcacgaccaaugggccucucuuuccacugauggccaacuaggccaucuuuugauacauaugcagcuagagacaagagcuccgggguacugguuaguucauauuguuguuccaccuauaggguugcagaccccuuuagcuccuuggguacuuucucuagcuccuccauugggggcccugugaaccauucaauagcugacugugagcauccacuucugugugugcuaggccccggcauagucucacaagagacaacucugucagguucuuuaguguuucuauuuccaguuuuagauccuggaugguuuuguucaauuuuuuuuaccuguuugguuguguuuucccuuuccuguaauucuuuaaaggauuuuuguguuuccucuuuaagggauucuaccuguuuaccuguguucuucuguauuucuuuaagggaguuauuuauguccuucuuaaaguccucuaucaccaucaugagaugugauuuuaaaucagagucuugcuuuugcaguauguugguguggccagggcuugcuguugugggagaacuggguucugaugaugccaaguacccuugguuucuguugcuuauguucuugcccuugccucucgccaucugguuaucucuguuguuaccuggucuugcugucucugucuguggcuugucccuccugcaagccugugugucaguauuacugggagaccaguuuucucugggaggaauuuggguauggagagcuguggcauaggaucagcucuggcauguagauagaaaccagaaggauccuguccccugcuguuccuugguuccauuguccugguaguucugcuagagucucuauuaggccaggaauuuaaaccaaagugguggucuuaccugugcuuacuccugggagaccagcucucucuugcugguauuuggguauauagugcuguggcacagaaucagcucuggacacucuggcauaggauuagccccgggcgcagagggaaacaggaaggcuccuauccacccaggcugcuuguugguuccuguguccugaggguuugaggcaggucccucugugcagaagugguggucuuaccuauacucauaggcuuguccacacuccucggaggcucacucucucuggccacuauuuguguauggagcucugugacacgggaucagcucucagaucauauaaauucuuaacccuucucuauuaugugccucuccuacauaauuuuauuuguagacauugagugucuuucaggaaaauucaucuguuacugcaaagguacacuugacuauaaccucaugaccaagagauuagagaaacaguggucugggaauuaaaauaugaaaccaaaggugagguggcucagggguuaaaaguauuuaaugugaagacuuggugaccugagguucauuccugguuuucacauaaagguagaaggagagaacugacuucacaaacuagucuucugaccgacccuaugcuauaucauauaagcacccauacacacacacacuaaccaauaauguugaaaauaaaaccuaaaaguuggggauaaagcauggcaaagaugaaugacuuuuuauaucuuugaggaauugauaaagggccaggaacccaccaaaagcagaucaugggauagucagcauaagcaggaugccaaugaugagcugugucugacaugcaccucccauaagguucacuuugaaauaagaaugaacaucagauggugcuuuuuaaccuuagacaugaaaagauuugaaggugugagguagcaugggaagaauuagaggaggaguguguggggcagagauggucauauuucauugcauacauauuugaauuucucaaaaauaaaaacuuuagaagcauuuaaaaguguucaaaguaguagcauauucugccaagcagugugcacagagaaaaggcaaguuuauaguucgggaaaguuauuucacacuucaagagacuucaauauggaaugauauauaauuuuauacuuuuguagcuugaaguaaauaagaauuaaauuuaaaguuuaaauuaaaccuuuaugacuaaauuuaauaaaaaaaguacuuaaagagucagccacacaaagagacagaauauacauauuccaggcuaagaacauaguagagacaaagauuuggaaaagaaaaggcaaccacuguaugaauagaagauguggaggugggggugggaggaauucacaugcauuuguuauuggagaaaggcaugggaagaaaaauauucauuuuauagguuagaagagauauauuugcagugaauauuuuucuuuggucuaauggguuuuuaccugauauguuccaguccaguugacccuuuaagguaaucauuucugggucauuguggauuguugggaagucagacuauaaguaggaagaacaugugcaauuuagaagguaaauuuggaaggacuaauauucgucgguaacaaugaucucaggaaauuaguaucugagacagugguauuuugaaugccaaauaucaguggucagagcucaaaccaaaagcggauaagcggaggugagccagugguacaggagagcaugguaacacuugagaggcuggcacgcagaacagccugugguggcagggaagauacauguugguaggaaaaugagaagaaguguuuggcagggggcggguaggugagaggacaaaauagacaugguuugucaucuuuacauuuucucaaucaauccagaggcaagguccuaucagucuauauaagcugcuaucuuuuccaaaccuauauucucuauaugacaaucuauccuucugugauaguuuccacaucagucuuucugucgugcaguuuaaugccuaucuguucuuuguccauugaagauuccugauuuuuaugaaaguguaaaauuucccauauaugucccaucugcucuucuuguuuuaucucucaauaacauuuccuuauucaucugaguuaggagacagcaaacuauggcccaugagcuaaaucuagcugguauuuuauuuuuauaagugaaaauguaagaaaauccagccauccuaguucuuuuguauauuguaaguaacuacuuuccaugcuaaaaugucaaauggagagaaaggcaagcaguuaagagcacuugcuuuuuagguccucugcagcagggaaucaaauaaccuauucuagcugcuccccccccccccauauuucucugucucuguauauaucugugugucugucucugucuguaucucucucugucacacacacacgcacacacacacacacacacacgcauauacacuaagaguaauauaauaucuuugaaaguuucagauauuaaggacagcccuacagaccuuguccuuacuaaauauaagaaacuuucaaaaaaaaaauccucagauguuaacucuauugucuuggugccuugguauuaaucaaaaugagugguucaguuuaacuuaccgaaaagagcaugggcuauauucagauggaauugagacaggucaucaaagucugcuuucuucucauugucauugggugcauuagucaggguuuaacuguugugaacagacaccaugaccaagacaagucuuguaaaggacaacauguauuuagggcuggcuuauagguucagagguuuaguccauuaucaucaaggugggagaauggcagcuuuuaggcaggcauggugcacacagagcugagauuucuacaucuucaucugaaggcagcuagcagaagacuggcuuccaggcagcuaggaugagggucuuaaagcccacacccacagagacacacugauuccaacaaggccacaccuucuaauagugccacuuccugggcuaagcauauacaaaccauaacaugggauuagccuaacaugggcuaaaguauaugcuucugauacaugggaaaucuucaaccuucuuguaucuuucucucugcucuuuugcuuuauuaguuuuuugcucuguucccuuuuacccuauaucccuaccucccuaauccuuucauguauuacucaagugaaaacuuugcuuauucccaauaucuauaugugaguuuuuucuuuacccauuauccuauguucuucaucccuuauagaauaugaguucauuaagaauuagcaguuacauuacuacuucuuagugaacacacacacacaccaucuguuuuauaccuuaaauacaucauucaauugaagccucagaaaauuggacauaguacuaccggaggaucccgcaauaccucuccugggcauauauccagaagaaguuccaaccgguaagaaggacacaugcuccacuauguucauagcagccuuauuuauaauagccagaagcuggaaagaacccagaugucccucaacagaggaauggauacagaaaaugugguacauuuacacaauggaguacuacucagcuauuaaaaagaaugaauuuaugaaauuccuagacaaauggaugggcaucauccugagugagguaacccaaucacaaaagaacucauacaauauguacucacugauaaguggcuauuaucccagaaacuuagaauacccaagauauaagauacaauuugcaaaacacaugaaacucaagaagaacaaagaccaaaguguggacacuuugccccuucuuagaauugggaacaaaacacccauggaaggaguuacaaaguuuggagcugagacgaaaggauggacuaucuagaaacugccauauccagggauccaucccauaaucagcuuccaaacgcugacaccauugcauacacuagcaagauuuugcugaaaggacccacccagauagagcugucucuuuugagacuaugcuggggccuagcaaacacagaagugguugcucacagucagcuauuggaugcaucacagggcccccaauggaggagcuagagaaaguacccaaggagcuaaagggaucugcaacccuauagguagaacaacaauaugaacuacccaguacccccuggagcucguguuucuagcugcauauguaucagaagauggccuaguuggccaucaguggaaagagaggcccauugucaugcaaacuuuaucugccucaguacaggggaaagccagggccaagaaguggcagugggugggggaggguaugggggacuuuugggauagcauuggaaauguaaaugaaauaaauaccuaauuaaaagauaaauaaaagggagcauugaguguguacugacaauuuuaauggaaauuuccucaggaaguaccccauagauggucaggucaucaaaggggcagggugacaaauggacaaagguucaagcagagcuaaucauuuuggaauuuucugcuuuauaauauuuugugauauaacuaauauuuugagaaauucgaagugcuugcacugguuuuucauugcuacauaaaaaauuucaaaauguaacuggucagauuaaccuauuuauuauuuggcacaacuucugagagucaggaauucaggaggagcuuggcugagugucucagacucaggcuuuuucuggacuugagcuguuagaugagaugguagcauugggaagcuugacuggacuucuggcucacucaugugcgggcaucacgcaaacuuacuauauagacuucuuagaaaugcucacaauauggcuucuccuagagcaaagagaaaaauaagcacacaucagugaccaagaaauuagagugacgucaguuauugugcauuguccauuuuacuggcuugaccauauccauggaauucaacccuauaucuuacacaugaagaaguacacugaggaaagaauaccggaggcauuggggucacuggagcugucuuaaggcuaucuggcauuacuugauacagcuaagcugagaaguauuuauuccagaggaauaguguuugcuuguccuugugaaugaaauuggugcuacauacuuggcaacaaaguaauuaacuuucaagaugagauuugagaaucugcuacuacuaaggaugacuaccauucaucuccagccacaagacuaaagcgccuuggcugcgguuacaccccaugguguauuauagaaugcagauuuguucauuugccuuucucacuucuguuaagaucugaguuugacuuuucccuucuacucauucagauuauuuugaagauaaaaugaacaaagacacagagacagaaaauucuucagcaguggauucagaaaacuuuggugaaacuaaugauaucuuaaauaugguaauuauuuccuggcuauuagauaugaguuaugugaauuuuaauuacuugugaacugguguguauauauacucuuuauaucuuuuauguguuaaaagcugacuucguuacuauuuaauaguacauauuaauauuagugaauuucacuguguuauuuccaucccugcguaaaucaaccuuugaucauguguacccuccuuuucaccauguugcccuacucuaguuccuuucagcuaccccauauccuucacuuaacagucucugaagggacucuagccaaagugaacauggcaaacauggccuugcccuucuccccauucccucugccuugcuuaaaauuguuagauuauauuccuaaagccaaggucuauucccuuauuuagcugcuucuuccucugcaaucgaaagcccccuuuggcuaccuuaauuaaccugcccaaucaauuauccuaacacagcuuucuccuuguaccuuuaaaaccugcccuuuuccugugugccguaugugucgccucuauccggacucaauguuuugucuuccacaacaaauagcccuccuccuucucccuuguucccuuccucuucucccucauccucuaccuccugccuuucucucuuaucccuucccuuugucucucugaagcaaacacaucuccuuugugcugagaacuugcucuuggaguccugagccaauacuacuuccuucaccuucccuugaaguuguguagugauuugauagucuuugagaacuauuauuuagcuuucauguauuuccuugcuacugauuuauauuauuuucuauuuuacuccauauggucugauaagauaucauacauuaaaauguuuuugaauuuuguacaguuuucuuugaccuuauauauggucuauuuuagaauaaauucuguaugcugaugucaacaaauguacacucuacaucuguugaaauauuuguuaaauccacuuauucuauaauauaauuuaucaauaacauuacuguguugauuguuugcuugcauaagaauguacuacugaagucaccacuauuauuguguuagagccaauuuuauuaaaaaagaagugagugcuucaguauuuggcacuuaggaaggaaagggauuuuacuucacauuucacucacaguucucuacaucagcucaucaucaaaagcauugagggcaggaauuuaagcagggcaggacccuggagacaggagcugaugcagaggccaugaaggagugcugcuuacuagcuugcuccccgaccuguucagccugcuuuucuuguagaagccaggauuaguugccacaaugugcugggcccucccacaucaauuauugagaaaaugccuuacaggcuugccuauagucuaaucuuauggggacauuuccuugauugggguucccuucgcucagaugacuuuagguuaugucaaguugacaugaaacuagccaauacacuaggugugguaauuuugauuggcaguuauuuuuuuauuaaugcaaugaaauauauuaucauuccauucucccuagucuuuagguccugcugauaaauuuuaucuuauucuaauugauuugccuuuaaauaaaacugagugccucucucauagcuuguuuguuggugguugauuuugaggugggggucccauucuguagccauuuuguuugagaauucacacucuaguccauguuggccuugaacuuaugauggccuaaaggccacagccuucauaacauguuuuuauauggaggucuacacauuuguuggaguggcugugucuuacacuauuaugugagacccuccuuaguaagcacaccuagucuuacgguauaacuggaggucucaguuuguuguuaguguugauuucaagugcaauugaacuucuuaguauaaagagcuuguagaacaucuggcagugaucaguuuuugaccugauguguguagugucagucugguaaacccacacacucucugugcagucacacaacgccaucacacagaaucuuacacaauucuccuucucaagcuucugacaguugggcucuaaagauuucuauuuucaaggaaaccucuuuccuuucagcucaacauuguauucuacuuccccccugcacagaauucucggggcauugcgucaauaugucuucuuccuggccagccugacucuaggcuaaugcccacugagcuaguacaauauugccugacaacuauugugcagcuuuugcuggggagacaugaacagacauguauucauuacauacagggaacuaacaacagacuaaaguaacaguacuaccaaugucccacuuggagacccaaugaguuuauuguggguuacuuacaagaaugagggugagggguuaaguacacaugcauagaugacuccaaggucgucuaugaagaugcuaugacugaaaaucccaucucagggugugugugugaugcugcccaacaauugccucucuagaacccccuugauaacuuaaagguagcucagcaggccagagagccuccucuuaccagucguccuuacugcuuaugcaaccuggaaggagggauugggggaaucucacaaguuucacugacuccuugaggcuugugauuuguuucagcuguggcacuaauuacuauucaccagucaucuucagaacuauaagaaauuacacucaugggcuagggaagacacacagucuagcuagucaagacucuuaaaauuagcacagaaagcucucucugaagaauuucuccauauuuccaagauuauucucaggugcuguaacuggagaaccaucuugggaugguuuacuaagaucaacagcucuaggaauuaaagccuccuauauuuuucuaucuucgcaaccauguuguguagcaauuuccuuccaaucaaagcauuccaacuuguagagaagcucauuaagacuuaggaagaaacaaauauaagcuccuaggcucaggaacacacaugacucauuguuuucucucaugcauggauuccugacugaaaagagaaagaugacaugaaaguggcaagaggacucuuuagggggcaggggcaggggcaugcgaaggugguagaaggauguguguggcugaagcacacauuguucaugcaugggaaugccaugaggagacauaguauuuucuugaauugggaaacaguuuuauccuuuuacaucuaggccuauaaagagugaaaccagaaaucuguuagcuccugcuaggcaguuccauaucccugaguuccagagucuggcccagugguguucaccagggcauuuugucuuucccuguuacccucccagagcaaccacccaacccaccucuaagagucugucacuacaauauuacauuccaccauccgccuuucuucauccuccuaaagaacuaggaaaggcuccucucuugcuucuaauauggaaaaguugaaaggcacuggcuugcuuuaagcucuauuuugcauauuaagucuauucaugauguucuaaguagcuuuucucuccuaauaucauuaguaugguaguguggauagauugcauuaaugccuggauuucuuuacauucguuauucauuuguaguuuuccauuuaccuagaagacauauucuuauuuauuucagacacauaugaugacuacgaguuccaaugagaaguuauuagauuuuucaccaauucaaaaacaacagguauaacacauagcuguuauuguuguuguuguuguuguuauauuacuguuauuguuguggguaagaauguuuuauuauuucuuuaaaaacuuuuuauuauuucuuuaaaaacuuuuuggaaagaagacuuauauugaaauuuaaagggcaggauugcgacguagaugauuccuauuugguuucuuuuauucauagcuauuuccucauagauuuuaacugcuacaauuugcucuuccaguuaguuaccugcccuaugauaaugauucuucucaacugagcacuagauccucagucaucuuagcucuugcuuuggggaagagguuaguaguuuucagaauggaccucagaauuugcuugugaaugacuuggccugagucacuaugcugacuuaucuggagaauauucacauuguuucuuuguguucacuaguugauaaucauuuuguaauagggaaggauuagcauaaaacagaauaaaaugaaauuggaaauuagugagaggcuauaaauagguaagaaagagaguuuaguuaguaacaguguuaguaacaaaaagucagucugugauuuucccaacuuagauaaaugaaggcaugcugggcagccuuuuugcucuuaaugacuuuaggggccaaugaaacaaaaauaagagguguuuggcaguuaauaaaauaagcaguugacucuggcuuagggaaucguguaauuucuguuuucuacugccuuugcuaccuuguuuguuuaaaaauucuuaaagacagauccuacaaaaugcaggaagauccugcuuaacuauaaaaaugcauagccagcccucgaaaggugagaggcacagugaggaauagcaugcuuuucaccaugggcgagcacuccaugucuugguggcuuacucugccgcaagcagggccuuaguuucuaggagaugcuagacagaguuucgcugaguugcuuggaaaagaaagguagcuacauuuagaaauaaguucuagcagcugggccugacugccuuaggauuauaaaaacaacuuucaaauuaaaacguuucuagaaacaguagaaauggaaauccuuuuuuaagaaaacugauguauuguccauauuucaaaucuuuuauauuagaugcugucaggccuacuuuaaugaguaaaaagauugcauuuguuauacuguuuuugaauauuagcuuguuaauuccuaacuccuguuucuaagaauuuauuuggcaaauacuaugaaccacuagauguagcauguuucccaguuucuaaaguuugaauuaaugagcuuucaaugcauaagcuuguagauuaaaaucuuugcaguaauuuauauaacuaugaugccuuugucaacuaauaauaguaugaugguuacuucaaaaacuuuacagaaucaagacacauuugagaaagugauggaaaguacaccgugcacugaaaaugaggauaguuaugaauaugaagaaaugucaaaaauaaaagaagugacaguguacaaacaauauuuagcaaaagggaucuacaugauacgaccagccgagauucuggaagcauuuucagaugaggaaguggguaauggccuagaccagguggaggagccgcgggucuucacugauggaaagggcuuacaaagcaagcaaguaggaaaggaaagugaugaagaaauagucucugagaagaaaacugaggugauggaaguggcagaugugaaaaagauuagagaaagugaagagaacucaaaaucagauucacuuuuugaugacuuaccagauaaaaccaugaauucugagagugaagacaauaaagauauugcugaggaaaggagaagcagugagcagaauaugaccuuugacagugaaacagaauugguagaagaaccagacaguuacauggaaugugagaggcacagugagcaagacagugcugaggaguuggagcagcccaagcuaguagaauauaguagcgaagagaaagaugagaaagaugagaaagaugacgaugaaguggagacugagaacuuaugguacgacaggaacuguacugagcaagaaacugagaauguauucagagcaaccagauuuuucccaaaguucgaucuuaagcaugaucauuugucagggauaccagaggagcaggaaggaccagaggauucagaaggaaauguaguaguggagcaaguaguacaggcacaaaaggaaaauuuggaauuugaaggagacagaaaggaggcaaaagcagaagccccaucagaugucauuacagaaaaagaggugagugaaagugagagagagucagggggggagagagaggacggaucugagggugacggggaucaaaucugugagaaggugaguuuagaaacagagcauuuacaaagggcacagggaaaacaagagaggaagaaagguaaggauaaaagagcaaggugcauccuggauaugaaagagagagaagaggauaaaggaugggagaaagggagugaaggaggagacaaaaugaagagggaugaaggaaaccaagagaaaaggaagaaagagauggaagaaagagaugcaggagaugaaagaagugaagaagaggaaggggaggaagaagagccagaagagggggaaaaagaggaaggaggagaggaagaagaaggcacaucagaggaucaaaguagggaggaugaaggagauaggcaagagaaagaagggagaagggaggggaagggaaggcaagaagaugggagagaaggguggaaggaaggagaggagcaagaacaggaggaggaaauagaggaaggugaagaggaagagagggaaggagaggaagaagggggagaggaagagggggaaggcgagggggagagagaggaagaaggggagggagaggaagagggggagggagaggaagaaggggagggagaggaagagggggagggagaggaagaaggggagggagaggaagagggggagggagaggaagaaggggagggagaggaagaaggggagggagaggaagauggggagggagaggaagauggggagggagaggaagaaggggagggagaggaagaaggggagggagaggaagaaggggaaggagaggaagaaggggagggggagggagaagaggaggggagggagaggaagaaggggagggagaggaagaaggggagggagaggaagaaggggagggagaggaagaagguggggaagaugaugaaggagaggagcuagaaaagaagaaaggagauauuacagaggaagaagaggaggaggaagagggacaagaaggggaugaaagagaaagggaagaacacggaaguugugaggaugauguggaggaagauaaaacauaugacagggaagaaggggaauacaagaaggcaauuggaaaaguugcugauaaugaaagucaggaagacagaaaacaauccccaaaaguaaguaaaauaaaugggucuaugaaauauggcagacauggcacauacucagaaaagcccauuacuaaccuagggaaaacacagccgucuaaaaugccaauggaguccagacaacuuguagagaauggccuccuaggcuccgaacgauucuggagugauguuuuaccacuuuaucuggaauugaaguaacagggaagucaucuccaugccugaugcguaauagguagacauuacauuucauucaacucaucuguuacuauagaaugugguugaaaaaacagacaacugaugacauuuguacuaaggugucaaaggcaacaggagacaguguuaagucuugauuccuccucagcucauaucuuguguucuguccccaaauuacuaauccguaacuaaaauauuauuaaaaggcauuuuguuauaauaaacauuuauauuccucauuaaugguuuauauacuagaagccuacuauaaguaauauauauacauauacacacacacauauauacacauacacacacacacacacacacacacacacauauauauauucauuccagucuguuuaaaaaguacagauauuuaagggcuaucaaaacuucugauuuuuaauaaauauuuuaguaccccuuuuccgucucuaugacugaaaauauuuuuguaagaagugaugauaguuuaaaacuaagguagaaaauugguauuuuaaaaaaugacauuugucccuuucccuuuuuuguacccuuugauagaaaucuauaacgugacagcuauguucaggucuuagagacuuaaugaugugaucucuuuugauugcugucuaggcaugugacaaaauagcuuaugaauugaguagcugaaacacauaaaauagggcucauagaaguuuaggcguuucaagaaauaaaacuaagcaccuaugcucauuugucugcucuuaaaaguaauaauuucaaugucuccugucuucuguaauuugaaauuucugaauucaagugauuucuguacuaacuuugccaucagagcuuccauucucauuguguguuaugcagccucaauggauuuucacugacuucuguaauucuguugcuuaucagaauguuucagguaaaauaaagauuaaauguaugcacucgguauugcuuguggaagaaaaacugucuaaacuagauaguaaauuucuaaaagucacauuugauuagaucuauauaauguagcuauuuugguuguguauuuucaccuuuuuuucaguugcuuuucuuucucagccuguuccauaccuucauuguaaauguugugugcuugaacuccauacaucugauucucucuaagaaggagcaugagauggccaggaauccaaugaaguagcauuuccuagagcagucuguaauuagaaccugcagguaguaucccugaguaucggacuacacugauuugacacugcagcccuuggccaagucgaccacauucuacuguuuguagaguagaauuagcaguaugauaaggugugugcaccaaaggugaucauuuaagaauaguuuugaaaugauuaaauaaaggggguggcaggcaugaagugcauaaaggaaauucauaagagaaugccggaaggauaagaagcuaaacuuccagucaugucaaaggugggggugggggagcauagguuuuccuugaagagacuagcccaggaguacugaaguuauauucuaaaaguacaucugcuucacuguuugaacugauagagauagccacuuugaagcagcauuucugaccaguuucaugacauuucccugcuccaaaacgugugguguccuuuugaaguaauaguuccuacaagguacagucaaaagagcauuuauguagucauuuugccuccagggcccuacugacaaauugugcuuucaggcuguuaugaagucacaccagcuucuuuggcuuugucgaugucuguuuugguguguguuugguugguuuugguuuuguuuucuaggaauguacagaauuaggaugugagaccuaaggaauuccguaggaagagcauuguuagagcuuuaucacacuauaauucuugcuaucccuacuccuuaauuuaagacagaagccuuaaguuuagucacaagaaucaccuagucuucaagcaguucuauggaagugagcacuagcccuaacaugcuaacuuucucugcccaguguucagugaacacuuaguaaaucacacauuguggcaggcccaauacacucaaaaguuuauggugaggaguuuguuggugguuagugauacauugagacaggguauaaaagaacacaaacuuucauaaguagagguuauuuuuguauacaucucauuagagaauuagaaacguaagugaagaauaagaccacuuggccccuccugacuugggagcugguuauguagaucucaguaguucguccuuccuuguuuguuucugagacggucucucauagccuaggcuuacuauguagccaaggauggccuugagcuucugagacuucaguugcuaccucuccagugcugggauuacaggcaugguaaaucugcuaggugcucaaguacuugcuuuaguuuacuggucauuacugggguaaaagugaggcauuaacccuguagaaucucuuaaguuacuguuuccuaauguggacucugucagaaagggaccuucagguaagcugcaaaggauuucugcagagcaucucuggcuguucaacaacagcccucaaggugaguagugcuaaaguguguguugauugauaaugauugacuguagagaugaguuuacaugcgugugugcucucuccaaccaaugcuucaguaagggaaggcauugucauauuuuucuucauucuuuucauugugaaaauucaauguucuguguuaugauuaguuccuaacauagagcuuaauaacugguacauauuauuaaaucacguauuuauauauccuguccccccaaaagagugcucuuccuccagucagaggaggaugccuuuaaaaggaaagccagguauuaauuaaucuaccacccauggcccagcccacucuuccucugucuuaacugucaggaggacuaaaaauguuucuccaaagaacacuugaaaccccgauguacuucagccacgacuuguucuuuucuuuucuuuucuuuucuuuucuuuucuuuucuuuucuuuucuuuucuuuucuuuuuuaaaucauucuuucuuguuaauuauaugcauaacuuaacagugcuguuuguuuuucuacuccuguaucuuuauccaaagcugcacuaagaugaaaauuaagcuccaaauuacauguauaccuugcuuuuuaaaaacagacuaauuaaagagaagaaaaaaaauaugugucuuagauaggcaagacauaagacagggccccuuguuucagaggacucuauaagccaacaggaaauccaucauugcagcagaguauguuagcagagugacuucggcuucuauauggaaagguucaaaaugagcuugccacuagugaguagggaaacuuugaaauaaaucuuguuaaguagaacuuaaccagcaaagggcguuauauacucauacaagauguugcagggaaaaggauacauugacuacacuugagguuuuguaagguuauucugguagcaauaugaagaaugauuccaagcaggcaugaauaaagucaggcauggcagugaggagccaguuauaguagaccagguaaagaaugaacuggacaugggaugaagacauggggauauguaucagaguugcauguaguugggagggaagggaaaagugacaccuuucuuuuggccuagaaaacugaguggaaacagugcuguucacagugacugcaaacaagggcauaggagcagucaguccagggagacccacguuugcaaguugccaguaguuuccagaagauguucaccauggcgaccagcuucucugucuggagcucaguagaagucauugggaucaguaacauguccuuguccuuucuggagcuagugaaagcaucccuccugugaauagagcuuuucagaugggaucgggggaaacaucggggagugggauaugguggcucucaacuuguggguccuaaccccuucgcguauuuuuccuguauaucacauauuuacaguaugauucacaacaguagcaaaauugugguuaugaaauagcaaagaaacaauuuuaugucugggaggccaccacaacagaaggagcuauguuaaagggugucagcauuaggaaggcugagaaccacuagguuagaguaagagaauaguaacaaaguugaggaacaaaacuuagagaaaauauugggggcuauauucuaggaaaggagaaaaugcuacccaagcaaaaaagggguuucaaggaggaagaauugauggcagcaaaggagcaucuugugggugggcugauugaagcccagagcuaacccugacgugaaaacugcaacagagcuccaaggagucugccuugcucaaaagcaggaucugaacuucauuuuacacucauaauuaucaggcaacugcuggcauggcucucagguuagggagggagauguacagugcagaggcuugcauucuuuggauaaaacuugcugagugaauuugcaguuuaugcaaacagugacaccccagaccaggauguccuuguugggaauuuaggaaauagaauaaccuucaauguuuggaacgucaguguguaggggaaacauggcucuaaugaucuugaggaagagcagagccccuguaguccaacaguccuggacucagaucccagcccuccacugauuacccuugcagaugcugggaaagagcuuuaauuguagcauuuacagcacagagaaauugaucccaugcauacgguuagccucaaauguaugccuacagaaaggaaauagauuguccacagaaaacaugagaaugguauagaauaaauguaaaacugagaauaaaaaugccuaccaccccaguguacaguucccagaauauugcauuuacauuuguagucuugcuucucaaacuggaauguauacaguaguuauaguaaugggguaggaaugacauacagaaucaugcauacaaaggaggaagacuuuaaaugaaguggugucauaagaagauaagaaugcagacaucaaacuggcagcuuguaggccuacucuggccucuagacuuuauuuuugcuuucugugcaaauaauuucuuuucauugaaauugucaguauuuaaacauaaacacagaauguguguuugugugugugcgcgcucgugcguguguguaugagugggaucaauuucucugugcuuuaaauacuacaaguguguguguguguguguguguguauauguauauauauauauacauacacacacacacacacacacacacacacauauggcuugcuuucaaauaaaauauaauaaagcaggccaaauuauuuuuaaaacaaagcccuauagaucaacugaguaaaaauagcuaaucaauuaaaauaaauauuugauuuggcucacugaaguacuaugcacagcaacaaugaaauguuacugaugcuuguggugagaacacaucauauuaaauacuggcaaggauggaaagccacaggaacucuaauuuuuuuucauuaaaauacagauuuuuaaagaaagauuuauuauacauaaguacacuguagcugucuucagaaacaccagaagagggcgucagaucucauuauggaugguugugagccaccaugugguugcugggauuugaacucaggaccuuuguggacgagcagucagugcucuuaaccacugagacaucucuaaagcgccaaaauacagaauuuaauauaaacaauuagauacuuuucuucaagaucucauuuguuacauuaagcaucagaucacccaauggugaauuuaaaaaacaaaaugaaccuauuucauucaaaaaaaucuuuaguuacacuccaaaaagucuacuuguaaagaaaaaugucuacuugugcuagcguauuaaaagcuuuaaaagaaaccccauaacuuugccgaaaauguuuaaaaauauuuuuauagaauugaguggguuuuuuuucuuuagauuuaaauagucacauuuuucucuuccccuuccuucccccaaacuuucccauauacuacccuuugcccccuuucaaucucauggcuuccuuuuucauuauuauucuaugcauauguguguauuuauauacauauauauuccuaaauauaaccaaaccuagucuaugcaugacauaaaauauguaugauuucagagcugaccaucugguauuggauaaccaacugcugugcacuuccauugggaaggcucuuucuuccacuuugaguguaccuugaguucuuuguguaggguugaguccuugggagcuuuucccugcccucuuugggauaucuauugguaucuuugccuagcucauguuuaggcugucauguuggugagacuuugggugucacuucucacacuacuaagagauacagucucaaagcaaccucccugauccuuuugucucuuugguuuuuuuaauccuccuuuccaaaauguucccugagccuuagguacaagaguuuauuacagaugugucaguuggaacuggacuccacaacccuggauuuugauuggcuauauauauauuuuuguaauggucuccaucuguugcaaaaagaaguuuauuugauaaauggugaggauuacacguaucuguggguauaaggacaaaagucuauauuguuauuaguuauuaugcuaguuuaguaaaguaaugguuauucuccaguauccaugacuucacuagcacugaguaguuagcuaagaguucaguaccagucauuguuuccucccuguugaacaggucuuaaguccuauuagaaagcuauuacuuacugccaagguaugcaugccacuauagcacccuugggguguggugucaugcugaucauuguugugguucauaggcaucauagcuggguaggaauauugguuucccuauauuagaagcuugcaugguacuuucugguacuauggaagcucaaccucauggaggggacauucaagucgguuccauugcugaggccucuaugccuuguuucugaagugcauaguguuuucagcaauggggucuuaaaccuucuaccucugggagucccuugggcaccucugaccaacaacuuaaaggagggauuuuccuaugugguauugggauucuuguuagucuuugacucuagagggacaauucuagccuaaaugagaaauuuacauuuaaucuguauauguauauuuacauacagaauugcauguauuguagauucuuuuagauaguuucuuuaguuuuuuccaggcaauuaaccucuucucuccuuauguauuuaccucucuaauaagccuuuucuuggagggccucagcaucauugaacacuaaagucuagggcucccuuggccuaaagcuuuagccaaggguucuuugucuucagcaauaacuguggucccauagaaguuucugguaggcacaggagagccuucuccuugccucuccuaggaaccaggguacuacucuagaauaaggauuuuggagaugaacguagacaaaguacaguggcaaacuguaccaucacaaggaacauugauaucucuccuaagacauacaaaguauguguugagccaaaccaaagaccauagcucacuguggugugugaccaaugaaaugaugauccaguuggcccauucacuucuucaacauagucuuagcacaggacauuuacagagugaccauuccagacuaucauuuuaagacuguacugaaacuuugccuuucuuuuuuauaaaaugccaguauucugccaauaucuccuaaauuaucucaguugucaagguaaguguuuucugugguuuauaguaguuguccagauguauuuucaugauuuuaaaugugguuaaguucaaagugcuacaguuaaugucuuuuaguaauaaaauaaaauaccauuauuuaauagcauuguguucuuuaucuuuuucugaguuauaaauaguuauacuuucucuuguaaaugaauuguaaaguugggggagaacucuaaaucccuauguuuuaagaaaugagcauaaugcguagguauaauuauauuaccaugcuauaauaaggaagaaacuauguuuuaaaaaaugagcauaauacauagguauaauuauauuaccaugcuauaauaaggaagaaacuucuuaauuucuuucaagcuuaagaucacucuuuagagaaagguaagaaaauguacuaaccaauuuuuaggaacacuaggcauggccacacagcagcagacauacacagaacaauagacaugaaguccuuacugaugcaguaucuucauguucagcauaggcucuacacuauuuuaugucuuuagcuuuuaaauaugauuuuuauaauguacauguucacugagagcaacuuauaucuauggaauuuuuaaaaagaacacauuuguucauuaaaaagaaaauguuuugugaucacuuuugucauaggcuccucaacuuucagaaacugugaaaccagaagaaggggaaauggaugaggaaauuaguauccugaauguagaagacacuguagaagaagaaaggaaggaaggagagaaggagauuguagaagaaggaaguauaccugaaacagaaggcucagaaacuauugauauuacugaugagaagcuagaugaaguccuuaaagagguaucgcgacaagguuauguccugagguggcaccugagaagaaggggagggugcauuguagcuuccugugggaguagauauaucuauguaucacuuuaucauaaggugaaaggauuuuggugcagucuaggaauuaagcaagccuucuaucuagcacacuuuucacacugcuugguaguauuuuauuccuauaugacuggaaauggcuccagguaguauacucuugggaaaugaaccagaaagcuggaaugcuuaagauuaaacuugggaacuuaguacuggugacagaaaugauguguguuaugugcauauauucacacauacauacauguaaaugcauacagccacagcaauauuugaguuccuaauguauguuugucauagaugcaguuaagaugcuguaucccaaguggaaugguuugugcucauuuuccccuuccagaacacuuacacaaaacacuaagguagccaugguuucuagcuaaugaaauauccucaugccugcucuagaaaagacucuaguuuugaaauugauucuuucuccaaacauaaacaacuaccaaaacauaacugaccuuauauuugaauguguagugccaguauuaaggauacguucaaacuaugugcuugucaauuuuaauuuaagagaugauugucauguagaggucagguuuucuugguuucuguuuuucucaagacuuuauuuucauugaggaaaaaaauuguucuggcaauuauuguuuucuuacagaaaaaaauccuguuugugaaaauuuuuauuaacuccaguuuuugguggccaguaaaauguuuuaacacagaaaacacuaaauacccauuuccuguuauacauuuuugagagaaauuguuugccauuccucagucaucuuauagacgaugggaucauacaguuuccacaaguucauacaauuuguguucguuguauuuuuaaaagacaaagucucgcuauauagaccuaaccaucaucaaacuuguuauauagaccacccugucccugagucauggaaacuaccugcuucugcuuccuggacuuacaggcaugugccagugugccugguuuauggucacugaggacauuagcaaucacugaacaucugagguuucccauagcacagaagcccagcaaagugaauuaucacuugccugaaucauucacuagaugcaggcucuagaaccaaguuuugaaaccaaaacuagguuuucuaacagcacaaauaugggaagaaaguuccuuuuuguuuguguuuuaccauacuguuucuuuauugguuauaggaagacagugccagccuucugcaacgggcccuucgugaguacaaugaaaauccaaaagguauaagcucauuugauuucaaaaugguauuuuaaauuuaguuuauuuuuaauuauguauaugucugugucuguaucgguaugugcauaugaguucaggagaaaacacuguaaaucuccuugacccagagcuuuaaaugggcuguaaguuguuugcuguggauggagggagcugagucugaaugccaagcaguauauacucuuaacugcaucccaagcauauaucuauacucuuaauugcuggcccaucuuuccagccccgcaaccugcuuaagaaucacuauuuuaucaucaaucagauauaugauguggacaaaagugguguuccuauauuauauuuguuuucuauauuccuggaaaaccuugaaauagggagauccaugagcuagucaugugaaauggaguguaggagaaaugguacgggccaggcuugugguagaaguccacagggauagucuuacugggccagggcauuugagugaacauguagagagaaacugccauugucuuaaauaagccacaguauacacagaaugagagcaguagcucacaagaucauaaggcgugagauucucagguuuauuuucacaugacccuuuaaauuggcuucuccauguucaccuuuaccuucuccgcuucuucaaaugcacucuacacuuacuagccaugguuguuuaugugucacugcucaaggauuuaggacuagaucuaccccuucuucccuccuacccaaccaguaguaucuugaaccuuugccucaagucccaacuuaauccuuaucaacuacuagggucuucuugguacaagugaauaugauugaagguccuggaggaaaacuauccucgagccucgguauuuccuccaggaccuucacuugugucucuaaugucacugcaggcacggaaaaaguaucugaaguguguuaguguagcagcgggugccacaaaauacaggagacugugagugcacuuuguuuuagaugcaaaccagcugugcuugugcuguaagccuuauccauuaugucuuuccaucaucgcucuauauacacauucuacuguguuuucauuaaggaaaaaaaaaagcaacuguuugugagcuugggauguagcccagugguagaacacaugccuaacauagucaagacucuugguuugguuugguccccaguaccucagaaauaaacuauucauuggacuggauaucugacugguaugaacuaaacagaagaagaaauaguuuccuugauuaguuuguccuuauaaguuucacagaaauagugaggaguuguaagugauguaggggccaggaaaauggcccugccauggaaucaugaagaccugaaucuguguucccagcauacuccaguacuccuagugcuggggaagcagguacaagaggggcucucagacucucugccgaauaacauugcccagucagugaacuccagguucaaugggaaacccugucucaaaaccuaagguggagaccauaaagggaaacauccaucauugcccucuggccuacacacacacacacacacacacacacacacacacacacacacacauacacacacacacacagagagagagagagacagagagagagacagagagacaaagggagagggagagggagagggaggaagagacagagauagagacagagacauggagagacacagagagacacaaagaggagagggauaaagggagauaagagaagagaaaaggagaaaucuuuuaaaauaauguauguuuucacgugucuucuauugcauuuccugcuuacuguucauaauaggaaauauuuggauagucauaauccaaauacuuuugcauugguuaagucauccagcaucuuaacguaacugacuccguuuuucaagaacugugugguaugacaucaccuacuuguccuguagugaacucugugcacuauccuacaacucggaggugauaguuucccugaaagcaucgagaauuucuuucucuuuaguuagaauaauauuuuggcauguauccauuuguaggacacauguaugaucguguaaagagcagcucuucagaaauucugggagguaaugauccaacaaguaaagacauaaaaaaagcuaaaaaaguaagugaagugaauuuuucauuuugguauuaagaccaaaguauugaauucacauucuacuuuuccuguuagucccuuauaguaacuguauaaccccaaaguauauaaaagguuuaagguggugguucauguuuuuaauaagcuagcuuucuucuguuaucauuugccugguagagauauuaaacuccuuauuuuaacaugcacuuuaaauagguacauuguaaauauccuagacagcuggauuuugacuuugcauguuuuaugugcauaccuaaugcccagaacugaccauugugcucauaucuuuuucucaaauaaucauagaaucuuaaauaaaguucugcuuugcugccaggcagugguggcacaugccuuuaaucccagcacuugggaggcagaggcaaguggauuucugaguuugagaccagccuggucuacaaagugaguuccaagacagccagggcuaacagagaaacccugucucgaaaaaagaaaguucugcuuugcuaucccuucuuucccguuuuacaaauugcugugcccauuguuuuaauuuuauugaugucaugaaccaaguuguuacuugucucugauaccauacgcucugcucacuauuacuuuuuacugugccguuguucuuucuggguucuuguucuccccaaagaaauccuagacaaauucuuuucauaggugucguuuggugguucacagcuugcauuucauuuggcgugaauacacuugaauacauuucuauguaaucagaguuuuucacugacaaauaguacagcuacuuggcuaguauuguaucuguuacaguuguugcucuuaagaauuuuacuuuagaaauagacuagagguuuacucaguagaccaauugccuagugugcuugaaacucuggguucccuccccagcacuguaaaacaaacauugcugucauauacuuguugggagauuugucauuuuauaugugcuuuaguguuaaauuuguaucucuaauuuaaacuuaauugaaacauaugacccuugaaucugagaagccauucaauuuauauuuuuaaaauguguuaucuauuauguauuugaacauuguaucucuguuucagauuaugacauaaauauuuuguuucuguuguucauguuuuuaauaucaguuuaguauucccuaugucccuugauacuuuuggguaauuuccagguuuuucuugaucuuauauuaucuuuuuugcugaaacuguucugcuuuuuagcauaccuauugaguuugaauuucaaugauuuuuuugcauuuaaaaaagccuuguuuguauuuucugugugugaauguuuaacugguaucacaugcaugcaaugcucagggaggcuagaagagggcauagcacucugaaacuggaauuaccaugguaucagugagccaaugggugggugcugcggacugaaccuagguccucugaagguguacaccaguuguguacaggcaccagaacauggcaucaccaacccuggaacuagacuuguagacuguuagcugccauauagcuacugagacccaaacuuggguucugugcaagagcaauacauguucacuacaccaucuuuacagccuuucccccuugcauuuuaagugaacuuuuacuguuuuaaaguucguauaaugacuucugcuuuaaauaacuuaaccauacuuauuuucuaucuuuuuacuaaucuauaaguugccuuggcucacuuccuaguaauagugcuuugucucuguauauguuuuaagauguggauuaaauucauguucaagcaggacauuuacaugugaacccuccucuuaguccuagguaagcgucagucuaugccuagaaaacgcuuccuggacucucgcuuaggucugaagcggcugcugcucagggucucuguuaaggcuugccuguccacacugcucauaggaacgucagcucccucuacagcaugccucuucuucauuaaagcucaaguggcacaugcuauucacuugucuccugguauuuauguguggacuuacagagaguacacggucccucacggaaccccacguaguuuauggguugacucaguccaguucccuacgguuuguaaacucagauuucuuaaagccacagcguuuagguuccaaggugugcacaugcugguuuuuggugaucaucccugaagcauguuucuuccucacacagggacuaucuuuuuauuauuauuauuauuauuauuagguauuuuccucguuuacauuuucaaugcuaucccaaaggucccccauacccacccccccaccccccuacccacccacucccccuuuuuggcccugguguuccccuguacuggggcauauaaaguuugcaaguccaaugggccucucuuugcagugauggccgacuaggccaucuuuugauacauaugcagcuaaagagcucccggguacugguuaguucauauuguuguuccaccuauaggguugcaguucccuuuaguuuacauucuugagaaauuaccugcauauuagaaaguuacacuucuaacuuaaugaggaggggcuugcuguuuuauaguggaacagguuuucaagauguggacccuccaguguuacaagucaaggaucacuuccauuuuaaucuauaaacucuugcuagaagucuuuauagguuauguugcuucuaucuuaugguuaaagaggaauuguuguuguuguuguuguuguuguuguuguuguuguuagcuccauuuugacuucugaaacagccacauccucaugaacuuuucauuuccuguguuuuuccugguucugacaucucaucagaagcauuucuuguaaaauagcucauugaaggacacuaauuucucccuagauaagucuucaaaggucuuaagucagaugagaccuuuguuguaagaugaugaucuuagcugcugucuccugcacauggccuuguuggccauauucuuccuaguacguuuuccuucccugacuuccgagcugcuuucuuuuuccaguuuuguccuuacaaaccucaguccucaggaaugccuugccacaugugccugacucucacucauggcuccucauuagccguccuucguucuucagcucucuucagagugugccagggaucccggcuccuuccaucuguuaucucuccugcacgcucacagugcuggucucucagcauggccccuccaucuccccauuacugacucugacccacaaguccugcauggcugucauuugccaacuggagcauuuuuuuucagaauuucugaugucaugauguugagguauguccuccuuuucuagagugucaugacagaaaugaucuguaguugagguacacuagugguaccagaaaaagucucccccaaaugacccaguccucuuacauuuaaauggugacaauaagugagugauuuuccaguuuucauuuguuccucuuacaagacaaaacaaugaaaucuuaauuuucaccugugaaauaccaugaugauaaagguauugcugaaagcuggucuuacuuuaguuaugaccacauucuuauaaacaggauaaaaaucuguuagguaguuaaggacacauuguuguacauauacguacaccaaaaugugaugugauuugugcccaugccuguuaaagcauuacaucccugcauacuuucugaauauuuugcuuacugaaaugaaaucuuuuuguuuguguguuuuugcuagauuuccuucuuuaaucggaugucauugacaggucagaaacugaugcagaauacuaaugauccacucccagagauaaagccaauaggagaucagauagccuuacaaagugauaagaaagaugccaaccagaaccacaugggucaaaaucuucaggauucgacaacaccaaauauggagggaaaguccaaauccuguacaauucuauaaaugcauguuuauguuucaauggucaccgagcacauuuguucuucauacuugaaaaauggugugacuucugaagaaaauccccugacaacacuguuuaaaaagguauaaauuaguauguuuggcuugguuugaacaauaugaacaguuuuaauauuuauuuauguuaauauucuuaacaguuuccaaaguauguguaccuccaacucucuuugaaguguucuggccuuacaacugcucaguguugcauaaaacaaucuauuuuuauauuugaaagacgaaugaagcuauuucauaguuuugccaacacaguuauuguacuuuguaauuuccuaagacaauguucacaauauuacgacacuggaacaguuuugaguauauuuacaacauuuaaaaacagggaccauuguaaugaacuuauuuuaauaaacuaugucugguugguucugcugucaaaauggauaugugcuuggaaguauuuauugaucaauaaggggcagaaaggagauggaucauuugauucucuugcagaggcauugagcuugcuucccagcacccaggggcuaacagcugccuguaacaacagguccaggggaucaggugcccauuuuuagucucugcagguaugaggcagacacaugguucacagacauaccuauaggcaaaauacugagaauaaauaaauaauaaaucuaaacauguuugaauuaaaauguacaaaauauccuuaucacuuaucaaauauaugaaucaucuagaaaauuuaacccugccaucauaagaaaccucaaaacaaucagacuugcucauauuagcugucucuagcaaugacgugugcuaccucaugacucgaaaagcaaugcgagaacuguuauucugcuuugauggaagcccugccugcuugcucacacuguggcuuuagaaaacugaagcauacucacuuccucugucuucccuugucagugagacaugucacuuuucaguugcagugaccauugccccauuuaaacaaagaaaacagaaccccaucuuuuuauuuuuaccuacagguuaaaaaaauauguuaauccaaaguggauaugguuuugaaaucuuaaaaagguaauuuucugaauggauauuacacuuaguagauuucuuauuuuuauuaaagguaaauacacuuucaaaacuugcauuguugaaaccucaguaccaggauaauauuauaaauauaaauauaaauauaaagcagaagcucuaagagcugagugggagucaaacucaaaaaugauaacgaaacaugcuacuggugguagauggaauaguaagguggcccuaagauuagucuuggugccacaggacuugacuaaucccuucccucugaguaugggugauaccaaugacugugguaggaugccacgccccugcuuguguuaccugagucucuuagaaagauuuugcagauguaaugggaaaacauguuauaccagagaguauaggacagccuugccaaucugagggcuuaucauucugcaacuguuaggaacugaauucuacccaaaaccagugaguccaggagaggaaagcccaggagaggaacacagucugcagaguagaucauagcccuggcuggcauugauucagucuuuugagcaaauugagcagaagacccaguggagcagugcucauaugccugcccuucaaaucuccugaaaccauggcuacauggagggacuuuccaucugcacaguguauagugauucucuuuaacaucucucucucuccucucucucucucucucuguaugugugugcuuaaacuuagcacuaaaccauagucacauaccaaauuugaucaaugaaguugcugucucuuauuccuccuccuccuccuccuguuauuucuucuccuccucuuuguccuccuccuccuccuucuccuccuccuccuccucuuccuuccccuucucuguuuuaagugagugcauuguuuugguaagagaaauuaaguuuauaaggaaaacauguugaaauauguagaccuuagauuuaucuuggcuauaauaaucacuaauuugacauuaaauuugaauaaggaauugauagcuuuaaaacucacuagaaaaaguaugauucaucugcaauaauuucagauuuuucagugcauacauacauugugaguuccaggacagucagggcuauauagugagagccugcuuccagaccagaccaaacaaauaaacaaaccaaaaagcaaauguagaagcuauacccauaaauucucacaaacaugauggcccaaaugugaggucaacaaagauggcacccaugaauaugccagacugcaugguguguguaugggggguuagucuaugaggccucugcccuacacaaagaacuauaggcaacugacaaaagcuacgaacaggagaggugaccuuuccuaaggaagagcagaccaauugcuugaucagugccaaauggucuacccugaaaauauacauacaaguaacauuauacagacugagcagauuauauuuaggaauguguauguauauucauacacacaagugcaugcaauagcaaguagugaaaaaaagagaccaugaauuuggagaguggggacggauauaugugagggauuagagggaggaaaggguaggaagaaauguaauugaacuaucaucugaaaaaauauauuuuaaaagacccaaaaauaagguaauguacuaaaacaacuuccaaauuagaauuuuuauaggcagagaauuuccuucauaaaugugaauagaggcauuucaauaaagagauaaguuaugucuauaccaaguuuacacuaaagugucaauaaauauuaucgugcuccuaacacaguagcucugaaucaggaagaccacuccccuuccccagaggacauuuagcaauaucuggagaggcuuuugguugucacaauucaaggagacagaggaggaagaugcuccugcagaacacaguucucuccaaaacgucaauaauacuggcauuuaaaaugaccuguccuagugaaaacgaguuagguucgcacacaaagcauugaaauauuuuauacucgcuucguucauaaugcccagacccagaaagaacccaguaaucaucaacagugaauggaaaguaaaaugaggcugcccauagaagaaaagaauucauuaguagaggaccgccuugucucgccucagugggaggggaugugcuuaggcuugcggagacuugaugccccaaagaaaaggggugcuagagggguaaggugggggugaguggguggguagggucaugccgucuuagaagcaaaggggagaggagaaggggccaucguggagaggggacugcgaaguaggacauuugaaauguaaauaaauauaaaaaauaaauuaaaaaaauuuuaaaagauacacacccuugauauagucuccaauucaagugaaucugaaaaguaugcggggcuaaagcaacuugucuccccucguuacuggcuauuucugugucuguggcauuaaccuaaauccaaaacugcaacaauggcaaacaaaucaaugguccuggagagcugaugaugggacuucaaagagcccuggauaguauuucccugaaaccuuucucuauucucacccgggugcuuacuguuugaaacuguaaacaguugauaaagcucuaaagcuaaacugguguacuggauugcauguugauuuuaacauauagaagacaaauuuuuuuucuuuuuuuucuuuuuuuaauuagguauuuauugcauuuacauuuccaaugcuaucccaaaagucccccacccgcuccccuacccagucccccacccacccacucccacuucuuggcccuggcguuccccuguacuaagguagauaacguuugcaugacaaaugggccucucuuuccacugauggccaacuaggccaucuucugauacauaugcagcuagagacacgagcucugggggguacuggguaguucauauuguuguuccgccuauaggguugcagaucccuuuagcuccuugguuacacucucuagcuccuccauuggaggcccuguauuagauauuuucuucauuuacauuucaaaugcuaucccuaaaguccccuauacccucuccccacccugcuccccuaaucacccauucccacuucuuggcccugguguuccccuguauuggggcauauaaaguuugcaagaccaagggccucuucucccauugacggccaacuaggccauccucugauacauaugcagcuaaacacacaagcucuggguauacugauuaguuaauauuguuguuccaccuauaggguugcauaccccuucagcuccuugggugcuuucuuuagcuccuccauugggggcccuguguuccauccuauagaugauugugagcauccacuucuguauuugccaggccccagcauagccucacaagagacagcuauaccaggguccuuucagcagaauuuugcuggcauaugcaauagugucugcauuugguggcugauuaugggauggaucccuggguggggcagucucuggaugguccauccuuucaucugagcuccaaacuuuuucucucuguaacuccuuccauggguauuuuguucccuguucuaagaaggaacgaaauauccacgcguugguuagaagacaaaucuuaacucagaucaauacauuuaaaucaaauggauccaaagcaaugagcugcaagucauaaaacucaagugacaacaacgaugccuugcuugauuccaguccaggaggucaaauaaagccacuuuggagacuguguucuuuacauuagcaucuuaugaugcagcaguuugaauaggaaucaugaaauuccaugauguaucucacaagcugacuccuacuaauaauuaacaagauguccaccuuguuguccacaaaaaacaaauuguugcauuaauguuuauugcuuguaugcugugacacaaucuuucucaauccgagucauuuugccuugaaauauugaaacuguggggaugucauaauugaccaaagguaagagcauggccguaucauucaggaaccugaacucugagcauccaguaaccuuggcauuuucaaagaucuuaaucuacaagccugagaguagcauguauacuuuuugcccacaguccaugggcaugugccuaauauucugcaagaaaaaucagaaagcguagguuuguuugugaguucaggaaggcaagacaauugucagaauuaaauauucuuacuccaggugccaaggaagugaauccauguguuuuaacaauaagcugaaaaaaguaguacagaauucucauuuuauauaugauacaagcuucauuuuaaaugacuaaacauuaaaaaaaaaacaguuaauuuccaaagcauauuuguauuagaguuuuccucuaauuugguuaugagaucucucuggagaauggcuguagacuuagucacagcuugauggucuacauugaagauggcuaugguuguuuacagugagucuuuuacgagauacuuccugauccugguggacaauauuguccaaguauucaaacuugaccauuuguuauucucccagaagcuuguuucuacuggcagauauaugugaggaucuugucugaccugugucuuaccuguagcaagaaagccacucuguagcaaggcucugugagagccuugaccuaggaagaguugggauaagguguguggccuggugaggcacagaaaaggcaauaugacagaguacacagugcaucacuuacagacccuacagagaagagggcaguacauucaccaugacaauggugauggggcauccaaagcauguguguuuugccagcaaugagggggagagagaaagagacaaaggaacuucaggaccaugcucuuuacugaggucuaggacauuaucaccaaagcagcuuuuccgcagagaaugugauggggugguucagggucaguagacuuaaauucuuuggagucccacaguggcugagcugauuuccugaacccuaucugcauaguaucuuguaggguaagugagucaguagagccauuccacagcugcuucuagcugucacauggagaaucauuuaaacaacagcuguggaaggcagauaucuuggugagcuaccacgagaaacuagcugagguagaagacuggaaacuauguugagauugugagcucugaagccuacuagcauaacccucgauuauuuccuaggacucaagugacaucuuuuacucagaaggguuauuuguuugcuugcuuccuugcuuuuccagcuguuuugcugcaggcuagucaaugacuaucuaaacagaaguguuuccacucuuucugccucccacgcuaaaaacaacaaaaaaaucuacucaguacauaucauuauaccauguggaaauaucccuaacacaaaacaugaaccauauguuguagugcauaccauaaauugaauguaguuauaugcaagagcaucucggugauauuccaagaaaauacuuuacauacgcacucuccacugaacacuauaaaaacaguuauuugacauugugaaaagcauguugggagcaguggugagaaaaugaagaaagagaaucauggaauugacuaggcucuaccaaggaggaagcaggguaaugugacuugucuauucuuugauaaucagcacaucucguggcuucccuuggcuuuaacagacagcagucacacugauuuaaaaacauguuuuagcagaagauggcccaguacaggggaaagucagggccaagaagugggagugaguggguaggggagcagggcgggggaggguauaagggacuuuugggauagcauuugaaauguaaaugaagaaaauaucuaauaaaaauaaaauaaaaaagaaaacauguuauaccuauauuccaggaugaaaagaaacuugaaaaaauccugauccacccccaauuugcucuaucccuuuaucaacuuucuccaaaugugggaaaacggauuccaacauuucucauucacaagaauaugcuuacauuucuacaaugggagccaaacaguguagucuuugugucuuggaugcaauauccuuaauuaaaaaccaaagaauuaguacuggaaaucaaugccauugcuuguucauguacuccaccacugagcuacacuggcaaccccuuaagacuuggucauuaaacaaaagucuucguuuuacugauauuucagcuuuaaaaaaauacacagaugugcauggugauccacaccuguuauuccagcacaguggauacugaggcuggauuguuagugcaaaacaaacaucuggaucguacgucaagacacugaaaaaaauccucauuggucugauuuaagcugaaaaguuaaagagcaagggaggagaaauauuuuuccuacagggcacacuagaaaugagaucuccuuucaaacaacuggugaauggugggauccauggauaucagauacuaaaggcacccuacaugcacacucgacagaugcagccuucugauuuugaauauaucaccagacuucucuuauaguugauaaaagaaacaggaaagaucuagccauaucuaugcuaaugaaagggagaaggcccuauaaaaccuuuggucuugccaauuguggcucuguaguucuaacaaaaacacugaaugcauuaaaggaaauacacuuggccaaguugguuguaaaaaucuaccaaauauaaacucugauucuaaacauuugauuauacacaaaugcaccucugugugugucucuguucuaucucuguguucucucucucucucucucucucucucucucucucucucucucucucucucucucucucucucucucucuugugaaaaccccaaaucuagaccuaagucugauaaagcacaccacacuugucauacgugcugaguacuuugguuuuauguauucuacauggacaaaaggcuuuguuuuauuuucauaauuguaguuagaauugaaccuaagaccuaguaaaugcuagaugcaugcuuuaccagggagccaguccuguggaagaaguuagaagacuuaauuguuuuguuuuguccucuaagcuguuuugguuuuuucucuaaguauucacagaugugagcacaucuuuuaucuagcucaggaauccugugucagugacauauuuguaugcagaguggguggcaaugggaaggcuucugcacagcuggcugagcugugcuccauuggaagugcauaucugcccaaagcucuaacagaaggacccaugucuugagggacaccaccuuucaggacuguagacgagaaguugcucuaacugggcuaccaaccccagaaacaaacuucaucaacauaaccgaagcugauagucaaccucaguugcuaaagacuggcuaagcauuuugugauuggcugaaacuugggaucuagaaauguuucuguuaucugagacaagaaacugaccacaaaucuucaaauaacuuacagaacuuccacuuuuuccuucuuuuuuucuuuuuuuuuuaaauuuauucucucauacaauacauccugaccgcagccuccccuuccauccaugccuccccccacccccugucucccacuccuccucuguuucccuucagaaaagaucaggccucccagggauaucagccaaacauagcauaacgagaugcaauaagaguaggcacaagccuuuguauaaagacuggacaaggcaacccaggagcaggcaaaagagucagagacaccccaacuaccacuguuagaaguuccauaagaacaccaaacuacacaaccauaccagguaagacccguacaggcugugauugucacaucagucucuaugaaccccuauaugaacucugcuaaguugguucugugggucauguucuccugguguucuuuacaccccaccccgggcaccuacaauccuuccuuucccuuuucugagggguucuccuaaguccauccaauguuuagcugugggucucugcaucugcuuucaucagcuguccaaggaaggcucucugaugacaauugggcuaggcaccaaccuaugaauauagcagaauggcauuaggaauuaguucacugacuuuuauuuuugucagccauauuugguucuaccuaggucucugaacaauccagcuuccaauuauaaaauuucuuuuuuuuuuuuuugagaauuugacgugacuacuguauuuacauuauuucuccuuccuccaacugcuccccaugucacuccaacuccuccucaaacuuacaaccucuuauucuuuaauuaguauugcuacacacacacacauacacacacacacacacacacacacacacacauacacacacacacacacacacacacacacagauacauauaaaccaucacuauuuucuaaacaucaguauaaggugcuaggcaaugcugcaggcuguauuacuccugauauacuagcuuacuuuguugaugugggacagccccacauugaccaagccagcucagucaguaaacagggucucaagggaggggagauugaaaaugaagaacaauuggacaaaauuagaacaugacuccagucaguacauugacugaagcaguuuuauuucucuccagccugcauuuacauuauucuagguauauccaaaagacaugguaaguucuuaggucaaagacaaaggaaucaagcaaaguaguaaacaaagagaucacacaagaaaguaaccaaguaaagucguaagcaaagccccauggccacuguuucuaauauucuucccugagccuacuuccuugucaaaaccucucaauaccacaugguggcacaugccuuuaauuccaacacuugagaagcaaaggcaggaggacuucugugaguucgaggccagcauagucuaucuauguaaguucaagccagucaggagcuacauagugggacccugucucaaaacaccaaaaaauaaauaaauaaauaaaaaguugcuuaaggauuagaaagaugucucagacagaccauuugcugaguaagcauaagaaaccaaauucaaauccuaagaauccacaaaaaaaaaaaaaucagguaugguuuucgugaauauacacaaaagacuccuccccuaaaggaaaaugacauuacuucuuugaauucuuugagcauuugccuauaaagaguacuuagaacauaggggaacaugaaaauucaaugaagaguagaugccucugcugcaguucauauuucucccagaaucccuuggcuucucauuuccuuguaguauaugcuuuuggugguuuaucuucaugccuuuuauugaacaggugcacacaacucuuaggcacaguacauauugagaagugguccagagaagacucugcucauggaauguugccuuuuagccaaagugaacagaagaugauguuuguaucccuugaggggugaacuuccauuagugauggaaugacaugggguucuguaagucaucuccuuugcuguaaaguucagacaacuaauccagaauuauuauacauucaaaacuaaagcuauucuguguaacaccacauuuaccauugagaucuuccugacugaugaucacucuuuaaauuccuuucuucagagaaaaaaacaguaaauaauuugaaaaaaaaaaagaauauuagauacuauuuccauaaaaccugaucugaaacauucccacauaugaacugccuucucccauucccuaauuuaauacacuaaguaccaucuacuaaaugaaucuggcucguauuuuuuuuuuaaaucucaaugauguaugggugucuuuacagcagagccauuccuuguuuuuucuugguucagagagcaaaggagaaaaagacuuuaacuggcuuuccucuccaucccauacguaaaaugauggugacaguaaacauuuucccuacuuggaaaggaaaaggaacagaaguagucaucugauacagcacuuccaaaauucuacccugcaguuuuguuuuaaaugaagaaaauucugaaucaggcccuaacaucaagggaaauccuuuuacucacucaucuuuacaguccucagaucucccuuuaagcaguucuuucuuuucuauuuugcucuuugucaugccuagguuaaguuauugaaggacauauauguccucuuuccauauguguagguuuuucugcuuuauuuuugaaaauuggguaaucaaaaguaguguuaaauguauauauuuuuguauguauacauauguuugaaagaaaaaauuauacaguuucaagauagcuauuaagucuuaaauagugaaagaauuuuuuuuuuuacuguuucauuuguuuuacccagaauuaugacugcucuccugguaugcaacucuuaaguggcuaguaguggggugggacaaauggcucagcaguuccuaguacuugaugcuauugcagaggaccaguguuugauuccccaguaucugaauagcagcuuagagcugucugugacuccaguuccagggcaucugguacccuccucuucugaucucuaugggcacaagaaauguacacaguacacacauauauauacauauaagcaaaacucucaugcacauaaaauaaaaauagcauuuaugaagcagauaagugaacagaugaauaagcaaaagccauuguauucuuguaauggaagauuauucguccaaagcagaaggaaauuguaacacuugcuacaggguggacuaggcugagaaacauguuacaugacacaaguccaaugccacuguucuaagauuguguaguccuauuuauaucagaauacacaaacacaaagaaaauguacaguaauuuuauuuuuauuauguuaaauuuuuuguguguucucauguauacacacacacacacacacacacaauguagaugccuacaaaugccagaaaugucagauuacuuggaguacauuuguuguuguuguuguuguuguugugguggugguggugguggugguggugguggugguggugaugguagugauuuuguuuuuuguuuuuagaugccugaugucugugcuaggaaucaaaacuagaaagauacuuugauagaccagugugugcucuuaaccacugagccaucucucaagcaccauaaauugugauuggggagguaugacaaggaaaaaaaaugagaaauggccacuaauuguuauaguauuuccuuuggggaugaugaaaguguauugguuuuacaguuuuuaacguaaaugcuauuuggcaaaugucaaaauauaagcauauuagggcuguggauauaguucagucuguauuaugcacauacaguccuagcucuggugaagcgaauggagacaagaaguuccaugagacaugcuggccagucacccaagacuaguuggugagcuccaaccaagugaaagacccaguguuuaaaaaaaaaaaaaagcuggagguuccugaggauggacaugugagcuugaccucuauccccacacacaaguacaaauacacacauacacauucacaccagaacacauaaacaugaaugcacacauguucaaaacugugguaaaauacaauuacacuuggaaugauacaugacuauaaugaauggccauguuugugguuauuuuagauauaguuuagagauuuggcacauguuuugcugguuucguuucuuucuuucuucauacauaaugaguggauauuaucccucucaucaugaauguggaugcacaauaucccucuuugcauauacgcaaugcugaagaagacaagaagggauaaagaaggccauaacaacauucauauuuucccaaguaguuuuauagauguaagaagguuugcugauaccuccacucuuauccugaaccuuacaguauuuaagagggaugcuuuauugaagugcaauucgaauaaauauaucagaaguacuugaaauacacauuuuaaucaaauuucugcacguuuauaccuuguccauacuuuaugcaucacuccucaaauuuuaccuacaccucuucauccccccuuagcaaucacuaaaauguucucugaguauagauucauuugcagauucuagaauacgugggucuuuguuaggguuuuacugcuaugaagagacaccaucaccauggccacuauuauaaaggcaaacauuuaauuauggcuaguucacacuuucagagguucaguccauuauuaucauuguuggaagccuagcaauaugcaggcagauguacuggaggagccaagaguucuauaucuccaucuaaaggcagccaggagggucugaagagcuugagcacuaggagacagaccuuaaggcccaccccacagugaugcauuuccuccaacaaggccacacauacaccaacaaggccacacguccuaauaaugccauuucccaugggccaagcauauucaagccaccacgacauguaaaugggcucagacauguaccccuuuuugugcaacuucauucauucaaaacuauugugaguagaaugacuggaucccaugauaaacagauguauuaacuuuuuaggaaaccaccuagaucuuuuaucuaugucauuugccauuuucccuagcaguauaugaggauuucauuugagucauauuuaguacuccuaaauauuuaguacuucauuugagccauauuuaguauuuacacuuuauucauuguaaauaggaaaaugcaugucacagcuuauuguuuuucaugaagagaauucaggucaggagccaagaggcaaaagcugaggcagagaacacagaggagugcuauuuacuggcuugcucaucauggcuuggucagccugcuuucuuaugcaugcccagggauaccauugcccacaguggcaauuacauuaaugauuaaccaagaaaaugacccacagacaugcuuacaaaccaauuugauggugauaaauuuucaauauauguuuuuucuuccaaagugacucuaguuuguguugaguugacaaaaaucuaaccaguacaacagacaaugauuuuuaucuucaaauaugguauuaacugucaaccccuugaagggucuuuuaucuuuucuggacugauguuuccuucuuggcuuagcuugcuaaacuaucuuaucagaaauaagaaugaacagagacuuacucuuaaaaaaaauuggugagaauacaaacucuuccuuugaugauaaguauaauuccaguugggucuggauuucauaaguaucugagucagcugguaagaguacuuaugauacaaguacgaagaccugaauucaaaucuguaucaucagugugaaaaaucagugaaagaaacccugccuuaaaugaucaaggcugggagugauggaguuuggugcccaauauccccuuauguccucuucaugaauguagauucaaacauaccuugaauacauaugugugaaugcaucacacucaugcauacaugaacaauuuaaggaauuuuuaaaaggaacacaggucuuucugaaaauguauagaaaguuaugcacacauuagaaauugcugaaagcucugauggcuuagcaguuacauuguuauauuuguuuguccccuucaagacacugccaaaaagccacugcuuuuaucaugcaagucugaaaauauuaucucagaauuaugacucuguucaauggaaacuuaauuuucuacuccuauggcuucugcuugacauuuguaaaggauuuuauccaaguuuggcuuuggcaggagaauuacucuagaguggauccaagaugaaaauguuuccuccaucuuauggaaacacaaauaccaugauucuuccugucuuccacuauaaauauuccagugucugugucaguuucucuugacuacagaacuguuaaaauauuuccuaucuaccaauauuugacuuacaaaaaaucccagagauguuuaaauuuuauuaauauuuuauguuauuaauauuaauuuaucacucaugccagauaccuuuauuuguucaugacugagauuuuuauuggaaacugucaucucaguuuccaauacucaguucauauucucaaguauaugguaugugcagcaaacgggauccacugugucuugacuagguuucucuugcuauuaugauuauaaaaagauaaagaaauauuaagauauguuauaugggguguggugaaguaugaaggaaccagucacacaauaguauaguauaguauaguauaguauaguauaguauaguauaguguaguauagaguuuauucagggcauggggaggggaguuaagaggguaguagaggcaaagaaaggaagagagagggagagaguagagaaguaaagaacagccaugaguacguggaggggggaagagaauggggauagagggggagcaaggggcaaaagagagagauaagagaggcaaaagaguaagagagggaggaggggucaagcagccccuuuuauagugggccaggccuaccuggcuguugccagguaacuguggggguggaguccagacagaauaccaacauuuccccauuuugguuuaguuaaaaaaggaaaaaaauuagaaagaggugauggugaagcacgaauacgguugucaugacaucuugcugcuucaugcuggcauugagagcaaugugucuccaaggaagcuagaaggauggauaugggggauguuuguccagucugaggagaguuggcuguuuccugcuguccagggucuguggagccaucugaggacaggucagaaggaccaggucugguaggagcgucuaugucugugagaggagauuggagcaucugaaguuugcuucucuggagcuguccuggauguagcaagcgccuggacuugacaagauguugaaacauaauuaucgauagagaauaagguuaaguauguuugggagaaagaaaauuuuuucuuaggauguacaauugaaacucagagggaucccacccucuggaauagauuagucagaucuauuuaucuggauggagccuauuugguccgugagagguagaucugaguagguuuccuguaccuuauaaguuuauaaaagagauaacacgaguuaacaacacgagcagucuuuaagaggagccuuuuguggggcagaaggaacaagauuaaaaaguuggaucguauaguggaauauuuuauuagaguuaggcaaauuuauaggaacuccgauaauguuaggacaguggcauagcaagaagaggaaauaugaagcauuuaauuaauggaaacugaguuuagguaaggagauaacagauuacaucugugaaaguuuuuuccagcugcugucuuagcugucaauguagucagaagucugggaaauaaacaauaauuuagcaguuauauuauuuuuaaaaugacagacuccacuagccaacaguuccugaagucucuguggcaacuugggcagagucauucuggcuuucaagugcagaagacacagggcuuuuucuguggaauggauacgugugucaugagaaauggcuuacuuuuauuuuagccaagucauuugacauagaguauccaguuuuuuccacugcguauuucagugauuaucauaucacaaugcaggcagcauccuguagcuguguccacaucuucugagaucucaugggagaaacuguuagaggauuuugggaauucugucugucauaaacuuaauaguuaacaaacuucuaacaagauugagcacuauauagauugguuauaaccgaauagaacuuaaugacaguaguaaaaaucauauucagacaggguaaggaugaaaaccuuagauaacuuugacagguuguguagguagagaaaaguauauuguuguuuuagcaaagagacauauggcuaggaccaaaauaagaaagcuggcagcaauggcauaagaucguggugacagaaaaugaguuuguccugugacacaaacugagcauugcaggugaugagaccaggccaggggugugggagcauggaaagguaagcauuugggcccuuucaacugcauagcccacacagcagaggcuggguggcagcagcuccggggagcucucgggggcgggcagccaaacccuucgagagcuccugcgugcaugcgagagagugugcagguggucgcacacgugggaaagucuguucuaacagacaggaccucuggcaggacacaaggugugggacccacuuuuccuaacugcagagcgggaagggcaacaaguaggaucucgagcagggggcagagccaaaccugcaucucaggcaaacucgcugaaucagcaggcugcaaaugagagggggggggggaggggaaggucuaagcuaugauagcagacugacccaagggugagaugcaucggggcuaaagucuaaggcucagagcuggugcugcugcaguuaguuguccaggccuggaauucucagccgcaggaaagaaacugucuccaaggagagggaaaucucacccaagagaaagaguccuaaaaugagggucagggacaguugcucuggggcugggggcuuaccagagagcaugaaucucuugugauggcugaggugugacgcaaaccugcagaguuucuagaucucagucauagcaccaauguugugauuauaaaaagauaaagggguauaagaauaugauuuacggggguguggagaggugugggggaaggggauaucucaguaggccuaugccaaggcaucccuucccccugagggaccagccauacuauaguauaguauagaauagaguuuauucauaacauggggaugggaguuaagaggguaguagaggcagagaaaggaagagagagggagagaguagagaaauagaggcaggccaugaccauguggagagaggggggaaacggaaugaggagagcaggggaacaagagggcaagaggcaagagagagaggcaagagaacaaaaguaagagagagaagagggggcaagcagccccuuuuauagugggccaggccuaccaggcuguugccagguaacuguggggaggagaauacuuggcuguugcaggguaacuguagggguagaguccagacagaauaccagcagcugugauaacaccaugacaaaaagcaacuuagggaggaaagcauuuauuucaucuuacaguuccuagcucacacuccaucacucaaggaagucggggcaggaacucaaggcaagaaucuggaggcaggaacugaugcagaggcuauggaggaauaccgcucacuggcuugcuccccuucacuugauaguuugcuuacauauacacccaggagcaagugcccagagguagcaccacccgcaauuagcuggacucugccacuucaaucaugaaucaagaaaaugcccuaugggcuugccuaccaaccaauuuuauggaggcauuuucucaauggaaguuaucuuaucccaagcgacuaacuugugucagguugacaaaaaccuaaccacacacucuguuuauuugcuuauugaagaugcccuuuuucuguaucaaaucauucaaaaaauguauaguauaagccuagucaagcuacuccaagauccucaaaguauggcaucucuuucuguuuucaagacaacugucuaucagcauugugcuccagccaagaaugaaggcaaacucucagaaacacacacaugaacuaccuuuguggagugauaccuugaaaacagcauauuuuugcuuaccugaagugaacuaaauuuagucucaugagcacaucaaauuucaaagaaguaugaaauaucauccugaguugagaaaccuggcuaaaacaaaugaguuaguuauauaacuagagaaaggaagcguggauauuagugaaggggguaggguugcaggagaguucuguguugguaggaaagcgggagggggguugguauaagcaaaaaggggacauuguggugggaggggcauauguauguaagcucuauggacauaauugggaugcugcuauaugaguuaaagucauaaccacaugucauuucuugguuuugagcauagauucuauguccaguagccaagaaaaucuuacauuguauaggaaaaaauaagaaaaaaaaucagaugugugccaccuuucugaaaauccuuauucuuuggggcuacaauuuggagaggaagaaauuugagcucccacuugccccccucuuucucucucccucccccccucucucucucucucucucucucucucuguauguauauauauauauauauauauauauauauauauauauauauauauauauauauauaaacgguuuccuaaaaagaauugggacacauuugaaauaggcacaugacuaugacagaguacacaucugucacagcaaucacuuaaaauaguuuucagacgaaugaaccuauuguucauuuucuuuggcaguuccaaguacaaguaagguuggggcaaagacaccaccauugcgccccauauuccugccaccaacuagauuuggcugaggucacugcaaugguuuuuugcacuuuuucuuucuuccccucaguguuuguauguuuucuaagcuaggucauauuuggcugaugcccuagcuaggcuguugaaaggcaacuaagagaacaaagccaaacuaaccagaucuauguagaaacacagcuacaucuaugaagguguccagggccuuagugaggcuuuuaggcacccugugcauggccucugcuucuguuuacuuugcagcuaucuucauucuccuccuuuuugugucagcucuaaucugagcaugcagagaaauagccauaacauuucaggaucauuggaagggaaaagcauuuuuccuugguuauaugauaguuuuaggauuauagugggaacugcaauaugcagcauauaacuauucuuuaugacuuauggaguuauuauccucuuacacgcguucucgugaccggccaggaagaacgcaacaaaccggaaucuucugcggcaaaacuuuauugcuuacaucuucaggagccagagagcaagagagcaagagcucuauugcuuacaucuuuaggagccagagcgcaagagcacuagagugcaagagccagagcaagagugcaagagcaaaagcucuauugcuuacaucuuuaggagccagagagcaagagcgcaagagcuuuauugcuuacaucuuuaggagccagagcgcaagagcgcaagagugcaagagagcaagaggcagagcaagagagcaaaaggggagaauggcgaaaccccgucccuuuuaaggagaauuauucuccgccuaggacguauuacuccuugauuggcugcagcccaucggccgaguugucgucacggggaaggcagagcacauguaguggaaaacuacccuuggcacaugcgcagauuauuuguuuaccacuuagaacacaggaugucagcgccaucuugcaacggcgaaugugagggcggcucccuacauuaucccauuuaugcugggaguauuuucagcagaauaccugcagauguugaugcuuuaugaaaauucccuuugcaggagauaccugccauguccaaguuguuauucccuucuugggagcagucaaugccuaauaacucuuugccccaaguguaucaguucaaaucuccucgucaaaacucaaaacaagugccuagcucucuaccuucagaguuccuuucaucccacaacuguccaagugcauuccguugggaacucccuacaugcucauugcugucucaagaguccacuuuuuggggaaccuuauuuucaaugagaaguaaagaaauguucaaaggucuauaaaauaaaauuaaaaaacaaaaaaaaaaaacaaaaaaaaacauuuaucacugguauuuguguguguguguguguguguguguguguguguguguguaugugaguauaacaugucacugguauguguguuaaacauuuauuaaugguauguguauguguagaauauuuaucgcugauuuauguuuguguaugaagcauuuaucacugggaugugugugugugaaaaauaucacugguauguaugugaaacauuuaucacuguaagaccugaaaucacuauuccuuucuccuuguuuuuuaugccuggaaauaggaagcaaccauguuuuuuuuuuuuuuucugaaaaauaaauucaauauauuuauugaaaaaaaaaaaggucuccucuccuacuuugguauccuucuguaacaaaugaauuccuguuaggggggacaguggugaugccauaaauggauaacaaguggauuugcccucuaagcuggauuggaauaaaugucuccuaccuaagucuuauacugacaauauuagaacugacucaaacuggggcucuggcagcagcgaacaauaugcaggagaugccaugucgguauucaacggugucugaagcaucagcuuccugccucuagguuuuucuuaguauucauugagcccacugccauagcuaauccaacagucacuguuuuauuuguguaauggauaacaacuacacauauuguuuacauauguauuauaaauggcauacaccuucuaaaaagccuucaguggauauucacagaucauguuauauauaauuuuaauuuucuuguuguaauuucuucuuguuucaacucacacagaaaaucaaagcauaauauuaugcuauuagucacacacacacacacacacacacacacacacacaaccaaccaacaaaccaaacaaacaaccaaacaaaaacccucgcuguucacuauuugagcauagacagaagccaggaaugguacaagucaggcuuucagaaacaugguugacaccuuaggaaguuguuugacacuucccuugagaaacacucaccuguaauucugggcucuaagacuaaacagguugcauucuccucuaugaaaaaccacauauuuggggcuccaguuuaccucuucaccccccuuucccaccaucccagcccaugauaacuuuaucucacccuuuacuguuuaaauaugagacagcugucaccccacaggcccauugguugaacauuugguccucagauguuggaacucucuuggugagguuuggaaaaaccucaagagauaggaagauauaggccacuggaagugugccucugaauguuaaaccuggccuguagccccccaucuguuuccugucuaccccaaggugaacaccccccugcuccuccacacuuuuucaccaccacaauauucuguuucaccuuaagccaagaagcagcagagcuacagaauaaggacugaacucuuugaaacucuguacagaauaaccuuuccuccuuuguauuuggggggggggggguauuuugaucacagcuuugcaaaauuaauuguggucuuacugugccacacagcacaucucuacauuucuggucacuuuguugccucugauuccauauuucaaaaccaaaacuaagccucaaauacuucaugaugacuuuuauuuauuuuauucaugcaugcaugcaugcauuuauucauuuacucauuucaaauccuaaucauugucccucccuccugaugcccccuccaacagucgcucccucauucuccccuccccuucuccucugagagaguggagcacaccccugguuaucccccacaaccugucacaucaagucucugcaggacugggugcuucuucucccacugaagccagacaagacagcugaguuaggggaauguauuccacagacaaacaagagcuuuaguaagagccccugcuccaguuguuugggacccacaugaagacugagcuacacaucuguuacaauuugggggugggguagggagugcuagguccagcccauguauguuccuugguugauggcucagacucugagagccgcaaggguccagguuacuugacucugcugaccuuccuguggaaucucuguccccuuuaucccaccuauaagaaaucagggacaggggauggagcagagacugacagaauggccaaggaagaaccagcccaacuagagacucgugaugacuuuauuaaccacuccagcccacguugaauuuuuuccuauguaccacuuguagugcuacauggcaaaugcuuuggguaauuucacucuuuucuuuuaucauauuaaggguaagcaguacaauaaggaacuaacaagucaguaagcaaagucccgugauuacucccaugacaguuguuucaugaugaccaaaauacuugagcccacuucgguuguccaagccccaaaucuuggccaaagccuacuucuuuuguuacacucuaagauuaaaauuccugccuuacccuacuucccuauuauaaccuaaaguuagauuuuugcugaaacuuacuuccuuagauacccuaaugccagauuccugccugagcuuaugucucugccacggccaaugucagauuccugccugaagcccauuuucuugucuuuggccaaugucagacuccugccaagcagcaccccaaaggcucuccacaaugauaaauagcugacauaaacaacuuaaaaggaggagauuuauuugggcucaaaguuugaaagguuuuaguccaugaccuauauaaagcccauuauaagacagaaacaucauggaaauaagcacugguuucaaagaaagcuauuugccuuuaacauccaagaaguaaggagagcaguaagauccuaggaucagcgaauauguguucagggcauucuuccagugaauuucuuucaccagcgaggcuauauuuacugcuuuauacuaccuuguaaaacaacuaaggaucaggucuccaauauauuagccuauaggaauaguucaaauuaaacauuuaugauuugaaaaaguauugacaaagaauugcaaaguuuauaagacauuaaauauauauuuuauauuauguauucuauacaguacauacauauauauauguaugucuuccaaauuuuuucucuaacacauuuuuauacaauuaagugacucuugcauguaaccacaaggacacagcagcuuaaucacuuuaagaacauuuaaccacuauagaguuauucagauaguuugcacaccagcuaaacaucaaaaucuuuaagauacauucaaauaauuaauucuuuaauuuccaacuucaaaauuaaacagauaucuuuuuaaaaagauucauuuauuuauuauuauaugcaaguagaguagcugucuucagacacaccagaagagggcaucagaucucauuacggaugguugugagccaucauguaguugcugggauuugaacucaggaccuucggaagagcagucagugcucuuagccgcugaaucaucucgccaguccccaaacagauaccuuaauacauaagauuagauaacaaaaugcuauagacuaaguaauguauuacaugaaaugaauuuacccugcacaguucuagaugcugggaaaucugggaugaagguucagugcaacugacucuggugaggaauugggugauuauuuguagaugaagccuacucagugcauuuccuguuagaaggguaaaauauguuccuucaguccucuuuccaaagugacacaucccauucaugaacaaucugaucaccugaauuaucucucuagguuuuaucucuuaauauccuuaaauuaccuuaguguuauaguuucaacaguuggauuauagaggaacacaaacaucagaacauagcaacaagaacuguagaaugaaugaauaucgaugguuuggggaaaauuauuuauacauuccacauaugagccaccagagugaaauacugcuaugguauagugcuuaguauucucaaacuggugaaugaacauaaaaugaucacacacugugcauuaacauuuuuguaagaaaugucaucucaaauauauauugaaauuuucauaauuagauacuuuugaacuguuauuucaagcucccucaugaaagauuuuccaaaacuuauauaaacaauagaauuaauaaaguaaaauagggugaguacuuagcauguucucuuuuccagugacaaugaugagcaaaugggacacugccuccauuugcauccaaacaauuuuagccauuggaaaaugcaaagaaacaaauucuagcauggguccaaguacuuuguacaaauagauugaugcuauuaagcugggauuuucguuaucuacugugggguaaugaaucaagucaaaauugaaucaacacugaucauuucuugccugugggucacuuuggguuaguuggacgguuuucacacacagccuuucaugucucugcaguugaaugguuauaggaauuaagguaaucuugagcauuuccuuauucccaugucuuaauacuaaugaaaagacuauagaaacucuguauaagaagaauggcaaugucacauaguaagaauagcauaaggaacagugaugccuauagcuauuuuggaaaauucauagcauauggcauauaagaaugaucuguuaggaucagggguaguuuucugaagaagauuaauauauuaauauaagaucugaaagcaaggagauguuuugcaaaaaaaaaaguauaggaaaaacaagcagacaaaaauauaugaagucagaacagaacagcccuugggacagaaaagauggaugaggcaaguugauguuguguaguagggauacaggguccagauuaaacagaacuuucuuaucuauggucaggguuucacucuaauccauaaacauguuaugguccuaagcaggcagauggcaguugacacuaauuauacuaaaugaagagaauacugagguugcagaaggaucagaaauagaugcagagaauuacuuaggugaccaugaauucuugaagugagacaugauuggagguagcauuggcuaagaguuauaaggaagauggagagacauagcuguacucaagcacucuaagaaagaaaaaucgaugagaccuacagaugaguuggugaaugggauguaguggaaggcacgagucaagggucgauuguggucccuuguguauauuugaaaaguugagguccaguacauguggaguugagguaagcuuaagcaaucaaaauuaauggaauuaguaguacacauuaguuuauugacagcuuauagcuggucauauugcuagaaguaguaaguuguuaucaguagugaaugcuuucuaggggacuauaagaguaauaacuaaaauaugucugcuggggucaucggugugcaggucaugucauuacaggaugaguuguuuuccucaggaguaugaugcuggaagauauugugguacuuuuccugaagaaauaaacagaugcauauucaucucagaccaggcauuaaugacaaaacaaauaaauaauuacacucaagucccacuuaaugaauuuaauugagauuauuuaaaggagaauggauacagaguucuuugcaagagccugauaaauuugagugucuacaccacuaaaaaauuguuuuccuucccuggcaacugguuagcugcguggggaucauuacaaagggacaagauuuuguaugucccuuuccccuccacgagggcauguuaauggaugcaguuuugugcagguauucaaagaugcugaaaauucaagaaaguaaugucaaugacauaucuuuuuaguuuuuauguauuuauuuuuuauuagauauuuucuucacuuacauuucaaauguuaucccgaaacccuccccccagccugcuucucuucccauccacucccacuucuuggcccuggcauuccccuguacugggacauauaaaguuugcaagaccuaggggccucucuucccaaugauggccgacuaggacaucuucuccuacauaugcaucuagagacaugagcucuggcggcacugguaaguuuauauuguuguucuaccuauaggguugcagaccccuucagcuccuuggguaauuucucuagcuccuccauugggggcccuguguuccauccuauagaugacuguaagcauccacuucuguauuugccaggcacuggcauagcuucauacgagacagcuauaacagggucccuucagcaaaaucuugcuggcauaugcaauagugucuggguuuggugacugauuaugggauggauccccgggugggguagucuccguuuaguccauccuuucaucuuuguuccaaacuuugucucuauaacuucuuucauggguauuuuguucccuauucuauggaggaaugaaguauccacacguuggucuuccuucuucuugauuuucuuguguuuugcaaauuuuaucuuggguauuccaaguuucugggcuaauauccacuuaucagugagugcauaucuaaugacuucuuuugugauugagcuaccucacuaaggauaauauccuccagauacauccauuugcccaauaauuucauaaauuuauuuuuuaauagcugaauacuagcccacauuuucuguauccauuccucuguugagggacaucuggguucgacacaucuuaaaggcagccuuucacaacugaagcaggaguuuagacagcuuuugggguaguugaagaugaaccgagcaaugagauugucauguaauauaucccacggagaauaagauauaucgaguacuagauuucacaguacuagaucauauacccuaaagacauauggguuucuuuuuaaaggaaggaagcaugagguaaauggagaacuucauauaucuuaugugauacagacgaacacaauuugaauccacaauagcacuacagagcaaaucagggaagcuuuagacaacuauacgaaaaauauucuauagcucaaaaucuucaucaggcuugaaugugcucagcucuugugcacaucaugaaaccagucccauggauuaauuuugcuuuagcuauuuacuagugucagagaaagacugauccuuggaaaccgcuaggaacacaaggucccaucagauuuggcuaaacgaaacauuugauuaguuaucauuaacaagaugaugcaagcuaggaaggauucauuguuuuuaaauuuggcuuugguuccauacuuggcuucagcccucagagcucuggccaaacagcagguuuucuguguguccucuguucucccugaggaccucccaaugagucagagguauucuacauccaaggaaaaucuuuaggaaaaggaggaguggaagccuauaagcauacauacagaggauaaaagaaggaaggauagaguaaaauggucauguguguugccugcuguuacagcuggaagcacuuuucuguaugcuagaaguaauuuucuagcauaauagacucaguagugaugcugacuuuuggaauaauuacacaaggguacaucaaaucuuuccaccuacuugcaaucaucuuucuuugacuugaacuaugucauaaggcugucauuuccagcaaauccuuucuggaugaagcaacacuugaaaaugcuaagccuccagggauguaccaaagcaucaccagaauuaacaaagauuaggaagagcagggagagaguugaaaggauagagucaucugcaggaaggcagcuccaccauucaauuggcagcaugauaacuuuguuguaaagaacagcagagcgagaacuaccucuguagaaaccugagccaauucuguuagcucuagacauggggugcaggagcaccucuguguguguaugcauguuuguguguguguguguguguguguguguguguguguguguguguguguagggggcuauguaaaacaauauaaugauaauugugaugagacauauaucugauaauaaucuguaugccaaaaaagaaguccuuuucaaauuuauagcccaauggacacaaauuguuuucucauugccauauuaagcuauuuuuugccuuuaaaguauucuguccugcuguuuccacuacuugccugauaggaaagaggaacaauuaugcugucuuaguuaggguuuuacugcugugaacagacaucauggccaaggcaacucuuauaagggacaagguuuaacuggggcuggcuuacagguucagagguucaguccauuaucaucaagguagaaacaugacagcauccaggcaggcauagugcaggaggagcugagaguucuacaucuucaucugaaggcugcaagugaaagacugacuucuaggcagcuaggaugaggguuuuaaggccuauacccacagugacauacuucuuucaacaaggccacaccuacuccaacgagaccacaccuccuaacagugccacucccuuggccaaacauauuaaaaucaccacauuccacucucuguccuccauaggcuuguacagacauaugagucuaugggggacuauaccuaaacauaacauaaugaaaaauacauuguguacaacuuccagaguccccauagucuauagcagucucaacaauguuaaaaguucaaagucucuucugagauucauccaaucacuuaacuguaauguccaaagaaagaaaggaaaccaacugggcaaacuccaaacucugcaucuccaugaugccaaagcugucuucagaucuccaauuuuuuuucaucuugguugacugcaaaaaacuucuuucuccugggcuguuuccacucccuguuagcagccauccucagcagauagcccacagcucuggcaugucaaauaucuuggggccuccaaggcaacuucaauguuacagcuucuuguuuuaaugucugggauccacauaugaucuucuggacuccugcaaagggcuugggucacaucuacagcucuguccucuguagcacucuaaggccacuccacugcugcugccguucuuggugaucaucccaugguacuggcaucuccaauacacugggguuuuccacugcaaccaauagccuuucacagguucucuucaugaugccaagccucaauuucucugcaugaccccuucagucuugggcuaucaacugcagcugaggcuguagcucuaccaauggccuugcuuggccucucacagugccaagccucagcugcccuccaugaccccuucaugccuucaaaaccaguaccaucuagauaauucuuacacauuaccaaauccagcugcagcucagauacaguauuucauuucucuggaacacgacuucuuuguacucucagaaaacauuuccaagauuucaccucagugaugcuguucucuucuuaauuaaugcuaauuucuuaguuccagcuaaccagcaccaauugucccaggggucccuucuacucugaacucuaaagccagaguuaugugcccaaagcugcugaguucugcugcuugcuggggcugaaaaauggaccccucuuauucuauuaccagcuuucuguuuuuguuuuucguuuuuucuuuuucuuuuucuuauuuuuuuugauauuuucuuuauugacauuuaaaauguuauccccuuuccuugcuuccccuccaaaaauccccugucccuuuccuccucccucugcuccccaacccacccacucccuuucccaguccuggcauucccuuguacuggggcauaugaucuucccaagaucaagggccucuucccccauugauggucgacuaggccauccucugcuacauacgcaacuagagacacagcucuggaggguauugguuaguucauaucauuguuccuccuauaggguugcagaccccauuagcuccuugggcacuggcauagccucacaagagacagcuauaucaggguccuuucagcaaaaucuugcugacauaugcaauagugucuggguuuggugguuguuuaugggauggaucccugguggggcagucucugaaugguccuuccuucuguuucagcuccaaacuuugucucuguaacuccuuacauggguauuuuguuccccauucuaagaaggaaugaaguauccacacuugggucuuccuucuuucauguguuuuacaaauuguaucuuggguauucuaaguuucugggcuacuauccacuuauuggugagugcauagcaugugugcucuuuugugauuggguuaccucacucaggaugcuaucauccagaugcaucuauuugccuacaauuucauaaauguauuguuuuuaauagcugaguaguacuccauuguguaaauguaccacauuucuguauccauuccucuguugagggacaucugggcucuuuccagcuucuagcuauuaggaauaagacugcugugaacaugguggagcauguguccuuauuacaaguuggaacaucuucuggguauaagcccaggagagguauugcuggaucuuccgguaauacuauguccaauuuucugaggaaccaccagacugauuuccagaguaguugugucagcuugcaaucccaccaacaauggaggagugucccucuuucucuacauccucaccagcaucugcugucacuugaauuuuugaccuuagcuauucugacuggugugagguggaaucucaggguuguuuugauuugcauuucccugaugauugaggauguugaacaauuuucuaggugcuucucagccauucgguauuccucaguugagaauuguuuguuuagcucuguacuccaguuuuuaaugggguuauuuguuuuucuggaguccagcuucuugaguucuuuguauauauuggauauuagucuccucucugauuuaggauagguaaagguccuuucccaaucuguugguggccuuuuugucuuauugacagugccuuuugccuuacagaagcuuugcaauuuuaugaggucccauuugacgauucuugaucuuacagcacaaguaauugcuguucuguucaguaauuuuuccccugugcacauaucuucaaggcuuuccccuaauuucuccucuauaaguuucagagacucugguuuuuuguggaguuccuugauccauguagacuugagcuuuguacaaggagauaagaauggaucaauuugcauucuucuacaugauaacugccaguugagccagcaccauuuguugaaaaugcugucuuuuuuucacuggaugguuuuagcucccuugucaaaaaucaagugacuauagguguguggguucauuucugggucuucaauucuauucuauugaucuaccugucugucacuguaccaguaccaugcaguuuuuaucacaauugcucuguaguacagcuugaggucaggcauggugauuccaccagagguucuuuuauuguugagaauaguuuuugcuauccuagguuuuuuguuauuacagaugaauuugcagauugcucuuucuaauucguugaagaauugaguuggaauuuugcuggagauugcauugaaucuguagauugcuuuuggcagguagccauuuuuacuauauuaauccugccgaucuaugagcaugggagaucuuuccaucuucugagaucuucuucgauuucuuucuucagagacuuaaaguucuuaucauacagaucuuucacuuccuuaguuagagucacacccagggaaugaccauccagagacugcccuacuuggggauccaccccauaaacaaccaccaaacccagacacuaggcagaugccaacaaaagucugcugacaggagccugauauagcugucuccugagaggcucugccaaugcauggaaaauacagaaguggaugcucacagucauccauuggauggagcacaagguccccaaugaaggagccagagauauaccuaaggagcugaagggaacugaagccccauagaaggaacaucaauaugaacuaaccaguacccgcagagcuccuuggaacuauaccacuaaucaaagaaaacacaugguggaacuuguggcucuagcuauaaauauagcagaggauagccuauccgucaucaaugggaggaaagacccuugguccugugaaggcucuaugccccaguauaggggaaugucaggaucaggaaugggaguggguguguuggggagcagggggaggggggaggggauaggggguucuaggaggggaaucuaggaaaagggauaacauuugaaauguaaauaaaggaaauaucuaauaaagaggaagaaaaaaaauaauggaauuguaauugcugacagauaguaauuauggaaauugaaauaagauauauuaggaacaacaacaacaaaguccucucgucgguaauauaagaugugguuaaaagaccagaaaggaggaauaugccauuccuuagauggaauaaagcuguaguugacugauugagucuucccucuuuaauguaaggucaccucugaauauuucgaacuaucagucuucuuuucccccugcuagagcugaaagggucuuucuuagaccuccauccuaaaacuuugguaggacuccugagaguaaaggcccacaccaguaugagggucaguuacuuugacucuggucauuugcuaggagcucucuauucucacuuaucccacacuaagcuucuggcaaguuuuuuauuuuauuauuuaaauuauagccacaauauguguucuguuucagaucucagcugggauucacugacuugucugucuuuccagauguuggaagacggcaauuugcccugaaaacucaguucucuuugggguagaaagaaauguguccccuuucaggguauucagcccccuuugguuguaaggguaacugcaaagguuucuaagcgagagagagcuaucacaaguuaguuuguuucuuuaaauuuuaccuucuggcauuucuguuuuccccauauccuuuccucuuuauccuuuaucaaaacaucuuuccugaaucuuuacugcauucggaaaaucaacuuuugcugaaauugucuuugcaaaauauacuauauaaaauauaguauauuuuuuucauaucacagaucuguuuuccuuugcauugucacaguguaugcauccucuauuucuugaguugaaucauucuauguagcauaggaagagaagucucuaaaucaaacgacuguaagcacauuuuacucuuagauuguccuugguuacuuuauacuugaaguuggaguucucagaguuacuucuuuuaacuagaaaacaauaugaaaccaauaaccaaacucgcccugaucuuguauucuuucauccccuguccaauaaaugcaugucaaauugccuuguacuucuauucuuuguucuuagaaugucuaauacaguuugcggcuuguauaacuguuacucucugaacuguuugguacuaacugcaaaucaguacacauacauaggauaagacuuuagaaacugauauagcaauuugauagucacuugauaucugaaaaaucuaauuuaaaaauauucaucuuaacuauaugucagaucuuuuuauauuagaucuauuaaacaauuaguuucucggauguauucaguuguagaaucuagccauggauauauacaauaaaacaguuaaauucaaaguuaaagccuucuaucaguuaacaggaaacuucuaugaccugugcaauaaacacuaucuuagcuaucaagaaauuaaucuacuauacucagaaaacauuauuucccaguuaauaaugcucaauaaauuuaaccaaauauuaaucuaacacaucaugccauacuccacuuauggccuuguacuugguuuuccauuuguuucaauaggagucaauguuuuggauauaugcauauaaaaagaugguacaaaacaaaaucuggcaucauuacaguacaccugaaaauggugaaaaccaaagagagguuccuggcuuuuaccaccacaaguacucauuuucuaaggaaugaugggugugucauuuaaaguuucccuucccauccauuuaugaugagaagauguggaaagggaugaaccagagaucugguuuaagaggauuggagauguggaacaauggaccgauuagagagaaguuggccuugacuuugacuuucucaagcccuccuuuuccugugguauguggaugaugaucaggugcuccuccaaugcugacucugagugaacaaguucaaggaagaaagagcgaguaaauacaaggaauccauucucuuuuguguucauuguggcccauucuucuuuggucuaggggacaagagcauuguugaauucugcaccuagcacugcagaugacugucaugacugcaagacugugaugucugugagucuuucucacugccacuuugccuagaaucaagaaauuauucagagcacuggacagaugucuguauaacucuaagggaucuugaaauuuucuugugagcaacucugcuauaguggugcugguaugccgugaagauacuuuuuccccuuccuugauaggguucauauauaguccaggcuggcauuauacucacaauccucuugccucagccuccugagugcugagacuucaagugcacaccgucaugucagcuguguguuuucaaaaacauuucaaugguuuguuuuuugcaauaauaaaaaaaagacaugucacaugccuaaacauuucaacaguacaaaggauuuuauaauagcaacucuuucuacucugucuuccccauacuguacacuuacccugcuuucuccagaccauaaaagucagccuaauaggagcauuauuuugcuccuuguuauuucauuguguauuuuauucaucuugaaugaauuucuuauaauuacauuggcauuuuguucauucauuuuaaaggccacauaguauuuaaucauauauauauauguauauauauauauuuaauaaaaugauucuccuauuaaggaauauugauauguacagaaaccacucaccuuuugcuacuaugcauauugcuauuuaaaugcuuuauaugacacaucuuuauaugcuugauggagugagaaaaacacuugauuucuaaagauccuuggauuuuuuuuucaaguuugguuguguacuggcuaguuuugugucaacuugacacagcugguguuaucacagagaaaggggcuucaguugaggaaaugccuccaugagauccagcugcaaggcauuuucuuaauuagugaucaagggggaaauuuuggccccuuguggguggugccaucucugggcugguagucauggguucuauaagagagcaggcugagcaagccaggggaggcaagcuaguaaggaacaucccuccauggccucugcaucagcuccugcuuucugaccugccugaguuccuguccugacuuccuuuggugaugaacagcagcauggaaguguaagccgaauaaacccuuuccuccccagcuugcuucuuggucaugauguuugugcaggaauagagacccugacuaagacaaauugguaccagcagaguggggcauuccugugauaaccugaucauguuuuggggaggacuauggaaggacuuuggaacuuugggcuugaagaucuauucguuguuaagagcucugucagauguuguguaggagcuuggaagauaauguugacaacagugcacaagauggaggucugguuugugaaauuucagagggaaaauuaaagacucuuuucagggccauugcuguuuugauugugaagauuuuguaguucugguuagcuggggcggaagaaucagcugugguuaacaagauaccagaacuacuaaagcaaaaacuuugcauuacugggacuauugaugcugguuagcuggagcuaagaaauuaguggugauuaagaagagaccagcaucauugaggugacaucuucugggaaguguuuucugaaagcacaaagaggcuguguuccagagauagccaagguuguacuccugcuacagcgggacuugguaauauguaagggucacccaggugguacugguuuugaaggggucacgcagagcagcugaggcucggcacugugagaggccauggaaggccauuggugaaggugcagccucaguugcaauuggugguccaggacugaaagggucaugcaguguuuuggagauaacaggaccaugagaugaccaccaagagcagcagcagcaguggaguacaggcaucuggagccuagaggaugacgcgugugcuacaaagggcauggcuggagaagugacccaagcccuuggaggagcccagaagauccugaguuggaucccagacauuggacgguugaagauuuauuuuuacuuugauugugacugugcccugauauuuucccucuugaaggaagaaacuguuuuaguggagcccacaguuaagagacuuuuaauuguaaaaagacuuuggauuuuaaaagagauggauauuuuaaagagauuguaauuuuaagaauauguaaagacugugggacuuuuaaaguuauuuagaucuuggggaugaauaagaauguaaggguugaggcuuacuagugauguguuuguguaauaaacccuuuccuccccagcuugcuucuuggucaugauguuugugcaggaauagagacccugacuaagacaaguugauuuuugaaaucucaaauagagcauacuuauccuuuuauguuuugauguuucaagucaguacagcaucccugcugugcagauauuuggaaauuauuuguuccuuucuuggcuuccuuguccucauuuacuaauaguaagucaggcgagcaauacagggcuaagaucagaguccccaugguaaucucugagugacuccuuuucauuucaaucagcucaucaguuuguaacuuauuugauagauuauguaccugguuaauauuguguugucuaucaagauagagugguauggguuuuuaacuucauuuccuugccuuccuucugcccugauacuucaaagguacaucaucaccaucaucaacaacaucaucaacaucaacaacaacagcaaaucaaaauccaauuacaauuuggucuggauaacaaugugaaagucagggucucccuauguaguucaugcuggucucaaacuugaaauauugcuucaauuggagguaugcaucaccacaccuggcuaagcugagugacuuuuuuuuuuuuuuuuuuuuuuugcgacaggguuucucuguaaagucuuggauguccuggagcuuacuccauagaucagguuggccucaaacucauagagaucugccuaccucugccuccugagugcugggauuaaauggguccuugcuuguggaccaguauuaauuguucuuaacugggagcaauuuuugauauguggaacauucaguaaugucucaagacaauuguuauuugucaaaacuaggcauugaggauugcuccugguaucugguguaaaagugcugagucugcuacuaaacauaguucaugcucaaugaagccuuuccccagggaagaagccuucagcccccgaagucaauaacauccagcuugagaaagucuggucaugaaauugguauagaaccuaacaccaguaccacugagcagugaaaaguagaacguuacaucagcuacagcauuauagcacacccguaagcauuuuaauuucauugguauaggccaguaucuguuuuuaaaugcaguuauucuaaauaaugcccuauugcuuugcauagcuuuuuuacuuuuaaaucuuuuaauuuuuauuaaaucauuuuaauuaauuaauugauugauuaauuuuuauaucccaaccucucuuucuccucucuccucuucuccaggacuaucccccucucuuucuccagccacuccuccuuuguuucucuucagaaaagggcaggcuucccaugaauagcagccagucauggcauaacaaggauauaauaagacgaggcaccuccucuuuuauuaaagcuagacaaaagaacaacccaguaggaggaaaggaucccaaggggagguaauagagucagagacaaccucuccucccacugucaggcauaccaugggaagaucauacuacacgcuguaacauaugugcagagguccgaggucaaucucauucaggcucccugcuugaagguucagucucugugagucccuaugagcccagauuaguugagucugaaggcuuucuuguggaacccuugaccccuguggcuccuucagucuucucuaccaccuccuuccccaagcuccucugaauguuuggcugugggucucugcaucuauuuccaucauuuucugggugaagucucucuggcggcaguugugcuaggcaccagucuaugaguauagcagaauaccauuaggaaucauuucauuggccuuuuuugucagucauguugauucuauccuagugcucugggcucucuaaaccccuggaucuuggcccucuaggaagugucaggaguggacucccucucauagcaugggucucaagcuggaccagucauuggccacccccucacauguucuaugccaccuuuaccccagcacaucuuauaggcaggacacauuguaagucaaagguuuuguggcuggauuggugucccaaacccuccauuggaaugccugguuagaggagccgauugguucagguccauaucccccuuuucuaggagucuucgcuaggguuacccucauaaauuucugggaguuuccauugcacuaggaaucuagcucuccccagaguaaccccacccaccuucacugccacauuuccaguugucucucccaguauucucucccucuguccucccuauaccugauccauccuguucccacucccccagcgagacuccucuccugucuauucuauuugcccuucacagugagauucaugcacuccccuuuaagcccuucuuguuacuuagcuucucugggucugcuaauuguaacaugguuauuugugguuaauauaacuuauaagugaguaccuaccgugcuugucuuuuggaaucaggguuaccucacucagggugaucuuuucuaguccuuucucaugaagcuccuuuggaguccuggccagucugugauaaaaucaacaauuauucucugaagagucuaaucugagggaggccacagaaggguccagccuuccccauauuucacaacuggaggaguuagaaaaaaguuuucucaaaugccgaaaaggguuauaugguagcccaaguuuggggguuuaguuaaaaaugggaaaggccuguuugaauaaaugacuuaaaaaucuucuggcucucaaugaucuuggccuacgcaagggaccacuguggcaaggagaaagaucuagcucugcaguggauaugauuccugucuagucgucuagccgugggacucugugaauccaaugguaacugccuggauuuugucuuccccaaauaccuccaagaaaccagauccauccugggggcagccuagaaaccuuauccugaugccagaauguagccaugccaacccauaggguggaggcucugggcugguccugcuguucuuaggacgguggagaacaacccaggagauggauagaucuggcugcugggaacuaccgcugaaucugcgaggcuguggguaggcagagaacuuccugucucuuguguuccccaucaccuggcccuuaaaucccauucuacacugcagcacagcauggaaugcauaaggccuagccuuugguaaaagagaaacaaacaaacaaacaaacaaacaaacaacaacaacaaaaucuguagaaugggccuuggcgcugguguaccuugcuuccaauccagggucuguccaaaucaaguuccugacugacuguuuaaacuccgggcauagucuugagugucaagcuggugaauggggccauggcauccagcuucagugggaaaucucaacuccuaggucgccuguuuuucuaugugacacacaagugcuucugucuccagcacgcacgcagggauucguuccaaggucccaggaccucugcagucacuaguuugugucuugguguugggggcagggggugcaaaaggagcaaaggauacuuuuggauguaauagguuucuagggccucuagcuggagaccuccgagggggaacggccccgguuuccagaaagaagggguggcacaaaaaagagggggugggcaaaugauggggcggggagcccugaaccacucugcguuccagggaggaggaggaaggagggcaggcccugacuagagggagggaaagaaggaauccaccaaggaggaguuuuccagccuggcuuuagaggcucugucucacuacacagccccucggucucuuggccuccuccagccccuuaagugagcugugcagccugcccugcgggggaagcgccggcucaccauggggagcccgggacuucggcccgagcugcugcugccucaaguacugccgcuguugcuggcgcugcugcacguccugccgagccagggcuucccagguaggagcuagggauugggguguguuuccccaguuagucaucuaggaaccucagaagugucugccgaacccccugcccugcaacagcaggagauggggggggucucccuuuguuuacucugaacucgucuuucgcagucccaggaagcgggucugaaagaggaguguggcucccgauuagguacaagaaacugaguucucucuugcagcgcuuggagccggagccugagcaccuucugcuccuagggcuccaagguuuaaaccaaacccucuuggcauagaaggcuaugaagagaaaguuuggccacgggcucuuuugcuucuuucucaccacacugcauagcuucuuuugcuccccaccccaaccccucacaggguuuugauggcugucagugcucuaggccugacaguuuauuuuggguagaagcuccaaaucuuggccccacucuggagcugaggagcuccgaaacucuuguggacuuuacuagccuagccgaagagccuucgugcauccucuuguccagucugcucccugcucccuccugcucccaccccaucccccgaacugcgccaaacucugggauuccgagaaaguuuguuucucuaagggagaagugccagcugagaguggugacauguggcaugcacuugguuagcaccagggaaagcaggaaaggcacaggauuguguuggagggcguggucuccaacagcuaaggggacccugguauuuacuggguuuucacagcacagggaaaauucucuuuggaagugcuuguuuaaaaauaucuaguuaacauccucacaaugaaaucucaggcuuacagaaggugucagaggggcagggcuauuuguuauggaccccuguggccuuggaaugaagagucaaucuaugcaggccccuuuaguugucuguuucuagaaaggugggccaugcauuguaaaguaugugaauaauggucuucguguuagacaucacuacgaacaguuuaaaucgggggcuugagaagaaacccccaggaagggagcuggguagauguagguaggguggcuuuuggucuuugaauguuccaaaugaguggauggauggauggauggauggauggauggaugacaugugaguuacaagacaggagcauucuuuguguuuugugcugaugcuuacagguuugaaguuucguaggaacuaauuaggggcaaagugcagagggggcuuuaccuuaguugcuagagaaaugucauuuuaugaggcugaugucuccacucacucccuuggcaauaauuguguuaaagggagcuuagaggggaucuaaaugaaagaaucucaaccucugguugagccuguccuagggaggcuccccuuuuucguuugcuauccuccccccuccugcucucuccucccugcuccuuucucuccaucucuacccuuauauaguauagcugccaagccucagacacccacagaauccuagauuugccagcucaggcacuuacuacagcuuauguuuugggacuugccuuugaguuucuuggcucagucggcuagccugcuggucccgccuccugacagccaggcagccaccagguuccucuuugccacuauuccuguugaucccucaccugcccucuggcuccacucagguacccugaagcuuugcaggagcacuucccuggaggccucacucccauuuuuuucuagucuauuucuagccuguuucuuuaagaaauauuuauuuuacuuguugauauuguauuuauaccauuuuccccuuuguuuucugcccugcaaguccuucccuauaccccacccccuugcuuucuaaacuacagaauacuauuccaauuggaguccucucuuggcacauaucaauggauuaucuugggaacugagcucugcuggggcuguugaauucaacagaggaaauuuuagucugagccagagauuguaaaagucugggaagggaaaaugcucuagacuuguacaucuggaggcauauggcaucggcuggguucacuauuaguuguggaguaacauguuuuaaagauugucucagaggcaccuauaguaugugaacaucauaucuccaggaagagccugucuaagaagauuuggaucuggaacuucacaaagagggagcuaggaauuuaggaccccaucaggauccuaauuaugcucuuagagcaacuuugucagagaaauggcaaaucuuuccuauuuccacccguagaagcucucuggaguucuucuaaaccugaauuugauguagcuuuucugggcuucuaauuuauuuuucccagccuaucaaagacugugugucuacagaagccugcaggaaguauauggaacgcuccuggcaaaguugcccaugucuguguuuggauccuuuuaagaaauggacuuguucaugaauucuauucuuaaaagaauucucacaagcuucuguaugucugagacuuuggaagcucacucuacccccugcacacaaagcugaagguggaggaugaaugcuguggucauggacaaagucuuugugaaucuuccuaguauuggagaaaacagguaaaguggugugguuuuguucauuagggaaaccuuaaagcuaaaucagaccacggcugucaaagcaggcuuuggaagugccacauuuggagauaaguaugaggaguggagcaccuggcucaggcucuacaauuaaggucucagcagaaccuggcuagaaaugucuauuugugcuuaagacauauaaucagcugacuaaauuacucugcaauauaaaagaggaucugcuagagagagaagggcauuuuugucugacauugucuuuguugagaacacuuccagccaguaaauuguuaccacuucucauuucacagauuugugaguugaauacagggcuagacacuaucaguaaggcaccaauuucagaccuuccugccuacucaguccuugcaccguaaucaaaguucgucccuucccuucuagaugaugacuguagcauuagugucucugaggcuaacucauugucugucuguuuuuuuuuugccaaauaugcgucuuuuagguggaagagugugcauguguguguauaugcguguguguuugugugugugcagguauguacauaugugugaucuugcaugugugugugcaugagugggcauauguauguauucauguauaagcuagaagucggucuaaggugucuuuuguuucuuucuaccuucacuucugaggcaggaucucucacuaaauuggaggcuuaucaauggagcaaaauuagcuggcuggagaggcacacaaacccuccugucuccuuuuauccaguucuggaauuacaaguguaugccaccacacccggcuuuucauguggaugcuggggaucugaacucaaauucuucuguacauggagcaaggacuuuacugauuaagcacucuucccagccuguaaagugggcuaauuuguagccuguauuucucuguucaaaaacuuagagcaauaacuccccaaguccacucucauguggaaggcucuccauuauauucaggaacuagauuguucuggcacaguucucaagugcuucacccauggcuuccuaaaaccuaguccaugugcacuacauggccuuuagcaguuuaguuauguuuuccuucuuuguagaugucauugccugcaucugggagugaaccacugagcucuuugacuauucaaaauucuccccauuaucuaacaacauccacauuuugaugaaaucaacugccugauccucccucccuuccucaccccucccuuucuuccuucccaguuaugggaaggggacacauggccuugugcaugcuauacauaugcuuuguggcugagcuacacuccggcucuugaaauuauuucuggaucacugaaagggaagccucaugucuuuaaacaagcacagcucucuguggcuguucugugggcuuugucacacauuucacgcacuauaagucauacacuccuuuucuagauucugaguccuaaaaaucuagguuuguacauguuuaccguuauguguauuccugcgcaugcucagcagaauaccuggugcuuauggaacuuaauuuacagugagacucugauaaucugugagagaagugcaugaguaaaugggaccuugugccaccaugaaucuacauacauaggaacuauggcuugcuagccacagaggcucauuuuaaauccacgaguacccccuguuuaagcaauaacugucucugcugggggcuguaagaugagagacugagugcagccacaagcuggagcuuggauuuauuuuuguuggccacuucauuccauguccuuccaaagcaguugaauggucuccuuaguaaacacauauauauguacuguaacaauuccccuuucagugaacacaacuaaaaguagcaauugacagcaaagaguuucaauauagguuugcuguuaccaaguuauaacauagcauggaguuuguagcugucaaguuaugauugacauucagguugaagauucucuuacaaaacagcaguacgaauaauugucucucaaguucuaguuuguaaggagaucuucgagccagucucuccaucuuuaacucuuuugaaacugacagcuuuagugggcuuuuugcuuuaagagaggcugcucuuuuccugauauauuuacauucugcuccaaaauaaaauugguuccugucuucccuaaugaaaucugagcuuuacccagacacuuacuuuaucaaauggccaugaauggugaagaggcucugugcuuggcaaaggggagugaguaaaguacugaguuucuucuuuucuguaguauccugucuccuggggaacuagacauaguuaccuccaguggccaauacuguaauguaaaugugugaugggcucuauagacucugagggagucaugcuggaacuugaccugauguugaagggugaugcuuagagauguugcugccaagauggugaugcuaaagguccaagguugcauuagaaugucuuugggcuucacuaagaaugcuuuggacugagaaacagaauucugggaaacuauuuccuccccugaggaaaagccccuuucccaauccaaauccacuauucacuagaugguuucccuuuuuucuugaacugugugagaaaaagaaaauuguggacuuaacaagcaaaagaaagagagaaggagagaaagagagaaagaaaaagaaagaaagaaagaaagaaagaaaggaaggaaggaaggaaggaagaaagagcacagaagacaaaauugcuagauagaacuuugauucaaccaaugaguagguggaggucaucucucuaguuaacaccagcuauagaauuuccaauucuccccauuuuuaaagcaaccaugggcuaaguguagcucaaaacauuagaccacauuguaugccuucaguucuguauucagugcccccucaaaguaaaacuaaaugauaaauaaagaaaaaaaucaaacaaaguagaaauaaacauagauugaaauugugccugcucuugauuaacacaaagucugagaucugagggaguguauuuaggucaauauucaggguauucauugucugaaguaguugugaauaagacccaaacuauucaauucaaauaucucuguaacauguaacagaauuuccaagauuacuucccagagacaaaggaauggaagauaaaaugucagugaauauuuacaauccucugaauaaaagagccaauuggguaggaagcaagucagggcauacuuagcugaugagaccuuuggauaucaaauugcccuaagacaauauuuuaagugauuuagacucugggaaguuuacacauucugaggguaagguuugcagauaaagauuuaaaacgaaggcuugcaccaaauguucuuagcaauacugcuaugcagccaaguucccaagguaauaauugauuacaccuggaucuuaugagcacauggaacaaucuggcuucagaaagcuccugaggaugcauuccuuagagaaaugaugcacucauccauaauucuagcucauaguggguguuucucucugugcauugcucuucaggaagaagauaaauggguuuggauccacugacucagauuaucccaggaacuuggaguuauacaucacauauauuuguuuaaaaaccuuuucaauaaguuagauuggcagaguuuuugcuuggcuuucuuuuuuuuuuuuuuuuuuuuuugcaauaguuuuucugugaugaucuuauagggacugguagugugauuagucccaugugccaacaauuuguuuuuuuuucugccaccaucacaaugucccuccaguuguguuuaaugggcacaucuucaaugcagcugcacccuagcauucucuaaugauuugucuuggucugugccuuguguggguggcugggcugaauaacccugccugguacaggcuuccaagaauauucaagcacauuaguuaaauuggagccacggggcaagaauuaagccaaaagauuuugggcccacaguggaauguugcagaagcaauggugcuguucauggccccuauuuuuuggaacucaguucccacauggccauuccuuauaggaacucuccagacacauuaucucugacucauuugccuguggccaaagguaaaaugcuguuucaauuuagauuuuuuuucuaucucagcuuuuuagguaguagaaucacacucuuucaguauuagcuaugcagagaucuaauuuucucacccaugugggccaauuauaggaucuuuuaaauuuuccuagucccauaauuuaacagggaaccuggcuccaagaggauaaugucaucaagagaggaugguucuagccagcuucaacccacccaccuggauggcugucucagacucuaucuagauugcugggggaguuucuuucuuucguacccagguuccucugagcaggcagccuaauucuucugcuggggauucuuggacagugaggaugccucagacaugaaauuuucaugcauuuuagggaggagccucucaugccucuugggaugagacauccucaguugggauagcuggagucacaagccgagcuacagcuagagcuuggcgaagugaaucacccgaccuccuauaggcugauauuggaauuuaccucugcaaugacuacuucacauuaagcucuuuccuggguucaagugcuagacaaacuaggauaagcuaugcuacagcaucaguauuuauaugaauucuuggguacccucucauucaucuuagcgcuggguuacuugggcauuucucaguggcuuugagaagcuccugacccaaggcuagcucuugaucucuuuuaaggcauuagggucccauaagcuuugucuccacacugcuuguuuggaguugcacaccugauuugugguaacaguuuaacagcuuuauggagacauaauucacccccuccagcauuugcccauugaaacugugcacuuuagugguuguauuauauucauggaguucauuguaaucaauuuuaggacauuuuuauuaucccccaaagagacucaugccuuuuggcugucacugcccaaucccuuuucauuccaacugcuaggcaaccacuagcuuauucucugccucuauagcugugccucuucuuuacauucuuuagaaguuaaguugcaugaaacuugucuuuuugugauuuaugucucucauuuagcccaagguuuucaagggucauccaugcugucaauuccauuccauggauaucuuccauuauacuuaucuauugaucaguuauuacucauauggguugcuuccacuucaagucuuuugggaaugauguugcagugaacauuaguguacagguuuuuguggggacauauacuuuuauuucucuuggccaguuaccugggaauggaacauccaggucauaugcucacucuaggacaaacaucuaggaaacuaccgaacucuuuucccagaaagacuacaucuuuuuaccuucucacuaguaauauguucuaacaucuguauagccucagcaucucugaggguucuuacacugauuuucuuuucuauuaaguaauuuacucucaaguauugagugacaaaacugugucuuuucugcaaauaaugaagggcuacgccagagaaagucacugguaucugcucuuucauuguuggcuggaggaguacugcuagcccacaaugcacucacuucucauugaauaagauaaaaaaaaaaaaagaagaagaagaagaagaagaagaagcccagucucuacauguuuaguuagacgggcagagaauucuaucuggagacauuuugggcuaauucagaaauaugggcaagcccaagauucaagacuaggaaaggaggggcugacuaguguggugguccugguugcucuuuugguggguguuauggugugggaaagaaacucccuggacaggcaugcaagcaaugcugaaugauaguggcuuagccucaaauaagacaaagcuguggaucugguauuuuuuuuuaaagcauauggguauuuaaaaggaaaauauaacaaaaaagcugugcuugcauuucuacgagauccucguugcacccuugggucaucuggaaccaagucaaaaauucagaugccuaggcuccacccaagacucgcugaaucagcauuuacauuuuacccagagccugcagaggaacuguagaugaggauauuugcauacuggucugaugaaagagugcagccuuugccaaaacagauuggcuugccuguuuagaauugcuacacaauggcucacuuccccuccucucccuuuugugguugguuuugacuucaucacugaaugaaucuuucuggauuuucaucguaaguccuuuauaauccugagauaaacaugugcaccuuuaaauucuuagucccuucucuaacucaaaauacaaaccuucaauccuucaagucuuucuuucuuucuuucuuucuuucuuucuuucuuucuuucuuucuuucuuucuuucuuucuuccuuccuuucuuucuuucuuucuuucuuucuuucuuucuuccuugacuucaacuauuuuuuaaaagucugcuuagcaauaagaguacagucccugccugaccuaacccagaauaacaacaaagcauaucuucagauugaccaguaacaggggcuuugaguagcuuuccccugcagcuaauaauuuuaguugaacaauuuuagcuaguuaggaggaggaggaggaagaggagaaguagcaagagcaagagaaagagacagagagaagaacaaguugaguguuauugaauccucagcuacccuggaggguaaggaaaggguauuaucuaaguuaagaccugcuugagauacagaaugaauccaggggucauuuagugagauccugucucaaaaacaaaaaagaaguugcagauauggcucagagaaagagugcuucccuaucacaggggagguccuaaguuuaaccccuaagauugaaaaggacaaagacuaucuggggggugguggugcccaccucugaucucagcacucaggaggcagagucgggcagaucucugaguucaaggccagacugcucuacagacuguguucuaggacaaccaggguuacacagagaaaccccaucucgaaaagcaaaauggaaaaaaaaaaaaaaggaaagaaaaagaaaaggaauuuuacaaaaaggacaaggaggaagaagaagggggauuaucugucuucauacuagaaaccaauaugaaagagguuagagaagaggugagaacuuggagaaaggaagccagugcggaggucaggagaacacaucagcccuggaaggucuccagacugggaagacuaggaugauggagcugcucaauggcaucuaaaaggauuauguuggggugggcaugugguuauaaacccagaccuggucuuuagaaagacagaauugggauuauuuggagagagucugaugaauuuuaaucugauagaucuggaauaacgaauaguuaauuugggugcaguuugcaaauuaauucaggcaugcucuauuugcccccuuccuguuuucauaucaucaguugaucaaacgguuuaaaguuuuaaguaguaaaaguacuccaaaggagauugauaauuccuuucugaucauuugaacacaacuuuguuaauuuacuuauguacaguauguaccuauguggugauauaaagauaauauuguauuguuucgucagagaucacagggcuuaugaaacuaaaaacgguuugucucuaaagucugccaaucccuaauggaaggucuugcuucugaaaguguaaccugaggcucagcuuuuccugguagcuuuagaaauuuuagauuuugaacagcaauccaaagcuaggaaguugcagccugccuuuuaucaggagaugccgagguguuuggaauugcuucuuccccaucaguagacccaacucgggacucaucuaggccagcauacuauaauggacacuguacucucuacucuuaauuuauauggcacauaacuguauaucuaguuuucuauguuuggggacuguaauacccagacaucucaaacucucuagaaauuaaguucucauuuuagucuuuccagucuuuagcuaaaucucaguguucuaacccaaacuggaaauggucuggccugaggcugcagacucugguuucucuggcuccaugguccuuccaggaucucccuacauugauauggcucaaagcccucuaaugucuuguauacacuuauuugaagcacugcuucccagaggugcacagaugucuccuguuuauguagguuguauugucauuaaguugagaugugcuggguccuaagaucugaauacaguuugccucccuacaaagcucagcaugagauaugcuuaccauugugcgggugaguuugaagagauuauuggaacagccagaaggcuugaugccuuucauaggaccagaucagguauggugauugcgggcuauuauaaagcaaggcaucuuuacuuacuugcucuucuccuuuucacugggaguuuuuaauaagaggcugucaccauauguaacuuucuaccuugaacuucccaaccuccagaacugccaaccaagauaagucugguuucaaucuugcagucauggguguuugguuguagcaacagacaguggccccaaacagaagauugaguguuucuuuagugcaggggcucccagggucaucaguauguaaccgucugggaggggacugggaagaauauccucaacucacgauccacagaccaguacaaauuacaggaccacucaagaauaugugacguaaauacauucucagacccuccccuaggauuaaugaaccagaaacagaguccugauaaaguugugccuagcaauguguguucuucucacacagucauguaugagggucauucguucggacaauuucagaucaauuuuuucagaacaucuagcgaaagaaacucguguuucacuuaucauuuuaaugagaaccauuuacuugcuuuaaauuuuaggacaggaccuugggaaacaccauacugaacuuaccgaguagggacgagcacagcaggcuucugaggugaagucaucucuuggagauuugucucucagacaagcagcuuaucugcacacuuggguugagaaaaguuucuccaggucagcaggcagcaucuggcugaugcaaacacagauuuuuuuacaguggguuucuggagguuaaaaugugcggaaggcuggggagcagcccuggggcuauuucuucuccuaugcaugauucauucuuucagaauucucaucugugggagacugcuagucugcaggcagugauucucaguacaaauggcugucccugcguuuuagagcucaggccauuucuucucauucuagaacuucucccucggagucucuaggaggaacagaaauauuacagccucagaucuucauguaaacauucuuucuuuuuugcucccaguagguuuguaucugcuacauugucacuuagucucagagucccaguaacaauaagccauuugggagacugagugaaguugaaggagccacuauaacuuauuguacuuccuuugagagcugacugcuggggucaagccagugaaaggaguucaggacgagaaaccuucucugaccuagauuuucaucaagaauggaugagacaacugacaacuuugauucuuauacuucuuuuugggagagaaaauaaaacuccuaugcgguagcucacugcugucugcccugcacucugaaagcuugugcucagcuuuaaaauggcccggcccaccugaugcacguaugagcugcagcucugcugaccacacuuucaugaugcuuuuaaaaaugauaaaaagaaguugggguguagcucagugcuagagcgcuuagcaguugcaaggccccgaguguaagcuuucagcacagaaaaaaaaauuguuuagaggcaaaucacauuuauuguaaaagcucuuagagacauggcaagauggaaggagguuugccucuuauuuuccucugcacucuauuuuuucccuaaaaucacugcgcugaucaguuugguauaaacgccuagaaauuuuucucugugugcauuuuuauaaagacacaaguuguuaauaaugcauugccacacgaagcaacaaugauaaauacauggaguuaucuccuuugccaggaaacagaggcccaugagauauauggcuguacaagugagugugguacaagaaauaucucuguggcucucucccacccucacuagcugucagagaccguguguccucagacagggccuuggucuguggccuugcucaaagccuggcugcaaacucccuuccucucuucaauuuuuguugugucccgggcacuauuuguggacaguuaaguuaaccuuuuuggagggccauaugacacaccacaaauugcuuuuguuccaucaucugguuucacuuuaaaggguagccuucuuccuucugucugaguugagugggaacaguuagguuucagagcuuuggaaaugguccucaguggaaacaggaguuagcauuagcuaaggucccuuguguugugccgaugcccucgguuuuagguaccuguauuuuuccuguuccuacucugucucuaagaauuaaauaaugggcuugguucuucaaacuauuaagcaauaugaggcuauccuggaaaaacguauucuuuuuucuuuuccuuuggaccagagcgaugcuuucaucuauaaauuuauccuuucagcuuccuuccuuccuuccuuccuuccuuccuuccuuccuuccuuccuuccuuccuuccuuccuaccuuccucccucccucccucccucccucccuuccucccucccucccucucucucucucuuucuuucuuucuuucuuucuuuuuucuuaauuucuuucuuucucucucuuucucucuuucuuucucucuuucuuucuuucuuucuuucuuuuuucuuaauuucuuucuuucucucucuuucucucuuucuuucucucuuucuuucuuucuuucuuucuuuuuucuuaauuucuuucuuucucucucuuucucucuuucuuucucucuuucuuucuuucuuucuuucuuucuuucuuucuuucuuucuuucuuucuuucuuucuuucuuucuuucaccugaaauauggccacaauuaaaauuucacaagccacaugcugucuucauugucuuggcuaauuaaaagcagaguacuuggagacuaagggcgccaucuccucugccuagaauuuuccucuggggauuuucugcagaaguauuuaaacugguggugggacauugucccagaugaagcagcuauagaagcaaggcuaauucgaagaguucaugucucacaaguuuuaccuucccacgcuccacccacgacacugccaguuuuucuugaugaaaucaaguucaaugggcacauaggaacacucuggacagggaaaaguuagccuaaggacuguaguuggguacaagagguaaaauuccucagugagauagaaccccagucauccacaguggugaaccccagcaguugcccaguaagcaguaucauuuuggccuacccuuccuucuuugccucucuuucucuacccaucauuauacaucccccccaaauuaacuacuguauccugucuuaagaucugcuuugggggauggcaaacauuagcuaugauggaauuuaacccuggccucuugaaguuauuuauuuuaacugauaaauugauacuuguuagauagagauguauaaugagggguucugagauaggagcuuggaaguuguuuagguaggcaugaaacuaccuaaaauuuggugguucaaaucaauagcaaccaaguacuugcucaugagaguuuggucagaauuuaguguggaaggcuaauuucugaccuauauacuguuggcugugugccuuuaucuagggcugcuggauccaagaugacgcaauucacauauuugguacuucaucugcaauggcuauaccccacccccaccucuaugucuuucagucccuugugggucagaccaguaucucuguccagcaaacuaaauggacauguuuguauuugaguagcuucccaauagaguaaaagcaaacccugccaggaugcuacugaaaagcccaggucuggaacugacacagcaucacuuuugcugaaaaauuuuaaggaaaaugacaaggcagccugauuuuuagguuggaaguaauagcuaaaguugguagauuguaacguguaauagauuggaauaauaguacaaauggggggauugauaguaguuaacuuggaaagaacuccacucuaggacugguuugggaauggaagcuagagauauuaguuuaacauucuggguuguuuucuggguacauucugauucagugaugaacucuaaguuaguuauccaacugcuauggcuuagguaugaaauaucccucauaggucaugaguuaaagcuugauucccagugcaauguucagagguagggauuuggggaagugaaugaaccaugaagccccugacauagucaauggaauaauucauugaaaguucauagccugauggcauuauugagagacaauggaaacuagguggggccucauuggaguaaguggaccacugaaaacauacuuccaaugauauaucuuguuucuguauccuuccuuguugggucacucugucuccugaccaccacgaagugagcagcucaagucuccuaugcucucucugccaggaugcucugcuuuaccacuggcagacacugugaggccaaauagccauggacugaaacuucugagaccaugaaccaaaauaaaucuuuaugucguuuaucucaacacauuuugucacagugaugaaauguagcuagcauaccaaugguauuuaacucauccgguagacaacagcaugaagacagagaauguauucauggacgguucuuguacugaaucaacuggcauuuauggaaaugugcaaaacucauuucccauugguuacuaguacuagcacugccuaccuucccuucaaauuugcucucuuccuccaucaaugcaaaaacauuauuauguggacacuagcuaauaauacacaauagaccuaaauaugaagccuguaagaauucuugauaauaacaucagagaaaguguuuguaagcuugaguaaagacauuuuuagauauaacagcuaaaacauggucuacaaaggguacagggaauuaauugugcuucauccaaauugaaauuguuuacucuuuagaacauacuauuaagggaaugaagagaaaaaucagaauggagagacuauuuuuaaaugacaugucugauaaagggcuauuauuccaaauauauaaagaacacucugaacucaauaacaauaagcaaccccaugagaagauacuuaacauccucauucaccuacuaacaaugggaccaacauggcuaauauaacuguugcuuucaucuaccaaaaaugggaacaaagucaccuuuucuuuuuggaaucugacuuucacuguauagugcaaauacaacauguauguauuccuaucaagaagggauuugcacacauuuacuaucccuguagagagcugacuggcuauuuuauguuucccuuacuagaauuuaugugacacacauccacaaauugcuagccaggaacuuuaagaaaccacuggacaccagcaauuugaagcagaucauuuacuguaagcucaagaggacaugggugucuuccaccaugccuuucuaagccuguuuaggcugcuagggcucccuaaaaaccucccuucaucuacuucuauucucaaguacaugauguccucucacuucaaggaaccggccucguuuuggccucaugacacagggauuuaguaucguugguacuacuagcacauacaagauuuaaaucgccuugauguuuuucuucgaauucauuuauacuugguguuaaagucugaaauauauuauuuuuacuuuuuuucuaggaacagaugcuaaauuaaauacucaguguucaguaaggacacugauuuuaugaugaguaagaaauaacauuuuucauuuaguuucuaaauuuggaauaagaaucuuggaugaacagcugcaaugucccaaacaguuuuuuuuuccauuucugugaaccccaaaggcacuucaugcacuuaacauuccagaaauuccuagaauagaaauaaaaaagaagaccaugcagaaguuuuguuuuguuuugauauguauguauauauguauguauguauguauguauguauguauguguguauuguuucuuuuuaauaagcauacaaaguaacaaguuucauuuaacuaugacauuuuuguacauccuuuguuuugguugaucuuucucccccacuucucuuccagauccaccucugauuaccagucuccugcauuccacuaguccccuuuccacuucagugucauuuguaucacccucuuuuaccccucugauuuaaaccuucuaccucuccucucauguuccuguuccugguuuuaugacccaugaauauucccccauagacauaugcacauaaaaaaauucaguuaagauucacauaugcgagauaccauguaagcuucaucugccugacucuggaugccccccacuugguaaaguauuuuccagauucauccauauuccuaugaacuucaagguuucauuuuuaaaucuguuacuucaguaacuuuuucaaaagauuacucagaguuuggaguagcucugugcuguuucugcugaugccuaucccugcagggaugaugucuguaacgucuugauuacuggagcuuugcagugugguuccuccaaauuuacucuggcuucaugaaaucacucuagacauacauuccaacaaaaaucuugcugagauuaauauugguauuauuuuaauucuaucgaugaacuuggggagugaauugaugucuuuuuuuuuuucuuucuauuugaaauuuccaaccuaugagcacaguucaaaucuguacuuauuugggucuuauuugacuuuguuuauuaaccuuuuguugucauuuucaguuaaggagauaaaaacacauuuuauuggauuuguaaguauuucuuuuuaaauuuguguuucuucauuuuucuuacuuuuugaaugucuuuugcuuauuuacuugaaauuuaaugcaucuuauaauguagagagaugacuggcaugcucaucaucagaaaacucugcuauuuaaagagauaucuaguaaggugagagguggaaaaaaagucaaaaaggugggaaaugaugguuuccuggaaucgcaguuccagaggaugauaugucugucccuugcauagacacaaauuuuauuugguccucaaaauaaauauagucuugggggcuggaggggauacucaguagugaagagucuuuuugcugcucuuacaggggacccagguucaguucccagcaugcacaugaggcaaguuccagccaucuauaauuccaguuucagaagacucuguccccacugcuggccuuccuggucauuuuaugcacaugaugcacacaauggacacacacauacacauacacacacacucacucuaaauaaaugucuuuaaaaaguaaacauaguuucaaccaaaacaauuuuuuucucauaagacaaugugaauauauuugaauaaugaaagaaacauaaagugauugacuguauauagaaugcagaugcgcuucugauccacuagauagcucaucugagaguggacaagcaauccugccuguagccugugggaaggaaauuagagaauugggagaauucaguaacaaauuuaguaaaaucuuuuaugccagugaggguuuuguuuuuaauuaaacgauucaauuaauugcuuuggggcccccguauugguauuaucacacguuacacuccuucucaaugcaacugaaaugcucuacuuguuuauaaaagagucaucuuuuauagaagaacaaggcaggcuuccuuuuguaguauaaccaaguaauggcgcugucugcccuagaccaggcaggucauguacugagugguguuacuucaaguguacuauacuucuuauucaaucuaagccauuuuaaauccggaaugaaucagcuggguuuuuuuuucuuucaaauuuauuuauuuauuuauuuauuuauuuauuuauuuauuuauagagcacaugccugaguguuuugccuccauauaugugaguauaccacauagaugccauacccauggguuccagaaaagagccugugaugccaugguccuggaauugcaaugguucugugacaccaaguaggugcugagaaccaaagccuuuugcaauagcaguaggaacucucaacugcaaagccccuucuccaggcccagccucacaucauuuuguuaagcagacagcuaucugaaaaugacuucagcuuacuuccaaugauaucugaguuucagaaaacaaauccacauuaauacccagguuuuauucaaaacaucaguaagucauagccuccaauuuccuggcuccuuaaagucuuuuccuuuaaaccaacuaugcugccaugugcuucagcaauugcuuguauauaaaucaucauugaagcuuaaaauugaauguugaugcuucaaguagagcgucugugguuguuugagggagaacagcuuccauaggcgaacauguuugaguguuugauuuccaguuggugacauauuuagggaggauuaggaggggugaccuuauuggagaaggugugucacugggggugaccuuugagguuuccaaagaccaugucauucccagugaccucucucuuucugccuacugccuguguaaguaaggauguaaguaccugccugccaccacgcuccccuuccugauagugcuuuuaaauguugccuuagucguggugucucuccacgggaauagaacagaaaacuaagacagaaucuaaccucauaucuaagacuuuuucucaucuuaucucgcccucaucuguuuucuauguguacuccauuguaaugucugugucuuaauuguaaagauagucaauaagauagacaaauuccauaugcaaggagcauucuaaaagcuggugggauuggccaaagucauauagccaggugauaggguagauucguaguacuucacucucuugauuuuuauagaaaacguguggaauucucagacucuuguuucagagucuagcauagcgaaguauuuuuucccauugguguguguguguguguguguguguguguguguguguguguguaguguaugacuguguaugcaugugcauguuguucucugcuuuauuuaucaaugcagccuaucagcugaacccagagcuugcugauaagccuuguccagggcagccagcucccuccagagauuacccugucuguuagcauuuucuaggcuccgcccggcaguuaccuuacagggcaacagcucccugugccugacucaguauaaaaggggcugcuugcucccucugcucucucuugucuucuugcuuucacucugcccucccucucagcuuccccucucuccccaccccccucucuccacgugcucauggacaaccucugcuccucuacacucucccucucccucccuuccuucccccaucucucugccuuucucugucucuacuacccucugaacucccccuccccaugcccugaauaaacucuauucuauacuguggcugguuccccagugggaagggaugccucagcaugggccccgcagaggcacccccucccaccacaccuuaccacaccuccaccaaacauauuccuucuuuuuuuauuuuuauaaaacacaacacugacuuugccuccuggaauuacaggaaagucaccacaucaaccuggcauucuccugaguucuggggaucuaaaccuugugcuuccuguucacauagcaagcccuuuaauuacugagccauuucccaacugcuuaauacacguuuguuucaauggcaacuuucuuuccauaccugacaaguaugugcaagaaaaccaauuuguuaugcuaaaaaucaggaugguagcaggaucuggucauguucuauuuaaugauuuuaaugguguuacauggguauguucaguuuauagaaauuuauuuauagacuuguguuuguaaaaaaaaaauagaauguuuagaacucuggguauacuucaguuguagaaaucuugcaugguguuaugaaauuugaaugcaaaaugucccucauguacuuauguuugcgugcaugugugugugugugugugugugugugugugugugugugugugugugugugugcucgugcauauucucugccuuauucauugauacagccuaucaaugagaagcuuacaaggcgcucuugcuucucagcugauaguauggcuuuaggucaagggaccuucaagagugagaugggaguggaaugaaacugguagacauuuagaaguuacaucccagcccugauuccauucuuauaucuguguguccuaaccaguuauaaucugagaagcagcagcuauaacaccagcacuccggaggcugaggcagggggaauuguagguuugaggcuagcccuuacauagagagguccacacuauauugaaagacccuguggaagaugaaggagaaagaaaaggcauacaaaaaauggaucauuucaguaguggaugugcuggggcaacugggagaucagugcuguaugauccugaccccugauuuuuccuuggacuucauugaaauauuuacuagugccuugugcagugcgacaaguaaucucuccccuccauuauaaggauucacuucccuccagaagccuuuuauucugcucuccacagcacuauucccuccuggugccuacaugauguuugugccaugagugauccagggucuuaagaggagccaucugucacagagcagagacgaagucguaaccauguggugguuuuggccaccaccccacaaugcuugcuguagcuuguuuaauauucacuaucugugcuuccacaagccagggcacaucuguauuuguaucauucuugugugucuguacucuaggcuuucaaauaacaugugcaaugaagagcuugaagcuaauuuuccagaugauaugauagcucccaaaacucucucucucucccucucccucucucccucucucucucucucucucucucucucucucucucucucucucacacacacacacacacacacacacacacacacuaguuccaucacaugaaauuagcauccucugauacucuguacucucuucuuucccugucuuagcacaguaggggcaggaaccuguuuauaaccaccagcauauugaacauuguccaucuucucuuuccucuucaagcuguacaaaauuaauuuccauuugcuuuuauuuuauuuaugguaugggcagucaguggccagaacccagggauuauauuucucuuuaauuuaauuuucugcaagguauaacucuaaaguuuccuuaacauuuaauaaagugcuuauuuucuuacuuauuacaaaaucuagucuauagauuuaaaaacaaaacaaaauaaagcaaaaaaaauuguuucgauuuacuuauugauuuuuggucaaacucuugguauucuguccaggcaaucccaaacuccugaucuuuuuauucuuuuucuuuuucucucuuuucuuuucuuuucuucucuuuucuucucuuuucuucucuuuucuucucuuuucuucucuucucuucucuucucuucucuucucuucucuucucuucucuucucuucucuucucuucucuuuucuuuucuucagcuuuccuaguaacugggagauaagugccuccugugaugccugguaccuuugcuuuugcuuguuuguuuguuuguccuugcuuucuuuacagcaucuuucauagugucucuguccuuaaagcauggcucugaaaacuuguuuacauagucucaugcuuggugugguugauucuguccaggaaaagucagacuucuguagagucgccucuguccucuugcagaucacuguuuguugcuuuguucucuccccacccccuacccuggaagcuguaccuucaugauguagguagcucgcuggcugcucuuuccaaaaucuaugaagguaacucugcauuaagcuguguguacaggucaacaugagaagacacaagucuucaggcuuggauuucuauuaaacuccuuccuguauauuugaaagagacuaccagcacugaugcuuuguuugugugucaguuuagaacaucauuaaucagugcugaagacauccugcacuaucuucccucagcugagaugggcaguucccacacaugcauaugguucccugucacauggcugcaagucuagucucucugaggcuuucuacccaggcucuacucaguacccugagaccugguucagcuccaaguucuggaauaacaggugauuaauauaacuaagccaagaagaggagagagucaguggacagauucccucagcgcccauggcccugcauggguuguaucucuugcauuuccucaguggagaggaguccagguuaucucugaaaguguccugcuuacaagacuacuuucaggagcuucccccuuuuucuuuuauccuauccccuacuuuauuguuaugcuuccaagaaucaccucccaauggacugccagcauuuaauuucuugucucauguagggucuacguugggagaaauaaaaaccaugaaaguauccagucuaguuuacuuaacuuauuuuucuuuuccuaguucuuauucuuccauuaauaaaacuacacagagaucuacagaauaucuccugagaggauagugccuguucauggguuguggguuuuguucagucaguauuuaucgauauuuuuccaagacaaaguagaauagaguagacaaugaaaaagugcaugguacuucauguauuguucuguaaaacaaauuucaguuguauaaaucuauauguauuuggggucacaagagaaaacauauuucucacugugauuuacaauaaaaggcuaaaaauaaaucauuguucucugcuaacauaauucagcaaucaguacuucuuuaaaagaccggucuguguuuauaccauugcauauacuguaucaaacaugacauucuguaggggaaaccaaagcaaugaaugacuuuggagagguuuguucuuuucuguuuuuguuucucuuauuuuugagaugauaauauaauuacaucaucgcucuaaacccuccaauauaccuuccuuacuuucuuuaaaauucaugguuucuuucuucauuaauuacuauauauauguguguguguguguguguguguguguguguguauaccuaaauacauaaauauaaccugaucagucugugaaauauuacuuauaaguauguauguauaucauucauguucuuuucaaaccaauacaaauucaaaaucauugucauucuaaaaguaucuuucaauugugaaguuaauaagauauucucagguuauauccaaggguaaaacugacauuuuugugucuauaguuuccauaccccauguuuuaacaguuuuggguaguauccacuuaaagacuuugaugccgccuugaauacccuuaauuuuucugugauugugaggagguauuuuaccguacacucuccaauguucaggccuacagacauauuuucccuggaacuagaacuuggaguccauggaaaguaagcaucuguggucuuaaucuguggucuuagugcuauuaauuucuucuugauuggugccuuuuucuaaaauguauguuaaaacaagaaaauuuagggcugcauuuugaggaagaaguuuugauugucccagugaaaaacuguugaaaacagcuugugaguugucaguauugguuguguuuccaaacuuugaguuugcaucaggaugcucucaguccuugauguuggcgccuguaucagaugaucucccaaagcauucccagagcuaagacucuaaguucauuggcaagcaugacugcugguuggaagcccaaaugguucuucuuaaguacuucugggagaaacaaauucugauaauugcaaacaaaugaucaacaaaccuaacaaacaagcucuuugagucaaagggauuuuaauggcuaugguuuaaguuuuuaaauuaaacaugaagcagaacagaauauuuauaugucuuccuuauuuuguuuguggcaucagggauuugaucaaggaccucacacuaguuagacaaguauacuacuauguucuuagcaauagauuauuuauauaauaugaauaagguaaaaguacagcaagcaugucuauuugguaauuuaauaagaacauaaagugugauuuuguagugcuuauuaguucuggccagaagcuaugcuuuuuauaccuccucagauauaaccaauauccuaaauucuacacuuaccauuccuuuuauuuucuuuauauuauuaccaaauauauuuauauuucuuuuuuaaauguuuuacuuuuauuaaauguuuucuucauuuacauuucaaaugcuaucuccaaggcccccuauacccuccccccgcccugcuucccaacccacccacucccgcuuucuggcccuggcauuccccuguacuggggcauauaaucuucucaagaccaagggccucuccucccauugauggcugacuaggccauccucugcuucaugugcagcuagagacacaagcucagggggguacugguuaguucauauuguuguuccaccuauaggauugcagaccccuucagcuccuuggguacuuucucuagcuccuccauugggggcccuguguuccauccaauagaugacugugagcauccacuucuguauuugccaggcacuggcauagccucacaagagacagcuaugucaggguccugucagcaaaaucuuucuggcauaugcaccagugucuguguuuggugguaguauaugggaugugauaugauuaaaaacauguuuuugaccuuaguauaauuggacugaguguaugcuuuuugcaauuuacuuuuauuuucacuuaauaucauauucuuggaauuacuccucuuauugcaugagguuaugacuuagacaaaaguauucacuuuauuuggagagaucucauuguguaaauaugucauaguucaucuauguuacuucuugcaugcauuuggauucuuguugguuuuauaaaguuauaaacagugcuauugguagaauaaaaaucuauuuccuugguaaacugcacaggauuuuuuccagaaguaauacccaggaguggauuuccuggaccauagugcaugcuaucuuugauuuuuuuucuaguaaggccaaguuguuuacaaaagagauuauauuaacgugaacuugugcugccuguacuggacacccuuugucaacacuugaccagaucguaaggacauuuucugagucaguaaguaugaacuaguaugggcaucuaggggaagccagagaaggaggaacgucuucucuaauaugcugacuugaguggucucuugaguuugucuuccauaauccagagcuuaccagugcaugagaaucaaugcucuguuuuggcagcuguccucagaaugaaagggagccuuaauacugucuacccuggccagaugucugcugcuuuagaaguuuuggguccuguguguccucucuauuauucuaggcucaaagcaaaaacugaaaggccuuuguauuuuuuuuccccauccaggauguuuaguggcuuucccucugaggacaguccgaguggcucauuacacuacccaaaguagacuucuuaagucuugauuuuuuuuuuuuuagcuuaugguucauuuucauuguaucucauggaauugggugagaguacucuaguaguuugaauggcacauuaccuccuguaacugccuuccucugauucauaagcuagaaauuuaucaguggagauggcuagcccacaacuucaucaagaauuuauaauaaaaugcuccaucuuuguuccugcauuucuuuuagacugaacccccaccccaggcacauauguagcagagggcugucuuguccugcagagaccugauacaggguggggaauacccagagugagaccacucucagaggugaaggggaggguggauggguguagggacucugugaggggagaaccaggaaggagcauuguuugggaugcaaauagauaaauuaaucaauuaauuaaaaauuaagaugcaaguugcuaguuuguuaagaguuuagauuuguuuuguguauauguucaucaguagagaaaagucaugcucaccgugguuaccauucagugccugcuuuaauuucuuacuccgaauuccuugcucaggauuucacugaagugagaguggguuuaggaaacauucauucucugaaaaugcccugacauggcauuauaaacuuuucuuaauaacaaaaacucucagauaucccauuugacuauguauaauuuaaauauggcaugaccacuauauuacuauacaucauuuuauaagucauaccuauaaagcagacauugacaauuuuugugagggauggaaacauuccauguacauuucuuuuccuuuggauaacuuucauugacuacacugacucaauucaauaacuuuguaaauggccuguguuauguaccuuugccacugcuguguuaacaugucagaaagaacaacuucaaaggaggaaggagcauuaguucauaaguucugaugguucagucugugguuacuuggcuacauguguuuggcuaggccuggagugaggccagcugucaugaugguaggagcauguggcagaagaugcucacuuuauggcaggcaaaggaaggaaaaggcugcagaccauguguagcauucaaagcuaugccuccaguaaucuuuccagcaggccauaccuacucaaguuuucaccauuuucugaaauaauaucagcugagaacaaguugaacuuauuugugugcauuuguguguguauguuuguuuguguuuagugaaacauggugcugcuaugcaggucauguuguccuugaacugguggcccuccuacuucuguuuucugaauggugagaucauagaugcauaccaccaugcccggccacuggacuuuauuuuggccaacaaaucugaaucagguggugcugcacaaaauggccacuccauggugaaagacgaggaacaccuuccauuucccuccuugcuucucucuuauccuggccucauaucugcucacuaggauauuagggcauuuucucagaaagacucaguuuuggaaaagucaccguaagugugacugcuuccuuucucacugguucaugauuucugacagcagaccacauuccugcaaaugagcacuucagcagccccgccaagcucuuccuuauacagucuugucuugauguuggugcucacugaugaucuacggugcugaacgaaggacaagguacuuggcacuguaggcccuucuccagcaaggggcugagaaaaggccaacugguucaugggguuuuuguauugacaaguugccuugggagcaguuaaaaacaaugaaacaauaaaagugguaauguauguuuacauuugcaguuuuuaaacuuugaaagcuuugcucucuggauuugguaaggaaaaccaggacacacauagaagcauccaucucuauagucaggucuuuguugaaaucuugggagaaugaaauugguaaccugugggauggcuuuacuagaaacaaaaugagcuugaguguuguguccagggcaggggcuuacacaugugggaguuaggcgagugaccccauguuuaagggucacagaacuagccaagguacaucuggaguucuagcauuauggcuaaaaacaacucuaauggaguauauaggggaccuggccgcauugaugauaugauuuauaaggcauguccaccaguuuuaugcuagugugacaaaugucuuaggugaaaaacuaccagaaagaaagcuuauuuguacucauggucucagaaguccauggaugcugacuuggcccuuuuccuuugagccugaaaugguacaguacauuauuacaacagcgauuggcagagggauucucacuuuauaucauacaguugauacgaagggaggcaaggagagagguggacggugagacacacacacaggagagaaauagguaucuagauagauagauagauagauaaugagagaauagggaccaugauccuacuaauuaaugaaguuucaggcuaacaagcaagcuuuuaaucuacaacacauaauuauauaauuauuucagauaauaagaaauaaagauaucaguuaauaauuaaauuaugucauguugcuaacuguagacuucaucuagaguucagaguaauuaaaauguaaaagugcuuuuauagucuaugaauuguguguguguguguguaugaaagagagguuuuacgcaugcucucuuaauauguagaaaguccauuguacguuuugcuauuuucaggggcuuaugaguacuuaauguacuuuuucaauuccaaaauaaugacuuuuaucaagacgaaggcuacuuacuggguaugguggcacaggucuuuaaacuugucacuuaggaggcauagucagcucaauagaucucugaauuugcugccagccuggucuacauagugagcuucaggggagucaaggcuacagugagacugcaucuuuauaaaaaaauuaauuaauugcaaaaaugaaagaaauaaaagaugaaagucccacuaaauuauggaacccacuauaaguguuuuaaauuugagccucaguauuaucaguuugaaaacagaguauuggaaguaagcacuaggagcaauuucuaauagccuuuuguuuaagacacaauucuugagggcauaugacauugaacuaacuuugggaaggggacaguggcugguuuuguguaucaacuugacacagcuggaguucaaagagaaaggagcuucaguuggggaaaugccuccaugagauccagcuguaaggcauuuucucaauuagugaucaaggggaaaggcccccuugugggugggaccaucucugggcugguagucuuggguucuauaagagagcaggcugaguaagccaggggaagcaagccaguaaggaauaucccuccagggccucugcaucagcuccuauuccugaccuguuugaguuccuguccuaacuuccuuggugaugaacagcaauguggaaagugcaagcugaauaaacccuuuccuccccaaauugcuucuuggucaugauguuuugugcaggaauagaaacccugacuaaaacagacaguuuuauuguucuguuuggauaauguugacagagucaaggguuacugaaaccaaggguucaaagauauucucucucucuaucucuaucucucucucucucccucccucccucccuccuucucucuuacuuuuucuguuuugcucuucucuaauuguuucauuuucucagauuaguguucccucugaaacuuggccucagccauuaauaucaccaugguucacagcuuccuuauuuucuagcccaagagauaccugcugaaggaucugauuguuucaucugggcucaugucaucauuccuauggucaagggauuaaaaaaaaucccuuauaagagcuauguggaugauaugcgaguaaacacagaucccuaaaagaagagucuuguucccuuggaaaaacacaguagacacccaucauaccuagaaacagaagccccgggcacuguacacugugucuccaccucacuugacagauuuuuuuuuuaacagagucuaacagacagccagugacagucagcaggcaguaugugacugucaguuugagaacauggaguuaaaaacugaaugcuuucaaaagagagaaaauuuccagaaaagagaccgucuauuucucacuacaggacauuaaguaaaguguaaguguucuguuggggaggcagaaacuauuucagaauuuaaaaaauaucuuaaaugucuuuuagcugaggaggcuguaacgugucacuuacaggcauucauaauguucauuuuagggauuuggaggaaacaucuuuccacacagucucuucucuuucucuguaccauuucaucuacuacauuaaaauaucacuuuguagcuggcaauuaaggacugcugccuaccacucucugcacauaguacaacgauuuuauuuuacuuucuuaguaccuuucaucucuugaauaauccaguuauucucaguuuugccaugaucugccagaauuuuguaaauuauagcauugauuggcugccaagaacuauguacccaucacagcuuuauuuggacaguguuuuugaaccuuaaauacaguaucuguuucuguaaguacaaccuucaugaucucucucucucucucucucucucucucucucuguguguguguguguguguguguguguguguguguguguguguguguuugggcuguguccgcuaacaucuuaagaggaagaaccauuucaaaggggucuuguagagaggggcacuucacucguuccagcaggccaguaagagaaaagaacccccugucuuauuccaugaaguguuggaugcuuaccuguggagacagaaccuauauacuuuuaaaaugauuucugaaaauuccaaacaaauuaaacucagugcugauguacagcuguaaacagagaaccucaagggaaugcaaacucaagagaacugaauuugaaagacuugauaagagcagagauuauggaggcccacaccuguagcagagggaucaugaauuugaggccagccugagcuacaaaguaagugaaaacaugcuugagcauuuagggaauccaugcuuuaaauaauaauuauuauuauugaaaaauacaaacuagaggaacucgguuuuaaaaucuccuuuacaguaaagauagacuugacgaaaugccucagugcugagaacacuuguuguucuugcagaggacccagauuagauuccuaguacccacaugauggcucaugauuguccauaauuccagucccaaaagauaugaugcccucucuggcuucuauuggcaucaggugugcauaugguccauauaaaugcaugcagagagggaaaacacacacaaacacacacacacacacacacacacacacacacacacacacaaacacacgcacgcaugaacacacgcacgcaugcacgcacgcacgcacgcacauaauuggagaggauucuaaaggguggaugauggcuuucaugugggucauauuaaaggacaaagaaacaaagccaggcacuccuuggugugcgauggcaucgcauagugaugaacccaccuauacuugaaaaaaauaucauaaauuaaaucaaaucaauccauuuaauugaugcugagaucuuucucugaacugagaauauuuuuuaugaacaaaguagccaagagucauugcucucccaggaugacauccaaaucauugaacgagguugcacugaaguccuagaggcaacagaagugaaagaacauugugaauuugaaguuuucaauucaugucaguuguuuauugcauguuggguaagggggugagguucaaguugauucauuugacugcaguuaauccaaaugcaaacgaugaggguuggggggggguaugagagaauauaauuugaaauauacacuacacucuucuaccugcugcugcauugcauuguuucuauuaauucauuuauguauucacuuuacaucccgauugcaccucccucuucucccaguaaccccucacaaucgcucaccucuccuucucugagaaggggcaggucccuucuggguaccaaccugccuuggcacaucaagucacugcaggacuaggcauauccuuucccacugaggccacacaaggcuacccaguuagggaaacaggauucauaggaagauaacagagucacggacagcuccugcuccaguuguuaggggacccacaugaagaccaagcuguacaucuguuacauauccguagggggccuagguccagccuguguauugcauugcauuuuuucaggagggaauugaagcucaugaauggaaagcuuuuucagucuaagauguacauuuacucagguauaauaacuuaguaccuuuacucucaacacugcuuccuacuugagagacugaccaaggauagacaggaaagcauuguaucagcuguauguugcaugggacauaacaucuaguccugacucagucaggggaaacaaagacauccccagucagcccccagaaguucuuaaauuuuuagucuuccauucugaacaaagaaacaaacaauuaccucaacaaaucuauagguuucaaaauccaggaacucaccgccuugguuguucauuucacccagacacagagaaaggaguaauugcuauugugacucuuuuucaggccgaauccaucacuaauaguugaaaugaaaagaguuuugguugaaaaaaauugaguggcuuuagucauaaugcugaacgauaaucauaugggcugauggacaugguaauuaaaauucuguuauggugacuuuuucacaguacauccacuugaauagauacauuuguauugaucuuuaaccugguaaagcuggaaaagauaauguugcaacuaaaggccuaagacagaacugugcacacagauacauaaaccaacucaaaaugcaagaaucaguauuuuuucuaguuauguugauguacucugacauguucaauucuacuuuucuucucuucaaaaauacuacuuuugagugcauuacuacugugauugaugcuaucgugugaaaggagccagagaugguaacagacgauaaagggggcauaucagcuuguuccucuggaacauucuagugaaucuucuacccucaauggaaacauugccaguaaauacuuucuucaccuaugccuucugcuuagcagaagguucucuagaugccuuuuucuggaugcuuuuguucucuguauaacaaggcucuuccuccauacgcaucguucuguuucuuuaccuucgggguuuuaucuguugcuuaccauggauuuugaaaaacaaguuguacaaagaagagguuuuuuuguuuuuguuuuuuuuguuuguuugguugguugguugguuuuuuuuuuaccguuucugcugcugugaacacuugucaagggccugaagcaaacacucuguaaagcuuagguuucuuucaagcacugcuccuccaauaacuuggcugcccucuguccacccaucuuauagguuggcccuugauugauguacuacccuuugucuccuguuaccaucccaagcuccuuucacacgauagcaucaaccacaguaguaugcacucaaaaacaguauuuuuggagagaagaaaaauagaauggaaauauuggucuaguuccucuccugugggaaaacauugcuaauaaugugacagaguaauaaucguccaugugggacucagggcucugauuccccaaagugccccauguauuagaaucuccugcaguuuuacccaugcaggaaagaaagguuaguguucugcccucuguccacacaucuuauagauuggcccuuuauugaugucacuacauauguuuguaugcucacaggcauuacagacaaccagaagaauucaagaaaguaagcaacaauaucguucuauggcaagcauuuucuacuggcucccauuucagaaggauuuuuaaguuaugaaagcacauagcaaaccacuguuucaaaacauaaacuauuauaauaccuugagucagaaagacauuuuccccuaacacaaauuuuaucauugaauuuagagacuaaacuugacagcaauuuauuucacuagagaagauugaguuuauggcuuuuccugguggcucuuaaauugaguaaauacagaugauuuucugaaucauaaaucauauaaaaugauuuagacagggauuuuugaaaauacacagaaggguuugauagugcugagauucuuguguucuguguaauacuucagauuucaugaccaugauauaugaucaucauauuuuccuauuuuccccagaaacucauuuguaagcauacgguaauagaauccuuuaauauacauucacugaauuaaguagaaaaugcgaguaugaaucgucaaauuagagucugguaaacaaaccaaagauaaaaucaccucauugauuuuaauauaguauuuuaaguacauauugcacaauggaauaugguuggaguagcugagguuuagacagauaccaugucuauauuauuugguuucucggaaggagagauuuggaggaaaaugucaugaaauaugauguucuuuaggauucuuaagggacuuuuguaugauaaaagguacacuguguuucccucucagguuaauaaagaauucuacagccacauccuuggcuucgucuuuagauaacauuuccuugucagugcccuguagucuaucuuuguucugaagcuaaccaaauaccuuucccccuaaucagcagagaguugccugaaucuuugaauuguaacaaacucucuauagacuguuuuuacacacacacacauauauauauauauauauauauauauucauaccugugauaaguuuuuaauuuauaaauucugcaaagagauugacaauuuuagaauugaauaaucacaaguauaauguuaugaaaauaauuaccacuauauuauaaguuaagaaaauacagucucuuguaaacacacauuuaauaugguguuccuccuucuagugagaugugagccaauccaguaccuauaaggugagaugaaguaccuauaaggugagaugaagugagacuaauaauuauuagucuuaugauuauuaugauuauuaugauuagacuaaugauuauuagacuuaugcgauaguuuggcuuuugcacuuggagauagggcagguguuaagauuuuaucaauaggagauuugagucuauuauagaucacaacaacuucagcauacgagcuuuucccuuuucuaccuugggaauuuugacuuucuuuuaacucagagaaaaaccuuacaucuucucucuggcauauuggaguugccagcucccgugcuuuggaaccaucauuaagcaaaauaagguuacaugaacacagauacuaugauaccauaaccauugaucuuaaagcaaauagcucccaaaugaugaaugggugaacauuauaaacaacuugcauacucuggauaaaggugauuuaggucccaggucagaacauguuauuucauccugcuauuugggaugauaugaauuuaaagccugugaguuaaauauaccuggaauuuuccauuuaauuuuauugaacuucaguuaugcauggcugacgaacuacagaagguaaaauguucaucuccuucuguguucauaaugaucauguuuacagugcccaguauucacacgaggcuauugcuuacuagauccuguaguuacagguccuuuccuauugcuguagaaugugucacuggacaucaguagucuagaaaaaaaaucaaucugaucaaauguagauacauacuucuuuugcuuucuuuccuuucuuuuucuuuuuguuugggugguugguucuugacacauggucucacugcauugucuaggcuggccuugaacuuauggauacugucuuuucucagccucccagaugcuugaauuagagaagucacaaugcccagcauuuucuugcuuuaaauguguuuucucucuuaucccacacuaaaaagagcccaguauuaaggagguaccacauauuucuuuacagaauauuagcaugggaugugguaaggaaugcuauaaaagcaggacuccuaauuuuuuuugucacagugccuuauuaaaaucuacuugaugcuaucauauuuucuuccaggaaagugaguucauauaguaaaaaugaguucagguugauuauggaguaggugacagcacucaggugaggcauccauagugagugcuguccacuuucucagugacauuaguauaaaaccgaggaugugacuuuuaacgaaauauauugauauauuauaaauagaucaauaaauaacuaguaaauuauauuuagaauaaaggucacaagggggaaaauuccugacaaaauauuaagaauucagaacuaaguacaaagucacuaaaaaucaaaacaaaagcaacaaacaaagccaaccugauccuuguggcuggugguguaucacagaagcaauacaucugguucccauuauguaucauguugaaugaauaguucauuuaggcaacuggcuaggguuuuucauuggucucaaaucucucucuacuccccgccggaugcuaaggaaaguuauggcaugaggaaaggaacacuauaguucucuuccaaauucuagauccuuaaugaaaucucaauagaaauaaugcacaguacuuugaggccucggugauuuuaucaauguagggauuccaagugaaagggagagagcccaggaaaacccuucuuugagcaguggugaaguugugaguggcuacuuuaaaaacaucuuuugaauuagaguuuccugcaaggggagcagaauuacaaauggaauuggcuuuagguuuagcuaagggacugagucauccaugccuuagaauucccaauuucugagccaauguagcauuagccuuuguguggaagaagcauucuuuucaaagagggguaauccaaaccauaugcaggcugaggggauuaugucacauuuacccucaaguaagagauuucuaaagggaucaccuuuuauagagagaccuuauaagaaaagcccccuuuuucuuugcccccugccugcuuuuuccaccgcuucuuauucuguggaaaacuuuuagcuaauauguaugauucuucuuugcuucacaaagcccagcauccugagcacauugagucuugucguuuacuuuauugucucccuugggaugucuauuuuuguaaacaaguuaucagguguuuuauagggguugaucuauauauucagguugaauauaaauagaaaauguucuuagaguagcaacuaauacccauuuauuuucuuugagccaguuuuugaaauuaauaacugauaggaugccuccauucacguuuauaucagcuuggauguauucaacuucaagcaacaagcacuacucugcacaguagcuuaaacugaaaggacauuuauuguugauaaaggaagcacagagguaaguggaaucuaaagguuauuuaguugcuaaaugagaucaucagagaccccaggguuauuuuuaaauucauucauucuaccauccucagcugaaauaaccaauccuaagaauuugaaccucaugcuaacgaaauggaucggaaucacuauacauauacaauacccuccaaagcaugaaaggagaaaaagagaagagucuuguccuucugaaugugugucuguucucuuugggaacaauguuacaguaugauccuccauaaacagaaguauguuaaucugcuuaauacuaguuuccauggcuauugcuaaagcaauuauuggaaagggcaaucugcuugaacauggagccacgauuuccuccccauagcaagagaagcuuagagcuaacccauccucugaccuguuguuaagcaaugacuagcuggaucuucagugccagccucuaacuccagcaacuuaauaagcagcagaagcaagaagacuguaaggucaaagucugugcugucuaaagaacaaguucaaggcuaacauaggcaauuuaguaagguagagucauucccugguacacaagguucuggguucaguuuccaauauuaaaaugaaugaagaaugaaucaacuagugagcaagagcuuuuagauuugguccucagaacuucacaaaacagugaaauaaccccauuaaaauauggggcucagagcuaaacaaagaauucuuaccugaggaauaccaaauggcugagaagcaccugaaaaaaaaauguucagcauccuuaaucauuagggaaaugcaaaucaaagcaacucugagauuccaccucacaccagucagaaugucuaagaucaaaaauucaggugacagcagaugcuggcgaggauggggagaaagaggaacacuccuccauuguuggugggauugcaagcuuguauaaccacucuggaaauuagucuggugguuccucagaaaauuggacauaguacuaccggaggauccuguaauaccucuccugggcauauauccagaagauguuccaacugguaagaaggacacaugcuauguucauagcagccuuauuuauaauagccagaaccuggaaagaacucagauuucccucaacagaggaauggauacagaaaaugugguacauuuacacaauggaguacuacucagcuauuaaaaagaaugaauuuaugaaauuccuagacaaauggauggaccuggagggcaucauccugagugagguaacccaaucacaaaagaacucacaugauauguacucauuaauaagugaauauuagcccagaaacuuagaauacccaagauacaagauacaauuugcaaaacacaugaaacucaagaagaaugaagaccaaaguguggacacuuugccccuucuuagaauugggaacaaaacaccgauggaaggaguuacagagacaaaguuuggagcugagacgaaaggauggaccaucuagagacugccauacccggggauccaucccauaaucagccuccaaacgcugacaccauugcauacaccagcaagauucugcugaaaggacccugauauugcugucucuugugaggcuaugcuggggccuagcaaacacagaaguggaugcucacagucagcuauuggauggaucacagggcucccaauggaggagcuagagaaagcacccaaggagcuaaaggggucugccacccuauagguggaacaacaauaugaacuaaccaguauccguggagcucgugucucuagcugcauauguaucagaagauggccuagucggccaucauuggaaagagcggccccuuggucuugcaaacuuuauaugccucaguaagagggaaugccagggccaagaagcaggaguggguggguaggggaguggggggggggaggucugggggacuuuugggauaucauuugaaauguaaaugaagaaaauaccuaauuaaaaaaauaaauuaaaaaaaagaaaggaaacagaacuguccauaugaaacagugagaaaaaaagguuauuuguuuccuacaaacagagcaaccuaacuacaaccuuuuuauuauuguguuaugcuuuuaacuuacauauucuucaggaaaauucacuggcuaccagauuauccuuauaauuuguuaucauucaguguggauuaagaaagguaggaugaaauaaauaaguacuccuuaaaaaagaaaaagaaaaagaaaacaucuugcuguuaagugaaaggauaaacuaguuaggaaauagaagaaaaguucaacuguaaugccuuuaagagccccauucagccaagccacauaaaaguccucucucacaaugucaaaagauuuguagguaguggcaguuacggagaaaaagcugcucaaauuucucucugugacaagauacuugaggaaaaaaaaaucacuuuaaagaaugaaagaauucucuuggcucccaguuucaguucuuggccagcugucuugauuguuugggguacccgcaacaaggcagagcaucauuggaguguaugggccagagaaggcugcacacuucaugauauccaugagaggauaucaugggaugccuggcuagaguccaacagcccuauagucuucuucaagggcucaccaccaacgcccuagggacccucccacucaaugcuauuucuuaacaguuucacaacuguuuacaguaucgcaacccugaggaccaacuuuuuuuuuuauuuaaacauuuuuuauuagguauuuucuucauuuacaauuaaaaugcuaucccgaaagucccuuauacccuaccccugcccugcuccccaacccacccacucccacuuccuagcucugguguuccccuauauuggggcauauaaucuuugcaauaccaagggccucuccuccuaaugauggcugauuaggccaucuucugcuacaugugcagcuagagacacgagcucaggguguucuggguaguucauauugcuguuccuccuauaggguuacagaccccuuuagcuccuuggguacuuucucuagcuccuccauugggggcucuguguuccauccaauggacugugagcacccacuucuguguuugccaggcacuggcauagccucacaagagacagcuauaucagggugaggaccaacuuuuugacacacaaaccuuaggggaccuuucagaacuuaacuauagcagcaaaaaaaugcacacacucaucucugaguugguucacauauaucuuugcuaggguuuaguguagggagagauaacaugaaguuguaagggaaaaugguaccgaaaauauaggauggauugaaacagaacagaugugguggaucuuauuauaauugcauauuuaaaauucuuaaauaaaaaaccuaccaauagucacaaagaguaaugacccuucccauucaucuuuuaaaucucuaaaaugaagaguuguccacagucuaugcauagggggaucuaggaacuacgcuuuguaaacuuccuacuuccuaagcaccaaggaacagugaaugggagcucuuaaacaauguuugguguggcucgucuauucauagauauuuacagugugaucauuuguuacacaaaguauuugugguugaaaacaggccacuaugaaauaccucuuugugguucuuggcucucuaagccuugaacaacugguuauauuauuaugauaugcacgacaaaagugccuuagguaaaggauuugcaaauccaguccagcuaagagauuagacccaggcaccaagaaauguagccacuguaccagacaauuaguauuaaguacugugggcagggcuguuagagagcugcuggggaguugagguuucuuuucucgggauccacagaauacuaagagcugggaacauuuggcuuggcuuuugacauguuuuaauguagaaaagaucaacccugcaggccauauuugaucacaagauguauacuuugugguuguucaggccaauugucagugacaugccagacacccauacugucucagaauuugugcaaaugauugacuucuucaguauugguacugaaacuuggguauguggaauuaaaggaagugcuccuaauaggaaauacagcucauucuaaggaaucaggaucugugcuucgggggcuacguucucauuguguuucagagccacaugcacuguuaacguucuagugcuuggaagauugaggcugaaauuaauggauuuuuucauaagcacaggggacaguuaaagugagcuacaugaauaugacuggauuggaggaaaguguggagaaaaggacauaauauguggcuccaagaaacacguaugucuaaauggcagagcaauggauaagcugugcccagagauuguucaaaacagagaaaaacaaacaacaacaacagaacgaaaaacaaaacagaacaaaaaacuaaggaagccaguguggauaaaaauuuuauggaaugagugggugccaguucaugcugaauguucuggaccauuuaacugggguguugagcagauugcguguauguguguguguggucacugcucaugauguucuuuuuaagauaugcaugauuaaagacucacguggaauuucauccuuuccuuggaauagacuugcagcaguggaauacugcuguaucaagggaucugauaccaggccuuugauuuauguuccuagcuugcaucccuugguuucagguccacauguuuacucuuugaauggaacaaugaaaagucuuucacuucguauagccaagggcucagguacagaaaucugcuaccaagcagaauacaagaaugacuuccucugguugggaaaauuucuccaaauggucacguugcagcugcccuccucaucucgauuuuuguuucugugcucuucaucucuccugaagaagaccaguaaaaugggggcauuaaguaugagcucacccugauggagguucaaauacacuccuuggagagccuuuccuuuuucgauuucaguggaagguaccugggaaggaaaucuguggcuuaaauaguacugaccaacuauaaggguuggugaucaggaugaaauaccuacauuuaggauugcuauguugaagccugagacuacuucaagaguuaaagauccacuccccaugggauucauaucuaagauccucaaaaugacuugacuuuaccuuccaaaugaguccauuucaaaucauacugucucuccuccaccuccagccuauuggguuugagcguaguaagacuucuugagaaaguucacuuuagcuucagcuaggugagguccucaguuucaauacaguuuucccaaggcaguuguauauuucuuuugucauugagguaagacauuugauuucccuucuuggucuccauccagauucauuucagcagauggacuuauuuuagcuacuacaaacacaagguucuacuggguuuucuuugucuacuggaggaacuguggguugggucugagucacacacauuuuauggugucugcucuggcaugagcuucauauacauuggcaucgacucagagugaauuugacuuucuuucucuuucccgauuccagaauuucauauggcccuguggugauuccaaaaacagucugaggcucauuuugauuggcuccagccacuacagccgagccagguucacucugagagcucccugucccaucaugaauggccacagaagcuucugcucuuggcucugcaaucuaauagcaccucuugcauggaugaugccaaagcaaugcuuugaaauaugcgcccauacuguguggcuuuucuugcugcaguuucuguucucuuuuuauuguaggaucuggagacucaccacuagaagacgauggagucugguauucacacucucuauauaaaggugaauucuuugcuucugugcugacaaggacccgcugaugccaggagauauuucuuuaaagcuucgcagagcagacuguaauaaagugaccagacaacacauuggcuuucuaauugccugucuaggaaaauaaauauuuaaaaauaaaugugugugggcacucauccuuccaauaggaaaaccaagggaaggaaaaaaagaaaaagaaaucucaggagugcugccuuucagugccccguggucauuuuauucuucuaaaugucuuuacuguccucacuucugccgaggcaagcuguagcugaugauagugaaaaucaagccuuacucauacauuacagccggaagugugcagagcaaaccgcccaaggugggugcugcgcccagugcugcuaauguacugacugcacggagaagaggaaaccuugauuuucaugagcuuuucucaugcucuuucugagcccagccuggcuccuaagaugagaaggaaaaugugcuguugcugaaaugaauuuuaacuuagcuauaggaaauccaccccuccacugugcccaggcuccacucccagcagguaucuaaagccuaaggaagaggcuuucccuacuggcucagguaagucuauucacaacuccugcugcugcuucccuggagccagggagcucagagcagaaaggaagguaaauguaaaaugcucuuugucuacaacagcugccucucacugcagcgggaaacccucaaggaaacagucugguaaaguuucaauuugacauuuggcccaagaaaugcauucauacucuggcaggaaaauacuaaccuacacucuugugacacuucugagcuacucgagaauugaaaaaguucuggucagccuuugccuaaagacuguccuucaggucuuuucccaagaagugggggaguggggggaggaguuuuucuaaacaaugacugguuccugugucuagguguguuuccauauuugcuuugauuucugaauguaauagugccuaccuucauuguuguggcauuaagcaauccaaccaaucacaaauuucuagucagauguuugggguaaggagaugcucugauucauaaaacuuccugaaaguuuuuuuuuuaaguucuuugugaguccccaguuuaaaaagaguccuaacacacaugcacaguaaagagacuccuagacaguagugguggccucauguguccuuaguucauugugcuugguguccccuucucaucucauagccuugcaagauagaaaguaaauaauauauccaaaaauaugccuagcccaggaccugaccugaaugucuaagaauacauuuuuuucaugauaaauuauuucucuugucaguuagauggcuugccuguaggaaucaucacacuacacauuuuauauguauauacacacauaucaaaacacacuauaugccuuaaauuuuuacaauagagaguuaaaguuuuuuuuucuucuuguuauugugguuaugauaaagagcaaaccuagggccuauuauugcaagacaauuguucuguucaagaacuacacuucagcuuuuaagugucauucauuuuaaaauuuagagcucaaccaugauuaacugcaacuuuagcuauggaauauuaagcuccucccagaguguggcacagaguauauauucaauaacugauuugaauugagucaaauuuaaaagaagaaagaaagauuaaauagcauacauuagguucccaguaugugacaucuuauuuacuuauuugauuguauuuauuuacuuuuuugagggauuggggcagaauaaauguugaugguuuuacuugggauacuauaguauauucacacugcuugagggaaggggaaggcgcauagagaugugucagaauugcccgguauuuacagaaggccccaaggguuagagagaguaggagugaguccuguggcccucccucaugcugcacuugagucuggacagguguuuuggcucacauccaugaagcacuaguaguuccucauuagccugcugcuccaugcugccagcuccaccaacuccauuuaauuagagugcuuaucacauuggcccugggggaugcaaaggcuuuccugauuaaucaguuuggaugucuacuuugacuuacccauggugcuugucugcacuuuauaugcaaagcaugcacacugacauucccaucaucuuuacuaaagaacugauaaacuguucaaauuccuucuaaagaguucuuuuggaagauaacaaaaacuaaaaugccuuuugcaaauaaauaaaugcaagauguuuuucccuccccauggcgacaacagcacagcuuuuagauauguagucgccacugacagaagaauuugaagaguccaaauaagggagaaaaaucugcuaauugcaugcugcauucaaauaugugaauuuguuauauaugaaaacacacauagaucuuuuucauauagaucacaaauauacauaguacauguagacagccugcauaaaauguuccagaaaggaaguguugcaggaaggccuguaggccugcugugcgcucugcacaucugaaucuacauggugcaagugaauacauagucucuagggugaguccuuaucaucucuacccaggacauguagggaauguuacuugagucuucaauuuccaaucuacugacaacuuucugaaaagcauuauaugauauagguacuagccaaagagaaccaugaagcaacaguguaaaaaaaguguucaaaugccaaaaccugggcagcauccuuuagcaggguugcugagcguggggagaacauccuuaggagaacguuccuggggaauguggagggaggccuguguuccuuuguggccacaugauggcgaacuuacuccacauacugguuauacugguagcacaggugcuguugagggauaacgagcugggcagcuauaggaauguagcucugguucaauguguuaacucuacacccacccccgacuucagggaacuugucccugacccccagauagcguagagauacauggacuggcugcuucaggaacuccuccacuaagaagacaguuuugcacuucuuuugaagguuucuuugcaugguacauuucaaagauaggggagaaguucagcuuuauuaaugacauccuagguaugcuuugggcaguuguccuaguuugcuucucuguugcuaugcuaaaauacugagcaaagcaacuaggggaggaaagggcucuuuuggaaagcuuacagguuauaguccaccaaagcaggaacucaagcagagaugcugcaggaaugcuaacacacuuguucucuguagcucucagcuugcuuucuuaugcauaacauccaggaucaccugcucacaguuggcaccaccuucacccauuauuugggcauucaagaaaaugcccuauagacaugcccauaagccaaucugauggagacaauuccucaauuaguuucaccuuucuggguggcuccagguugugucaaguucacaaaaacuagacaacacagccacagcaacuagaacaccaaaaucaaguuuuccaucugaggggaugucaccccaaaugguguauaacuauugacaucugaaaagggggauuguuuccuuacuuggagcaauuguuccaugaguguaagccaaaaugacacucuauugugaacacugguauagcuuaguugaaauuagcaaacaugaguacugugguuugcuuuacagagaaauaugcauauagcugggaggaaaucacaguuaauugacucuguuauguauagauggcuagggugaaaauuuacuauggcaucaauuaguuucaauagaucaggauaucauauuaagggaaauacuagaaaaacaaaagcuuauugaacauucauuuuguucucagcaucgugcuaggugauaaauauacauacagucuuuaucucuuauaacauuagccaguuauugguguaucaacucagagaguugaugucgcuugcccacaucaaacaacuauuuaaaguaauuuagauucauauuuaauuaugucuagugcucagucucacagccauaacuuucuuaucuagagguuccuaauacacaggccagcauuggagguucagaaccuggaauguagccaaucugguagcacagagugaagggcugcauuaucuaaaccugucacuuguuauuucucccuuuguuucugccuguagacacuccguggugcucucccaucaaggugaaguauggggauguguacugcagggcaccuccugggggauacuacaaaacagccuugggaaccagaugugacauucgcugccgaaagggcuaugagcuucauggcucuucccagcucaucugccagucaaacaagcgcuggucagauaaggucaucugcaaacgugaguagacuagaccugugcugagucuucagggacaaaacugucuugcucugagaugaagcuuugauuuaaagcuagucgauuuuuauaauauaacagagugaaugugugcuccuuuuccaaagaaggguaugcuauacuguuugggggaaagaauagauagauuuuuuuuuuuuagcacaccagugauauuuguucaguaaauacaaaguuccaaagaguugcuggugauuuaguaguaaauaaacuuccagagcguguaacuagguagaggugaaagacaugacauggguacaggaagggcucuaaacuaggagcuccuggguaggagauuaauggaaaagaaaaucaugaaaaacaaauauccugaaggguaggauuuagggguacaagggggagucacugaagaagugauucuaagucuguguaauggaguaggccugggaugaaguugauguugcauuucaggggcaaugucucaaagcucaucugugaaguuccuugcuugcuggcugccuccagaggcaggcagacuaaugacauguucugcuucaugacaaguucuccuguauuuaggcuguagauggguagagcauuggugaaacccauuuuggaugccuuuauuacccaaagucgcuaugccuuauugaugacccaauguuuucuaagucuucaacauacguucaacauguuuugcacaguacauuauugauaggauugggccaagugcugcucaggacuauagucaugugguccagaauauguagauguuauaacugaguuuauguaguacccacuuaacaauguuucaccacauuucccugugaucuaugugagggccuuguuggauuucuucuuuucauuuuccccaagaacugggaugugagcccagggccuggcaaaugcugaaaaaaaucuauuguauuccuagcuuuaagaagaaaaacaaaacaaaaguuuuauguuaagacagggucucaccaagucaaaaggcuuacagcaacucaauuuguagcccaugcugguuuugaacaugccaucuuccugccucagucuccuaaguagcugggauugcaggcuggugucaccagauauggucacacuugcccucuucaacuuucuucagagaaaagagaaaaccucuuucagaaaauguuccugcugcugccucucuaccuacuucuuguuuacuuguuuguuuguuuguuuauuguagucuaggaaauucugugucagucuuagaauuauaagugugagccaucugcucaacuuuuuuuuuuuuucccauagaagagaaaagcucuccaaggaaugacugguaaaaggugguucccgguguggagugugaaugagaacugccaucuucccugcagggugcucuugacagagcaagcugaagcugacucugcucuccaugaccccuugcuggcgcucugaucaccauucuccccuuucucccuuuagucauuggucucccccuggcaacacuuucuuccuucucuucucucaggguucgcuucuggggaauucagucuaggacaguguuguggcuggaaugccaaagcaaccuauugugauaggaagcaucguguguucuguguggcauauaggcagaugccacauguuauuauugauuaaugccacaugcuguauuuuuaaugccacaaauuuuauuguagcaaacuguucacugcauauuuuccaagugucuggcuuuugaauuguuggacaaaaaaaaacuauacugcaugucugauucuauccuuuacagagaagcgauguccuacccuuaccaugccggcaaauggaggguuuaagugugucgauggugccuacuuuaacucucggugugaguacuauuguucaccaggauauacauugaaaggggagcgaacagucacauguauggacaacaaggccuggaguggccgaccagccuccuguguagguaagaaaauaucacaggcuucagggggcccaucuuuggagagaagcaaugggucuuuguuauuauaacacacauuaaaggaaauaacagugucccacguuugcaaccuaaauagacagcauucagucaguagccccacagguccgaaauccaacagcccucgaccucagucucuaacuagcagacuuugaugugaccagcuuccagcugacuguugucaguuucuagaccugcugcugcuacuccugggaacuuacuagaacugugaauucucauauccuccucugcuucccgaauuuaaaauccuggauguggggccaacacuuugcauuuccauaggcccucuaggaauuuuaagaucuucaaguagagggccaccaaccucagauauugcuuuucaaauuuucucaaauucucuggggaccuugagaaaacuacagacuugaagucagcaggucuugggauugauccuguaagagacaacagacauuuggggccagaaaauuuguuguggaccuuuccccuuugcaauguuuaacaguguucuuggauuuuacccacugagcguuuagugacacuauccucucauccuggcuccaguauacuuguagcuaucagaaaugucuuuagacauuuuucaguggcccuggggaggaaaauuagcccaucuguugaugaucacuugccuagggauaaugagugcaucuucaccauagcuacauguacuugcuaccuggguaccuuucaguagccuaccuuagagaugcugauucaaggagccugaaaaagaggcauuuggaggaggccaacagacuucuaaaagcaucucagaugauuuuccugcuggagauccaggaucgcugucuggaagcagcauuagcaaaauugcaaauuuccugccugaucugagacuggcaagcuuagaaacuccagaguugagcccaaucuacuucuagaaaagccaguggagguaauucucgaguaagcugaaaauggaaagccugcuucaggaguaaaaauguaggaaggaguuuaguaucuuuauacucaaacccauuguccucagagcagaagcaucagcaugaagaggaagacauuuagaagguagaaccaugagauccugcagcccuaaaacuggaucaugccuuuggguucugcugucucugucgacauuggggcaccuagccaucgggcaguguauucuguacugacugacacuggagucugaaucucuguaguacugaucuuguucugcagcuccugugcaagugcuugagcaccacuguugcagaagaucauuuacucuuaaacugugagagauggcaggcccuucucuuaaggcacaucaaaacccaaccccacauuguuuuaagauagaauuuuaucuauuccuugaaauuuucauacaaugcauuuucaacauauucaccccuagcucguuucccuagcucguccccaucccucuuuucuguggaggaaagcugagaccucacuuggcuugugugagguugcguagaaccaugcaugguccccaggaucucugugcugaacuugcuaaaucaagggauugauuugguccuaggaugccaaaagcagcuggcuauaggaauuuggguccuguccugccugugucugcccauucugcagaaaacugcuuaguucaguguccuaauaaguuuuaacauagggauuccuuaaauacucaguguucugggaggcagggauaguuacuuagagaucaagaguuaaaucugaugaugucucuggggcucaauaugagacagcgucucuggcuggggcuugggagguuuuccauaauggcagugcuguccauuauuuuuuauugauaauauguuguuauuacucugauguuaugacaagaaaucaguugaagauauaaccaauacccugccuuaacaguuauagccuauaucauagcuuaauccauuugaaaauaaugaacccaauuuauuuauuuauuuauuuauuuauauuuuuuauuaucaggacaaaaaucauuuuaaguuuuucaaggguaaggaaguguaccagagggacuugguuacaaaagcauaggaauagugagagagaugcuucagcaauugagaguguaugugugugcacuguucuugcaguacacuugaauuuaguucccagcacccaaguugguaggcuuggcugccuguaacucugcuccagggugaucugauguccuuuuuuguccucuuauggaaaccacauacacauggcacauacauacuuaacacacacacaaauaaaaaauaauuuaaaaacucaaaguaaaaguacaggaaaaaaugaaagaguaaaaucacaacuguauucuguaucaguuuuucauuacugugauaaaauacuugacuuugacaacucccaggaagaucuauuuuggcuuaugguuucuuucaguucaccaugccugggaggguagagcagaucaccucaugguguccaggaaggcaucuaggaaagucucagagagaucagagugagggagagaaagaggaagauaagauuuucuuagauuucuucuuuuucaaguuuuauuccauuuaggcuccagaguaugggaugaggccaucuauauuuuuaggguaucucuuucccauaguuaaucaccaucagaaauacccacauaggcauaagcaguggaaugucucaucaacucccuagucaauuaucaaauuaauggauuuggcugccaagauugaccauugcaauguuauuauugacaacuauuuacaggcagaauccacuauugaguacaggauagaagagcaacagugauaugguagagucggccacagcuuuucacacucuaaugauuuaacauuaugauggaugagaaggaagagcucaggaaauauucauuuaugguccuuauagaaauacaguggcuucuacugccuuucugcccuguuucucaugucagugagaccaguguagcacccagcugacgaagaaauauauacaauaugguauuaagauauaguccugacccuauggcaaacugagugccagcaaaauggcagaaucaucuuucucugauuaugcagggucuccugaauccuauuguacuuguccugagaacccuugcucagugaggaaagauagagugugcugagggggugagaucuagacaugcccauuacuaaguggauguguugagagaagggcaccucacagaugcugccucugguaucucccugugcuuugcuguaugcaaauuagcucuugaaaacaaaccagaagaaaccaaucaaaucucaguucccuuguauuagaaggaacagagauuauggugcuggagaagagaagcccaaaacucuuucugcuaagcaagcuuuggcagggcacuugagggacauacuguucagauuuccagauugugcacaacaauggaaagaaaaugcugauuguucucaaaaagcagcaagcaugucuaaagccagaccagauggcccuggaacuuacccagagggagagggaagaaaguuagaaaugaaccacaauuucaugcaauuuaucuucccauuugcugagacaagguucaaauauaugggaggaacggaaauugggcacacaacaaggugagaauggaaagggggcucagguacccaugaguuuagagcuccaugcuaaaugacaagaacagacaaaguaaguugacaaugugauuuuggugacagacaagcuggaguuuguccccagugaauuuuacuccaaagcuaucauuuacuccuuuggcuuuauuaauaaguuugcuugugugcuggcaagaacaaggcuuccuugagcauaaguuagaggcucgccuauuuucggagcugacacauggugcuugaguuguucccagguuuccacacaaccuuaaacagcacauuuuggccagaacugugcugagugcugagaaagcuaacugaguucccuuccaaauggggaaggaauaaggagaaugggcuuucuuugacucugagauguucaguucugaggucuggcuaauuuguaagugccacaagucaagcuaauucucuuacucagacuaaagucaaauucagcuauuuaagaaguggggagaaucagaugggaggaaggaaggcauaguguaagcugcaauggggugaagaacuuaagaagaccuuccccacacugacuggagcuagcauuguguguaagacauuuuaauuucuaucaaauuucauuaauuugguucuacagaacaauggacaguaggaaugaacacagaucuuaaguuaaagacuacauuuuaaguagacacaccuuuccgcuaggaaccaaaauauuuuccuacuccaaaacaggaagaaaaaauuuaaagacaguuuuaaaagcauguaugaagaaaaauuagcaaaugccuuuuggcaugaagagaguaccuauuuucuuuaacaaaggacaaaguaugaaccaaauugguuguugaaaucccucucuuuuuaaaaaauauuuccuccagaguaaauagucagggauucaccaacacaaguuaaauccaugaauaaaaaaaauauuugaaagagcagauauggaaauuuauggcagacauuuugcugucugaugucuugguuuaaccagugacugauggggauuuuuguugggcuacgauucauuuuuuuuucauugcuacaaauacuagcacagcuaagaauaaaugcaccagugcauuguuacagaugaucuuauauaaauuuucuccgggcuugcaaauacacacuccauuaggaaucuaauuucaguuuuaaaaccauuugguuuauggaaauucuggucacauuucugccucucaugauuuaccacuauaacugaacaguuaaacuuucaguggccgacucuaauauaaauggcguugugguugggaaucuuuaguuguggugcuugcucauugcuuucccuucuuguuucuuuuguuguuucuggaaaguuccuugaaggcauguagugccaaagaaauggagccauuucccagagcgguccacagggauuguccucuggcuggagaaaggaaaacaauugggcaaguuuucaaagagaaguuuuguucugucuguggcagucaggcacuccauguagccccaagagaccgauggcucuggucucugucauugcucucaaguucuuuuuuaaaauauacuucuauuugaaaugcaauugcauuauuuuccucccuccaacccucaaacucuuauguuuaucuuauucaucuguugcugugcaacaaaccagaacuaagugguuucaaacagcuuacuuacugaucaaagagacacagugagcuagaaaguugguuagcagcauucugugggggugcccgcccucugcuagacauaauaauagcucagaugauaaugauuaagugacuaggggaugcagaacaugcuuccagaacauauaaagaaagcacuuugacuugggaaagcuaaguugacuagucugauuaaaucugaaucuuucccucuugucucccaacaacccucuguuuucuuaccucucaccaugaacuaacaccaugugaauggcuuuacauggcaacugccuccaaaccuaugaaaucuaaaagugccauauucuguaacaaucaccuaggucugaggcugacagaggaucuuugaguuuauuguuaguuguugaccgagacauuguucccgugaagcucugccuuguugcaagcacaugucugguuaaacauguuaaagauuccuggguaaauaguucugcugccaaaguugauacaguacaauauauuugauuaucauacuuucuaacucagaaaggaaaggggaauacagagaagggacaucauuugucaaaaaucuccaaugaaugggacauagaacagaaagcaugaguuucacgagggcuucaggauuuccacacaauaacuggcuuugcaggcaucuggauguuaaggggaauaguaauuacguuucuaugguaacucgcuccauuucaugcauggaaaucuauccuaacuuaaaagaagcuaugguagccauggguaucuggggaauaaaaagcuuaguucucuggagcaucaauugauccaugggcugguccuaucaauugagaaagaaggcaguugcuuaaggaggcuuuagaauccagucuuucugaugcucuuuaagggcuuauagggaagaugugguaaacaauuucaaaagaauaugaacauaaagguugggugcaaacaccaagucaucgucauuaucgucaucaucaucaccaucaccaucuucaucaccaucauuuacaacaacaaccacacacacacacacacacacacacacacacacacacacacucacucugaaggagcauuugaguucuuacguuaagauguggaauaguguauuuaaacaucagaccuuaaggaaauuccaaaagagaagacauuccuuccaguguauaaaugggaauguuaauaauaguauuuaguaguuuacucaggacuuaacuuuaggugugaaaauucaauguauggaugcaagaggaacacuuuggauauauggauugggcacauagggugcggcuuuuauucauuuuguguuugaagaagcucucuuucugaacaacuaggccccuuuugacuggucauugguggacagacacaagcugucuuugagaaccucugagauucuucccccagauaaccuacuuugaaguguguuugcacugucauuucacuugguugacacaggaaaacaguguguccaccacauuuccuuugccugcugcagagagcaagaaucuccucuuauacaugcuaacacaauguaauuacacauugaaagcaguaaccuguccucagccccucugucucuguuuucccuuuuacauaagcauauuuucuagaaagcaacugucagcuaucucugaccaauaggaagcagauauucaacacuuguuuuucugguucacccaagacuuuggaacacuaaccugaaugaugaaagcaugucuuguauuacuuagcauaguaaaaaaaggggggauuauuguaaagaaccuagcaacugcaaauggacacuucagauagauuucagcauauacauaauuauuuuauuaauuuuuaaggcauagcuuucacauuuuaaugucacuggaguuaggauguuucuuauacuugaucaugacuuaaauucaaugaaauaugauaguuauucaauucagaucaauguaauaaggcugcaaauucacagucuauugaagcauggcauugggugaaagcaaauuuagauaacugaagguaaagcuguuugagaaaguauucaauauucacacuuuuuuuuacacuacauaaaaugagaacuccuuagauaagguacuggagaaaguaugugaagacauuuacuugaugucuuuggucuccagaagacaugauucaguaucagagggaacauuuaacuuucacucagguuguaauagcauguagauaauuagugggugaucugugaggcaaugcaaagcugacugcugaacgcugucuuuaaguauauucccuaccuucuugacaucaaagaccaaccgguaaacuuuauaauuuccuccugugauuucacuucagcuaugauuacaggcaacaacccaguguagaauuaacaucucauucauucccagaccucauuaucaacccaucuuguuaaggagcggguggaguaacucaaacacuucacugaaacccccgugagccucagugugaacauacguaaacugagagaggugggcuccauuacauauccauggcauucaaguuugccuuauccagaacaaugcuguacucugucuccuguuaugugugguuugugaugaaauaagcaccccaauacacuauaaacugaaagguuuuuagcaucagauucacuuccaccuccaaugccagcauuuggaaugacacccuuggauaaaguuggcauucacgaaagauuuguugcauccaauugaaucuaagcaggcgauaaugccuuugcuugguauucuaagugucuuuaaaucagucccuaaagcugaauggcuucuggcuuuagcugaguaacugugcuguugccaguucagugugcagaguuaggaaguguacacacagcacauguagcaagggcagaggauggcaggucugucguuuugcagguaaguccuaaauggucguuaaaacucagcaggcuggaaaggacaggaugaaaggauagaagagguuuccagagugaacgguuucuucggaagggcaaguaucuagaggucuuggcauuuuagacugggaguguaggccaccaguauaacauauuucuugauuggguuauguuuucaagaucuggaaccuccuagaaucaagugcccaagugugaaagaacguauagcugagcccaauaagcugacaguccggguguccugggaaagcccagagggaagagauacagcggaugggauucuuacugaguaaguuaaacaugaaacuuggcagcuggaaugcucccucucccuuucucucucuuucucucucccucucccucucgccuucccccucuguacccccucccuuuuucccucucccuccuugaagccuuauacauucuagguaagcacugguccugagcuauaucaccaaccuauguugucuuuuuggaaagucagaacauuuccugaauaugaaaugcuuacuaccaagagugggguguaucuaugccaauccauuuauguuuuggacccggaacucucuggucaccaucuaauauauuguagaguguauuuauaugauuuuuauugucugucuucauuauaauacauucaguaccucauuccuaaagauaagaacuguaccuggcacauagcacucagguaauauuuauugauggaagucagggagaaaaguaagaagggguagagggaaggaagaaagaaaggaagcaagugagaaagaagguagcugguuaauuccagaaucugcuuucuccuguugcuuacugaaaaggcuucuucucauguccaaggccuuccuaagcccccaaacacauuggugaggcuucuguguaugcuaagccaaaugcugugccgcucauuacucugugguuugaugcaguacuuuuuuuguuguuuuuuugcuuuucgagacaggguuucucuguguaguccuggcuguccuggaacucacuauguagaccaggcuggccucgaacucagagauccuccugccucccgagugcugggauuaaaggcgugcgccaccacacccggccaggugaugcaguacuuuuacauuccuugucuauuuuuuauuccugcuucaaaauuucauuuuuguuuuuaacaaaaugcccuuugagggcaucaaauacuugucauccuuuagcuucuucccugccccacgccuguuuuucugucccacugcagucauaguugaauguccagcugaguaauggguagucaccguuagugagacucagucacauguuguucuaauauaucauuuggaccuguacccuaacaguauuuuccaggagacccugacuucaugucagcaugcccauguuucaauuaaaguucauggcucacguagaucuacugacacaggucacauaccuggacaauaagcuucugaagcuucugacuuaugccauuuugggccaugaggcagcgacagaguuucuggaaucuugucaauccugugaggcucaagacaacagaguuuuauacacaauuauuaguaauugcauaucacuuacuaguaagaggaguuaaaucucuuauucacauuuuauuuccacauucuaauaaucccuccacuguaucaucuacuaaaaauaacaggauuaggaucuuucucaacuacaacuucucaaagauaaaguaugaucaguaaacauauuuacucuuccuacauauguagaucauaaacccccuaugagaaacuucauggaauugaguuuaaaagguaagccguaugaauaaaacaacucacuauacacacaugaacauuacuaugcaacauaauacacacacacacacacacacacacacacacaauguagaaaaucaagucagaguuggcauaauugugguuuuaccacuauccuuaauuugugacagucuuguauaaagccugacucagccccuugaauauagucaguucuuagauuucugcaacaguuaagucuuauauaauaaauucaaaacauaagaugucagguggccauaugacuccucauuuauauaaaaaucuuugucuuuuugaagaggaccuguuauuaggguucaaaugaugacacuuaacaaaaggaccacgguggcccccaacacucuguucagcagcuuagauguagucugugguagcauguguucaggaagucugacuugucccauguucaacucaugcuuggacuucuugcuuuccuagcacauguccugggacucuccuccccagcaucuuucccuaacuacuguucuauagucuguuuccaaagcgaaggguguauuggcaaacucugacauggguguuuauuuuucaguuccccuuggcaacuccuguuacuuucauaaugaaauagagucucagagaaauuggcagccacucauacaugagugauuacucuuucuggguuuaucugaauuuacauuugcuaucuaaggaucuuaaggcaguuaaagucaaaagugugcaacuucugaguucauaagccuuguaaucaugucacaccuaugugaacaguuuuccuuaauggugacaaugauaauuccacaugcccauuauuaucacauaucauaauuccuaggaacaggcaugagaaguuuuuauaucuuaaaaauuagccaaaagcugacauuugauuguguuuuaucugcugggaguuuugucagauugcaaggauagaugcuauagucaccccuuauugugaaaucuuggccaagucccuuagccuucuguugucuugguuuucuuacucgugaaauggaggcuuuuaucuaccccaaagagcuccaugaggauuaaauuaaauaauaaauaauaaaccgugcuugauaugcgugagauuuagauaaagcaaacaagagauuuugcucuuacuauuacagcguuaggcuagucaaggauucagagacuuuuuuuuuuuuuuuuuuuuuuuuuuuuuuaaccauuugcucagaaggucaucacugacggcgaugaaauaaagcaaagaacacucuaguacccauuccagggcaaaauugccaaauggccaacuaaaccguacuccaaaagaauuuuucucaaaaagcauugaguuaucugcccaacauacaugcaaaacauacaggcucagcuugaaauaaaggcccuuugccccgguucugucauacagcaacaaaugaauacacaaacaaacugaaucuccccuuagcuggggacuucuauuuuucuggcaucaaauuguucuugugaaacagagggaagcucaggggaccccauuccucucagagccucugugcugguuaaagggcccagaagcugcccuuuaacggaacuuuccucuguucgguauagacucaucacucaauaucugcuuuuuagggacacaagcauaauccuggauauuucugcuuucuuccuuaaguguuauucugaaaggccuuccuccgggcucaaauuuuccagaaggagaccacaagauugaguacacagucuaugacagagccgagaacaagggaacuugcaaguuucgaguuaaaguaagaggugagacugcugcuuccggaugcuuguccaguuacuggaacgucaaagagagaggggacagauucucaauccagagcugucugaaugccccuggucguaggacuacugccugcuauggauuagguuuucaugaagcuaagcaaaacaucccaucuuaaugucuggguuucaauaugaguagguuauguagggaaugggacuaguuucacaggggcucauagcuaccuauuuaagaggaauaauuuuuccuucauugagcuaauagcucaauuacuggcaaugaccagagugguaagaaguccccuccuuuaggccccuaaaaggucaugcucuuuguuuuacaaaucuuuggucucccugagaaaaauauuuuuaaaaaccuucguguuuuaugguuuaggcagcuugucaguauuauucgcucgucagagcccggucuccucaucuauaucaugagggggcuaaugccgcuauuucaaaggucucacugguaaggguggugaccauuaugggccauuugagaaauagccaucacugccugggacucauuucacuaggugauguauaacaucagaacaaacugagaucucaccuucucugguugcaugcucagggcuaagguuacucuggguuugugucuccuacagucagacguuguggcaagcucaaugccccagaaaaugguuacaugaaguguuccagcgauggugacaauuauggagccaccugugaauucuccuguauuggcggcuaugagcuucaggguaguccugcccgaguaugccaauccaaucuggcuugguccggcacagagcccagcugugcagguacgugugcaguucuuucucuagcuagaagcagaaucugaaacccccugacuccagggcaggucaauagcagcuuuagauccucuacgucauaaaauacagcaucaucucugcucaccugagugggugaacaaaggugcuaagucccugcugcagcucaacucaccugcauccuugucuugcuguugccuguuuccugaucacccuuccauaucuuuaaggaaacaauugggaggccaggacucagggcuagccuauagugguguuauacgucaacagacuguuuacuuacguauauccuucuauuuuacagguggaggaucuaguuuucaaugcuaguaaacuucuguauuuagacacucuaauuccugucuugcacuauugacuugaaugucauacacaccuugggcauuuggaauccuuccuccuuuguaaaaugagggaaccauaccucuuuuaacuggucaucuacugaaugguggaauagagcauugccuuguacaggauaagccuugaacauaugcccgaaguucuuacagaugaguagcaaucaggcuagguguagcuaagaguguaaaaucuagacuaccuaggacacucuagaccauuuuauuuuauuuauaugcuuccuuuuuuucucaaucccagguaucucuuccuuucccccacuuuaacucuaccauucaaagcaggugguugaaucuauucaauuucauauauuaaagcagaaaggucacauaacaucucagacuccucagcuaaguacuuaaugucuauuuuuguggcacugaggccuggaauaucuuauaaauuuuaugucuauauguccauaugguagcuacuagccauauauggguaugaagcacuugaaaugaauccaaauucaggaauauugucaguguaaaauauacaccaauuucaaagucuuagcacaauaaagaaugacuauaaagcacuccuaauuuuuguauugauuucauguugaaauauuuggauauauuggguugacauauuuguuuguacaguuauaaugaagcuacaagcaaagaacaaauuauauugacauuuaaauucuauuuauauugaccaaggcuguccuaggcugugaaccccaaagccaaguuuggagaaaagaacuggguuuuauugaaagcaguggcccagaaguuggcaccuagcacucacucaguauaguugaacacaugaaaacguaaaugaacagugauuuuuaaagcaagccucaaguuugaaacauuaacaacaacuucauaaaaccuauaagcuuguuuucaauuauuucuucuccugagccaaucauguggggcucuuugucauuuaucauuaguuuauaugucauaacuauaauuauaugacguuaacucauguucuccauggccauauugaaagaacaaugacuuuauguuagguuaagccucuaaguuuaauacaauuuguuagagcagcaagagaaaacuagugugcauccuuugcccauuacaguugcuucacaaauucacuuuuuuucuuaauuuuuuuauuauuuaaaugcauuuuauacaucaaacguauuaauaauauugaguauuuugagagucaaauaauauauaaaaauuuguucaacuuuuuauauucacauacuuucauacccuaaaaauaucacuaaugaacauuuaauacuaucaauaacugaggauccuauuucuaauguugaauaccaaauuguuucaaaacauacaaaauauucuuugggaauuaagcauaguaaaagagcauaaaauauuaauagugaaucauaaggaaauauauucaaaagcccuuauaugauaccaccuggcauagugaggagagcauuuaaagcacauuuuauaucuguguacauuguguaacuauaaguuuacuuucaaaaguuuaucaguguuucuaggagagaaauuauuuuaucaguaaguauauuuuaaaaauuucaaaauggcaaaaacucauugagguaaaacauuaagaaaaugcuaauuucauuggugggacucauguauccagcugcuuaguccauuggauggcugugagaaucccauuucuguauuugucaggcacuggcagaaccucucaggaaaacagcuauaucaggcuccugucagcaagcacuuauuggcaucugccauagugucuggguuugguaacuguaugggauggagccccagguggggcagucucuggauggucauuccuucagucucugcuucauacuuuguuucuguaacuccuuccaugggcguuuuguuaccugcuucuaagacggguagaaauauccacacuuuguucuuccuucuucuugaguuucaugugguuugugaaauguaucuuggguauucugagcuucuggacuucugggcuaauauccacuuaucagugaguguauaucauguguguucuuuugugauuggguuaccucacucagggugauggguccucaaugaaggagauagagaaagaccuaaggagcugaagggguuugaagccccauaagaggaacaacaauaugaacuagccagcacccgccccccuccccagcucccagggacuaaaccaccaaccagagagcacacauggugggacucauguauccaguugcauaugcaauagaggauggccuaguuggucauuaaugggggaagaggccuuuuguccuaugaaggcucuaugccccagugugggggaaugccagggccaggaagcaggaguggguagguuggggaguagggggaggagggguuguuuuucagaagggaaaccagaaaaggggauaacauuugaaauguaaauaaagaaaauauccaaaaaaaaaaaugaaaaaagaaaaugcuaauuucaagcacagcaaggaaaauuaucaguaauuuuucaugauguuuguagaacaugauuuuaauguuuucuuuuuuauuagauaucuucuucauuuacauuucaaaugcuaucccaaaaguccccuauauuccccuccugcuccccuacccacucacucccacuucuuggcccuggcauuccccuguacuggggcauauaguuugcuagaccaaggguuggccaacuaugccaucuucugcuacauaugcagcuagagacacgaacucugggggguacugguuaguucauauucuuguuccaccuauagaguugcagaccccuuuagcuccuuggguacuuucucuagcuccuacauugggggcccuguguuccauccaauagaugacugugagcauccacuucuguauuugccaagcacuggcauagguguggcuaucuucuuuuggguuuguugaaagauuagucucuugcuuuuuucuaggguguacuuucccuccuuguguugguguuuuccaucuauuaucuuuuguagggcuggauucauggaaagauauuguauaaauuuuguuuugucauggaaugucuuguuuucuccaucuaugguaauugagagucuugcuggguauaguggccuggacuggcauuuguguucucuuagggucuuuaugacaucugcccaggaucuucuagcuuucauagucucuguugagaagucugguguaauucugauaggucugccuuuauauguuacuugaccuuuuucccuuacugcuuuuaauauucuuucuucauuuacugaauuugguguuuugauuauuaagugacagaaggaauuucuuuucugguccagucuauuuggaguucuguagacuucuuguauguucaugggcaucucuuucuuuagguuaaggaaguuuucuucuguaaguuuauugaagauauuuacugacccuuuaaguugggaaucuucuauaccuauuauccuuagguuugguuguuucauuguguccuugauuuccuggauguuuuggguuaggagguuuuugcauuuucuuugacuguugugucaauguuuucuauggugucuucugcaccugagauucucucuucuaucuccuguauucuguuggugaugcuugcaucuaugaguccugaucucuuucuuagauuucuaacuccaggguugucucccuuugugauuucuuuauuguuucuauuuccauguuuagacauuggaugguuuuguucauuuccuucaucuguuugauuguguuuuccuguaauucuuaaagggauuuuuguguuucuuuuuuaagggcuucuaccuguuuaccugugcucuccuguauuucuuuaagggaguuauugauguccuccuuaaaguccucucucacuaucaugagaagugauuuuagauaagaaucuugcuuuuccggugugacgguguauccaggacuugcuaugguggagaauuggguucugaugaugccaacuaaccuugguuucuguugcuuauguucugaugucugccuccugccaucugaugaucucuaaugauaccugcccucucuauaucugacuggagccuguccuuccugugauccucauugacucagaacuccucagaguucagcaguuucagagauccugugauacugggauccugugauucugagauccuggguguuucagagcuccccggagucaagcugucucugggucccugaguuccuggugagaucaagcuucugagauccugggauccugggauccuggucaugucagagugccuggaaguggagcuucuucuggguguuuugggacaggcuguggaguuagcgcccaaggucugcucagggcaccucugaucuuaugauccugggcauguuagagcuccugggaguggagcuuccucuggguguugugggacuggcuucaggguuuauaaccaaggucugcucagagcacuggcccagaccagaaguaacucgugccacuggucgguuggaguuccugagugcaugggucccacagaucccaguuacucccagguguuggggcagauguccuccucaccucugauccuaugauccugggagucacaacuucccuuuucuaaucaacuaauuaccuuugaagucucauuuuaggguauacuugguuuuguaugggacuggcuagaucaagccagaacauagagagagcuuuggaacucaugugacaauuucugauuacagcgaugaaugucaauguuggugucagaacagcagcugcacuucuggaucaguuuuaugagaaaaggcgacuccucauuguaucuacacccacagcucgaaaccuccucuacagauugcagcugggaaugcuacaggugagacauggaggcagagccaaggugggagggagaacucugacaggaagaagacaggcccugaaaacaaaugccuaauccauuuagggugaguuugaggaaccaguacuuuagaugcagucauucauuucuggugcuggugcauaaucuuauuaacauugacuccccagagcuaacccaaucauucuccaaccagugaaguuucucugccuuugcucauaaguuuaauugacauguuguccagguccagccaaaaaacaauugucuuugcugauccuguccagcacauucauagacuggaggugauccaucaggaaucuucccaaggagauaaaaggcauccaaggcaccauaucccucccugggaauauccccaacucaaauggagaugauuuuuguugcuacugaaggagauaacaugccagggaaagguagaaacugugagcaucacacuaaguuuccugauuuagucuugaaguugcuuagcaaugauuggucaauguuacugaauacuaaagaggcaggauugcuacacuuacuucucuuguaggagaucuccuuuauuccuguuagaacauucuugguuuaaucaaagacagcaguuuacuacacacauuagcaaaaaaauaaaaugaauaaugagucuuucuuucacucuucuuugucaucugaacugguugcccauggacugggaagaaucauaugggaagaacuaaguuuacuaaauccguuuacuaaacccccaucacacuaccugcccuuguauaccuauguuuuaauuaggacugaagugaugaaagaucaugaccaaucccauuugguaaggaaaguguuuauuuggcuuuccuccaucaaucacuaauuuaaaaaauaccccacagcuggaggcauuuuuuuucaauugagguucccuccucucacacgacuuuaguuuauaugaaggugacauaaaacuauccagcacaaacucuuugcuccucauaaaaugcaaguaaauauauuuaccugguuuuauggguuuuggcauagcagcauggcauggccacauauuucuugagcucuucuuaucucuacaaaaagaauaagccaagaaacuugccuuucuucuacacagauaaaccuugguucaugcaccaaaauugaccuauugcugcuguguuuugcaaaauuaaauuuuaauagccacaguaaccuuuauucaucuguacauuugguuauggcugguuuaagauuguagugauagaguugaauuauuagguuaaaagccuuugagucacugugaacacuacuauuuauuaucuuuuucuuuugggaaaguuuuugcagcccucagcccuagaucaucccugcucccucaggccccugcugaauuguugauuaucucguuggcuaugguauuuuggaucuagauuuuuuucuuuaaauguauuuauuuauucacuuucuaccccaauaucagugcuccuucucuucccaguccccucucagaucugucucccaauccuccuccuguuuuccucugagaaggaggagccacacuuucaggguaucaucuccccccccccccccacacacacgcacacauacacacaucaagucacugcaggacucguugcauucucuuccacugccaggcuauuuuguauaauuccucuaggaauauaguuagguuuucuaggcacucacuuagccuuaguuucucaauuguuuucggagaaauuuggaguaggcaaagaagcacccacaagaaacccauuuccggggugccuuugcaguuccuuaguuccacucacaccuccccuguugguuguuccuucagcaagcacaguguggccucgaucuccgacaugucaccgugguggagcugguaggggucuucccaacucucaucggcaggaucagagcaaagauuaugccuccagcucuagcucuacagcucagguaggcaacaugcacucuguccuuaaauuucauuuccugaaaauacgcuugcaucucaccaugugugcucuuguaucuggucagguuuucagacuuuuuuucuuuuucuuuuuuuuuauuccuuuaaaaaacauaugugucagaauuaccaauuuugaaacaguuuaugugucucuaaguaauuuuagauagaacucauucacaaaucucaagguuuaaacuugaaagaaaaacccuugaaauuuauucuacagacuucuauagaaacucuauaagaaagaauuaugguaguaauguuugcuagguccucuguccuaagaauaguuucuccuaugcuggcaggaauggguuccauuuuuugcagccuuaaacauaaucagugaguggucugacacuccaauaauuuuugugccacuauugcccuagugggcauaucuuacaaugacagccauuacuguaacuugucauauucacagcuaaguaagacauuauuauuauuauuauuauuauuauuauuauuauuauuaguaguaguaguauuuucuaauaguguaucguacuuucuaacauugugaaaacuagccaguaaagaugaagcuuccagagugguacccaucugaacucucuaaauuuugugacucaaauauauuguaucuucagcauucuguuauuaguuuuuuuuuuauuagguaucuucuucauuuacauuuccaaugcuaucccaaaagccccccauacccucccccacuccccuacccacccacucccacuucuuggcccuggcguuccccuguacugaggcauauaaaguuugcaagaucaaaggaccucucuuuccaaugauggccgacuaggccaucuucggauucauaugcagcuagagacaggagcuccggggggaggggaguacugguuaguucauauuguuguuccaccuauaggguugcagaccccuuuagcuuucuauucaguauuuaguucaggcaaccuucagugcuuaauugcuuuuauucugggaguauuauaaucaugcuaauuggccuguuccugcaugucugacugaauuaugcagugggaaauugcuaguguuuucuucuucccccuccaaguuuauucuccucucucucauacccucccacuucuucugccucugucucucccucuaccucugguaugugguauauguaggugugugguggggguauaugugaauguguaugucugugugugugugguuugguaugcauguguguaugauguaugucuguauguguguguguguguguguguggugugguauguguuuguuuguaugugugugucuaugugucuaugcuuaucuauguguaugguguauguguaugcaugaauguguaucuguguacauauauaugugugucuguauguguguaugugugugguauguguguguguauguuuguauauguguguauaugugugcauaugugugugcaugugguauguguauuuguaugugugugugugugugugguauguguguguguguauguuuguauauguaugcauaugugugugcauguguauuugaauguguauguauguguguguauauaugcaugucuguguguauggguguaguaugugguaugugugugugguauguguacauaugcguacguaugugugugugugugugaugugugguauauguguguauguguauauaugugguauauguguguguauaugugugugucucuguguguguauguggugugguguguauauguguguauaugugugcacaugugugugcaugugguauguguauuuguaugugugugugugugguauguguguguguguauguuuguauauguaugcauaugugugugcaugcguauuugcauguguauguauguguguguauauaugcaugucuguguguauggguguaguaugugguaugugugugugguauguguacauaugcguacauaugugggugugugugugaugugugguauauguguguauguguauauaugugguauauauguguguauaugugugugucucuguguguguauguggugugguguguguauguguucauauguguauauaugugugugugaugugugguauguauguguauguguguauaugugguauauguguguaugugguaugugucuuuauguauguguggugcgugguauguguguguguauauaugugaauguaucugugugugugguguauaucuguaugugugugcauggggugguauguguauauaguguauaugucuguaugugugugugucuguauguguguauaugucaugugguauauguguauaugugcauauguguguguuuguguauuauguauguaucuguguaugugugugguguguaugugauguaugugugucuuuauguauguguguggugugguauguguaugcaugugugugugugucugugucuuaauaggagaggaggguaugaaaauaaaaugacuuagcaucaguugcugcuauccuuaggacagacacuaagcagcccuugaugucuuuuuucuccauccauccagagcacuuguuuauacccuugccuuaauauuuaucucucuuuucugucauacuucuaaagcuagagcacuaauagccagaccuugaguaauguuguauugaagugagauucaauagcuaaaagacaauuucagaauaacuuuuuuuucuuguaucuuuugaccacugugacauggguaauuaggccaaacuaacacuccuuaaaaucuucccuuccugcauaacuuuguucuuuuguacccugcaagucucugauuucaaggucccagaugcauccuuauccuuuagacucccaaaugguuuuaucgucuuguacauuaauaucugagacauccaugccauuucaguuuucugaaaaugaggaagaaagagaauaaaaacagacaauaguaguagucugguucuuguuauuuuaucagaauaccugagacaaguaacucauauaaauguuucuuuucaucaugauucuaaagucuauaauuggaaauagggaaacuccauucaaauugcuucaaguuucuaguaaaggucaccgaucauggagggagcauauagucucauaaauuguuuauauccagagccaggagacagagagacaaggagaccaggguuucauaaucuguuucaaggagauguuuccaaaaggccuaaaagccucaugguagacaucauuucucaaagagucuaccaugucccaguagugccaccuaagaaguaugcuucaacacauggucccuuggaggacauuuaaacucaaauuauaguuuaaucuuuuguguuuauccuuggaaauguuacacaucacuuaaacccccacuccacuggcuagaacuaaucgcauaauuaaaacugaauuucaagggaguuuuugaaaugcagugauuuaucuuuaugaaaacaauaagauagcauauggugaauaacaucaaauguguucaaaaaaguucacaaauauuuccuaagaguguaucacagagagauaccccgguuagauuuaugccaccuagugagagcuagcaucauuuggcaagaugaaaccuggauauaagaacuaaagcagagacuguaguggagcaaugaguauuggcuuucaccccuguccuacuuagcuuguacuuacagaggugauaccacccccaauggcuugggccuucccauaucaaucauaagucuaaaaaaugccccuacagacuugucuacaugucaaucugauggaugcauuuucucuauugagguuacuuuuuucaagaugacucuagcuuggaucucucucugucugucucucugucugucucucuguuugucucucucucacacacacacagaaagaaagagagggagagggagagggagagggagagggagagggagagggagagggagagggagagggagagggagagggagagagagagggagagggagagggagucauaccacuuaucaauuacuuagacaaaccuuguugcaggagacugaggagaugguucaguagauaaagugcuugccucauaaaugugaaaauaagagcagaugcucagaaccuaaguaaaggcuaagaaggcaugauggaccugucuguaacuagccuuggaagacagaggcagggaucucuggagcaagcugacuaucuagauuagccuuaucagugagcucugaguugaauugagagauccuaauuucaugaauaagauggagaaucauugaggcagacuccuuaugucaaucuuggacugacacaucaacacauauguuuguguaccugcauguguguauauguacacacaugcaaacacagacauauguacaccacauacuuguuucagaguuugugaaauuacuuaggauaauagauagaugguagacacagauacacagacauaugauauauacagauacaacauuaauaaaaucuugaugaaauuuugaacuguuuaaaaaugaaaaauagagaauucuacauuagggaaaagaucuauuauuuuauagccuguacauugggacuaauauagagcucuguaggcugauaaugauuuguuacaaauaagcugcuuaaaugaauuuuguggugguuuucaaauuuuagccuacaucauaauuuucuacagggugaaaauuuuguucuuuugcuugcucccuguauuuuuggauuugguaggucuaagguagguccuaagaguuuguauuacuggcaaguuaucugagaaccacauuucaagaacuacuugcuuaguguuuuaucaaggugucaguuucaaauaaaaguuuuccaagcaacuucuaaccaucaccuauugaauuccacgucuggcugcaguuaucuucauaagacauuccacaggcacaaaguacuuggcagauggaugucauacuauuuuucuguuugaauuacaacaaaaaggaauggccaugauuuacucaauaaauagaaaacaggaagaaagacaaagugaauaaguaugccuggauagucugaaaauucucuagucuggcuagaguaccaauuucaaauacuuguuaggccauagagauaguauugaagagaaucaacagaaaugaaaggcugggugccugcuguugccacaucaccacccaacuucuuccgugcccccauuucuuuuccgcuuaaauguguaagcuaagucaugcccuacuuagaguaauuuucuaucguaaggauaacggggaccaaaaagaauaucaguuuuauaaugauuuuauucucagacuucccaggaaggugacucaggaagaauugccaucugaugauaaucaucaugcuguucagaaauacugccaaccucaucacucaugccaaaagcccaaucugugaggugcccuaucacuuguuucugagacgucuagucucagcuccagcagggccuauuccuguugcuguugcuggugugaccauuucucaguucccauggcgguugucuuauuuuuauauucuguguuagccaauguacaacagucacaaggaacguguaguauagccuccaggcuguugucauucuggccucauaaguguuauagaacacauuguuucaucuagcuauccuaccuacaaacuccagccauagcaucccuugcccccuucuccuuccugccuccccuuaguuucucacuccucuauuuuuuucugggcagcccuugagguugaacuuaucuccaacacuuagacauuggcugccugguggaggcaguguaaucaucuuuuagucacuagacagggaauagcaagucaucuuuccacuggggaaaguauuaauuauuccucccuuucauaaaauggcuuuuuaauauauauauauauauauauauauauauauauauauauauucaguuuuuauuuuaugcaauguuauuuuuauuaguuuuucaaguuaguaugaaaaugaguguguuuccuuauggcauguucauacauguauguuauuauauucuuuuuuuuuucuggugcacuuuggguuuuuuuuuguuuuuuuuuuaauauauuuuuauuagguauuuuccucauuuacauuuccaaugcuauccccaaagucccccauacccuccccccuacuccccuacccacccacuccaacuuuuuggcccuggcauuccccuguacuggggcauauaaaguuugcaagaccaaugggccucucuuuccagugauggcccacuaggccaucuuuugauacauauguagcuagagucaagagcucugggguacugguuaguucauaauguuguuccaccuauaggguugcagaucccuuuagcuccuuggauacuuucucuagcuccuccauugggggcccugugauccauccaauagcugacugugagcauccacaucuguguuugcuaggccccagcauagucucaaaagagacagcucuaucuggguccuuucagcaaaaucuugcuaguguaugcaauggugucagcguuugaaagcugauuaugggauggauccccggauauggcagucucuagaugguccauccuuucaucucagcuccaaacuuugucucugaaacuccuuccauggguguuuuguucccaauucuaagaaggggcaaaguguccacccuuuggucuucguucuucuugaguuucaugcguuuagcaaauuguaucuuauaucuuggguauccuaaguuucuaggcuaauauccacuuaucagugaguacauauugugugaguuccuuugugauuggguuaccucacucaggaugaugcccuccagguccauccauuugccuaggaauuucauaaagucauucuuuuuaauagcugaguaguacuccauuguguaaauguaccacauuuucuguauccauuccucuguugaggggcaucuggguucuuuccagcuucuggcuauuauaaauaaggcugcuaugaacauaggggagcauguguucuucuuaccgguuggaacaucuucuggauauaugcccaggagagguauugcgggauccucugguaguacuauguccaauuuucugaggaaccgccagacugauuuccagagugguuguacaagcuugcaaucccaccagcaauggaggaguguuccucuuucuccacauccuccccagcaucugcugucaccugaauuuuugaucuuagccauucugacuggugugagauguaaucucaggguuguuuugauuugcauuuuccugaugauuaaggaugcugaacauuuuuucaggugcuuauucaucccuaccucucacuggccugcccaucucaucaccuuuguuuguuuguuuguuucuaccugccuuuucccuuuuguuuuucgagaaaggaucuccucuauguauauagcuguccuagaacucacucuguagaccagucuucccucauuaugcacagauaucuaccuuuuuuuugccucccaaguggugggauuaaaggcuugcacuaccacugcucggcucauuuuuaugcaaacaaacaaacaaacaagcaaacaaccuccgaaccauucaugauaggaaaacauacacuuuaaauucauacagcagugcauguucugccuguuauauaaccuagagacauuccaacagaaacaaaauccaggagaggagauuggauggccucauuauuuccccgugcucagcugucuaguuacuuugcucuuggcuuucucauuuaaauaugcugguauugauagaaaacaucugcauagauuaaauccauauguugaaguauagaaagaaacaccauauaguugaaaccauaccugacuauuuuuaaaaauuauuugugguacaaauuauaggcaaauaaguaaaagugccuagacguagacugaaccuacacaguucuaaaugcucuccugaaauaguuacugaauaggucaucacuauaaacuuuugaauguuacuuuaaucaaauuuauguugucgaggcuuccuccaacuuggcucuuuugacaucuggggcuggauuuguuugguuacaagguuguccuguacauuguaggauaaauauaucagcauaucuaguauuguucaauuagaugccaguaguaucuaacugccuucuuaugacaaccaaagguguguucagacuuguccaaauaucccgugaguggugaacagucuuguuguuaaucaucacuguuauaguccccuuguagcuacuuuugguuuauaguaccauagccagccugagaucuuccagaccauaauaaugcaaagcagauuugcucagccuuucuucugaauaccaauugacuggagauauuacaauauuccauauucugauuuguuacagaaugaggucagacaugagccaguguuuuucugagcaaauccuccaagcccacacuuugaguagcuugagugagggcauaaaaaggauucaauccuucauggcaucaagcauuucuguugcauaggauuuuccaagggcuauggcuggucccuuaaagucuugggauuuggggucaaacacagacaagucuucuuuuuguuucuuccaggcuguugcuucgaauuccucucuacuccuucagcauggugguaguggauaagcauggcauggauaaagaacguuaugucuccuuagugacacccauggcucucuucaaccucauugacacuuucccccugagaaaagaagagaugauccugcaggcugagaugggccagacuugcaacgucugaugugcuguuacauucaugguggcuccucaucucuuauucuauacuacagugccugugggaaggccuuaaaauaccuuugauguacagauuuucauuuguaauuuuaaaagucuauuuuauuaugugcuuucuuugcucuuagacauuggcacaaggcuuuuuuuaaacuuugaaauguuaaaaaaauacgaauauaucuauucuaacucuccuuuuaguccauuguggcugaugaaauuagaagcuacagccacacucaugcacucagaauauuccucagugugaaacauguuuuccuuuuucuuuuauuguuuauauaagucuuuuguuaauaaaauaauuugaagcaaacuuacuaaaacucaccuuuaaaaaauacucaagcaccaggcuuauuugcuuggcaugaucaguaguuuuaaaacugugauucuuuguuuaucuuaagaaagggaaacuaguccugucaaggggucaacugagcugagagagagagcuacguucccaagugggagaauagcaaauugaaaauauucagacaaagcuacaugauguucauacugaaacugaguagacuuuuuccccaauguaauauaaaaaaaacuauuuacaaaucacuucccucauaugagguacuauaaguaguccagagagguuuaaaguauacaaggggauucacauggauuccauguaaguacuggacgauuugauaucacaagucgaaugacuguugggauccuggaaccaaucauuccugaguuugugaaugaacaagcaugaugggccaguagggcuguauucuugacugcaccccacccagagaggugacaauucagagguuguacaucagaccccuuuucagauauuucuauuuuuaaaugauugagccuagaaaaaaaaucacacauuggcauuuaauaaacaauuagauuguacuccua

SEQ ID NO: 9394 - RNA, 4695 nt, Mus musculus
ugauuccaagggcccggagcucuggccugaggaccuuuucguucugaaguuacccggugggugugaguuauugugugggcaggggggagcugggaggcccgguuugggaaguuuugccggcaggugcaugagccauuaccuggcagaguuuuagaaauguguaagaacagcaaccgagagucaagacacuagaagauccaagcagaaggaaggaaauugauccagaugaaggauggaggccaaagggaaggggcuagaggcuuucuccacggcuuagcuaauuuucaaagugggaugccuuuacuaggcaguugggauuuccguuuucugggagcuguuagagaaaagaaggcaggauuccagcauuuaauaacccaaagcaauuccaaauuuucauuagggugcauacuuaaaauauccagagggucugggucucagaaggggucaaacuacauuuuaaguuaugagaaacaucaacuacugguaaccagguaauguguuuuucuaaagcucucuuccuuggcucuugucugccauaaggguuaaaacaagccuggacuguuuugaacaccucugugcagaagaagugguaaaggugagggugagguccucucugguucaucuuagccuauuucccuauuuuuaaggguucagacucuuggcagaaaaugccucuaaacugugaugaagcccuaaguacuuuacaguguacacagugaagaguuuuaccgccgauaccucauugaacccuaauagaacccuuugccauagcccaagaagaaguuccuuuuuauugcuaaagcaacacuggaaauuuuucucucaugggagacacuccauuuuguugacaaacagaggguggaaaaguuuucaaaucugggcauaagaagagaaaggcugagguuauuguuaugugucagguuuacacaaugcauguuucccaucuacauucuucuuuccacugaucuccuuagcuccacggggcagauaacaaacauuauuucauguuuaaaagaacaugggacacugaaucagaaggaugaguagcugucguuccaaaucaagcuggcuggcuggcugggacugugucuccauacauacauacauacauacauacauacauacauacauacauacauaagaaagcauuggaagcauggguuaugaucuagaaccaguaaaccagagggagauggagauuugccagucuggguucuagaguuaccaaugacuuuucugucuguuaucagcucuuguucccuucaaaauugaaaagagacaugauuuucgguagacaguaccaguccuucaagaaaaaacaaacaaacaaacaaacccacaugcauaagugucucuccuuguuuggggcgcuuuuuugucuugcaggggaaugccauacuaaaacuuccccccgaagacuuuagugggaagaaauuuaaaauuagaagccugagucaucuuaucuggaggaauggaagagcugacuggagguugagggauguggcaaaggaaaugagaugggaaaugaguaugggcucagggcugggaaccugaaagaggaguuucaaguguaaaacuugaaagguagauccagggcuaugguacacagcuuaggcuuauuaaguaacccuugcuuaagaacuaucuuuugaaaggagcacuugacacacacuccagaaaguuauuggguauacucccauuuuuuuucuuuaaaugauaagauauacccaacaccaguccuaacuucugccaccuucuccuagucuuuuugauagccaaaagggccacaaggcccaaguucacacuccauugccaugcucuuaucucuuggugggggacacaaaacuauagaucagaugaccagggugcucuucauaccuggcagcaguaguaggaaagaccccgccaggagggaagcaaaugccucaguguucccaucccccugcagcugaccacgaccugggccguggagggagcaccccauguccacgugcauccggcauguccugcuaacucuucuuacauaagauucccaaguauggagucagggcagcugugaaucccucuuacccgacgucuaauaauaaaucgaggcuaaauuuccggacugcagucacucuagguucaggauugaggggcucuuuugcaacccggacacacaagcauuccggucaucccacccggagagugcgcgccaagcccgcccagcccgcgcgcgccaguccgcccucugguuuggacggcggcuccuugggcucagugccucgcccucccucccccaaacagcuuguucuggguuuggugcuggggugcggccgcuccauccucccagcccuacccugccuugcccugcugggccgcccugccuuagcccggguaucaggcgagaggcggagccacccggcgugccccgcccccgcgguagaaaggguugggcgaguguuacucgcggucagggcugggaccuuuuaucugugcugcuggaggagguaggaggaggagacaucaggggugguccugggcgccugggacaccuuucccggacuauaaauugagcaccuggaaugggcagggggccggagcaaccacagucgcccuuacucacaguccgaucagugaccgcagcagcgcccuugggcagccaccguccgcaacgcaagcacugagaaccaggggauuucgcagugcaagagguggguguccccgcccuuuggcagcccgggcuaauaugguugcuuucgcuuagguuuuagaagggagaaaccagagaguccgggaugggggagauuuuuuucuccuuuuuuuucaaaggucuucugcuaguauuggaggaggugauaccggcuggucccaaggaaccacccuugugccuucucuggccagccuuggucagggugggagcaucgcgcggaccggaugccgggcauccuaaccggguggguaauuuguucuuuucgucucugucucccaagcagaaaaaggcuagacccagccacccaccgucaauccugagccaaagauaagagcagccgggccucacgaagggcugagcugagaaagaagcaaguuagagagggcggagaaggaucugggaaucccgucacaccggcuucaagcaggcucccggcaucagccucugagagcgcuugaaggcggcaucgccagcggucuaucuccguguaccagcgucccuguguuuccgcgcccgcucggccaccaugaugcaaaucugcgacacauauaaccagaagcacucgcucuuuaacgccaugaaucgcuucauuggcgcggugaacaacauggaccagacggugauggugcccagucugcugcgcgacguaccccuguccgagccggagauagacgaggucagcguggagguaggcggcaguggcggcugccuggaggagcgcacgaccccggccccaagcccgggcagcgccaaugaaagcuuuuucgcgcccucccgggacauguacagccacuacgugcugcucaaguccauccgcaaugauaucgaguggggaguccugcaccagccuucgucuccgccggccgggagcgaggagagcaccuggaagcccaaggacauccuggugggccugagucacuuggagagcgcggaugcgggcgaggaagaucuggagcagcaguuccacuaccaccugcgcgggcugcacaccgugcucuccaaacucacccgaaaagccaacauccucaccaauagauacaagcaggagaucggcuucaguaauuggggccacugaggcgggggcuguccccgcugcccagcacccucucucgggucggcucuaccaccccucucuuuccuccaagcuauuuucuuccugguuguggggcgcgaagggcacacuguaaaguugggcuguguacuuggugggguuaguguggagaagagggccucaucgcgagagcagaggaaaguagucgccagagagggggguucaaagacccccggagggggccuacucuguguuggugggaauggaacugggccgauguccuucauucagccugugccuuucuugggguuucuuuucuguuuuucuuuccggaagagaagggccugagaaagggccaugccagggcacagugcuggguugccacacaugggagggcagcuucuagccgggugcuugggggaggcggggcucagccuccugcugcccugccuugagcugccagaggaggccuuggcguugcuaggauugcgucaguuuuccuguuugcacuauuucuuuuuguaacagugacccugucuuaagucuuucagaucucuuugcuuugaaacuucgucgauuccauugugauaagcgcacaaacagcacuguugguaaccgguacuacuuuauuaaugauuuucuguuacacuguacaguaguccuguggcacccuaucccuuucacgccaccccucccccgcccguguguguaaacuggcgaugugccagcuaggaugaagcuugccacucggcuagcgaaaauaauuaacauuauuaugagaaaguggauuuaucuaaaguggaaccagcugacauuauaucuguaucguauggagaaugaugaagggcuccacuguuguuauaugucuuguuuauuuaaaacuuuuuuuaauccagauguagacuauauucuaaaaaauaaaaacgcagauguguuaacaaaacuggacaag

SEQ ID NO: 9395 - RNA, 4695 nt, Mus musculus
cuuguccaguuuuguuaacacaucugcguuuuuauuuuuuagaauauagucuacaucuggauuaaaaaaaguuuuaaauaaacaagacauauaacaacaguggagcccuucaucauucuccauacgauacagauauaaugucagcugguuccacuuuagauaaauccacuuucucauaauaauguuaauuauuuucgcuagccgaguggcaagcuucauccuagcuggcacaucgccaguuuacacacacgggcgggggagggguggcgugaaagggauagggugccacaggacuacuguacaguguaacagaaaaucauuaauaaaguaguaccgguuaccaacagugcuguuugugcgcuuaucacaauggaaucgacgaaguuucaaagcaaagagaucugaaagacuuaagacagggucacuguuacaaaaagaaauagugcaaacaggaaaacugacgcaauccuagcaacgccaaggccuccucuggcagcucaaggcagggcagcaggaggcugagccccgccucccccaagcacccggcuagaagcugcccucccauguguggcaacccagcacugugcccuggcauggcccuuucucaggcccuucucuuccggaaagaaaaacagaaaagaaaccccaagaaaggcacaggcugaaugaaggacaucggcccaguuccauucccaccaacacagaguaggcccccuccgggggucuuugaaccccccucucuggcgacuacuuuccucugcucucgcgaugaggcccucuucuccacacuaaccccaccaaguacacagcccaacuuuacagugugcccuucgcgccccacaaccaggaagaaaauagcuuggaggaaagagaggggugguagagccgacccgagagagggugcugggcagcggggacagcccccgccucaguggccccaauuacugaagccgaucuccugcuuguaucuauuggugaggauguuggcuuuucgggugaguuuggagagcacggugugcagcccgcgcaggugguaguggaacugcugcuccagaucuuccucgcccgcauccgcgcucuccaagugacucaggcccaccaggauguccuugggcuuccaggugcucuccucgcucccggccggcggagacgaaggcuggugcaggacuccccacucgauaucauugcggauggacuugagcagcacguaguggcuguacaugucccgggagggcgcgaaaaagcuuucauuggcgcugcccgggcuuggggccggggucgugcgcuccuccaggcagccgccacugccgccuaccuccacgcugaccucgucuaucuccggcucggacagggguacgucgcgcagcagacugggcaccaucaccgucugguccauguuguucaccgcgccaaugaagcgauucauggcguuaaagagcgagugcuucugguuauaugugucgcagauuugcaucaugguggccgagcgggcgcggaaacacagggacgcugguacacggagauagaccgcuggcgaugccgccuucaagcgcucucagaggcugaugccgggagccugcuugaagccggugugacgggauucccagauccuucuccgcccucucuaacuugcuucuuucucagcucagcccuucgugaggcccggcugcucuuaucuuuggcucaggauugacgguggguggcugggucuagccuuuuucugcuugggagacagagacgaaaagaacaaauuacccacccgguuaggaugcccggcauccgguccgcgcgaugcucccacccugaccaaggcuggccagagaaggcacaagggugguuccuugggaccagccgguaucaccuccuccaauacuagcagaagaccuuugaaaaaaaaggagaaaaaaaucucccccaucccggacucucugguuucucccuucuaaaaccuaagcgaaagcaaccauauuagcccgggcugccaaagggcggggacacccaccucuugcacugcgaaauccccugguucucagugcuugcguugcggacgguggcugcccaagggcgcugcugcggucacugaucggacugugaguaagggcgacugugguugcuccggcccccugcccauuccaggugcucaauuuauaguccgggaaaggugucccaggcgcccaggaccaccccugaugucuccuccuccuaccuccuccagcagcacagauaaaaggucccagcccugaccgcgaguaacacucgcccaacccuuucuaccgcgggggcggggcacgccggguggcuccgccucucgccugauacccgggcuaaggcagggcggcccagcagggcaaggcaggguagggcugggaggauggagcggccgcaccccagcaccaaacccagaacaagcuguuugggggagggagggcgaggcacugagcccaaggagccgccguccaaaccagagggcggacuggcgcgcgcgggcugggcgggcuuggcgcgcacucuccgggugggaugaccggaaugcuuguguguccggguugcaaaagagccccucaauccugaaccuagagugacugcaguccggaaauuuagccucgauuuauuauuagacgucggguaagagggauucacagcugcccugacuccauacuugggaaucuuauguaagaagaguuagcaggacaugccggaugcacguggacauggggugcucccuccacggcccaggucguggucagcugcagggggaugggaacacugaggcauuugcuucccuccuggcggggucuuuccuacuacugcugccagguaugaagagcacccuggucaucugaucuauaguuuugugucccccaccaagagauaagagcauggcaauggagugugaacuugggccuuguggcccuuuuggcuaucaaaaagacuaggagaagguggcagaaguuaggacugguguuggguauaucuuaucauuuaaagaaaaaaaaugggaguauacccaauaacuuucuggagugugugucaagugcuccuuucaaaagauaguucuuaagcaaggguuacuuaauaagccuaagcuguguaccauagcccuggaucuaccuuucaaguuuuacacuugaaacuccucuuucagguucccagcccugagcccauacucauuucccaucucauuuccuuugccacaucccucaaccuccagucagcucuuccauuccuccagauaagaugacucaggcuucuaauuuuaaauuucuucccacuaaagucuucggggggaaguuuuaguauggcauuccccugcaagacaaaaaagcgccccaaacaaggagagacacuuaugcauguggguuuguuuguuuguuuguuuuuucuugaaggacugguacugucuaccgaaaaucaugucucuuuucaauuuugaagggaacaagagcugauaacagacagaaaagucauugguaacucuagaacccagacuggcaaaucuccaucucccucugguuuacugguucuagaucauaacccaugcuuccaaugcuuucuuauguauguauguauguauguauguauguauguauguauguauguauggagacacagucccagccagccagccagcuugauuuggaacgacagcuacucauccuucugauucagugucccauguucuuuuaaacaugaaauaauguuuguuaucugccccguggagcuaaggagaucaguggaaagaagaauguagaugggaaacaugcauuguguaaaccugacacauaacaauaaccucagccuuucucuucuuaugcccagauuugaaaacuuuuccacccucuguuugucaacaaaauggagugucucccaugagagaaaaauuuccaguguugcuuuagcaauaaaaaggaacuucuucuugggcuauggcaaaggguucuauuaggguucaaugagguaucggcgguaaaacucuucacuguguacacuguaaaguacuuagggcuucaucacaguuuagaggcauuuucugccaagagucugaacccuuaaaaauagggaaauaggcuaagaugaaccagagaggaccucacccucaccuuuaccacuucuucugcacagagguguucaaaacaguccaggcuuguuuuaacccuuauggcagacaagagccaaggaagagagcuuuagaaaaacacauuaccugguuaccaguaguugauguuucucauaacuuaaaauguaguuugaccccuucugagacccagacccucuggauauuuuaaguaugcacccuaaugaaaauuuggaauugcuuuggguuauuaaaugcuggaauccugccuucuuuucucuaacagcucccagaaaacggaaaucccaacugccuaguaaaggcaucccacuuugaaaauuagcuaagccguggagaaagccucuagccccuucccuuuggccuccauccuucaucuggaucaauuuccuuccuucugcuuggaucuucuagugucuugacucucgguugcuguucuuacacauuucuaaaacucugccagguaauggcucaugcaccugccggcaaaacuucccaaaccgggccucccagcuccccccugcccacacaauaacucacacccaccggguaacuucagaacgaaaagguccucaggccagagcuccgggcccuuggaauca

SEQ ID NO: 9396 - RNA, 123621 nt, Mus musculus
aagccgaggcugcuggguuugaacggaaugccggagucgguggaacucggagcuagucccccccgaaggucagagaguuguuuugaguucucguacccggaagggggggggggcagggaggagaggacgccagggcccgagagaccccgcgucagagcagaaauugugcuccggaacaggcagcucagcggaagccgcgacgggggcgggucacgugcggcgguggccgugcagcugcccggggagccgggcuaagacaagggcccggcggggcgaggguggcgcggggcggcggcuuucacagcccaagguggaagcccgguagucggagcuccgggaacguggggaacccggagcucgagccccggaggcgagcgcguuaugcaggggguggugugggagucagggcgcuccgagcuccgcguggugcggcgcgggcgagaggaggacgauggcgggggggggcaguuggggggcagagggacgccagcggggcucccuccuagcaagagcuugauccacgcggagauugcgggaguggcugagacccgaacagggaggcgccgcucuugcagucaucggccuuguuuucuucucugaggcaaaucccggaacggcuggaacagccauccuugccugagucccaggggcgcccccacuacgcuugggggagggugcauccugcaggguaccccaguccgagggcgacagagguggcuuagcaagaugugagucaguggcgcgcacgaauucacacccuuccccgggggggggggggggagagagagagagagagagagagagagagagagagagagagagagagagcgagcuagccacuuugggccuccucgggaguguuauggggguugaugggggauacuggagagaaaccaccugcaccacugaagccugugauggcuucgcggccggguggauugggccguacacgugcacaaaguggcgcguaauacucuugcgugggaggguuagggacacaaacuuggucaccugccaagaacccuuaggaacuuuggugucgcucucagccuccagugcccuggaauauacuccucuuucuaggggaguccacgaugcucagaucugaggcuuggaaagaguguaguagugugggcuagccugggacgagaaagccacccccguuccucucacgaaggcacagaacaguugucuugcaaaguuuccuguacuccuccccacacagcccaguugaggaaggguggcucuuccggaggugagggaggagggaauagucucgaagcuaggacuggugcauuaguuccuuuaacuaugacccuggagcgcgagggacacccggguccccgcguguugguguuccuuccagacacuacaccucaggccacuguagcgucuguuuaugguugcgacagcgggugcugagcaaugucugggacaacaagagacgccauuugcaucccccccccgcaccccugcagguuggcaggggcgggggugucgcccugcacggaagcgcauuucuggcagugacacugauuagaugccgugccgcuacgugcacggaaucggggugggccuucaucacuccuguucgccacucacucuucuggugggaaaguuguggguucccccccacccuucccucucgccgcacagcugcugucuccgggggcggaauuaggagaccguguuagcucagccaggagagagaggaucucgccggccucggaaagccgccgggcccgggccucgaaaauccagcccuggcuuugcgucgagcugccgagugcggcgcuuacgcgcccggccagccgaggccugguuuccaucugcccccuucgccuccguguuaaguucgccggggaaaacccaacgauccgugcaaagccccucggaagagcgcuacccccaccccagccugauccugaccgauggaaaaaaugacaguauaggucagaacaggcugcccgggaguauuaauguggcugucucuguucccggugcuaggggaggaugggcgccucgccaggaaaccgccgggggaggagccaugagggccgccugccccucuugaggcuagaaaacguggauucucacagggaccaaacaaaugugguuagacagcuacgggaacuuaucccaguuaaauauggauccaucguguguauuucaagcgacauucccucccccacaaucaaauacacugauucaguuaaaaauaagacgaaaacagguuagucuguagaugcgaaccuugcugucuacuuaucaugagacaugucuucuggagguucugaccugaacccaaucaucuugguacaauguguccuaagguaaaagaguccccguuacgcugcaccuucgagaaaucuuugauuaauagaacucgaagagacuauuuuaguuguaguuucuacuugaugcugcuuacucuuccuugcacacuccugcaagguuguuuguacuuagcucuuacaacccacguuucucucuugccuuucuuuuccugaguacgugccgggugcgggcaggaggaggccacagaacuaugcugcugccaaggccgccgcccucggacucucacuugcgcaccacgcggccuccgaggaggggagaugugaacucuccggguggcgcucgagaacuggaauucugcuuugagucugaggaauuuguuucagaggcagaucagucacagcuuggagggggcggggguagauagagacuguacagggcaagcuccagaggugacccaggcucuaaggagcgaaccguagaagcgucuguguucuuugucuuucgcggggcuggcagccuggcauucacagcucagauaaggaucuacuaagagccacagcccaucgccagcacauuuaagugauuagucuaccgccgguagccacuuaggagaaaugucuugucuuugagaaagaaaaaaaaaaagcggccucauguuaugaguuguauuggacccuucagacccuucuuugcugccugcacacaucucccuaccgugccagacaguaaggagagccuuuccuagauaggaaucugaccaauccuguucacaugaacauuauuuauauuugggugucaguaaaauguaguccacuaauggcagaggacuuuccuuucacccagccucaccaagaacgagguagcuuggaaucgcgucuugaaaaaucaccuugaacaaaggugggcuaggagaguauuucugaaagaccccugcuguguccuucaagaccgcggggagaguguaaagaugcggugucugaucccugccuggaacuugacaguaauccaaacgaaaugaaugccagcagagagcccaguccccaggcuuggcuagcucuuccuuacaguucuagcacucgggaaacugaagcagaggauugccuuaaagcccaggcccaccugggauccagcgugagacuguaagggcugggggaagcuacucuuucacaccaccaagucaggccuuuaagguuaaggagucaagagauaguuugaggccauuuuugcuuuaacuaucuuguggacaaaaacagugaacguacucuccacuuugcccaaacaugccucccgagagaccugggguaacuuuaacuucgggggagagugcccccccccccuuuacccauaggaagggaauacaauaauacccuagcaagcauauguggcacuggcguggucuacacacaggaagccuauucuccucugaccaacucuauuaugagguggacacuaagacugcuuuccuugccuuaauugugucgccccugggguccagaacuguuaagcagcuugcccaaagcccuaagagggccguguggccucucccacgcuguagccugugugauuuaaggguuuucccccccuaagggaaaaaaccucccucccaacccucccaaaauuuuguggcuuaagaugcccaacaucuuuggcugcccccccccccccgccggcgcaaggaaaacuccagacuuagguaacagaaucuacugugacucgugacucugcagcacagaaagggccaagggagacagugcaaaggccccuagcccaccuagccgcauagcauccggcagucacguccgccggaggugacuagggccuggggguagccgauugcucaggaacuccuuaucgccuaucuucagugguccugugaggcuuagguaaacggccacccgcgguggugacugguucgugcaggucccccgucuccaggcgcgccccuaggcuccuccggugggucuggcuagaugcccaguggcgccuccagaagcuccggucuucucuccacuugaggcgccagcccugagcuaagcuccccugcuuggagcuggagagcccaguugggacggcuggauccgguuguuugcccucaauccagcccgauuaccaccagcucccuauucccccgagcgcgcgcacaaacacgcuuuccaagcgcgcuccaggccuccacuuucccuuccucuuccuggcucgcucuggugcuucgaaagcucgcggcgauuguuugcuucgaagaguccagguggggaaggcugugccccucccccccccccccagcccgcauaagugcacacgcuguuaaagccuggggcgcacagccaggccuauggacucccuugucccccgagaaguggcagcugcuagagaggaucgauucuacccgugcuuccgagagacacaggaguaaaaauaggagaccuuagccugugucugaauuuggggacgggagaguaaauccuaucucccaagaggacuaguagguuugcaccgcacagcuuauguggaccacagugugacaucccuacguguucuggagaggcugagcggccuaggcgcacuugggggcuuagugguuuggggacccugggagagacugucagagggggggcggagcaggaguccucacuccucaaggcagaacaccuuuuuuggaaccuugaaacccaggggagccgcugccaucuuccagucgcgagucgcuccugaauguuucuuuaaggcuccuucccgggucgcggcucucucgcuuuccacaggcuagaaagauaaagucagggccggggguuggggugggggacuggcucacacaacugugcucucgacuuugccuaccaaguucacuguggucccagaguguaccccuccuccccaggccacaccucgaugggggccuguccuguuuccuuccucguugguucaaaucucgaguuucauggagagagggcacauuauauugccaaagucacuaaguguccccccccccccaaagucccauaaggauaaccuaaacacaggauucccacaccccgggcugauccuuccucgccuccugggauuaacuggacucacagguccauaaaacacuuccggcggggccagagggucugucugcagaaacacuuuaaaauagcccuccguggccgggagucggaauugacacagacaauuccuguuuuuuuuuuuuuuuaggcuaugaagggaaaucgucugaagcgggggggggggggggguaggguaggcagcuuccagaaaacaaaccaaaccaaaacaaaaacgaugcaccauuuuaaccaaaugacacugauucaggguagcauggguauucaacgggagcagacagguugcaccuggcuucugaccacacuucaaugaugaacacaaacacuuugaaacuugggggcuaguagaggcagccucccccucugugagaguuaacacuaccucugcccuccuuaaguagauugaagaggcuggaaguauuaaagugcuuugcaaaggcagcuuggcccguccauuucgcuguggucagggucucucccacacauggaaggcaccagagcuuuguuaauuaagaaguagaacuaagaccaccccccccccaucccugcaaggcuauggaagauacagucaagcccaaagcacguucagaccaggaauccccaccccuuucuuuuacaucacuucgaauuaaguuucugaagaaugggcgaaucuuuggaaugcucuaagaaaaauucaccauuaaaauucgagguuaaugagaacgaaaauaguccuuuaaaauggauuaaaccacauuuuaagacaagaaccggaagaauauaaauucaaaguagcuucuuggccuugucccccuaauguaggucuggagagcagaugcugguagauagcccacccaccacacacacacacacacacacacacacacacacacauacacacacacaaucugggaccgggaaguaggacuugacagauuugaacagcaaggugauguaggucugcugggcgaagaccaggaagcuaggcaacgacuuggcuuaaaaugaauaugaaaagaaagacuuaggccugcugguguuuccuggaggccuagaacuacucagaauggggaggugaggggugcucuguaaucuucccugaaggauucaagcaauccuacuggccuggggugguggccaggugcaaaagggauaaaggccuaggcagagcuuuaacccaaccucucuaauuuggcgcggggugggguuagaggugauguaguggagagucucugcuugagcuccacgggccucccucucacuuccuuggcuacgcgcggccucuggcuaggacuaaccagccuccagcucacuguccuaaacccuaagcccuucccgccuggaugcccaagcuggauccucaggcuuccccgugccuggcagccucggcucuuccccuuugugauuuaaccgagguucagaaagcuuguuuaccucggcagccuugggcgacucggucugcggaaaaagccccuaggccagcgccgaccaguagggggggauugucuuauagauuauuuuuccuccugguuuuuguuuuguuuuguguuuuuuaaaccagaaggcgagguuggagagggggcgggguggcguguugcugcuguuuucgagagcacuguauuugaaagagaaacaaaagccguuugggagguagcaaggcuguuuuuacauauaaaaaaagugcaaugaauaccuagggcccccagcagugauaaacuaaacgcucggcggauuucgacuauuagcaguuaaucuguuaucugcggucaccaaacaaguucuagggcucggaggaugccgaauuccuguuccaauugagccgggaucuguugggcacauccaaugcccauaguuucuuccagugcaaauccaguuuuggagaacuggguuucccagauggggcacugauuugaggucucauuagacucucuuaggcagucaaagaucugcuugcaucgccgcucgaacucacguccugccugugauucagaaguguguuuaaaaugguuacacacacacacacccuuaguuucucaggccugucaauuuugcacguaguaggccuccaaaaauauuagcaauguacgauagaaacuaaagugaaucucugggccuggaagacagacugauacacagccucguccugggaagacuauuggggugcccagaucuucccuugggccgcugcagccugcguucaucuucggccuccgcgggccagggcgggcgggguaggccagaaggcacuaagcgccuggagccugcacgaugauaaauauugcgcagacagcccauaaauaauuugcauuauguucagcugacaacgcagggcgauuaauuuuaauagcuacauauuugccugggcugcugcuuucguaggcccgguaaugaaaggcgagaggccgcccuggcuccgugcucauggucccggaaggcagccgggaggaaugggaagaaggcccgaugcgguuucuccuccaggcaguccccagggaucccggguuccugccccucuccccccccccccaccccggcccucuccucaguguagaaguggggugcgugugaagcccaaguaaccccgaggccucaagcaacaggagccaccauaaugacgcugcaauuugucuggguugggauagccacuuguggaagggagauccugcggggggcggggggacaugcucuccacccagaccaaaccccgagugaauucagggguguagggggucacaguccgcuuugguccuggggaagugcugguauuuuccaaugcgccugccuauuugccaguagaucuuuagcuuggcgagggcuuugccgaccucagggcaggagcaaggggcaaaacaaagccgugggguccgcguauccugaccucuuuuuggguucagaguccucucugcccaucccgcacccggagggaacccccacccccauauuacuggccgcaaaggcccauggaaaggauggaaagaaagggucccgagcagcucuuuaaaagagggggcggggaggagaacgcggugagccaggccacaacagggcagccgccgcagucccgcgguggcccggugcgugcgugugcgugucgaugugugcgugucgaugacaaagccccgcugccgucagcaagcucccggcugcucgagcgugggugggggaggggaagagaaaguaguaggggguggaacccucgcucacguagguagcugaagcuucucuggagaaagaguucauucaugagccacaggagucuccccggcccggccagguggagcuggcuaaagcuagcaccuguuuuauuuauuugccuuuuuggaaacaagcaagugcaucgaucauuaccauauuuuaauugccuuucucaaaggucaucucuaauuauggguuacgagaagggcuggcuaaggggucugcaaccccuguguguguguguguguguguguguguguguguguccucugagacaaugcuccuagcucagaucgaaaugccauuccgaggguguccgcgagcgccugcaagacugucacgacgugcuggauccacgcagacccugcugcgugcacaauaaaagccgagcaggcggcagagggccgugcagacccacggguuuucuuuuuagaaacgguggugcgaagagacuugacaauaauaacacgcagcaggauuaaaccagggcgggaagaagaaaaugcauuuucguuucuaggacugagaggguguuuaacccauccgaucccccaagagcuuuuuuuaugcacacacagagacaggugcgggacacacgguggcuugggacaaccuauuuuucauauuaaucucgucccuucuuuaagaaugguuguucauuacagugugagcgaacguuuguaauguuuauucuuuuguuuuauggaaaauuauaccagacuagcugaaaagaaaaaaaaccgguugaggugagguuuuuuuuuuuuuuuuucuuuucaaaagugcguuuuuaggaugcuuccuccucgcccccuucauuuuaaaucauuuucagaaacucuugaggcaaaaggcuguacucagagggagcagggcagagggggucucagguucuugggacaggauugaagcggguagaaaucaggaaagagcuguuggguagaggugggcacccgccaccccagcuuggcuuucucagaagagccuggcauuugugagucaccagccuguuucugggaaugccgcuugcuagagccagggccugggucaggcgucuuggagagucggagggucuugacugccucugcuuccugccugcccccacaccuggccuccuggccucaccagcagccagcucugcugggaggaggaaggcagagccagaugacugguccaaagccccagagaccgccuggcuuucuccuccccuguaaucauaaccagaugcacuuaaacgccuuucaucagaggaagcccaaagcccuuuaacaggcagcaaugaaaaccuugcaagggccucucagcaugugugccggggggccccugagcccauuucucaaccaagucagccugagguugccagagucuaagcuuucuucuccuguaccucggaccucggaggccuaauaaguuacccaaucaggucaguugggggggggggugaggaggccagggcugcuguuagguguguggguacagaccccauagaaagagaggcauacagggcagccagcagcuagcacugaggcugugaguggccauguaaggugagguguucaggacauuuccagagguacucgaacuaucucucuaugccacugcucccugcuaagcucuacagaguuuaauacuugcaagagcagcaacuauuuuauuugucuguagaccuggcacaaaguaagccauucaaauguuugggcgaucacagcuguggugggaaagcaagauauauuuagguuugacauaagagcucugccccaaacaguguuuaaucucccgggaccucgguuuccucaucuguaaaaugggcaugagaaugucuauguucacaagguuaggaaaauaucagaugaagaaauugcacaggaaguucuaggaaggucauaauaaacucucaguaucuacccuggcuuuguccuguaaggauagugaggacugggugucuggaaugcagcccuggggaaggggcagggauuguagcccuuggcugagucugagucuugcuggcuuggaguuugaauuagaagaaaggauugcauauaggacuggugguuuaguaaugggugcuuuggggcccacuuauugguuugggggugugcuuuagcuaggaccaccagaaaaggaggaaagagaggggaaaggaggaagaauuguuuccaaaugugcauccaucaaguaugguggcuuaugguguaauccccacacuacaugagcuaaccuggguuauauagugagcgccagguacagugugagacuaucucaaagcuccugaaaguguacauuagaggcacaggcaggcugucccaaagcugugaacaauuggagggagccuuuccagccuuuggucuuaguuucuacacaggggacuaagacuccugcccugaggccaggcugccagagaagaauggccagcaguuguggucuaagagaugucccuucaguccugacccuugcuugucuagcaugguuguauuuaaucaaugacaagucuauccccuagaauuaggcagggaaaggguugaguucugccugguucuugucaugguuguucggaauucuggcuuguucuagagcuccccaguucuuagcuuccccaacccuguccucaccagacacccacaauucagccauaucucucuccucguuguaggucguauuacuugugacacuggagaucaaacccagagccuuuaugaaugucugacaagagccuccucacacacauuuucuuguguuuguuauucacugagcagcagauauggcuagucucaaaagccagcuugcuucaucuccucccuaggaagcuagaauuacaggugggccuucacaccuacuggauucugaggaucugaacucuaguccugagcacuugacuggugagagcuuuaaccuugaaccauccuccugguauccacccuucauccccaaugaaaagaccuuccuuccuuccucccucccucccuuccuuccuucuuuuuuuuuuuuuuuuuaagauuuauuuauuuaauguaaauuccugcugaaucaccccaaggggagccuacuccuggaccauuccccaguuucuaggcaacuuggguugccuagaaaagucuuuucugggugcuaaagugauggcucagugguuaagagcacugacugcuccuucagaggcccugaguucaaaucccagcaaccacaugguggcucacaaccaucuguaaugggauccaaugcccucuucuggugugucugaagacagcuacagugucucuuagaccacaacugcuggccauucuucucuggcagccuggccucagggcaggagucuuaguccccuguauagaaacuaagaccaaaggcuggaaaggcucccuccaauuguucacagcuuugggacagccugccugugccucuaauguacacuuuuuaauguacacuguagcugucuucagacacaccagaagagggcauuggaucccauuacagaugguugugagccaccaugugguugcuaggauuugaacucagggccucugaaggagcagucagugcucuuaaccacugagccaucacuuuagcacccagaaaagacuuuucuaggcaacccaaguugcuuuugaacuccuggcaucaagggauccuccugccucagccuccuuguucuugcuccugcuccuuagccaaugcuugugguauuuggggggggggcagagaagaccuucucuuuagucuuccacauucugugucuugcaaucucucccaggaggccagccugaagacuaaggucaguuugccugccuggggaaugguccaggaguaggcuccccuuggggugauucagcaggaaggcccagcccugugaaugaaaacucacuugacucggguguggcacaaguuggacugucugggucagggaguaaaaaaguauggguuucuaaaggaacgaggaaggaaauaucauaagcuggguuuaccugccuuuccuuugaaucugugaaccacagagacagguaucuucauccuacaggagacaagagaaaugugggagaagaaaagaauaggcggagaaacaaaaccagcggcuggaaggaccugcucucucugcugcuugccuggacagcugcuguaggucacagagggaacagcagggucuucagugucgcuccuucccggagagaggaagugugaaaucuacucucaggaaggcauaggucacugugcuauggggguucugugaagauuacaaugcugugagauacacaugccuguaaucugaguacuugggaagcauaagcaggaauuucaguauauagucuaggcuacauauggagaccaucucaaaacaagcaaaagaauaaugaugauaaagaccccauaauuuuaaaacaaagcauuuguaugugaaugagguuuugucuacauguaugucuguguaccaacugagugcuugcugucaucguaagggcagaagaaagugucagauggccuggaacuagagaugcagacugcuaugagcuacccuguggguguugggaaucaaacuuggaucuucugaaagagcagucagugcuuuuaacuucugagccaucucugucuuucucugucucugucucugucugucugucugucugucucuacacacacacacacacacacacacacacacuuacuuuggugggguggugaaagugauauugagacaguuucucuguguagcccuggcuguccuggaacucacucuguagaccaggcuggccuggaacucauaguuccaccugccucugccucccaagugcugggauuaaaggugugcacugaacuaucuauuauugacaguggaggauuugcgaucucagaugucccacccucccuccuuuuuagaucuguuccucccucaucucuuuuacagugcuagagauagaaacugggccuuugcgcgugcucaugcgugugccugcauacaugcagaggucagaggacagccugcugggaguuguuuuuucuccuacuauggucaagagaauggaauuuggguccucagauuagauggcaggcaccuuuacccuauagaugagcuauuuagcagaccccccccacacacacacacacacacuuuuauuuuuaaccuaucugcccuuucugcauggauuuagcaaggcucugugcaaaugguucucuccugccgcaugucaguugcagggaaggaaaaggguagcuuucagggcuggaaucauguagggguaucuuugggcuuccuuuugucugucuguuggcugggcccugagcuauauacaccauagcaaaaacucaaggcuccccuugaggccugagcuuccucgcaguauggugagcaaagugguaggacagaauuccugagcagugccuugcauaccaagaacaaguacuccagcaaauaaggcugaaacuugaccuagccuuggaagucaugcugugucacuccugucauagccacuaguugccuuuggggucauagcccaugaaaauucaaggggaaaggacauauaccacaccccucaggaacaguggcaaagaacuugugaucaugggggaaggagaaacaucuaggcaggcacucuuuuuuuuuuuuuuuuuuuccuuuacgaucuagccguugcccccucccccaguccuccuucccacaauuccucaucucauuucuccuucucccugccucugagggccagaccaggcagaucucugcuaucuaucuaucuaucuaucuaucuaucuaucuaucuaucuaucuacugggguccucggaguagccuguguaugcugccugguugaugagucagugucugggaguuccguggggucugggcuaguugagauugcugguuuuccuauggggucacuauccccuucagcuuguucaauccuucccuuaauucaacccuaggggucucugaccucaguccagugcuuggcuguaaguaucuucaucugucucagucagcugcugguugggccucucagaggacagccaugcugggcuccugucuguaagcacaucguagcaucaguaauagugucaggccuuggugugccaccacccccaccccuggccccaugagauggaucccaaguugggcuggucauuggacugccuuuccuucagucucuucuccauuuuuugucccugcaguucuuuuagaaaggcacucuugagagcuaggcuuaauuagcaguggcucuaaacagaauagucuacgcucuaauagauacuuauacccucuagaggccucauaaauuauacggggggcagggggaagcagagagcuaaaauuaggccaggggaaaaagaaauacagcuauaaggcaaauauggauuuuaugaaaaauagaaaauauccaaagauagcucucugugagcuugucaagugugggaaggauggaggaaggcuuggguggugggucagacagcuuuuuggcaucucagcauugaaagggaacuagguaauggaugagacugcccaugucugcuguucucuuccaccuggcauuugggguacagugugaagcagcagcccucuauuguuccaggcaaugucgucgagauggccuuacaaauaaucccacagccccauauacagagaucuuuaugguccaaagcuaggaaugucgucagcacauuuccuaaaguaagugugugugugggggggggagaaaugacuugaauacuugcuguuugugcccccaccuucgaugugguuuuaaauacucagcacggaucgcguugugacuggagggguuggguacaucuccagggccccagguuuccauuauccuugucucuaaccccugaauggagaguuugacuucuaauuucaugcuagggguuucagaggcagcagaauuguauuugccucugccuuugaucugcuguuucauuguggcucugacuaggagacagagauaaaaaugugcuggaaaaacaugauuuugucuggcuuuggaauuugugguuauuauuuucucgggcucccuuaagaugacacaccuuccuuaaauuucaaaucagaaucauuucccccauuuuugaauaugcaaaaguucucucugggcuguugucccuuucccuaguaaagauauaauuaaaaaauauguauauggguauuuugucugcauguauguuuauauaccacgugcauggugcaccugcauagcccauaagaggggguuggagccccugaaacuggagauacaaauggccaugagcagccaugugggugcugggauuugaacccaggccuucugaagaagcaaccaaugcucuuaacuacagagccaucucucucacccugauaaagauaacauuuucagcaaggguuuggggugcaccuuuugcugcucauguuuuaaaucugaguggaagcuaaaguccccacugaguagaagagccauaggugagcccugaucucucuuugcucucccugccagcacuugccacuauguagcugguuuuccacagcucccuuaaggugaccaggcucugcuggccuaguucuuacaguggaaacaaacgaaacucagacuuaguaggaaccuugugggucagagcuaagugacacuuggcuguagccccugaaguagcuggcuucucaggcaggagucaucuuaucagguuguguaguuugugugcuacacaaugauccccagucaagccagagaaugugggcugggauucacggguacuguuuucuaauucuuacaaaguuaacaaauaggcuagggaugcugagcaaaaggagaccccuacccugccucugaucaagaagaagaagaagaagaagaaaaggugacauaaggcaggauggaagggaaaagaugucuugggagcacaguacaguaaccuaagguuacaagccagugugaccagcuccuuggaacugcauuggcuuucuuuucuuuucuuuucuuuucuuuucuuuucuuuucuuuucuuuucucuucucuucuuuucuuuuucucuuuucuuuucuuuuucuuuuuucucucuuuuuucuuuucuuuucuuuucucuucuuuucuuuuucuuuuuucucucuuuuuuucuuuucuuuucuuuucuuuucuuuucuuuucuuuucuuuucuuuuuuucaucucucaucuacaggcucugguguuuuuaccuuacuggaaccacucugcucuggguuagagaggagaaaggguaguuuugaaaguaagguggggccccacagugauggcacacaacuuuaugccuuuaaucccagcacuugggaggcagaagcagaggcaggcagauuucugaguucgaggccagccuggucuacagagugaguuccaggacagccagggcuacacagagaaacagaguuucuuugguuuugaacauguggccucuaagauaugcugacgaggacaggccuuuguguacuuggucuaagcauuaccgagugguagaacagaguucauguaaaacaaaggccacacuauagagcuggaauagcucagagagugcuagagugccuagcauguucaaggcccuggauuuggggccccagaaagugcaccauacacaaaugaauacaacuuugaaaggaaaaguauucagacauaaaucugcuucucuccagaggaagacaaauguaaacuuaagugccuauucugcccuuauaaccagaaaugcguaaagcgggagcagggaggucuucccccucauggguuuccucuguguguauguccuguggccuccccuuucccccucugugcugagaacgggacucagggcuucuggcauguuaggcaaucuuuguaucucugagccacacccccaggcugcuugccugccuccuucuacacuguggucaccccgaccccacaccccugccuaaggacuacgagcaaguuaaguguggugguauguugaauggacaucaguuccaucauggugacuggaaauucucaaacuuuuacuauucuaaguaccuaaguacuggccuuucccaccucagcuuguuuguuuuaaauaaaagguuauguaacucauccucaaaguccuauacagccgaagggaacuauaaacuucugauccauucugacucuuaccucaacacagcugggauuacaagcaugugccaccaggagcuguuuuaugauaugcuggggacuggacccagggcuucauagaugcugggcaagagcuuuacugacuaaauuaccuccaggacuaacucaaugucagcuucaucuagugaugucuuaagaugguaaaggaagauuuuaggugucuauauuuuucccuguccucauuguggugugagaucucaagauauuaaauuuguucucauacuuuauaaucauaaucccaucuuauaaucacauagagauuguucauugaucaaacaaaagaauuuugguaauuaaauuucuucuuuuuuuuguuucuuuuuuuuuuuuuuuuuuuugagacaggguuucucuguguagcacuugcuguccuggaacucacucuguaggucaggcuggccucaaacucacaggaaucugcuugccucugccucccaagugcuuugcccuauuucccuucauguguauauuuagggauuuggugcuggagagauagcuuaaugguuaagagcacuggcugcuaauccaggggccgcaaguuugagucucagcagccacauggcagcucacaaccauagauuaaguucuaggagauucugugccuuauucuggccuccuagggcaccaggcaugcacaugguacccagauacaugcucuugaaacaauagaagauacauuagcaaaguaucuauuuuaucccccccccccaucucuguguguguaggcauguggauucagguggcuguagaggccagaagaggguaucagaaccccuuagaauuggaguugaacugggcaaaaaugagugcuaagaauccaccucuaguccccugcaagaggugcucuuaagugcugggcuacuucacugugguggacuuaacauucaaaucuugcucacugucccagcccucaggauauagaugagacugaccccaaacuugucaagcuccaucagcuucagccuccauguaccaccaugcuccaugcuaguugcauuuccuucucuuuuuauuucauguauaugaguacacuguugcugucuucagacacaccaggaggggccaucagaucccauuacagaugguugugagccaccaugugguuggugggauuugaacucaggaccucuggaagaacaguuggugcucuuaaccacugagccaucucuccagcccauuguaucuccuuaaaaccuuuacuuuuaaugaaauggggccagaguauacugauuucgaauggaauauuuugguugaaaauugcuucuuuaccacccacuuaaugucaggagcuuugcaaugaauccagaguuucucauucuucauguuucccauaguuuaaauaaacuuucacccuuuuuccuaaacagcagccuuucuggaguaauucccuguuauuccccgaaacuugggaacuauucuuuguuaggaaaguuuaguguguguguguguguguguguguguguguauuuuuuagacaggguuucucuguauagcgcugguuguccuggaacucacuccauagaugaggcuauccucgaacucacagagaucuaucugccugccucugccucccgggagugcugauugccaccacacccugauuacuguuaauaaauucuuauccuucuuucacagcacugaucuccacuucuagaaaauaagggcgauuuuaaaaauaauuuuaaaaauuauuuaauggauccuucccccaggcguuugauuuccgucgaucucacauucuuuuuuauuuccgucgauuucucaauccuuuuauucaugucuagacauuugcaauucugccuuucuaccaagguuguaaauuguuagaagacucaaggugucuuaaaaaaaaaaaucaccuuugcacuucuguguugcccuaaguccugagcaaguuuccuucaaugcaguuuaccucuuuaaaaaucggacgcauaaaguuccauccuucuccagcccaaggcccuggacuugacuugaaaccgugguaacuuugaaauccucgcucguccugaaagagcaaggccugggacgcccuugaaugcuagggacugugcugcaggccgcacccccacccccacccccagccgacugcauuugaggacagaggcccaaguuccgggccacggggaccaaacgcucugugcuggccgugcuggcugucuccgcagcggagaacaagagguggaauuaaaacccgcacugacgacucggggagggaagcucgccagcugcggcuucccugagggucgcagcucuucugucgccuguggggagaggguccaccuggcccgcagugaggacgggguuccagagggagcgcaggcggcacgcuucgggagcuggggacagucgccgggucccuuccaccaaagccuguggcucuauggagccaccgccgggggcagcggggccugcgccucccggucaagauggcggcgggcgcgcagccacgcgggccacuggcgcccgcgagagguggcugcagucccccaggccgacgccgccgcuagcacugucccccggcgggaagccgcaccuccucaggcgggagcaacccagggcucaguuccuccacuucuucagacggccccagugcucaaucaacgucacagcagaccaucacuuucucacacccccagucgccaggggacuccuguuaccaggagguagggcccggacuccagggauaaggagugugacgcuggcuuccaggucgcacacuguggacagaagaccaacggggacuacugggugcaggccucacaccccaggcauuuccuccaaccuuggagcacgauuccacaauuauucguagccacuaaggaaaacccccuuaauaagacucagaacccagagccgcugaagucaccaggaaugucuuggagaauccauaguauuaucuagucaaagcuacagaauaagagggugucgucccauccccaccccccauacacauuugcucugacaucggaguaggaguaggcuccuagaaaccuuagguccaguuuacuagaaauggcauugaugaaugcagcgcauucugagcgaucucagguugggcucagguugagaggucaggacccccucccagccacccccucgugcgcgcgcgcgcgcacgcacacacacacacacacacacacacacacacacacaccagggaaaggcuggugcagguagugucucaauuggggggaguguggauaaguacccagaaaagcuuccuuauuaccgucuguaagcuguuggcugacaccuccuaccaccucaagguucugucuaaaguucccacguugcaauaucagcucuggaaaaaggggcugaaugugaaguuuuggguuuuguuuugaugaagugaagucguucugcauaacauuugcacuggcuuguuauucugcaggaaaacacuuccuccauccaccuccucagccaccacgccaacuacucguuccuucuucugcaccucccccuuuuaauucucucucucucucucucucucucucucucucucucucucucucuccaccccccccccgcgugccucucgccucucgcccgggucuaggcagcccccuucagcacuuuguucaagugcagcgguaaacccuaggcuaagccuaauucucugugguccugaccuuccuucccacugugggccuggaaucaggccugcccucggggucuccugcuucauuaggauccaacugugcuuucucuccucugugcaccugaugcuuuucaaacguacugguucacccaaaaagaaaaaaaauccaaauaaaucaaaucaaaauaaauaaacaaaucguauaccaaaacagaaguucaaaacagcccaugaaugcaagcucugagccggguucaucccaccauugaaaccaacuaugaaaaaaaaauguuuuuggacacagggucuauguaguccuggcugcccuggaaauugcucuguagaccagacgggccucauacucagagauccgucugccucugccuccagagggcugggauuaaagcuguaccccaccugggcaggcucaaccauccuauuccuaaaguuuucaccgagccaagccuuuuucacugcccugacaccuaccuaaagucucuccgggugccuggagcaccucaccugcacugccacuccuagucccuguccagcucagccucucccuggaagcacuguaacuuuaaacaucuagacaggcugccugccuugcugguuucagugacgacucccaggagaccgcagccuggagcagcaggccccaucugcagugcagcugaacgaguuaagcugcccuaaguuugaguggucuggggugggggccuggaccugagagaaccggcgggagccuugggcaagccaggccuugggggucccuaguugcagggucugaguucuuucacaagugcuguuugagagucccagaagacucauuccuugggggucccuccuaaacccggccuagaggagauuaaggaucucuuggaccgugaagaggcaaaguucuaagacccgaaauguuugaaccuuuggcccuagggccuagaaggguccacgaugcaggcaggcaagggagacucaguucucuguguaaccccuaggugaguuuagguuacuccagacguugcagauagcgcccccccugccccccaagcaagugccagaacccaggguuagugcugccuuagccucaccgaccccgucugggccucacaaaggccuuguguggggcccgggccgaccagaaguggccaccauucccagaucuuuaauuaugcucugagacccuacccuucccccaccccaucgccggcuuccagcccuuuaaucaauuucacgauauuaaauauuaauuucccgccagccacgcuuucucgaaggaggggggaagggacacacagggcaaagccaagaaaaggauggcuuugcugggugugaccaggguaacugggcguggaggacacgcgagcuccuaagugaccgugcccagaacucaggagucacgguguuugcacccuucaacuggggaacuuggggaguuaugaacacuuaagaugcaugucuucaggaggggcagccaggugugcagaguucgggucugcuuggugaccaccuccugcucugcggccccuuccccaccucuaguggcgagucaggcucacacgggccugcagcgcgccgcgaugauggaucgcgccuggcgggggugauuugguguugaucgcacauuaucacuggcagguuggacugguugcugauggacgacuucuagcggcggcagcagcagcgucuucagacaccgugcggugauucgcucgcuuuacaaggucuuucccccuaccacccuccucaccacuuacgcaugucgggagagucuaggagagagagugggggucuccccguccucgaggccacccaccucgguccgggaccgggugugggccgcaggcccagagaggaggggaacuaagaggucucuccuacuuccucucauuucucuuucccuuacagccugcccaccuuccgcuuccccaucggaacacgaagggccuaggucacuuggccggugauuuccucggugcccagcccaguccgcggggugcagucucccucucccugccgcucacgacccucucagggcucccagccgcggaggcgcuggggugaagcccccuccuugcuucguuuucuaaagugccugcaaauacaaaagcgguuccguaaugccuuccgucugcgagagccggaggaccuuggcugaccuuucggaaacugauugcaacugccuguuaacagcccguacugaccgcacugagcggagcggaggacaaucauuuaagugacagacggcgagguggccccggcucaguugagcggccugguuaagcccuccccuccccccuccccagcuacucccccagcuccgggugcacugcgggccguggccagcucucuggagagcggggagggcgcaccgugagcgccugugagugugagugcgugucugcgauuaugggccgaaggguuaacccuuugcagaacgccgccgggguccuuugaagccgagcgcugccggcuuaaucugccauuugcagaagaggaauaaagaggcugccuuguccuacuaccccuaauggguaaacuguacucucuuagcgugacccggucacugucccugcugcugccgaggaaagaucucgacccuuggaucuucugccauggcgcuauguaaccucccugcgcuuuccucuuuuuccucacagaaacaaggaacagcgcggggacagcgcaaagcguccaaaggcuuuaagguucgcgaugcaguggacguggguguuccugguguuuucuguuuuggaaacuggaaaaaggggaggugggcucacagcaggaagggcaggugggggagggggaggcuggugacagggcaccucgggcuucucucucucucucucucucucucucucucucucucucucucucucucucucucucucucucucucucucucucucucucucucucucucucucucucucucucucucucucucucucucucucucuggagagaucgccagcugcucuccaacaggcagcgcccugaaaucuauuuaaagagagggaaaggggaggagaacaaagggggaggaggggggcggcgagagagcagggaggauccgccgcuccgcgggcacaucaagcgcucacaucuguacacuccgcgaucgauggggagaauggauaauauuugucagcugcagaccuuucucuucccgguucccaggaaggggagggggcaagggagggggaggggcaggcagaccaggcgagagaggccgcgucaaggacagcgcgccucccgcugcagccgcacggaaacccagugcccagaaagccggcagauuuuuuucucuuauuaucauuauuaauuauuuuuuauuauuccacagcagccagcgagcgcucagccgcgccccucccccgcucgccugccgccucccuuuguugauuuucagcugcaagcguggcgggcccgagccaccgccgccgcggagcacgauuugcucuugcgcccugggucgcagcugcggcccaggaagucagggcuccgcccccgcccccgccccccgaggcgcggcagauccuguccaccaagcgcgcgcgcgcgcgcgcgcacacacacacacacacacacacacacacacacacacacacacacacacacacacacacacacacacucaucgguggccagccaccaggcuauccuagcaguacuuugcugcggcuuugcgucccccaaagcccaggcgcuggcugccucgaccaggagccagccgugggccgcacaccggccuucaccacccccuuccccggccgcggcacucugaugccgccacccucacacauggucuucauuuagcacacuagcggcucgcuuccucucugcucuucuccucggggcuuuucagagcgaggagggagguuuagaggaaguuagaaaccuugugagcccacggggaagggggaaacccucguuagcagucugagcuuccgagacggaggggagcguccuacgggggauaggacagagccuaggugcccuccccucccuugaauguuaggaaggcuaagugagagguggcagucucacccauucguccuuuugccuguuagaccuuauaucgcuaaccuaguggugcccucagcuaguuggagacggauuggguaggguggagugggaguugaugggacaggcagucaacgaaugagaccuaagauagcucagacugacccaaccguaauggcuagcucaccaaaccuuucccauucaccccagguugaaaaccuaaaacggaugacccaccaauuggccuggguccacuguguugcggaagauggaggaggggagcugcagagauucgggguuuauuuguauacccucauccuccugcgauaccaagccagccagagguggcgucccugacugcucugcgguccugggcagggcaggaagcuggcgcggccgccgacugggcaggcaccacuuggccuagcccgcuguucgcuggaacucgcgaagcaccaucacucugaguugaguucccgagacuccggccuggucacccugagcuguuuuccucccacaucgucaguuggccucucucgcaagucuccugaucucccgccaucugcuuuucccuuccuugaccgaucucuggaacuucgaaauacauucaaccgccuuuucugagauucaaaguuuuguguuuccccagggguuagcagccuaaugcuucccccguuucccggaacaaagcaaguauucagccgggaggggggcaggcugaguauccucucccagcagcgccuggcgccugugcagguucagaacacucucuuuugaaugcaggugccuuggugugagugagugugugugugugugugugugugugugugugugugguggugggggggggggggcuuucuuuccuccgucucuccggggagcccgagaggacacuuguguuuaggcgagguucucaccccgagcuaggagggcacacacucggcuguuuacagugugucugcugcuggagaucacuugcccacacuugacagcgcggggcacccucaggcugccagauccucgagcacuucgccggaggcuuucgcaguacuggggccagggugggcaaggaaaagcgagaggucucuuagaauuuugagguuuugcaguccacagaucccccaccaccaccaccaccauaacaagagucuggaucgaguagucugucaaaggaguuuaggggaggagugaagagcucacgaagcggggugagauucaaaacaguccuugggcuaccaucagacagccuauccccaucccccagucccgggugcgcccuggacuccacucgcgacucagaggugccucucucuggacagcgcuccgcagcuccaccugucuuugccacccuacgcgauagacuucucaccccaagcaaggagggagggcuacgcuagcugugaccacgagcgccccggcuuucagccguacagcucggccuuagaucccgcuccagcucuucccuucuccccggccuguggcccgcuccaggcgccucuagcgcggccugaaacuugaucccgugucggaaggacaguauguaaacaccaggcgcgcuccgagaacccgcgggaggggccgagcgagggccgcccgggcgagcagcuccgaggccccgcgcccccuccugccugcucgcccggggcgugaucggcagggccgcugccuagcucucugccuucccuguuggcucagcuaauuggagccgccgccacuguggcggccucuuguugaauuuucuagaucgcaaccguucagucguggcugccugcggcucccuucccccucccacagcuguuaucaaggccagcaacuuguuggugauggggacagucccuccacugacccuggcgucaggcuccgcauuuacuucagcaguuccaagaguguuuuuuguuugguguggugugugagguguguguguguggugugugugugugugugugugugugugugugugugagagagagagagagagagagagagagagagagagagagagagucauguuggaagugcaaggauucccgccaggauucgaggcuccugguacuaaaccagggaaccuccuggcagaaagccuuuauucucacggccuugcaccaggaaguaguggcaguccagagggccuccaagaacaacuccacuagcuuugguuccuaaccggaaaacauuacaauggggugggguggugauggcagaaaaauaauucccucucucuuacccggucccuuucucuaguugacaccacauuuggaacuugugugcaagucccuugaaccuccugcacuuuggagucuaggccaccuagaugccacaaagcuacuugcacuuugaguugauugauguaccaagcagaucuaggaaaaaacaacacucucugggcucuguagaugcagugcucccaagcugggucagcuucaagccuguggugcuuccccuuccucccagccuucucuggccagccaucgauugccccagacacauuuguacuggaugccgucuauccgugcagccaguaaacuguaguggccuauaagagguuccaaguuuggccucauggcagagugggaguagaaagcaguucgguagacucaggaagaaauuacugguggcaggagaagaacucaguugcuuuuuauccaacaugcacauagauugauugcuaguggauugcacaggcccaaggcccaaccuuguggacagcagcaacucccagccaggaaguacaugcauagacagaggcaaacucccaggguuugggugagugagccaccauuaggggaccuuccacagcccaagagagagcagcugcuuuuccuguuuggguucugggaagggugucuguucccacccuggcuuugaugguucccugacaacuguuagggaacaaagacuggagaccauaggcucauugccugucauuucccaacaccucuggucuucgccucugacuuucacccagaugacuaggaugggagguuuuccugagguaccuuucccaaucuguuuauacuagagcacaguuucccacuccuuccauauugcuuuaaacuaugaugaaagggaauuucacagaauuaauccgauaacuugauguggaggcuggcacuucagcaggucaagaucaccuaggguuuuguuuguaucuaaguucaccagauucuuccaaucagcuaaaguugguugucucuuauugucaauuuuucuucuauuucuauagcugggauggggagagauuucugaaaaaauguuuacucuccauuaccucuaccuaaucugucugggaaugccucguucccuuuuuuaggauaaagcauauuucuauguuuugauaaggaagagaauaauugauguuccucuucaggccugaaaagauaauuaugugucccaggagcugucuguuuggcagaugaucuuguuuucuuggccacuucccucaacccccuugccaccaacaggccugaagguucugguagcucaagaagacccugaaagguaggcauucauguuuguuguuguuguuguuuuuaucauaccaagaauaucccgagccagccauuggaauuccugcuucaucugccugaaagcuuaugccaagagcuccccauggggccuguggugauggaugucuugaggccuaggaacuggagcuauccugauggcagaaguugagugccugcaugcaagacucagaccugagccaaaggaaagcacagacagcaaccaaacaacuccaggcaccuggcuggcugacugcauggaaacaacucuccaucccuccuccauccaucccacagccaggaaagcccacaggcauaccauuuagcgggguuugcuuuauuuagcucaacuuaggaaugguacccacgaaugguacccuuaagcauaucaggaagcugagaugcagcccugacaucucacuucccuuggcgccugccuuagcuuggcugaacuugcuguuccugucuuuuuagaggacuugcuuguagucuugaaucaggaucgcacugugacaccuccccagggguccccagcuauugauuuuuaauauccguauucaauauuguguauuaaauauugaauccaugcaugagaggaugcgaugcaaaucaccaaccgugccugugacuuuaauaguuguuuuauugcccggaaaccacaguuggaugcaaggcauccugcagccaaggcuggggguggugggagugguacagggauggcagacagaagggagggcugagcacagcugggccuccccaggcagacuugagaccucuggaauagcuccugcugaagaaauagggaggcacuuuacaguguuugccuaagggcagcagacugggggcccacucugggguucaauggaaagggcugggucugcugugugagagacauggacagaggaagagguguggagccauguccuuccuuccgggauuucccuaacuggaugucuguuccuagccaguaaccacccuuccccucuccacacucaccccaggacaggcacacaggacuacugaacaggaaagcgaaugucagcaggaaacccuaggucuacuccacuagcugagcuagccuuaguaucuguucuguccacucaccucucuuaaccucuggggcaguuuuccuccucugccacuguggggaauggggucugcacugucucccuuagagcuggauggaacugcuggugcaaaggacauaauaauauucaggggaaagccuuuugucugcagcuguccccagguaggcaggcugaggcuuuagugcuggcuuucucuuucuguucccuccuccagucccuccgccccuccgggugucuucuuucaccccguuccucuuuaaaggccuuggaggccuccacuuggccacccaggcuccgugacacccauuuucuccacucggcuagacagucagguuuuaagggaccaccagcagggagacaggaagggccagaagggguagguggauaucccagaguauggguacagggagugugcaugugcaaagccagccgcaguggggaagcccuugguuucauuugaggcaagagagacuguuuugcagccgcgaccagugcaggcgagcuggugguagguagcgagaggggagcagagcuugcaagguacugauuggcccagcgugacaaucugcuuguggccaggcagucuugguaccuacucccgggucuuuucucaaauugcauuacagugcuagugguugagggaagcccaguuugguuccuaauugcuggaaagccagagcggguagugugcuauaaugguaccaccauagggaagcccaaauggaaacucaguggaccacggcacuccggagaccacucuccaccuauaagccuguuaucuuugccccaagcuuggagaaagguggaugccagaggagccuggauccaggaagacugcccagggacucccucuucugcuugggaaguuccacacaccugacucaccccggaccgacagagaccaacucuggcagcagggcccgccaagagucaggcuguacguucgucacuaggcacaugaauggagaugugccaggcagggccuggcugcgcacgccuccgcgcuggggcucaggcggcggcuacagccuguguuuccgggucugcggcugagccuuccuggcguucuccucuggcuuugucucacugccagcuucucgcuuguccucgccagucuccuggguccaugggucgcgcucugccucccagagugcgccuuugcgcacguguagcugccuucccgaaaccuagccucuugcugcggguuacuggacacugccuuagggucgcuguguguguccauuucuagaagguuccccagucuuuagaaaaaucagucucaggacuacgagacaggagacucggaggguuuggguuugcuucgcuccgauccaggccgaaacuggcaagggggcuuuuauuagcccuccuacugcagagucgaggggggcacacuucugcggcugaccucgcuguuuguggcccucuccccacacucuggagacuguuagucgcccugaagaauuugggcacgcuguccugcuggccggacuuguaggcugggguccgaguacccagagugcacgcgcacgugccaaaggcagggacccgcgguggaucagcaggcugggagugacugggcugaaagccagggagcaccuggaaacacccuaggccucagggcaggugacacccuucagaaccccgacucccuccucccccacuucgccccccuuucccggcccgcaugcggucggccucugcggcggaaacacgguccaacuccuugaaaguaaacuugccgcgagcugccagggccgggagagagggagcgagccggcgggggugucugcgucggggaggccggggaggcuagugucaaguuucagccccuaaugacaaucgauggcgaggugccaaggcccugggaaacggcuggaaggggagcggggguguguguggggggcgggggcggguugagugaaagggaccacgccacagggcccaacuugcgaaccuccgagacgcgaggcgcccacaagagcugagggaggcggcggggcgggggcgggggcgggggcggcgggcggggaggggcgcucgaggagccgcgggagaggagcggagcgcaagcaucuuccgcaauccauucaugcacugaagcgcgugcagagcugcugcucgcugccauuguuacucgcgggcggugugggagcagagccuccacucuggcgagagauaaauggccucugacagccccuccucgccaagagagcuccucggauuucaccgcgcggcggcucucaggucugugccuugcucgcuucccggugagaaccuuuaaaucagccuccccgcccucccuucucccggacucugucccccccgcccucuccggcccggccagggcccccgggggcgcugcgcacaggcacgagucgccuccccagccggggguuacgaaguggggacgccgaagggacccgggggucgcggguggggagaagcagcuagcgccccccacccgggcuccguuccuccgcccgaacgccccgccuccgcgcccacaagauggaucaggcuaccgugcggagagcgggcuguaaauauuuuaaaagucucucgcgcgccggcgguaauggcuuucgcaguuggaaugugugcuagggaaagaggaagggcgacguuugugcuguguugcggguugagagaauuguuucuauacccucucccuagguucggggugggcuguaccgccaggaucccggguuucccgccccgccgcgucccgagauagcaucaagaacaccagucguuagggaacuugagucuauaucagggcgacaaaaggcccagucgaggugacuccagagccacuuucuucuucgagggaggucucucaaggucuugggucugagacugguccaaaaccucugguccagguccgcuucucacgggugauccggggagggcgggaaacgcacaaauaaaaaccccucgaguuugcguggccacuaaaagcuggggcuuggguuucugcagcagggacaggucccguuugcgucuuuggucccuuucucaacuccccuguaaagccucuauccgcucaaaaggcgccauccgcuuugcauuuaaaucugaacguagcuuuguggcuacuuggguucgaaaccuggguaggggagcgggggaaaggucggggcgcagagagguuaaugcccaggcuugguggcagucaugugugggcacucuucugcuuccucgguuagucuaggcuuggaaucuauaaggcugagcccagccggauaggagagggugggggaggggauucagucuucucugucgggagagacuuaauaggcccaccacagggcgugugugaggugagguggucuccuuugccagcagcagcuuccuggcagggcaggggcgccgaggugcuuggagcuggggcaggccaggcacaccagguucucguggaggguucccggagcgugggccuaggcuaggacugcucaucucuauccuccaccuggcucucuccccgauccgccagagagugggugcgggaggccuuucggggcgcgccagggcugcccuagacgguccagugcguggagcucucagcucuggcagcuccucuuccaagggcuuguguugcgcccuucucgcuuguuugucucgugugagccucguaaaccgcccugauuuauuacccagacuaaaugcuuaauuugugaauaugaaacagauuaaaaagggcggggguagggggcuugaggucggcauauuuuagcaaucagaccaaagcagcccggcagauguuucaaauuugucgacauuuucaggcucauguggaaagccagucagaauggucaagagauccuuuuuccuuccuccaaccugagaacuuggcagugaucaacaggaggugauuaguagccacacacacaaaaagacaccagcagucaaggaguuaacagaggcugagcucuucaccuccaggauccggguggagggaaugggggccuagggucacaaaggcaaccugaucacaaagccuggaggagcccagcuaaaaaggcccaaguauuagaagguaacucugaagaacaaagucgaggguccauuaaaaguuaauucagcaaauaaacuucaguggcgauaaaacaaauaagaaagauggcaacuccaacuuaaacuaaccaacagauaauagaaaggaguggcuuugauguggccuaaccaugugcuuucccuuuaagcagguccccacagugagcggcccaagacgggccucuguggagcacccucuuugaaaagaccccauguguacaggcagugcuuuuuggcguuugucauuugggagcaacuucacacaucaaaggcgaccacaguguucuuuucagcucccugguuccacucgcccagugaagcagauacaauuucuauaaauuggccuucuccucuggguuuugauugaucaucaccauaugagauuauugaaagucuaaugucuuauuucacuuucuccaaggggugaggaggggaaccauuuauuggaagucaggccacgugaagacucccggguugugcaauaguaauuuccauuagccuggauuuaucaaccucuugaaacucccaugcguuuccugugggugccucauuucaccucccuucccccaccaggccugugcuucuguggcuguucacagguauaguccagaaccuuccaauugggaaggagaaaauggauauugacuacacggaaaggaacaaaagauguauuucuaagcauauuuauuccaaugcuccaaauuccuucuuuggccuuuguuuuccacuccaaacuuuuuugucccccuuucgccuggaugcgaucuuucauuuauuuaaaguugauuauggcgccucugucuuguccugcgccagacaaaagcuuagagaaagucaaagaccgcguuaauuauauguuucuuguaaacugacuuuucaugucccccuaacacauuuagcuggcuugguguuuaguuuaacacucaagugcugcaaauaugcugcuuaaaaugcugucuuuauuaaaacaaauaaaugaauucaaagaccuuucuaauuucaacucgugugggcuagaaacagaagagaaaaaugguaggaaagaguaugggcuagggaaagguagcagggagacuggagagaaaaggcacacacaugcaugcgcauacacaugcacacacauguacacacacaagcaagcaagcacucgcacaugugcguguaugcgcacacacacacacacacacaggcugcauuccuucugccaucccucccugcagccauguuaaacugguccauacaauugucccuggcuuagcccugcagcuugccagccugccaggauuuuccaucacuuggugccuaaggcaaucauuagcucagaauggacagcccucuaccugcuagccgccagucacuuaucagccagggguaggcuggcuacaucaagcauaggucccauuuguucagccugagagggguccuugguauuugccccugggugaguugguaccuaauuaaacucuacccagggcagcuuacacuaaauauauguggguugagaggaggcugggaggaaaaggcagucauuacuuaagcagggaaagugacuuuucugagagcgggaagaaagggagccgucugaucacuuuguuuacccuaagcagagcuucagacaccacaucaauggccacaaggaaauaaggggaaaugggaacuaagggggaaauccagagaccacaggccccuaaacccaggccuugucaucaucuggaagcaagagggagguuuaucugagcucuagacaacacuggcugcaggggguggggagggggugcgggggugggggggagauccaagugcccuuuguggcuuuggagucauugcucaugugccacaggccuguguguguacucaggagcugggacuguauaaauggccgcggagacagaaaggaacagaugugucaaagaauccagugacugaguguguaugguaaaguuacccugacgaggcacgggagaacaagagaaugaucgaucagcugaagccuaggccuagguggcaggaucccgaugaucagaacuagggcuaaaggacuaguuugcgaacaaagguggugguuguggaucuagaaagaucuuggggucuucuuuaagcccucaugaauucagagggugaaaacauuugaucaacuggacaaaaaguaaaaccaaguaccaagcacuucugguugguaccaagaguuagagcacuuuugguuggagaaaggguuucuuucuggcucacuauuuuaaccaguuagcauuuauuaagcacuugccuuacgcaaagcaguaugcuggacaucuggggccacaagugcuagacuccucaaaugacccagcaggggcgacuccuuccuuuuaugugcaaaauaacaaaggacauaaaggacugugggugagcuucugaggacguggagaaggaaaucagccacucccugagcgucacuguuacccugccccugcgccugcagcuggauuccaggaggaagaugaggcuaccagccucuuggggccagggaccucucugcuuccaaccuaaacccggaccaagcuccagggccuuccagauuguucuguuuggaugguggcaggggucacauggguccuuuacuucccccuuccuuggaaagccugccuaacuuuauuuccccugggggccaggccagagagauuuugaugcaaaucaagaaggcagcuuuucaagucaggacuagccugaccgagagacuagccccagaccgagagaaaagggaagcuugcacugccccccuccagcgcucucucucucuccucuccucuccucuccucuccucuccucuccucuccucuccucuccucuccucuucuccccuccccuccccccgccccccccccgcucuuucuggaacucgauaagggaauacugccucccugaacaaaacaaacuuggaaaucuccaagguuuggaauugugagggagucccccagcagagaauuugaacuggcuuaaauacaucccccuucccugggcacacucccucugugcccccuagauucgacuugccccuugggguguuucagugugaucacaggugcccuccuucgagccaucuggccugggcccagccuuugcucuugguuucccuacgcacuggcgaaacgcgcuggaaccuucaaagcgcauuccuaaacacuaccggggaacuguggggaagugcaaacaaagaggcugggaguacucaggcaguuagcguacugagucugugggccaacagggcuggcccaaguucagucagacucccuggcucugagccagcuagagcuggcagugcgcccucuccagcccacuacucagaccuccuugcccccaaauuugggcacccccccuccucagccagcuuaagucuaagccagcccuccugccccuccgcaguccucugagaacaguacuuccucauucuggucugguggauaguugcaggcuucugcgcgagcucuccgagagagaguaaauugucaaagagcaggagcccuucccuucuuucgaguggccccgggacugagcauggccugaguucccugacugguagcuuugggauuugaguaguggugaacacuugguaacuucgauccuaugcugaauaaaaguccgaucgugcucuguguucccuuacgcaagcagacguucccuagaaauacaaauaggagguggggggggaugggugucaaaucacaugcuucuucaugggucaccggugagcagagucauucgcccacuaccuuuagcucuggucucuggucuguuuaauacuacugauggcucuugcaagggaguaggaguaacaccucagguuuccaagauucugcuuccuuucacacaaaagcugggagaaagucuuuguuggggggggggcucuuagcucuuagcccaaccugccuuagaauuagauccuagcccaggcuauuguugaacuuaaguccugggguuacaugucacccuggccugcucauguguauguuuugaaacagggucuugugcugcccagagcucaguccuccuaacucagcuuguuguguagcugaaacagcaggcuacaacuacagaggacuuuuuuauuucuuucucuuuuuccuuaucccaccgaguacuggaggauugaacucagagucucauauaugcuagguaaguuccuuaagcacugagcuguagccuuagucacuuuuauaguuuuuucuuuugagacagggucuaggcuggcuuugaacucagaaucucccugccucagccauuuuagucaaaggcgcagggcgauacacucgguuuauauauagguacuacagaucuaaacucagaccccuguguuguacaacacugaacccuuucucaaccccaagaauuuuuugggcagggggagguuggggggucuggggucaguuuugaggcagaauuucucuguguagcccugaccguccuggaacucgaucuguaguccaggcuggccucgaacucacagagaucugccugcucaugccucccgugugccguuacugcucggccaagacuguauuuuuuuaagcuauaauucagugguguguuuuuaucgaugcuccacuuacauacaaacaccuucugcccaaucuucuaaguggggacuugggggcugguguccuauguuuuccuuccccaagauucugccuagauaacuagaucauauuaauugaaaaugguaggggguaacaccugcacgugaccaaaaaaaugucauuguuuucagauagggucucauggugcugagguuggcuuuagacuccugauccuucugccucuacccacugaaugcugggauuacagaugggugccaggguagcauauggcaaaaaauucuaaggcuaucaaaguguguugagggaagaccgugacucucucauccaucucugcuucucugcaggaucacugcucccagcuuccugcgcacaauugucagcauagguacaaagaaaaaggaaaaaaaauaaaaauucuguccaaaaaagagaggguuggaaaacuaguuuuaccuugaagaagccaaagcccaaagaaaaaucaaaagacccaguggucuuaaugaacaucuauaucagaaggcaggcuuucaaaagcacaacauuuauuuaacauuccuauugcaagggauucagcagccuuucagaggucugaaucaauuuaacuucaucuuaaacuguuacagaguaauacauuccccacuuagauuguagugauuucuuauucccuccauccacccuucuagagcccaguguggucgguagcucaugccuacaacaccagcauucucuaagcugaggcaggaggaucacuucagccugagaccuugucucaacaccuccaccacuaccacucaaaagcauaggcauagugauacauacuuacaacccaggacuuggagcuagaguccugagaaucagcggcucaaggucguacucgcuaucuaguaagcuucuuggucagccuguguuucgauauaagguccggucuaaaaccgaacaacaaaacaaaacaaaacaaaacaaaacgccgaaggaaaaaggguagguguggggugcugcagcaugagacugcucaguaaggaaaggcacucgcugccaagcaggacagccugaguuuuagccucagaacccaggugguggcaguugucuugugaccuccauauuuaccuaugugcacuagaaauaaacagaaauaaauaaaaugucaaaguaaagacuaucugaaaguuugucuggggaagcuaggguucaaccgcugccucggcugguugccuaacuguggaacuaagcaguuacucucagcucacccacggaaugggaaguaucaacguggcccaucccauaauguugccauuaaauuaguuggugggcaaaacugacuuaaaaauaauaccuugcacccagaaacugaucauuggggguuagggagacuugagccucacacacaucugguugguuucaaccuugcugugguauuugugaauaagcuauuugucuuugagucucugugucucugaagccuuggguguuugaccugcaagagacaggaggaaccccaacaugcuacucgccugugauacucucagacaguuuccagcauauuuuugguuucuucacuguuaaucuguacuguuaggacaaaaaacacuggaccaaagcccuccacccucaccauucuuuuuuuuuuuuuuuuuuuuuuuuuuugguuuuugagacaggguuucucuguauagcccuggcuguccuggaacucacuuuguagaccaggcuggucucaaacucagaaauccuccugccucugccucccgagugcugggauuaaaggcaagugccaccacugcccggcacccucaccauuuaagacauggggcagggguggugauaguguguacuuaccuagcauacaugacauccccagcaguuugguccccagcaguauguaaaaaccagguauagggcuaaugagguggcuaaguugguuugccucagagccugaacacuugaguucuaucccugggacucagugauucucuagagguggauagaugagacuauauuuaaaaaagaaaaagacaaacauuuugauggguaggaguugcuacucagagguagagugguaucuuaugcuuagcuuauaugagguccuggguucuaucuauccccagugcuagaaggaaaaaaaaaauaaacaagacgauggagugugugggggggaggucaugugacucccacccuuccuuagucugaccaucugcuguccugcugauaagagcuucuuagaagacaagaaccuguuguuauguagagauccaaaaagccagaucuucucccuaggggauaugccuaggcucccaaagaggcuggggaucacaaaauugaggguuggucaggugugguggugcaagccuuuaauuccagcacucaggaggcagaaguagguggaucucugggaggccagccuggucuacauggagaguuccagaacagccagggcuacauaguaagacccuguauuggaaacaaacaaaaaagcacagcugaggaucagauagaagaagcgggugacuccaugaaaccucucacuguccugugaguuagagaguuuuguucggaccacccccugcaccugauaaaacuguccgggauauacuuucauaggacaugcugacugguggaggcccugacagcccgaggaaagacaaaggaauuuguuuaaagguauacuuugcucugugcuagaaaacaccucucguaauguuaggcuuuggaggcaauaauaucugcucuugacauugugguguuucugccauauaauuuaauuaacgugugaugcaggcacaaagccagagucaaacguucugacagcucuuggaagccaccuaaaucccuuugaaguuccuuacuacaccccaguaacacacagacaaagccccuaagguugaagacagccccugauauggggugcagaauuuuaucagcaauuccaauaucugcaaacuuccugauaucuuuuucccucaauaaaauguuuuaucuggaugagguggcacaguccgaacuauaggagagacugaagcaggaggaucgccugagucuagauugaagacuaauauagacaucguaugauguacccuuaagucagucugucugucucucugucuuugucucucugacucugucuuuuaucugucuuucuauuucucucucucucucucucucucucucucuguguguguguguguguguguguguguguuuguguuucuggguaucucgcugucuuuccuuuugagaaagggucucauuauuuauuaugguucaaguuggcuuugaacuugcuguauaaucuaggcuaaccugaaauucuuugacaucguccugcaccagucucccaaguguugguaucauagacacgaaccaguacacccagaaagaucaucacccuuuaaaagaaauauuuucuucuucgaguucaccuaucacaaaguuccugagcuccacacaaaucagauacuagacuuacuaagaaggaaaauaauuauauuaucuguauaaaauuauuuaaugccuacuacccuccuaacaaugcuuugggcacuuggcagugucuuggaugucaucaaauuuuauuuuacugaaaauggagaauaaauacaugaacaaaaaagaaaauacugugaguugugcuaaauuaaaaaaauaagaagggcaagggaauaaagagagcuaguauauugaaaaccauauauuauucuaaaaagaaaaaaauccuucuagaaagaauguagagagugcauugugagucuuggguaggccaaggaauauacuuaggugguguucucagucagcucuugcugaaagaaagcuguguaagaaaccacccaaagcacagagcagcaauucauuuugggggaugcgucuguuggucacguggguuugguugcugagcagaggcuugaucauaaguaggagcuggguccaaauuagcuccaugugccuuucacucuccagggacgagugggccaguuagggccauggcaaaaauugcaagagcaaagaagaacaaaauggcucgggaagucucccacucaggacuugccauuguuucuuuugcuuacguuucauuggcuaaaaggaauucugugaucugauggcagugggcuggggaaauaggccucaccucuagugaaaugaguugcagaaucaccauguagauagggagggaguauggggcagugagcagggugcggaguagcccaaucugaaacagauggcucaaaccaaaacuguguaucucuagcuaugacauuuauauauacaaauacauauaucaaaugauaaaaccgccuuugguggaauuguguguuuuagauuaaauuuaaauaaacccauaugauaauuacacaucagcacccccugagguggcuuauggaucuuuguuaccaacuucaggaaaccugggaaucuaggacauaggucuugccaaugcugagagagaagugugucuuuuuuuuuuuuaacauuuauuuauuuauuuuauguaugugagugcccuguagcuguacagaugguuauaaaccuucaugugguuguugggaauugaauuuuaggacuucugcucguuccggucaacuccacucgcuccagucaacucugcuugcucaggcccaaagauuuauuuauuauuauacauaaguacacucacuguaguugucuucagacacaccagaagagggcgucagaucucauuaggggugguuguuagccacccugugguuguugggauuugaacucaggaccuucggaagagcagucagugcuuuuaacuguugagccaucucaccaguccccgagaugugggucuugagggagacuuuucuuaucuccuggacuucucaugcagaguacaguagugggggaggaagaccagaggagaccccagaggcaguaauugcuccugcugacuucugugccugucuuggaaugguagcaaucuggguuuugcucugcugccaacaagcccuucagcugcucuccauggcugcccaggacccagggcugggauggagauuccaguagcuccuugucccugcgccuacccugccuugucuugcuguccuuuagguuuuggguauuauuauuauuauuauuauuauuauuauuauuauuauuauuauuaaagugaucauugcuuuguuugccuuccuucagugaauuccuccugggcucugcagccagccaaagcucuggaagcuggcccuucacuuuaggaaaggucguuguucaauugauucccgcagcuaauggaaucuaaucaccaaagccuggagugauugcaaucagaggaauccaccugguugaaaagaaucuaaguuuuccuuuuguaagcugagagagugaggugcuggggcaggcaugggcucuaccaggcuccuguuuggaugccuugggucuucugauuccugccuuuaaagucaugugaagugauuggccgccugggagggaggaagccuagcccugaaguggaagugggauugcuuccaaagcagccagccaccuucaggcuggagcaccgggcacacucacacaacugcaacuugagcucugagcucacuggcaaccgcgguuugguuucgauggguucacccugaacuuagcacuguuugaaucucccacucaucugugugccccaccccugaauccgucucaguucuuacgcagaggucuuccugugcuuucagccugcuuucccuauuagaugcugcugcugcugcugcugcugcugcugcugcugcugcugcugcugaugccgaugaugacaggcugggagaauauuuauuuucagugaaacacgguagcugugcagagaagcacacacaucauuagcauacagccagaucagcacacucgccuaacugauacccacaucaggauucagacagauccuccucaggccuccaaccagauaucucagccuuccuuacacacucaucuuuaaggcacauugccacccuacccugauuccuaauagcaucaguuagccuccucugauuugguacuuuguagaaaagaagggcaugggagugcacugugugucuggcuucuuuucuuugcaguguggcagugagaucuguacacauuauguguagugcaauugguccauucuccuuaagguaugaguacacauuuuauuuauuucuguuucacucuuaaugggcauuuggauaguuuugauguuguuacuaauaauguggcugggaauguuucguguacaugcccuggagcagcugcauuucugcuaugugugucuuaccagagguugaauugccagggccauagguucugucagcuuuugcuguuguuguuguuuugugguacugaagauugaacucagggccuugaaucuaaguuuucuaucaccgaguuaugcucauagcaguauagucagaauucauagauaaggcugaaaagcaucccagagcagaucugagcguggugaugcaucuguaauccuaccauucaggauugugauuucaaggucagccugagcuacacagugaauuccaggcuagcuuggaauagagcgagagacugugucucaaggggauaaagucuuuuuuuuuuuucuuauaaaauccugagccaugauggcucaguggauaagguacuuaccaucaagccuggccaccuacuagauacacacacacacacacacacacacacacacacacacacacacaaacacacacacacacaaacuaauuaaguaacuaaauaaaugcuaaaauuuuguuuuuacauuuucucaaacuguacguguuacaucagcacuugggaguccaagguggaaggauagcucugaacucgguaccagguugggcugcauagugaguucuaggucacccugggauagagccaacccccacuucccaaaaagcagguccucgcagauauuuucugugaccguccuagggacaugcuaucugcagcuccgagaaacagaagacugguuugauuuaauguucaauaaaaucaaaaacuugguccuugaucuuuagugacaauaaguuuuggaaacugagaauauaaaauuucaaaucagacuggagagguggcucagugguuaagagcacuggcugcucuuccagaggaucugaguucaagucuuagcacccaccuggcggcucacaagagucuguaacuccaguuucagggaaucugacaccccucacacuaaugcauauaauuuaaaguuaaauuauuuuuaaaaacucagaucaacuccugccucucgucuaguacuugggggcgggggggggguguugaggcaugggcaucgcugcaaguuugagucaagccuaggaaggugaguuuaagcuaguuuuagcugcagacugagagaccuugucucaaaacaaacaaacaaacaaacaaacaaacagccagaucauguuauacuuccguggucugguccugccccacucuaagauccccaauucauaggcacaaggugacaaugucacuguguauuucugcuaccugccauuuucuuggugaguccauccagagcucccccugcagugauagcccugcuccucccgcacuucuuuuguugagccugcguuucacuaagcacccagcuggccugggacuccuaguugucuuaggucucacagagaucugccugccccccgacugccucuccaggaagggauuaaaaguuuguaucacuuugcccagcuugcccuaauuuguaauuccaggugucaccuuucccagggaguacugucccccacggcucugucagguccugucuguuaucuuugugcugauuguacagccacaaaacuuagcacagcauuguucugagaaggccugguaucuaagcuccucuuuaguugaguuggguggguuauuuguuuugcuuuguuuacauguuuguuuugggcuuucugacagaggguuuuacuaaguagcagaaggaggaugacccaggcugguugaaacccaaauccuccugccucagucucuuaaguguugggcaguuuuagagggcaggggccacagagccaauaugaagugcuuauaacaccaauucugucucuuagucuggcaugguggcacauaaccgucucagcacuugggaggcagagagaaggaucacgugcauaggccagcuucuacuacuuagcagcuagcuggguucucugagauccugccucaaaaccagaaaacaaucccaggccuugggaggcagaggcaacuggaucucugaguucgaggccagccugguguacaaagugaguuccaggacagccagggcuacacggagaaacccugucuuaaaaaaaaaaaaaaaaaaaaaaaaaaaaaaaaaaaaacaaccaaaaacaaaacaaagaacagaaaacaaaacagucuggaaagauggcucugcaauuagagcacuggcuacucuucuaaaggaccuggguuugauucccagcacccaugauugucuauaauucuaguuccaggggaucaaacacccucuucuggccuccucaggcacuacacucauguaguauacaaauauauauucaggcaaaacacccauaugcaugaacuaaaacaaaaaaauaaacaaaaguuuucucuaaguuguguaaggauaaaaagggcuugccagggucugaacaaguaaaugcugucauuugugacauuuguguaucagcuacgcauucuuaggcgagccuggguaacacagugagagacuccauuucugagguugaggccagccuggucuacagagugaguuccaggacagccagggcuacacagagaaacccugucucgaaaaacaaaacaaaacaaaacaaaaaaaaaaaaaaaaaagaaggggacucuaggcuccgccuaacaguuacuuagcagcagucagguaggagccuggcucauauauaaaaggucucucucucucuuucucucuuccucccucccucccucccucuccucuccucuccucucucucuucucucucucucccucucuguccccccucucucucuguccccccuccccccucccccucucuccucucccucucuguccccucucucucuucccaucauugcucuccccauguauuccuggccagccucuucccuucuuucucucuccucucucuuuuuguguccuuuucuguccucuuucccucuacucucucuccaagacccccuucccaugucccaaauaaaguucauuuuauacuagacccaucguaugacugguaccuggggaggugggggaaugccucagcaugggccugcuuaaggcacccuuuuccaccgcaucauggcacagcauuacaaaacauaucagggagagaaaagaaaagguuuacacucaauaugaugagcguauccgugaaugacuuucugaucucuuuugguugucuuaugaauaaucuggcugagaagggcccacuggcugguucacacaccaauggccucaggguugcuugggaugccaguuuagaauacagaguucuggccccaugccugaaaauucucaguaggcuugggguggggccuggagcucucuauauuuaacgcucugacugugacacauggccagguuuggaaacuagagagucuaaaaagaaugcuuucuucuuggaugugaggaaauaccaggggcccugacugggauccagagaccagguucacaucuucggucucccaccagauauguuaugacuuacacaacccucugggccucacuuuucugugaacugggaaucacacaguagaucuauuuggauuaccagugcugggcaacaaauugcccuagaacuucacuuaaggcuguuuugguuuuuuguuuguuuugagacaaggucucucucuguguaggccuugcuggcuguccuggagcuugcuaugcaaaccaggcuauccucauacucaccgaggagaucuaccugccucucugccuguugagugcuggguuuaaaggugugcucuaucaugcccacugaagguugauuucuuaguaacguuagggguaugguacagggggauggggacaagcaagccaagaagcaaccauguagccuuuucugacuuaagucaucaucucacagugucaccucugguacauugaaaaacauucaaaagcccagcuagguuugaagauguacacccugucucaugguaaaaacugugacacucaaugucucaugguaaaaaccgugacacucaaugugcaggaguguuuggaagcagcacaguacgucuugagccgucaggcagauucagcgaggucagcuuuuaacauacccuagacugacacagcuccuuccaaucugaggucuccgaggucccagcaaacucaauaccaggucccaccuuuccacugcuggguguuggugucaggcgcccauagaaaaguagaagaguggucaacauuucucacuucccagucaucucuagucacuuuggauauaguucaaggcagcagugggauaccaucugaugccggacaccuuagcuccucagagaggguggucagauccaccaggccucuguuggucccuugugaccccgauaucaggccucuuccuaugccuacucucaacuggcagcuguuuggcuugggauggagauuccaggccauucgcauauuaagggacuccgggaccuacuggugcuagaaugauggcuagaguaacuuuaguagcaugcuucugucucccuggucucuucagacuugaauuuccuuacugcagguuuggugacacugagggaagaucaaguagaaaccuggagggcugggggugggguuagaguagggggagauugggggacucucccagggaggaaaggaugacuaguuucuaggggauacauuuuacaggccucaucugaggcagcaugaagagggauguggggcucuccgcagugccagagugggcaggaaaagcagagcagcagaggaaggagccauucugggccugguccugugugcuggcauuuaugaagggggccauugaccucuuugaaaggggcagagaagaguccauguucgguguucugaggaagcugcuuuuccuccuggggcucuccagcugccacaucagcaccccuccuccacuggcauccauuuagcaacugucuuguucagagcuccuagggaaagagcucacaggaauguggaaguuagcgcaccccuccccguccccgcccaccaucguguacacuccuuguauuucauggacauagcccugaugccuagagaugguugcuguguguguauguguguguuucagauaaggucuuauguagcccaagcugacuucaaacuuaauauguagccaagagugaccuugaacuucggagucuucugccucuaccucuugaaugcuauaaucacugauacacucagccaugcucaguauugccaccccacccucaccauguguguguguguguucauucugggguucuaauguagcuccuuaugcuugccuuacaagcauuuuacugaacuauuucccuagccccuuugcccaguuuuaugcaguguuuaugcagauugaacccaggucuuuaugaaugcuaggcaagcacucuaccaacugagcugcauccuuagcccucuuucuguguugucauggauaaacacacaccacaugucccaugguaagcacccuaggaauucauggugaaagacaaaaugugaggacuccgccaugucugacucaggaaaggcgacaccccaaaucaagaaauggucuugaugcaaacugcaagagguuuuuuugggaaagaccagugcacuggggaugacucauaucccacgcagggguagaaaagccaaccacgagcucaagggguaagggguuuauaaaggcacaaaaacugcaaacaccuggcauccugaaacaauggggcaacuucuauucccugccauuagugaggucuauuuuggacauaggucuaggggcuuaaaauuuuuuucacucucucucagaaucuuucaauggcaaggaaggcagggcgaggaguaacacgacuggcuaugggauaggcugccuauucucaucuccgugccucaguuuccuuaucuguaaaaugaggguaaggggguacccuccucgugaggaggaagugacgggugccuuuaacagguugauccccauuuguuagggauuggcaaaacugggauuguagaaagcaaccagcaucaucuagaaggacaaucugaagccaagaggcuagaggugggaacuguauuuaaacagccucccucagcaucauauagggcagaggaaacaccaugacugucagaguccacuagcucugugaucuuaggaaagcuaccaaaucucagggucucucuguuuuuguuuuuaagaaacuguuucgauagguagccuaggguggccaaccuugaacuccuaugucucucaggaugguuuagagcuuuuuggauuuuaauuuaauugaauuuuuugagacagggucacaguguguagcuuuggcuggccugaaacuuguuagguagaccaggcuggccucaacacucagagaucacuugccucugugucaggauugcugggauuaaagagguauaucaccaaacuaggcuuggcuuugaauuuaugacucuccuuccucagagucccgagugcuaggauuauaggaaugagccacugugccuggccuuaagccucaguucuaccaccuauaaaauaagguuguggccaugucuucuuuuaaccagacauucaugaagucacauaaaggaaugcauuaacugugcaucucagucuucauagguaaaugaaggcuuguucccuacuggcucagagcugugcauccagaggguguuuuguuguuguuguuguuguuguugcugcugcugcugccgccaugcugaggacuggacucagggccuugucuauaucaggcagcugcuuuacuacugagcuauaggcuagcuccugggaccagguuugauuuauagauaccuggagaucugacuucugcaggcuuauuagagacagaaaugguggcacacaccuuuaauucagcacuccagaggcagaagguagcagaucucugugagucugaggccagucugaucuacauggaguuccaggauagccaggaacacauggagagacucuugucuccaaacaaaacaaaacccaagaaagaaagaaagaaagaaagaaagaaagagagagagagagagagagagagagagagagagagagagagagagaaagcaagcuugcaagggcugcuggagagaugguuuaagaaagaaagaaagagagagagagagagaaagaaagaaagaaagaaagaaggaaagaaagaaagaaagaaagaaagaaagaaagaaagaaagaaagaaagagaaagaaagaggaagcaagcuugcaagggcugcuggagagaugguuuaguuguuaaauacaaucaguguucuuccagacagcugggguuugguucucagcacccacuuggugacucacaacugccuuagguacacacauuuaauugaaucucucucucucucucucucucucucucucucucucucucucgcucaauacugucuugcuauguaggucugucuagccuggaacucaguuuguagagcagguuggccuuuaacucaaaggccuucugccuucugagugcugggugcaugugccaccacacccagcuugccucucuucuuuaauauguucccugauggccuguguauuguuauggcaacugaaaacaaacuaagacguggacauauccucacaguugggugguugucucgucaguucuucugcuggauauaucagggcuagcuagcucauagagauggagucauaacugucagggagaauagccuggcaccuuagaagucucgcaguaccgcuuugggaacauuccugguguucagagcaaguuauuaaggcugcccaaauucuagggggcagcuauagguuucgcccuguucugaucugcucauuggucugcucauacuuccauuggcagaguaccugggugcuggugauagacccaguggcuuugaggucuggaaaucaaagcagagugucaaugcgcuugguucuuugugaggucuuggcuuguaggugggcaccuucuaacugugcucucauggucuucucucugugugugccuguguccucuuccucuaggacagaagucaagguauauuagggucuacccucuugauagcauuuuagcuuaagggccaugguuucccauaaggucacauucuaggguacuaggacauuagcauaaaaacauacucucuuccucccuugccaggagguucugucaagaacccaugccuucuuggauggacucugaggugacccagucucucaccuuggaugggaugcaacugugaauacaacuguuacuauuguaacaguuguaacuacuauugucucaucugcuuaccugaaggucagugagaaaaaccucugacuaggccucacauccuccauuuucaauuucucccgcaagcaggaacuuuucccaguuagccgcucaagugucuguugucuguaagaugucauugcugggcacacagcaggcuucugggaccaccucgccuaucuuugcuaccugucuuucccugggcucauccauuguaaguggaguuuguuguguugucuccacgaacgggacagugcagacuguccacaccugccuuugucaccucccagcuacagcccuccauauuccaucugacuuccucucucugucuuuccagagcagucuccuuggaaugagcaucucaguccuucgcagacacguacauagggaguguacagaaaauaguuacagagcagaacucauuucagaaucuucacgguccuuucagguccuaguucagaagccugcaguccgaaauuucaaagaacccuauuaggauucuguuguuguuguuauuguuguuguuuuugcucucucucugucucucugucugucucucuuucucucugucucgcucucucucucucucucucucucucucucucucucugugugugugugugugugugugugugugugugugugugugugagugugauguggacagggcaccccugugcaugaugcuccuguuggauucccauucuuuccuucuaucauggauucugaggaguagacucaggucauccgguugugaggcagguguuuucccggacugaucaucucucuguccccuccacagagauucugaagggguuucccaucagaaccucucuucaaggaccaugcuccuuccucauuccacagcugcucauguaaauaauaguaacaguaauaauacuaauacuaauaauaauuugagacaggaucucuguuuagcccuggcuguccugaaauucacuccauagagcagacugacugacauagcuucucuguucuguuuugagaccuuaugcugagcuagcuuaccauccuuccuccacuacuugggcacuauaacgacaggugugagauaauuacagggacuugguacgauggaccauuuuugucccuccuauauccccccaaauugucuccccaucccagccucugucuccuuccagguuuuauucuagcccuccugaagccagggaaaucaaggacugauagcaugaguuugcagacacagcugccccaagagaaaugagaaaggggaagaaaagacaccaaugcaaauagacggcaugcagagguggacaucaaauggccccacuucuggguacggcccaagggaaguagcuuugguagcaucaucaacaagcacagucgacaggagcuagcaugugcugcagcagcgagacuucuguacagcaguuggguucugcguggguuccauccugagacuccauuaggcuuuccccacagcuugucagaaaccuccaguguguucagcuggcuggagcaagccgccauucuauagcuucagcccucccaccgugcugucucuaguggugccaagguuucauccagagguagaguucacugggggcucugaggagaggacccagccagggauuaguaaugcccacaccccuuauucaguuuugcagcuagacucaugguggguaucuuugaaggaagauuaguaaguguaagagacaugcagaccucagaguugccucaggccccaggaaugaggucagacgugauaaccgcugugcuguggccagagcucccaccaugccaugccucucugcuaaaccagagcauguuuuccaaacagucuggccggucagucaggccuggggcagcggugggcagcaacaggcuaagugugucgcugggcugugccccaaagcuugggcuuccuaaaucagcacguucccuguuacucaguacucugacuugugugccuagaaauagaaaacuccccugcacuggagggggcagggagcuaagcccuagugacaggggacuuugaauucucaggauggugaccgaaggcugcuaagaauauccagcacugaccacaagccaguugacacccuaugcaguggcaaucuucuguugcccuuccggccugggaggaaggagguuccuaugacaucacagcucaugaaguugucccuucugguagggguauguagacaugagagugaggagggaggggacauaaaaaggcauccacuggauccugccuucaaggaauauaaaacuggaaaaccauagaccuauuguccaucucuuacaaaaaucauggucagucauccagaggggaccagcagcuagaucaagggguaucugaggccuagcagcuaaggaacaagagccagggagacucuagacucacacacuccaauagcuagcccuguuucuucggguacaaagucaggggcuuggauuaacguuuuacaaacaaagaaauauuuguguguuguuggucucaugagcucucugcaguagaaaagaggccacauauacacgaaugcaggucgccuggacuacccaaagaagucaaguaauagcccuaguuuggguuuaggguuuaggguuuguucuuggaggccaguggagggcuggaaaaagcagauuaaagacugagcaagaaagugacucaguugguagacuaguugccugguagagccugggcuuugaucccuagcaacacaccacacacacacacacacacacacacacacagaugaggugcuggcgaacaucuaugacacugagagguauagggagcugucaggagagucagaaguucaaaccagcaugggccacuugagaaccugucguccccccccgaaaaaaaaaacaacaaaaaacaaaacaaaacaaaaaccuuagccaaggagacaaaaccaaaguaaccaaacaacaauaaggaggagcagaagaggaacgcccaugccuucggagucuugagaguggagcuuauuguuaaaaauucaugcuuacuaucugugaggccuucgguuucauccucaaccaaauaugaggugggagaacaggacagaaacauacgcguauauguguuguuuguaugugugggugaggcaaagguuggcaucagucaucuuccucugaagccccuggcacucccgacagcccaccaugcagaagaaugagccuccuaauuuagcacaagcugggugagccaaccuaggaccaugagggcagcgcugagaggagggggagugugaauuggugccacucuaacuaggggccuggacaguggucuggagaagggcucuugguaaccagugcuuucagaauagagcccugggugacuggacaaaggggacugagggaaagugaccaggaccagcuucuaggugggccccaaggugacuaggggcugaaaacaacucuugaaugaaggucugggguugcccaggagggcuggcagaggccuguuaucuuuaucuccagugaauaccuugaaucacuauaaaauucuggccacagguucugccucccuuuuccccugguccuuccuccuauuguaguuuuuauuguaguauuguuaggauccuaggcccccaccccccaccccuuacuuagagcaagcauccuccucugacagcaucuuugcccugccugugccugugcugucucuacuuuucugcaggauuucuuccugcagaaauccacuugacucaccuccuuucacuuuuuuccaccuuccuuccauuccgggucuggaaaaggccuuggacuggugagguguuucagugugcaaauggagcuugcugccaaacugaacggccugaguucagucccuggcgggagagaaucaaugcugguaaguuguccuuugaucuccacacauacucuguggccuacaugugccaccuccgcacucuggaucacacaaggcuuccucuggucaccucagaaucaugccaaguucuacuucuuacaugcucuucauguccucucgugucuucuguuguguccauuguccaccaucucuggaugaccugcuaccuugauuauuuagcugccaucuguccuguuggaagacacguguccugaaggcagcuauuugguuuguccccuuuggguagacagugccuggacuggccucugcacacaguacauguguaucuuguaggugggguauaagccacgggcugcaugguggggaguaaacuauaaaggggcagcagcugaaagagggaggcagucaggcagccauugccgcagcauugagagaaugcucugcugggcaggcaggucacuggauuuggugcaggaggagcagugaaaggagcuggcaagaucaaagauucuggggcugcauuacugaacaguugguggggggccauuuucuauugcugcauagcauucuggagaccagguacguuauaaauagaaauuuaagacagacauguuggggcaugccuuuaaucccagcauuuagaaagugggugcuugaggaucaggaguucaagaccaaccugaaauguccaguagaccuguggcuagucuggguguccuagcaguggaaaaaacagaagacccaagauggcucagcaggugaaggaacuugcuugagucugauuucugggacccaagacuccugaagguuguccucugaccuuugacuuacaaaaggaccacauagggggcacacacacacacacacacacacacacacacagagagagagagagagagagagagagagagagacucuuaggguuucuauuccugcacaaacaucaugacccagaagcaaguuggggaggaaaggguuuauucagcuuacacuuccacacugcuguucaucaucaaaggaagucaggacuggaacaaacgcaggucaggaagcaggaggggaugcagaggccauggagggauguuauuuacuggcuugcuuccccugacuugcucagcuugcuuucuuauagaaccaggacuacaagcccagggauggcaccacccauaaugggcccuccccuccugaucacuaauugagagaaugccuuacagcuggaucucuuggagguauuucuucaagggaggcuccuuucucugugauaacuccagcuugugucagguuaacacacaaaacuagccagugcgcgcgcacgcacacacacacacacacacacacacacacacacacacacacacacacacacacacugaaugaauaaaguauguauuuuuugacuuuaaagaaugcugggcagugauggcgcacgucuuuaaucccagcacuugggaggcagaggcagauggauuucugaguucaaggccagccuggccuacagagugagguccaggacagccagggcuacaggucucagaaaacgaaagagagaaagaaagaaagaaagaaagaaagaaagaaagaaagaaagaaagaaagaaagaaagaaagaaagagaaagaaaggaagaaagaacaguuuaagccaaagaaagaaaggaaagaaggaagaagggaagaaagaauaacaguuuaagccaaagaaagaaagaaagaaagaaagaaagaaagaaagaaagaaaaacaguuuaagccagaggugauaaugacccccuauaauuucaguccucgggaaggugaagcagggagauugcagaaaauacuuagccuggauugagggagggaaguguggucuauuuaggcguggcuuaugugcuuaguaugugugagaccuuggguucugagggagggaggaagaguggaaagaaaagagaaucuaaccaccaccaaacaaacagaaaauaggagacagggagugagggagagagggagagagggagagaggagaggagagagggagagagggagacagggagugaggaagagagggagagagggagacagggagugagggagagagggagagagggagagagggggagagggagagggggggagagagggagagagggagagagggagagagggagagagggagagagggggagagggagagagggggagagggagagagggagagagggagacagggagagagggagagagggagagaggggaggagagagggagcacagagguucacagcuugcaauucugaaggcugguugguaggugcaagggugugguaggugcuggugggcaucuggugagggucucccugacacaucccaacaggugcaugguauuucccaaagacucucccccaaauagcacgcacaguugugacuaauggggguuauaguuccaacauaugaacauucacugugggcuccaguggaagucccuguggaaaaggcagcuggacuggaggagaggcaggacagagugggcauccggagcagagagccuccauaacaugugcuguuagaaccaacugggcuguacuguagagaagaucuguucaugaaauuuuaggguuuauuuucauucuuugagacagggucucacacugugcaucacucagacuggcuuuuaacucacuguguagccuuaagcuggucuuaaauuuucaacccuggugucgggcuugcacgcaugggccgucauacccagcuuucucagguaauuugacuuuauuauuuaaaauucucuucauuguuccgggggccgugccacauggaagcuguucucuccuuccaccucugcguggguuccaggaauuaaacucagggcaucagacuugaguggcaaaugcuuuuacucacugagccaucucgccaagauuugggcaugccauuuuacauuuuaucugccuccuuuuauaucuaauucacacucaguuguuuauuuguagacaauuaugucaagaggagagggagcuggggaaaucaguuagcacuagggcauccaguacccucuuuuggccuccacacacauacacaaacacauaaaaauaaaauagaucuuccuuuuuuaaaaaaaucaauuuauuauauuuugaauuuguuaucacuuuauugagguauggcauacaaaauguauacaucugcaugaccaacauccauaucaacauauggaacauuccagaagucccuacaguggaagggaaucuccuaguccaacuucuaacaccuuagcucuguucacuuucugaaaagaugucaggagacuccuauaacacgugauucuggggacagauuuccuuuggaccacauuuuaucaguuagcugcaucaugccaucugugcuugcgucuuacaaaacagccuuccagcagggcugagcccugggagcucuguucugugggcuacauggagagacagcgguggauuuguuuuuaauuugagcggggcagagagaauauuagguuguggccuucucaggcuugucugcggcuggcucaggcuagacuggaacucuugaucuucuuuccuuccuccucugucgcugccaccccuggcuuccuaucaguguuuuaaagcaagugacaggcugggcuuuguguuaggugcugcuugggauuuuaaaguggaagauguaguugagaagagugaagaggagauaagccuggcuugcaggucaacugggugcuuaagcugccagaccuugccucuucucuaggggacuuucuucaugccauucuggccuaaagaugagaaauagaaccauugcuucaggauaggagauaauucaaguucuacugucuaggucauguaggaaugggugagagacagagagagagcaaagagaugaaagagagagacuuacuucuggguuuggaugugguuucuggaacagaaauucuuuacaagagccucucaugcuguuggauuauugcugguuucugccucucacauuagagggaauuucagaacccaacgucuagaaagggugaaugcuauggccuggguguggugugacucccccccccccccgccacacacacacacacacacacacacacaccagacacaacacaacacacacaccagacacacaccagacacaacacacacaacagacaaggauucaaaugcuggcaccuugaucuccaauuuagcggugguggcaacuuuagguaguggggucucuuaagagguaauuaggugccuggguccuaagagccuuucugaagagaugcaagcgaguaucaccagaguguauuagcuuuccugaaauuggguugcuucaaagcaaaacuuacuccccgacucucucuuguccccuucucuauguagguacuauccucacugcuucccugccaugcucucaugaugcaggcaggggucccuuaccaagacaccaaugucacacuauuggaaacuuccagccaccagaggugugagccaaguaagaguuuuuacuuccuaagaugcuccgucucggguauuuuguccugccgacacaagcaucuugcccaagaucacacacuaauauagccagccuuacaaagcagauccgcauccucugcaagcuccucccagacuguguagcacccuccccuugacaaagagccuaguguugccaccaaaagaacgaaauucccucauuuugaaaggcguugugaauucagcuccauuguguagaauggagcaaagaugucucgagccagcaugacauuauaauucacgucccucucauguuauuuaucuuugcuuggguuugugugucuuuggaagcagccuuaaaucauuauuggaacaaaguagagagaaaaauaauaauauauaauuacaaaugaggaauacaccguaugauccuauuaauugccuccccugcaaucuuuauuuuuggcauuuugauaauaauuaaaggauuaggcuucaauugguggcaguggcggguuagccuugaacucuauaaacaguagcaguacccccuauaggaguaaucugguaccaucugccaccugggacccggucgagcagcaccagggcuaugcucugccaggcucaucugaauauuuacucugcucugaagagaaacuguggcaaugguuggaaaauaaaccccaaagcaaaggagaagcagaggaguaaggagacugcacgcugcauuaaucauugccagccagccuagagaagaggaccauggcugguucaagaagacagagcgaaauuaucaucaagauugauuuccccuccagauucccugugccaacaagcagaccaggagggucccaguguagccacuggcacugaacccaugaagguauccuacuacaccuugucaaagagcaaggcaaagcuaaccaccacccucugccugugggucauucuggaguuucugccaguuccacccuuggcuucacaagccacaggaguggggcgguguguguguguguguguguguguguguguguguguguagcccucuccuagggaccuggcagauaaauucacugcaggacaaugauguccuuaagggacaucauuugcaugccaggaugcagugaaggccacuguucugagcccaguucugauaagcugagggaccuagccaaugaaugaagcuguucacagguccuagaaaguaugcaaguuacuacccaugucuuaccacaagggcagaggcagagaugacuuggguagcaguuggauuuggugaagagugucucuaagccucaguucccucaucuguggaauggagacgguaguuuucuauaaggaaugagaucagugaauauuguguuuggcauauaggaaacccuuuguaaauuagcuauucuaaugcugaagaaagcaaaucugcucccuagaucucaaaagcucuucagaagagaauuguggugguggugggggggaggaccccuuuccauagcacaucgcuucccccccccccaguccccguaaugauagggguggccuuuguuuguuuccagggcuagcaauggaacccacgggccucacacaugcgcaguaaguguucuaccauuaagccagaucuccagucagcuccaugagugaccuccauggaagcucaaaaccagagaaacuuggcccgggaguggggaagggcaaggcagguuauaaugucgccauccaaugcagagccucaggggcacagugagguuuuucuaacucuguuacagggucugcuugcucugucugaaguuuuuaccuugaguuuccuggccccacacauauccaaggcuuaucuggaagaaagguacucuucauggcgacacucggguucccauggugacaccugcugauccuggaaagaaagaaacuccuuggaugcuauuuacugcaguuggcaaggggccaggaugacccacgaaagacaugauuggaggauugggcuucagaaguaucugguuugcagaagcaguguaggcgcauggcugacaugugccagauggccgugaaguucagggagcaaucccuguggccaccccuuccuagacugucuauauaggaguaugguuuuggggggagggcgcauuucuaagagcuuuagucuccucggcuguaaggugaaugguagugccucaggguucuuaggaggcgugcaggagacugcauggaaauguaccuaguaaaguauuggaagggagcgaaggucccucaauaaacacuagcuauuuuuauccuguacaaauuagucaaacagacuugcuugcauggugacacaguuccuguuaguucaugucaaaggcauggaacugagagacaaacucaauugccccgugccaguuauaaccauagccuacauuuaugguuccuggggcucuugaggagaaggagccugcaucuucugucaccaaguagcagcuggauuagcugagcgugguagaggaacuugugauccugggccauacaguaggacccugucuagaguggucagggguaggcaaagcacaaaaaggaggcuaugcauuugguuuucucuggcucuuggcuaagggcuccugcugucaccuccuguggaugauuuucugcugcccucgggaaggcuaggacaccuagagccuuccagaaacaugcccaugcaagugagccacucggcuccucugaccaagaaagagcuuuaucuucaucucgugcucccgugggucuuucccgaugguaucaacucuucaugccuuguacuucacuuuccuaauuccuucugccuuagucuuccccagaaccacagauccacucucugcaccuuagcaccaccccuccagcuguccugcucucucacagugcuccccuuucugccucggcaacagaaugagaaucaggaauucaaucauucagucacgaauuuuuggagauugagucucaguaugcaagccuugaauucacuaagaaggcccaguuggacagagaccugccugccucugccuccuaagaauacugucacaguaggucuuuuguuuuguuuuguuuuggaaacagggucucauguggcccaggcugucuuuaaguucucaguguagccgagaauaaccuuuaauuucuuccuuucucucuuucucgcuaucuuccuuucuuucuuuccccacaagaaaucaaaggauuucuuuguguaacaucggcguuccuagaacuagcuuuguagaccaggcuggccucaaacucacagagaucugcuugccucuucuucccgagugcugggauuaaagagaccuugaauuucggauccuccugccuccaccucuucacagccccccaacccccuuuuaaugggguuguuggggauagaacugggggcacuguaucaauugagugacauuccaaacccuuguuuguuuuugaaacaugguagcagcccuggcugaccugagcaugcucuacagcacagguuagcccugucucugcuucccaagugcugggauuucuggaguguaccacccuucucagcccaauagugugugugugugugugugugugugugugugugugagugugugugaguguguguguguguguauacacgugcacucaguggguacuaugauaggcucuaggaagacacagugaacagcaacagagagagcccauucaggagcugacagcagccugcucagaugguggguagauugcauggaaaugguagagaacaaguugcuuggucagagaguucaggauuguugguuuguuuuuagagacaugaccucaccauguugcccaaccuagccuggaacucgauauauagcucaggcuggcuugaaacuaaagggccucuuuccuccgucucccaucuacugauguuacacccggauaagaaguuugaauuuuguuagcauagccugaguguggagaucagaggucaguuuccuacacgguggacauggagauagaauucagguucuuaggcuuggcaacaggcaccuuuagcaacugagccaccgaaccagcaccuaguugguucaaucuuugaaacaagguuuugcauuguagcccagccuggcuuugaacucauaauccuaccuucuaaauacugggauuccaggagcucagcaccaagcccagaugugcauauuguacaaaggccugucuaacagguauguggaggguagauuggacaagcaugagaaaugguaccuggaacuaaaaucuucaguaauaauccaagcaagagaaugcgguagccuguucugugguuaaugcaaaagcuuggaaacuagguagaauauugaaaaguagaaucaguucucuuugccagagugcugcacgggagcaugguggaaagugaagggggaagguuuguaucguuccaguuuuaguauaugugcugccacagcgagcacuaagaggagguuuuguguagggcuguauaaugguagguuacaaagagcaugggacucugaaaagaaagcugccuggauuugaauccucuugucacaaauuuccuugaguguuuugaaguccuuuacuucaauuuuucacgugacccauagcuggugcccuuacuggauaguugaaagaauucauagacaauuucuguccuaggcuugcuuacuuaaacaucacuggguaaauguuagcugugcuuacuaagcuagauauggaucccaaggugagcuauccggucugcccuuugauaugggggaccuggaaccuggaaacaaacccagaaucacuaagugaaggauugaaacuugggaugaaguucaccaaggaagcggggggaauacccaggcccaaggccacuggagggccacagaaaagagcccagcaagagacugaaaguggcucucagccugacaaaaacaucaguagguccuaccacuggaaacacauacaagggagcaggguagcgaaggcaaggauugaaaacaguucacaaaccuuugaucucagcacucaggaggcagaggcagggggaucucugugaguuugaggggagccuggucuacagagugaauuccacagacagccagggcuauguagagacccugucucaaaaaaaaaaaaaagaaaaagaaaagaaaaagaaaaguaaaccagauacuuccccacucagcauaaaggaagugaccgguucccagcacuuucugcagaaugccuagggaggauggauagaauaguuugaaaaaggacguauuauacaaugaaauugcaugaauuuuggcacaaacaaggaccauugccuugugcugauugagucaccugcuaccugucugugccuauaaauccaacugcuagggaggcugauacaggacgauugcuugaguucaggaauugaagccagcuuguguaaccuaaccaggacggacacacacacacacacacacacacacacacacacaguauauugggagcugcaagguguggcaagaaguuuccuggguaaggagcagaauaguucaugcaaagaaauucggcuuaugggcacugcuggaggucuauaacccacugcagggaaagccuagaauguaagggaagcuaccuaacacauggcuuaaacacacacgcacacacacacacacaccccugcaacauaacuauacacacauccugugccuguuucuucucuuaaccacagacccuggaagucuucccuauucguaaacaaagcagaacauuucaugaaggugcuauccaauuguugcugggcaaauuacauuguuucggauccuaugcuuucacaaacaaagcugugcuuaacuaguaucuuaaacauacagacacacacaagcaacaauaacaaaaagaaaacuuugaaacugaugaguaaagaaaugagacugcuaugcuggcaaaugccuuuaauuucugcuggggaggcagaggcagguggaucucugcagagugaguuccaggacagccagaauuagauagagagacccugucucuaaauaaaauaaaauaaaauaaaauaaaauaaagaaauggaacuguugccuggauguagggaucuccaucaagaggugaagcugucuuggaaaacagacacauaggaagcuagucccaggcccugaaagaacuauuacauuacaggagaugcuuugaccaaaggaagagagcagagucagaaagaagagcccuugcugggcgggcaugguggcgcacgccuuuaaucccagcacuugggaggcagaggcaggcgaauuucugaguucaaggccagccuggucuacaaagugaguuccaggacagccagggcuauucagagaaacccugucucgaagaaaaaagaaaaaaaagaagaguucuuagaauuugagccgggaggcagcuaggaagagacuggggacuaugugaacuaguguagaguugacuuuaaagcaucaguaagacguucugggugcuguggugaccccaggaaugggugguuggcuuucagcaagcggguaagcucauuuuacaaauuaccugcaauagugcuaaaaagcaagucugucacuaaggagcaggaucugggaccuuacuaaugagacuuuagcuuguguguguuggggggagguugucugaaauuuguguauuuuucccccauaggaaaugacauauauguacuggaaggcuuuggaaacuuugaaaaaaauuccuagaauuuauaguucugaugguuuugcaaauuguauauuuaaucaaaggcacucgaaugccucucucucucucucucucucucucucucucucucucucuuuaacuauugaagagccauuuaaaugucaacauaagugauucccuaccaaauagugcugguuagacauuaguuccucuaauagaccauaaugauucauaaggaggcauuucucgacucuaaauuguaggccuauugaaauauaaauuaagaugauaaauaauuugaccuuaccugagaguacuaaguauuuacacgugucaaauacgaaauuacccugaauaucacggccccuaaaaaggcagccuucgucucaguaaauaaaacggguuaaugaauuucccuuggagagcgaagggaaagaggaauacacaaaaggcuuugcuccaggggcucggcccucccggcccuccagacuugcaguggggcuggggagaggcgcgggccagguucccccggagagccaggcgggugcuggcggccuucggcgcucggcgcguucccuucucccccuccuuccgcaacggcgcuggaguuucaaaacauggaguuuccacaggaacuuugccaggccgagcucgcagcccucccggguucccgcagcggcacucgcggcagccuccccgcagagagcgcugacccggcggccacccagcgcagcgcaaagcucagcagccccgguucacucccuggggaggcgcagagcgccgcccugccccccccccgccccccaagguccugcagagaggacugcgccuucggcccggagccgagcccauccgcccagccagugugcuggcccggggcgggagucgccgaggcgaucguugccgggugggcacgccggcagccggcugcccgcggugggauuugguuuuguuuuaaagccgcuuugcgcgccggggcugcggcggcggcuguggcucugugugugugugugugugugugugugugugugugugugugugugugugugugucuguguguuggggggguagcacauugucaaugagaaauuuccuguucguaagacucagcuugcaguuucuguccugcccuugaacugacaaguggaucuccgcggcgagaguccgggagagccucggcagccgcgcgcgggggugggggcgggggcagcggcgccgaggccccgggagcggggcugagcugggccgccgccugcccucccguuucccccgcgcacccgugagcucugagccgagcggugacuaaucuguggcuccgggccucuuggcgcgcagcccgggcucgccucccgcccccuugucccuccuccuuccccagccccugcacgcagagcuccgcggggugaaucgugcgggccgccuugccuugccuugccuagagugugggaagcggcucgaggcaggcgacuugggaacugucucuuucgacccgggccccgagugugcguguguuuccuuccccguaggcacuuugaucagcauuuccucugugccgcggaggagcuagagcgaacugaggcucuuuaacccucugcaugccacauccacugaaggcuucagggggaacaugcuucgggagacagguccacccgaucgaauagauuuggccaagccggaguuauguggagccgggcuggaucccaggaauuugccccuguguggcauacucuucuagggacagcaggccgggaagcccaaagccaaggggcugugcaguaacccaaccugcccggcgaggcgcgguguagcuugaaaggcccagcgggcuguggcuucuggaggagacagggaagacuuggaggaacugccuuagagcaguucgcuggcacagagaugccucuuagucuaggguagggaguccugcucuugccccgcgcucugggcucuggcccccacucccucccuugacucggccucgcuagggaguuaaugauugauuuacuggcuccgagaggccggcgcccucccaagcuauuuguccacgcugaggaguugcuggagagaggcgcagaggccuagggagcagggucucgccuaggaggggcggccgggcuaccgacgggaaaggaugagcacuugguuagcuuccacugggaaacucuagccguguccgcggcgaacccgcgggaggcccugccaggacgaagaagggugccuugggaaguggcacauguaaauggauuggcagcuggugauuaggccgcccgguuuuaugagucauaauaggccgcccgccuggcccucaaccugcugguuguagacuugguguguuggggcccaagcgguacucuacucccaaccgcgcagagcgaggaugcuccagggggcccuggcugccguaagcauugcacaggauuuccucucauuucucgcagaaggcaacacaaacacccuaaaucaaacugcuccgacaaccgaaggcuccacacagacacaucaauaaggauuucgccucccgcguucgaacgcacugaaacacuuguccuauuuuuaugcaaaugacaccacacaaauagaucucgcaggcccuggagaggggcgggaggaggagggacgcgggcgccccaccagggggcggggggggggcgucaaucccgcaccucggggcccgcgcuggcuccggugcaguggggcuggcacuaaccaggaggcccgccccgcgugcgguggcucccugccagcgccgccuagucggccgcguccccaggcugccugcagaggcggauuagggaaggagcgaagcgagccugugacuaaucgcggggccucggaccggagcaccaaggccaugugcgacugacaggaucgacacuagccgaggacacggcgacgccucgcuuaauugcaggcuuuaaaaauugccgccugagcagcuccaaugcagaaagccacagcauacgcgugggucuggggagugcgaccggggguguggggggggagggguugucccgauuucucgccugaagaggggaagguuuggcaucuccugaaccgagggagcaacacugagccccccccccccgcgcuuugcaaggucuucccaaaggcaugcuaagugagugugggugagguggccagccaccggggacaagguuuucugucauuuguccuuugaguccaugcuucccucuuguugccccguacucuauaaagaaggccuacaguaaaugaguaagguuccagccagccuuuugaaaaggagaaucacacgcuaaacacuuuacuucgauccuuuccuuuauucacugacugagaaacagggccccgaaggaccagacgaaagccaagucaagucaacgcaccaaggaucaaggucauugagugccaaaagucuggggucacagacaagaacccuggucucuucgaaggcccguggucacagucccugugucccaggccuucuuccuggagcgcuggggccucucaggagagaagcgucggcggggcggcuugucugugaguggagguggggguuggaaggcgguggcggggaacccagcaagagaaguuuccaccacgcucugcucuguugcugccaaaauccccuggccccuccccgcccgcacugccuuccguugccaccacaaguuugguuuaacgagagagcucgggacaaaagcaaaccuuuucuauagacccugaaaacaaaggggaaagagacgcgcgaggccgcagagaagcggcugcuagcguaauggugccaggccgaaagcagagcauuagaacugcaaaagccgcgcgggcgggaggaagugcgaggcaggaggcgggagcgccgggagggcgggcgggggaggggcgcugcgccauguuuccgugucacccgccgagucgccggcgcugggcucggccgccggcucccgccugccuccguaacggcagaaagcgugcgauuagcagccagacaggcggggacuccgggcccacggggccgccgcacacgccgcccgcggucccggcccgcgcuccccucccccucccgccggguaauccuccuccucgcugcagcgcugugugcacucucauuagagcaggguggcuuuucucugcgcacucgcucggcucccgcuggcaaaacaacgccuuccccggccgggcccugggccaggggagucggggagggccggacgggggcggggugaggcugggacagccucgcagguuagcuccgccgccgguucgaaaagauggggaggacccuuuggcccucccccacgcgcagugccaaagccgaagguccauaccagacucucugccccucgggagaggggggagaugcuggugccauccugaccuacugccguccgcggcacgaggccagaaugcguggggcagaugagggugucuggguugaagagcgggaguggacacuggggaagguucccacaacugguuuuugacccguguggcuugcuaacgaccucuuaaggccagaagcuggauuucagguguuguugcccuaagacccucagggagaucagugcccuuucuggcuuugggguugaccgcccaaaaugaguaggaaauggguggggggagacuccagugcuccggagcgccccauuucuguuccgcgaucucuguacacaacaguagacagcuucuccccggcaccucgcgcccagcugcagggcucgggagcagguguuccugccuggcccaaguggcggcucagcgccccuccugucccagcugcggggcccagagaggagggaggggaaaggcguguugguggcgguaacugggaggggggggacgucucgccggaccuugccuaaaauggguccauuccggggugcggacaaucgccuggagccuggaggaaucuaggaggacagacggccagcucccgucuaggacugcccuaggggccagcacuggccguucggggcggcgggagggcuuccgguccccgugacugcggcggcggggcggcggggaaguucccgucgcggccgcgaggagcacccuccccuggcugccgccgccgcgcagcucucggagcagcgcccuaggaaccccggggcaucgggcgacgucgcccucgccuugugaagggaugggggcuucaggguguuccucgauccccgccccgccccagggaccugaacgcgggaucggggacccugcgggaucggccgcgcgccucccagccccuccucgccgcugccauggcgggcacgugaaacgcagcucggcgccgggagcccgccggggagcggccuggcccgcccgcuccucuucgcagcggguccagggacgcggaaccaagucgggccgggucccgccgagcucuccgcggccccgcaccccaucccugcccgaaccgggccuugaggucacgccagacgacucguccaaggggaacucgggcugacuaaugggacgcuugugggccuccggagaggccgggcuggcagcagugcccgcucgcucugcgcugacgcugcgaccaggcucuucggggaagggcgagaggagggguuuccccgaccggugguuucggcucccuggggacaauccggcugcggauggcucugggcuuuggguccuguagccugaucccgggcccgcagacuggaggugcuuacgggaagaaggugccucagagcucugagccuguuguggggucuccuuugcuugcuaucuugggccagcagcuuuauugggggggacggggggcggggaguugcaggucaccuugagggcgugggcuuagauaccaaaaccuucaacaaauagaaagucuuccggaaaucccucagugaggagaaaacaauugauaaaacucagggagaguccaguuuaguugggaguucucagggucugggcccuccccgccccccacucccgauuacagggucuugugaaaaucaacagaguuuuuuuuauuuuuuccaacgaacagccaccucauuguugacauaguuauuauauggcccucccaaauauagcuaccuguuuguuuuaguuucagcacauccucucgauggugagacagaaauauagaccaguaauaaaagauaaacaugugucagaugcagaauaaguccucaucgcgcaucccugguuuugaguuuaauuacacuagaaauccaguccucccacgagaaggccugaaacccugcaguagaggugcgacuuuuccuggagagccucgccuuuggagagggguugcugguggaaggcaguuagguuuuaaaugucacuuccaaaugaaaacgcuuuccgucagcuuuuuucuuuuuuugaugcaguuuucgaaaggagcauuuuuucgagauaagaagugaccgaucaaaaucgcugaggggagguuguaagcagccgcuuugccccagcuuagccuuaucuuaucuuucacacuugcauggcggaaaaaaauuggcuuaucuuuauccccaccccauucucgccuuaauugcuaaaaaacacugguguguuaaacgggcaggaaggaggucucuggauugucagcagaacaggaagauucaaaaaacugugggcuccuggggaaagaagagggugacagaguguauuuucccccccccuuggccuuucuuguacaguguggaggguccugucccagcuggaaggcaccaugaucagauuuuuuuuuucuuuuuaaaaagaauuaaaaccaguauggcuuuggcuugggcaucuucccggagccucuuuuuuuucucgacacccuguuuaccaaccucucuccuucauccccucccccuccaaacaacaacaacaacaacaacaaaaaaggucagugggucucugauugagacucccuaccuucauccucucucuucuguguugaggggugggggugccggguugggacgugcagcuugcuggaaaucauuaaaauauaugcgggugucugcaaacacacacuuuuaaaucauggcguucccucuccaugcugguauauuuaaacuccagagcgagcuggauccccuuccuuucagucguuugucugugucaccgacaggccgcuaauggcugggcuuccaggcgcugugcauuaugcauuaaccuccuccuaccgcggccccacacagaagguucugucaggccucacgacgcaaaccacucuacauccccgcaaucaagacagggcggggugggcuguacgggugcuaaaggucuggagacgcugggguauggagugagggcacagcagaucgggccugcaggaagaauagacucaggugaauugugcuggugauuaaguuaaacccuuuggaauuuucagccuggagaggugggauggugaccaccccacaccaaccacucucccccucuggguaccuccccccaagcacucaguugauuagaauuaacccaaguucuauuuuuccuucugcuggcccuuagucauuuccagaccccgccaguccccagguagcagagauaagcagaaaaugguugguagcgggaggcugguauguugggugggaaggcaauuauuuggcaacucuguccccuuuaauuugcauucccacuuaccccgccccucacgcaggauaaacuaugcccuagagggccuagcaaaacccagaacccaguccuggacauagcauaaggguggaucugcaggggcauccggcuucaaugcaggggccaggccuuuucccaaagccuccuguguuucugccaucuggccaguaccuagucagccuuuggcaacagcaguauagacugagauuccagaggucagggccuggcauaaauguagccuagagcaggauuuuccugagauuauuucugugagccauucugguucuguucuuugggccacccaccuccaaacagccuauaacucuccaaaggcaauuaucuuuuaaccuguccaaccccaaaucuaacaguuuucugcccgggaaggcagcuaccucucuuuagauauuucacaauuaguaaacuccuuagggucauggauaggccuccaauuguuacuucauuugaguuuugaaaggaagacaggcugagcuagauuggucuacgcuacuccaccccaccccaccccacccuauggaucuuuuuuuaagucccauuggguaagccuagaguucauuugcuaaauguaagauuggaacacugugaauguggguuauuugcauguuuuuaaaagauaguuaacauuaacaguauagcccacauuacauaaaguaaaaaugcaucuuuaccauucauguauggaguguuccaauaacuccaauaauaaaucuaguaacaucagccagaaaaacaccagcugaggaggccuauauaggaggcuacagaacuaggguuuccauucuauacauaccugucauaaaugaauccccaaccacacacacaaaguugggaacccagauugccccuaauuguagguaggaccuuugcauaggaugcaaggccuuaccccagaccuagggguggcuagacugguggaagugcggaaggucuuauaaucagcagaauucagcaaggacagacagguuucaaauuugcuccuagaagcuccaauuugguuguccaguugcagagccugcuuagaaucuguagcaagagaaggcccgggagucuaaaguccagccgaacguuauaaucacaaggccuuuucaugggggaugaggcuggugggggaggggaagcauccgcagcuccaccucgcaguacuucucauuuccgugcugauuuauuuuucaucuggcaaggcauccucccuugccucgcucucacuugcucaucugcugcgcuuugcuuucccugaaauccucccuuuucggaguaucacagucugacaucagggucagcucuagugggccuuagaggagagggcagggaagagugcgaccauaugcaucugggcacucccagauucaguagccaccccuuugagugaggggcacaagaagggacugcuuuucaacagcuuucuuuucccaggcaacaauuuugacgaaccaggccaauaggugugauccuucuccacuuagggcccuggggaaagucucacauuuuaauucucagugagucagaaacaccccccccacacacacacacacauuuuugcgccugccucuuaggacucccuuaauaagauauuuuuuaaaucccacggaauugggaaacgcaucccuaagagauggaagagaaagcuuuuaauuccaccaacucacuggagaaccccguggaguccagagacucccuuaaagaagagggggugacugccacaaauuacgucaaaggcgaauuuacuggccuguuugucuccagcaucaaauuucuccagcagucagccuuccccaaggccccuucacccuuacagcaccccccuccguuuuagcucuaggacuuaaaguuagacaaacagaccccauugucagcagucucaggaggcccuacgacucgagaggccucaggcuccaugaucgccuccuggauuuucggaaaguucuggacaguuaauguaacuuggacgcugggaaaagccuguuccugggagaauugggaggugagaagagggggagagaagguggcugggcagcgagccagggcuucugcggugcggccuaaccaagccggaugagccuggcacugcucugcuguuaguccaggccagcccuccugcccagcccacagccgcaccgcggccuuucugccuggaaucguguacagaguuuccccacaaauacccaacuccagcuuucccgguuauuuaagacuuguuuugaauaaaaggagucgcuucaaaaagaaauguugcuacaacacacaaccagcggccuucccuccagcugugucuguaacuugcaugcguucagucuaauaacuuuuaaugucuagcccuaaaacgucuuuauaaaaaauagcuuuacagcauaauaguccaggugucuuucugcuuguuaccggagauuaaaaaaauguguagguuagcuuucagagacacccccuccgccacucaagaaagaccaggaaaaagaaaaaaaaaaaaaggcauacauuccauucugcaggcgcugguucuggaagcauuagcggcacagcacagcuaggcacuacccacuggccugccucucuuuugcaucaguuguuacaagcaucucuggagcaugaagauuuaauucuguucaaaguuucggguuucaaacgguagagauguuucacuucugcuuugagaagggcuguuuuuauaacuaugcugagaacuaaaacagaaugaauaaaauugcaccuaauaucagucacaaagucaguagugggugucauuuuuaaaaggaaaaauaucuucuagcuagagaugagauuuuuuggucuugaccuugacuuaauaaucaacuugagaugcuuuuaauucauuguuggcguguagacgcuccaggauauuuaaaaacuuuccgagugggguuacuagccacuuccauuucggacuuagguucucaucaagccugcaccacccugucccuaggcagaagacauacuccagcccgucccagaaucgaaagaccccguagaagcaccgaaugggguaaccuuuuggccucggugucagggcucccagccugugugccuugacuucccuucccgccagcuuuucaaacuggagcgguguucguccuugaggcucugcauuccggggaggccugaaccucgcuucucggcuucccccuuucgcuugccugcccuuccccgccccccaucccccccuggcgcccagagcugcuccuggugcguaggagaagcucgauacgugucaauuggauugaacugcugcgggcgcaggcuguacacugccgccgagccuugaucugcacgacguuaccgagugaaaauuuaugggcugaacggugaagccaaaaguuguucccggccaaguaaaauaaaacgcgggagauacucucacgaggccgaggugagagacgagggcagaccuuccagccaucggagguccggacugugaaaugcuuaagaacugggagaaacucaggcucaucccaggucccuuuaugguccucccacccccuuguguccccaagagcagccccccaccucaacacaauucccacacaauugaaauguccggggagcaagggcgcggaacugccacuguugcggguggugguguuuucacguagcucuuagcgccuuaaggggaaguagcuccucugggaagaaggggcgaggugcgguggggguggacgcccacgcgcacucaggcucugcugggcuggcucucggaggggacgcuaggccgggagagcgcagcgcugguggcgagaggaggcaguggcgccugccgcugggguuugacagcuuuggcugagaggagugcgaggcgcuuuaugguaauugcgguccuccacuggccuucuggguagcaaggggagucucggcgcgcggcagggaaagccucccccgccgccccgccgccccgccgccccccauucuuggggcuggggauuuguuggccgaccuagccgucgccgcugcggagucggucuccaauacccuaggacgugagcccuggcugggcgugaaugcuaacucggccggagcugggacggagaggacagagggcgguagaguugggggggggguacgaggacacgacccgccacccaggugguuugggguucagauguggcgaggccccaaugcacccggcugggaauccgugagggccggggaaagucgggcgaaccuuuccuggggaaucacccccucccgaaaccccaccgcggaggcgccgcagcggagggugagcggagacuggggaucucaaacuugcgagagcuggaggcggcggcggcggcgggcgggcgggcggcugucgcucgagcgcugcgccugaggggggaggggaggcggcuguugggagggagggagggagggcgggcggagggagggggaggaggaagaggagggaaccugggaggggggacgcguugggaucgcggcgugcggcagcagacggagccugagcucccagcggcaaggugaggcagagcugcgcuccgggccgaacggcgaccgagcucuucggccgagggggagacgcgccggaacccagagcacgaccgagagcgggagcgaggcgggcggcgguggcggagggggagcacgcgagccgccgggcggagagcccgagccgcgcugucgccgcggagggacgacuuggccaacacacucgcucacacacacucacacacacacccagcccgagcgggcgcucucggcgaaccgucaacauggcgcuggggcucuugcccgagcgcgggcggcagcggcggcgcgggagcugcugagggugacagagcucgggccagcugcgggaggagaggaucgcgcggggccgucgccaccugcccugaagcucgcagcccgccccgccccgccccacccccacgcggcccagagcccaccccuccgccgggccgaccccgagggcagcagagcggcugcagucggcggcgagcgagcgcggcgcugggaguggacugcgggcaccagaggaagccaaacuuugcugcucgcugcgcuuucccggccgggcuccuucacguagccgcccucucccgaccccgcacacauucacccagccagccgcccccggaucuuccucgccgccuggacuccgcuccggggaaaacuucaaagcgccggaucgcagggcucccugccuacuucccgacuggggauuucaggucagugcccggaacaccuuuccccgggggccgcgggcgggcuggcgcgccggggacugcagccgaccuccucccuccgaggguuucuccuccgacuucgguagacccccguugggaggcuuagcuaccuugcucgcuuucgguuuuacaucagagcugcaaguuauuaaaaaugcagccaaccuaagcggcccccgcaugggcaccagggagggagggacucgacggaggaccugccgccucccgagggguugggaggaucgggaguugaacgaguggaaguuugcagccucugugugucugcgcgggagcgcggucgucgccgagcgucgggagucaggcgggggggggggugcugggcuggaagcugggaaccucgucucggcguuaccucgcuagcaggaaggggagggcggcggguucccgucugcuuucuuuuucgacucggaaaagaacuguaaaaacccccagccgccgccgcuucgucuggccucuccuggggcccggcggugccuccgaguggaacgccggcuugagcgugcgcuagugugugcggcgggcgccucggaccgagccgagcucgaccugccgucgucgcucaacuccggaggggagucccggguuuuuccuuggcuugccccaaagcgugaaucacguggaauaacgggggcgggggggggggccuacuaggaaacagcggagagccggagauucggaaugggccaguccggcgacccgucaggucagaugcauuguuuuguaaauguucuuuuaagauucuaauucgaccccccccaccuccaucccuucccuucgggaggcgucccaaggcagguuuuaaguucggagccuccuggagcccuuguagacugcuuguuuagggacggcgugggggagcgagcagagcccucggcucuccgcuuggcuguacggagccuggugggaagccccgaugggcgugugaaagucugcggccccgggaaguuggucccacucggagggagggcgacgcggaggcuccaggcgaagaggaacucgcgcaccgggcgcgauccucggcugaggcggggagggcgaggcggcacagggccagcgcuugaagcaggcgggaggcugcgcuacggagccgccacaaacucgggggcugcgggcugcggcgaagagagccugcuauuuucgaagagagccuccgagcgcccugaacggaguagggcggcucguggcacguguagucccggcggacuucuggcugcccggcggcucaauggaacacguacccacgucccgaagacgaccgaaccuguccccuuguaggccgaggccgagccaggcuuaauuugcuguuaaugaaucuuuuccagaaagucugcgaccuccagcuagacucugaauacccgcgcgcgaagacgcgcgccgccggcgucuaaaggguggggguugggggaauagaaaagcgaagaaggaacuggaggaggguuauguuuauuuaaaaacaaaccuuaaaaagaaaccagcgcgccucaaauagguauucguccugccugguugcgucuagacuagacagaccgggguuuuaacuguaacccccucccugcgcacccuuauugagagaaugcuagggaugaguacugcuauuugguucuaagguuaguuccuuggacggaaaaaaaauacuuuaaaauggaccgggaggaaaaaaaaugaggaaauagcccaccccagaaggugguggguggugagcagacagacuuggguauuucuagccaucugacacuucuguggcauuggaaacggacaccaccaccgggagagaccgaccuguacacgguacuggauuuugcuaacagaauugcuuguguggaagguauuucaauugucgaccucagagacaccuauauguggacucuuggggggaauacucucuucucgaccuuucccacuccauccccgacuaguuaccuggucuggguugcagugucgccucugguguuuauuugggauugaauugugucguguagaccuacgcggagccgggaugauuaauaugccguccagguuuaaucugaggcuggccuuuagugugcggaguacaccaccacguacgcgaauugccugcggugguuaggggaucacgcggguuucggucaccaggcgcugggcggguaggucuggacuggggcucgaucggccccagcucucuccuuugaggcgcugucaccaguaggugacugagaguuaauuaggaaguguucucuggaucaaugggccgcacagcucauuagcgauucuuuccagcccuuugcagggccggccuggccuccgccucccacacagcccgggcccccgcggucccugcugcggagagugccgcugggaaguggggagggguggucagugagggacagcgggcaggccagaacaacuucgcagggccguguguugcgugcgccgccgcgagguccccacagcccgcucuuucuuccugcucgcggccgccuccacugugucuuuaacucgcucuagcucgcuuugcugccuggcugcuccuccccgccucccucgccuaucucuuguucucuaagcacgacgccugugcuccccgcccaguuugggauuagacaagauaaaaauaggacugcccagcgcgcagagcugugacagugcccggguagccgggcugaugcgagcgcaagggguagggucuggggaagacuagcagggugcucgggucggccagauucuuauuggacccucaccuccuaccccgcaggcgccgucacgcucgcuggacuccuuccgcugugaaccgugcgggccagggggaccugagcagggucuccgcgcucucgcggguguuguuggugugcgggugauagaucggucuagacaggcaugcagacucccucccggcugaaggacgggggguggggggcaguggagucggcagccgacuccggagagcugugagcuagcaagcuaaagcuagccugccgacccagcaagccgggcuugcuugccggguggaaggcagauugagggggugucucuuaacccuuuaagugcgguaaauaguuuaauggggggagggacaaugagucuuguaaaagugacuuauuagaguggucugcggggugggggccuggguucuagacccacucguguuuuccuuucucuucugugugcauccgcccauucuuucacaaaucgaaugcagcugcucgacagaguacuagcuugaccuaguacuccugauucugggaacuuugaccucaaaaugggcacccucgccuaagaaucugaguuucugagcagacuauauagaccucucuguuuccaauggggaccugaagcauguagggggauacucaaagugagagaaggucucucugacccagacgccuccagauuaaagcccccccccccagccugagaugccaggccagcaaauacagcauguauguauugguggcagaacacagcauuccuugaguuguccauaaauacuuaaccacgaacuugugaauaguuauaaucagacaugugggagagacaauccaaauuggagauggucuggacacuuaaaaaaaaauucuaucauucguguaucgaugaccuaaaauuuacugcagcucaccauaaguuagucuaguucuauucggggcuggauauugauagguagguuccccuauauagaauuaacuuauucccucccuccuuucccccuuaaaaauguguggccuaagguuccucuguuuacauuuaaacugcaaagccaugcuggucaggccaggaaaugaacuucauuauauggcuagccaaagaaccuaagcaguagaaagggaaucucagauuaagauguaucucugaaugacaagugcugggacaaaucuagagacuuuggucccaauguccuaguagaagagaugcccaggagauaaagaacuggacaagagcagaguaaacacggguauguaaauguagaccauguauagugguauucuaaaagaaaaacuguagaugucaugaaacuggaaaguggggcagaguuuccauguguugcaaagacaaaacccauuuaaagaaguaaagagggucacuugggaaagcacaaaaggcacgcauaugcauacauacccugugcuuagauacaggggccuaauuaccaagaccuccccuuugccuugagauggacuuuucacuagugagacugauugaaaguaagaggggagccagggcgugguggcgcacgccuuuaaucccagcacucaggaggcagaggcaggcggauuucugaguucgaggccagccuggucuacaaagugagcuccaggacagccagggcuauacagaggaacccugucuccaaaaaccaaaaccaaaccaaaccaaaaacaaaacaaaaaaagaaaguaagacggggcaacucuauugacacauucucggggagauaauguguuugggcaguagaaaauggcaaagcagccuuccaaauagguggcuggcccucgguuaggaucacuucuaguuaguucuugcccugcuggcuagguagcaggaauccaaagaggcugggaguucuugaccuuggagaggugagggaaaaggcagcaguaguggccaggagaaagauguaagggugugguaaauuuggugaagguggagcaaggcuuggacugacagagagaauugacagaaggauggaugcccucugggaagaauaaagggagcgaaugcuuucauguugguaugcuuucuuauauauuuucccucccugcuggaagagacucugccugggacagccagugcagggugcauuagcaagcaccucggugaccccagacauguaaacuccugcuaggguuuaguuugcucggggcacuuguuugccuggucccucuuugucuaagcccagucaggaauuccaguuuuuauugggaagaucacacuuggguagagcccaggcuggguggggcagagcugugcuuugaggaaggcuggcagcuuccuaaaaggcccaaaugcugccccaacccuaacacaggccucaggagcaaccaguggcccuuagaaaugccacccugguuuccucaaggauucacuguucagacaacuagccaggcagggucagggaaucaaaugugccaaccucugggcugaguccaccgcuacagcuaggaaggcccuuuguuaggcccuaauguucuaggaaucagaugaagaguguaaaugcaaguguguuugcuuaggagucucuugggacacucuggaucuggucuagaggggggggucuccccaaauuaggcguugguuggccaccaucagaggaacuuggucaguguugauggccaaugggauucucucucucucucucucucucucucucucucucucucucucucucucucucuccccucccucccucccucccucccucccucuccccagaguuggucuuccugcugagcccuaggugguaggucugggaaaauccaaauaagcuggcacaggaaguccuguccaccuccaugguagcccaacagagcuuaucccugggcacuuggccuaaggauggaccuccuuaacagauccccaacaugucccucaagaggggacauguauauuuugugggguagcaguuuuuaugcccuucccggauauuucugaagguucccauuccgggcugacugacgcucaauuccguguguccucaauccguauccgugugguauggccccauuuauuuuuuuucagggagcaaguaucacuagccagcacccacacaggcugggcuccccaugauuagacaaauggagaaguccacuccgagaagauccugacagcauaaaauauaauuugugaucuaaaagacaguuuccaguauaaucucauuaugcaccacagacucccgguguuauuuuguggaaggcggacaaugaucaauuuacauugacccggggcugggcgagcuuuuagaugguaauugccauauugauuugcaugcaaaaaggagaccugcuaaaauuaaagaccggaagcuaaauuaaacuaaauuuauugucuaggugcaaaccaggggaacuauugggggggagggaggugagucagguuagguugcuaggggcagaacagguaagaggcuagcugagcuuggggggcaauuuacaacuuucccggauagcuuugccuugauuucaaaaugugggaaaggggucgaguuuaggagaaaguuauaaaaagguacaguugcagugaaggcccugggucuuuuaaugccaacgguaacuauaagggagaggggagguuuauaggguuacgggggucuuccugcacccuucucggcacucccaacccgaauuucuauuguuuugauucuacggggccuucgcuauggugccagggacaucaaaaucuaaagagagaaaggaagcguggagguggggggaacccuucucuguucccgccuugcuccuuccccuccccccucuacagcgagagaccuugugguggaggugaagguguuagaggcuaaguauccccuccaccuuggagaggccugguggguccccacggaugggacugugggcaguugucucaucacgauggaagcuaaggucacaggcucagcuggauggcaauugccugggaagccgcagacuccagguggccgaugucgaaguagaggaggauggguggauuggacuggagugggagagagugucuguuggagcuucgggccugccuagugccagggucagggggucgcugcuagaaauucuggcaugcuaggccaguuccaagccaggccaggcaggagcuggaaacucaucuggcuagccaaggcuggaaaguuuuaaaaagagaaagaaagccacuugcuggaggucuggcugggagccaggucagcuguacagcauggccacucggaguggggguggggugaacggagggagugugcgcuccuucuguccaccuggacccucucccucgugauggcucugccaggucuauuucagagguccugguugagcugcagaggcuggcaggggugaccagauguguggugccugauccaggccucacuaggcaaaggugaagauuaguaaaucuuugauuugagagcuccuaaaggaaaugaaagccugggcuaggccuagagaugaggaggaaguggggagaggaucuuuaggccauauccugguuggggaaaggaaagucuuccagcuugccucggugguuggcuuuugguagggauguuggggugcccaaaggggccugauuuagaagucacuuugcugaucuuccaucuggucccuaggguuucucuuccaucuggucccuaggguuuccucuuggagcguuaggagauguagacagauguaggauucccuuccagaggcccuuugcuugaucuagauaauggauugcaugaugugacaagucuaggguggccaucucaaucauaggaccaguccagaagucagcauuuccccugagaacagagaguccaggccaccuacuacuuacugauguuuggcccuccaagcagggcaucucauugugagagauuuguaguauguagugggagauugugaaaucuccauuucagugaccuuagagauugcagugauguuuaggggaaagugggcucuggcuuccuacuggaugaauuaccuaaguuucaugugcuggcucuugcaguugacacacaaagccuuaagaugucuucugcacuuaccugaggugaagacaauaugugaaaguggggauuucaagugacacaauuaggccaauaauuggcuccucuccugcaacuccaggacugaguuugaccauggcccauuuuuacuagcugugugaccuugggggcaaguuauuuauggccucugagccucuguauguuucuucauuuguaugacugggaauaauuaucuaccuuuaggaucaaagacacuguuuggcacauaguaggcccagaggguuaauaauugcccugaaugacuggucauguuucuauaaguugcuccuuagcucugcagugucccagggaccaaggaugcaugcagguuagcugcccccuccagggacauuccucugguugggccuauaggggcuccucucuuuguuuagaguucuuugccuuaugccuuuaagggauuccauaugcaacgacuuggauccccccccccccuuaagugggaucauuauauaggucagaauugauuccagaacugguaucuaggugccauuuggcacguuuuccagucauuauuucagaggaggggacagggcugcuggagaggaccuagcuggaagaggugcaggaauggcugcuacagcagccagaggugcuguggcgugauagggauuagguccggauguuaugaaggcucacugugguuuucaauaaagucagccagagacugcuucuuuuauaucgauauguauuuaaaagaaauuacuagcacgagaagaaaaccagaccuguauggauccaggccgguaguaagcuacugugaucagguucccucuucgacucccagaggggaagucagcuuuugauugaagcuacacuugguucuugacucucaggggaugccugcucugaaacaggagcucccccccuucuuucccuaaaagccuuugugcugaaagagcuucaguaggcaugaaucucuggucccucugaagaaagccuugcggccuuugcugacguugguuugugaacaguggagcaguggauuuuaccaggccagcacccccccccacaccuccaccccacccccugauuuagcucacuaguuagagguaguauaugggcagggugcuccugacuggugguggcugcagcguggagcccagcugccuggaaucugaaggcucuguaaccuuugaagggggcccccucaugagggggcagaggugcggagcucgaggacccaggguuguuuuggagggucuguuuguuuucuccagucuccgagaggcugaggguggagacggacggacgggcaagaguguguuccagcuuugagucugauuuaaaaaaaaaaaaaaacaaacuugauuuaauuggagaaacuccuaggcauuucacaguucuguacaaaugcaaacuugaaauagcuugagaccuacgucauuuuuaggaaaggauaaaugaaguacaaaaguguucaaacuauguaaauccuuggaguugucugcccucccauaaacacaugacaagugccaaggcauuuccagucaaaacauccauggacccagcagucuccuuccuuuguauuuauuauuuuauuaacagcauuuuacacagcauuuaacaagcccagacugcccgcuuuccacagugccuggguggaagaugggugggggugggggaaaguggucuacaaacccacuagagaucucccgauggacaggcagucuaucucuacuggccagcaaggagccaaaaguaguacugaggagagagcucccuuccuauccuaggaguguuuuugggcuucuagaaugugucugcucccauagucuacguggaagguaaaucagggucuacuccuggcuacucugccccuugguuauuagugaucuucaaagaaugaguauuugucugucguuauucuauauccugguggaaaguuucuaacgaaaaguaaugccuuucuuaagucauaaaaugagccuuguaugauuauuuaauuaaaaucuauuuaaggaccgauuaggcguguaauuugcgcuaauaaugacgauuauggaaauguucaacuuaaccaaaaagcauaaaggagacauuuugaucaguggggcgaccaguaaguauucaaugaguugggcaauuucugaaagaccagaggcggaccucuguggcccugcacagaacugcagacauguccagccucugugacaaccucggggggcugcaggccucucuaucacagccccagccuacccacuuuguccaguggccaaguagcgugagcagccaucucuucccauccagcgccuccagacucuaccagaggcacaaacucugggagagggcugauaaaccacagcgaaaucacugcgaaauggcggugcucuugggcuuaacaaacugcaccgagaaacgcacgcuuccuuggcuggccuuggauagagcccggagggguggggugugggggggagccagggucccuuguuccggagaaagcugccagcugcuggucuuggugcgaaggcgaaggcagacacaaugcugcuguuguugguuugaucucuaacuguggauuguuagucuggcuuuaacuaugugguaaggggggaaugugaaggcuguuuacagcgagugcaaauaaugugacagcuguuggcgcgcgagccgcgcugcgccuccucagcacucacacaaagcgcgcacuaugcaggcaggccccguggaggagcugcagagguggccaccacuuuguggcuggcgcuuucggaugagagaaagcugggucacaucccgucaccagucacauccccagcaugcaccuuaaggacugcccaaagggugggguaggggugugggaggguuuauauguugugguugagggaucuuguuagaccgaggugucaggagaaggccuggggaagguggggguggggcccggagugucacugucuagagggguuuggccaagauccaugaaccuggguccucagcugcuugcggcagaguuugcaagauucgggaaaacaaccagcagccccaaauaaagcuugucgggaagaauuaagugaaggccuucuggggaucccgcaggcucugaaggcuguucuuccuuugcaauggcucuauucagauaaguuagagagaggcgcggcuguguucuggccacuguucuucaggguggaaaugcaaguguguggguucaggauccaaaggcguuugcauuuuccgggaaaggggugcagguugacuuggagccacacggucucauaagcucccccuggcagagcacaccggccuucagcuacagccuccaaaggccugguagaagaggcaccacccgcugggcacuagggugcugugauaggagagcaggagaaaggugauggugaggaccagcacucuguccaauccuggugaugcaucgcauaggaugcauagauauagucuagaacuugggucagucucuuggguggccuggggcaagcugggaggaaagggucaccccaacuccucaggagucccgaggucgaaaggagccuucccaggauauagaaaggcuguucccgggcuauggaaaaccuuuucaggcugacuuaauucuacagccuccuucuggguuacuuuggcccuuguguggccagccgacaggcugucugagucuagaaacuccccaccccccagguaggacuucuuucuacauauuccccucggggagcugggagaugcuucuggagugauacaugaacuucggugccaguucuauaaauuggucucuuuuuaugacgugugccauuuucuguaggaauguugcuugcaaaacgaguuucgccuuggaggaaaggcggaaagauaaacaagccuguaacgccaaaacacuggcagucuuuccuuccuuccagcucccuuaaagcagccgggcuguauuuccaggauuagacucaugcuuguaaggagggacucuguuggcuuuuuuuccccccaagcaaaugcaaauuagagaaaaauaauuuucuuucaacgauaugcaauguauuagucacuugguaucgugcucucaggcaggccucauuugcgcgucugccagcucgcucacaucugcuuggcgcuguuggggcauuuuaaccuuggcggugucgugucuagucccauggaucaagaaagaguaauuaagcucugaacagccacaaaaauucguggguccccaucuauauggcuuuguuuuggggugcuuugaguuccaaggcugaguagcagaccuggaauucuuauuguuccuuguaaagaccaugaaucuggcucuccugcccaucccagccccccagccuucccaggacguccaggcucugcacagucuacaagaagcgugcaugcagauuucaggacccuugcauguugcgccuuacuuccuuaaaaaguuucuuuguguuuccuaaggauagccuuuuguauaacuuguuacuuucuguagcaaauguguuuaguuuauacaaagccuuaguggaaacuaaguacuccacuacuuagccgaguacuacuacggccuugauugacaugggccauuuauuuaggauuccucucuagguuguguggauuccccagugggggacagaacucuguuaggcuggaucaaguguuaggugggggcggggcggggcggggcgggguggugguggagggggaugggaugugaaaaggagugcuggcuuucuuccuaaguucugggugcuggugcuggguccaccuccuuuucaaggaccucuugcuuccaaauucaccccagugcgcuuuggaugcagauauaguucacugacuaguuuaucuggcgcagccugagguaaucggaaagaacaaaaggcagggaagggagucucuggccauuccuguagaagggagggggaaauagccaucccuguccuuggguugggagcggugguaaaucugauccccauagcugggauucugccucggguagaggauggaugcccagcaacccacuuuuaguagacucuuggggucugcccuacccagggcuccgugccuguccuauuuuacaguauaccaccacacucagcucucagcuuaggggagaguccagagguacagucugaccgaaggaagcucaaagugaagguaggguuugcaguccuaacucuaccgguaagcucgggagcaugucccuugagggcucaaauuccgccugaacccacucaaaaguuuauuuuuguuugaaauuugaugaugaagaccaaaggaguagugaaggcucccgcagcggaacucuggaaguucccgugagaacgcaggguuccagggguuaacuagggucuuuggggaggguggcugcccaaggggagaacuggcaguuucuggaaggccugaggggguuucuggccaggucugcuaccucucccugcugggaccuuggcagggagcuguaaggaggggcagaaggggcuagugagcucugagcagggagcgagugcugggaaagacaaucccuuuguugcagacuccucacaucaggcucugcagaggcauggagagggggccgccccuccuccuuucucccuccgcugccacugagggucaaguuuauucccuaucccgauggcucucugccgugacccuggagcuucaggaagaaacuagaaagguucuguaugcugggaaggucaggucugugugagcauggccaucguccgucuccuccgcgccugcucccugacuuuagucuuuuacuaauguaaaauuugggguuguggguggcgacacccacagagccagugguugugguuuggagugugcaccugggcagccuggcucacacaccucuaaccccacaccucagauagaugcuaaauggcucaggaccugggagcaauuugagggucccuugcucaucugggaaagcagcccaggaggacccgcccugcauugcauauccgggaaagcauuuucuuuucauuucccacccccacauaggcccuccccccaacauucuaaaauaggaacgucuuuccccucccuuccuugacacccagagcguggugcugcugugacucagucugcuuuuggagcaaccccaggaagggcuggcgcuagcuuugggcuugggugaaauccacaucaguuguguuuucccccuccuggucuggccccucuguaucucccucgucagcuccccacccaugauagauaggagaccgcaucaccauucugaacagcguguuuaguggagucagaugcuguuggaugggguuaacgggcuccagcgauugccaggcaaaacucaaguccagagugcagccaaagucucuagaaaacacagggccaaauauuuacagagggggaccaagguuggagagauucagccaccugcccagggacacagggugggugagggugagagccaaagagaauggacacugacugggaccaggcuacccaugugccaccuaagcuuccuauugugggugcagugcuacagauggaccuguucaaucuuuggcugcugcccacauaacugcccguagggugguggccagaagggccuagggaaagaacuuaaucccaaagaagggacugccaguguuugagagguuucaucucuuccuagucucuggaagcaauauuuuuccuauugugggugcaggggucaccgguggcaguggaagaugaucugccacuaugggguggcaguggggacaacagacaguugagccuaguguugcuacugccuucacugccuccuccccguugucugcagggggagaucuuaaauguccuuaaagaagaaacaaguaagugggcugcgguggcauaugacuuuaagcccagcagagacacauccaucucuugaguuccaggcuagccacgacagaaagaccuugccuuuuagaaaaggaaagaguaugcucuucugcaucucuaugugcugucuuggcagggaucgacuaaacgguguuaguagguacaccuugggggucaccugaugucuuuucagaacaugaagcaauugggcuccuuuuuagagaugccuggguuggagggacagcaccuaaucuugguccugcucaaaccaagcauggguacucuagccacucuuuggcucaggagcaaaugauuguucaccaagucuguucaggugaguccuccggcucuccguuaaacacaguaaguucuaaggacugcagccacauaccaaugcaugcuugccacauagagguucccccagaccucgguuccagcaggcagauacugcacuuagcaaucgaccuguuccguaagacucagacagccaucccugccuggcucaccucugagccaccuuuucuuugcguuuccuuucuuauccuugguuuucucuccauggcuggcagaaaggguuaaaauccagagcaagguuaaagcuagcaccuugcccucagaacaggccggugcuugcuuguaaagugcuuucucaugagugaugucccacauuuuggcacuucuagaggcaaacauagccugcauguggaagaaggggcaaagaaugagccucuuccuuauauauagcagccaagugccuugaggcacuccguauuccagccaccauuucccacagccaagggucagcaaagucaccucuuugcuuuagagguagagaaaaagucccggcuacuucacuaggacuuucuagaaacuggaagggcugagauguucuucucuucugcugcuuggucucucuuuguuuuuucacccagagguuuggggguggguacucccugcuccuccaugguugaguggcaacaggacauuucuccugaguguauuucugcugggcucuuggacuucccuuguuugucacccuagagaagggccggccuccugccuagcaaggcccacagucaucgacccuuucuauuuugaucacuugcucuuuagccaggcaccugaagaguuaaaaguccuuagcuuguugcaaugaaauuauggcuggcgguggcgccacuguucguucaacagaccuccacuuuuaagcaguucaaaaaaaguucacagggcagcuaaagauuuuaaguguggguucacgagcgugcacaagcacucgugcacaagugugugcaguccacagugcaacuccuggcuuagccuacucuccgaaaccauacacacaggagaaugaacugcacuccaggccuuaacucucagucugucccugugucugugacacuucauucugauggcuaguguuauuuaucugugacaaugcuauugaaaaaaaugaugaguggaccccagagagggguuaaaguuucaguucuccaugccgucccaggucccucacagucccgguggcauuuucugggcgggggguggggggaaggacugaagauaccacugggcuuucauggggaagaggucaggccuucccuaagcugauucugauuguccuugagggucccugauguacucuucccaagguggccaacuauguaggagguggcuggguuucaagacugaggaacuggggccauggagauuugacuuuucucaggcccguucuucugacccuuuuuccuggggggauuaauuguggagcccugcuguccccaguaggauuucuauacuuccccagggcucuaugagggugugaucuggucccuccugcggcuugcuguccaggaccccugugccaaggaacagcgcucuacuugcucagucugccugcaaugucuucccuuuguugugagagugggcaggagaugcccacucaggaaagggacacuugaugaagugggucuugaaucuuuccagucccggugacuugacauuccuugcuuauuuuguacaucaaaaaggggggagggacacagugaacagcucccacacagucuuccccgguaccccagucugucgcuccaugcaccguggcuaggccauuuggaguuucccugucugaagaaagagagacccuucccaggaaaccagcuucaccaaaguccauucccaugaugccuucaggaauuccagccucuucagggcccuccccucccugcuucauuguugagcucuaacugugcgugguguguuggugcguguuguucuaugguugggggccgguggggguugcugguggacaaaaggccuacuuaggacaaagaaaggagcauagcugagcuucuggauucaggccucccaagccuuucccacccccaccccagucccuggcagaagagucccuggacggggugccuccacccaaccgaccuggcagucugcuucucgugugcuaaaguguaaaagcaagcauuugcauauuuucuccugcuaacaaaggaaaugugucgacuuaagggaacauuugggcuuucggaaacugugugggugggugugugagggaggagaaagaaaaguuccccugaugaucuaucugcacaccaauuauuucacacucggauuugggucccguggaaaaaugccguggccuguccuggagaagggaaacugagauguguuugugagcagggaauugcccagggccaucggucccaggcauuaaaggcuccccuacuuauuaacccagcauuuaacagcaggauaugggcugaagcgcagucaaaagaaacggcucaaccuccaaagagcaauuaaaauccugcacgaggauaaaucacgcggcgugauaauccuguuaauaaacugcagcuuguccugacccuucacucaugcagcaaacuagaaugugcuguggguaggggcggugggcugagaagguaagugggggagguggucugggccccuucgcacccucccuuccgcagccucccccucccacgagguggaaaauggguggcuuuugccuguucccugugugccagcagcucggagcccaucagcgucagcccuggcugcagagacuuaugcgcuaaugauuucuuguccccagcgagcaggcagucauugaauuacucagccgccucccccugcagcucccaggcaaaaccaccccuguuaggugcuuaaucuaauccagggcuccaguagagagguucaccagcccacuggucucucucuuucacccuccagcuuucggguugggcacaggacagcuuggaaauucagccgucccaaaccugcugucgccaccaccucacuguuucugccucuaccaccccaagagagaugaaugugccagugaucuagcaaccugugucuuucuggucccuccucaaauauggcuucuuucucuggcaaaagggugggcaggcccagaccugugacuaggaugggugucuuccuguuuguuagcuugagucuggucuccuccgucgccgugggacagguguguucuugguucauggacauugguggacagcgucaggcacaggcuacgucguguaugaauuaccuugaaagaggcuuugcuuucucagugccucucuccuuuaccuaaccucacggggcccuccccccuuucuuuuuuuaaacagacuagacgcuugaagccaagcugccauccaaggggcgacaugcuuucugcaaccccucuguaugggaacguucacagcuggaugaacagcgagaggguccgcauguguggaacaagugaagacaggugaauagucuccagggccaggccuggugagggagaacgggcgggucuucuccuccacacuccugagcagagcccaugcauacccaagccccccucaucuccucacagccagagaggggcccaaaaggucuggacaagagagaucuccuagcugguggcccuugauuuacaguuuuaacaggcagccugguucagcgaagcauugccgcccuuuaaaagauuagccccuaaagcggccuuucagugcgcuuucguccuuaauuuauuauuucauauuuaugaaggagaauuaauccccaucuauaugcugcuuuaacucuaaaugucaggagugugggcccagguggaucggcauucaaugugcuuuuaaaacaaauaguuugcuuaguaauaaaugaggagguggcuacccuuuccuuggguccaacccaagguuucagguugcccuaugcugcccuucuguguuguuauuggccaggauucugaucacuggacagcccaguuaggcuuucuucuaauccaugauguuggacuggggccgagacaacugaacaggaggugauggaagcagcuuugggguacuggugaaucucugccucugcugcucaucagugcuguuauccugaggauuuggaaguuggcguggaacacuuucuuuaucaaugcucucugauaacaagucccaggacagccaacagcagccuggcacagaugugcggcuuccucuccugccugaaguagcugacaugucucugauacuauuguacauccccacacagcuccacauuguuuugauaaaggcugcaaauauaacuucaccaucaccauggaaacuagaugggucccuaacuuuguuugggggaaagaaaguuuugaaagccuacccucaggguuaaugcagauguggauaaaugaaggggcuagccuguagacuucuagccugcuugguccauggccauuuuauuuaauuucugcccuccagaacagcucguaaggguuagcuaagacagcacuuggccucuguagaaaaggucacgugagagaagugugcuuaauuucuggcuugcccaccucugggacauauguguuauucauguccccacacaugaaaggccugccuuugcuuuguucugccaggguaauauugaaucaccauuugggagcaacuuucacuauaggucauggcagggaggguuaagacaguucaaaaaaaaugaaugagauuaguagaaacuggucugguccggggagauagaugaaagauauauucagcaagaaauguuuucaugaaauuggugugucuuuuuaaauaggaaaauuccugugaaugauggcgacgcuucaaaagccaggcuggagcugagggaggagacuccccugagucacagcgugguaagggauggauggucucucuugauaggguggcucucagugauuuguaaucaacuaugcauuaguuuguguguaauuagggagugugugugugagugucugucuguguguguguguguguguguauuugcuugcgcgcacgugcucacucaugcacacaaugugaggagggggaggcaucagggccuggcuauguauuguuuuuaauauacucugcccucacaagcccucguuccuuggucacguggaagcaugggucuucuauaaccaucuaucccguuaaugcuccaagcuguauaauucucuagccuccaaguaguuccuagggcuuugcuuugccaguaaaauaugaaacacuggacuguccuuuaaggcaccagggaaaggaagucaaaaaugcaaccauacuuugaccacgcccccuccaagccccuuuauugauuuagaacuaagacaagcuagaaaguuccucauauccauuguccggaggaaaacuguuucuuguccuguucaauaagaccuuucuguguccaagaaaugaaugccccucuccccaguccaaccugacagguuccacagagucaguguguguccuguaccccggaggaguggugcagagaaugucuuauuugguguugucugugccacagcaugguaggguuugcucacagaugagcaaacuaaugacuugguuucuagucugaguggaucuuucagugcuuguaggaucucaguugaacagaaaugacaaaaaaugaggcuucaaaaggauuugcaugugggaggaggcggggcacugggcacagcaaagcuaucuuuagccuuuucuguugggguguuaagggugaugucaugugacccaguggguggucuuucuucuggaccagggcugcuacugugacaggugucccaaguaacuuguguuauucuuuuacaaagguggauaccaguggagcccaucggaucgauggccuggcagcacugagcauggaccgcacaggccucauccgggaagggcuccgggucccuggaaacaucguuuauucuggcuuguguggauugggcucagaaaaaggucgggaggcuaccccaagcucucucaguggccuuggguuuucuucggaaagaaauccagagaugcaauucaaaccgaauacucccgagacaguggaggcuucugcugucucuggaaaacccccaaauggcuucagugcuauauacaaaacaccgccugggauacaaaagagcgcuguagcuacagcggaaagcuuggguuuggauaggccugccagugacaaacagagcccucucaacaucaauggugcuaguuaccugcggcugcccugggucaacccuuacauggagggggccacuccagccauauacccuuuccucgacucgccaaauaaguauucacugaauauguacaaggccuugcuaccucagcaguccuacggcuuggcccagccacuguauucuccugucugcaccaguggggaacgcuuccucuaccugccacccccacacuaugucaacccucacauccccuccuccuuggcuucacccaugaggcucuccacaccuucagccucugcggccauuccaccucucguccacugcucagacaaaagccucccauggaagaugggcgucaacccugggaacccaguagauucccacaguuacccccacauccaaaacaguaaacagccccgggugaccucugccaaggcagucaauaguggccugccaggggacacagcucuccuguugccuccuucaccucggcccucagcccggguccaccuuccaacucagcccgcugcagagaccuacuccgaguuccacaagcacuaucccaggaucuccaccucucccucagucacccugacgaagccauacaugacagccaauagcgaguucucuacauccaggcuguccaauggcaaguaccccaaggcucuagaugggggcgacugugcucaauccaugccugggcacacccggaagacaacgguucaagacagaaaagaugggggcucaccaccucuguuggaaaagcagaccguuaccaaagaugucacagacaaaccacuugaccugucuucuaaagugguggaugcggacgcuuccaaaggugaccacaugaaaaagauggcucccacaguccugguucacagucgggcugcaaguggcuuagugcucucuggaagugagauuccgaaagaaacacuaucuccuccaggaaauggauguucuaucuauagaucagagaucaucagcacugcucccucauccuggguggugccagggccaaguccuaaugaagagaacaauggcaaaagucugucacugaaaaacaaggcuuuggacugggcaauaccgcaacagcggaguuccucguguccccgcauggguggcacagaugccguggucacuaauguuucaggguccguguccagcucaggacgcccagccucugcaucaccagcccccaacgccaacgccaaugcagauggcaccaagaccagcaggagcucgguggauaccacgccaucagucauccagcaugugggccagcccucauccacgccugccaagcacgguggcagcaccagcagcaagggagccaaagccaacccagaaccgagcuucaaagcgagugagaauggccucccgccaaccucaauauuucuaucuccaaaugaagcauucagguccccagcaauucccuacccuaggaguuaccucccuuacgcagcaccagaaggcaucgcucuaaguccccucucuuuacauggcaaaggaccuguguauccucacccaguuuuguuacccaauggcagucuguuuccugggcaccuugccccaaagccuggccugccuuacgggcugcauacgagcaggccagaauuugugaccuaccaagaugcccugggccugggcaugguccaucccauguugaucccacacacgcccauugagaucacaaaagaggagaagccggagagacgcucccgcucccaugagagagcccguuaugaggacccaacccuccguagccgguuuucugagauguuggaagcuagcagcaccaaacugcauccagaaguccccacugacaagaaccugaagccaaacucuagcuggaaucaagggaagacuggggucaaaagcgacaaacuggucuacguagaccuucuccgagaagaagcagacacuaaaacugaugcaggggcacccaaagcaggccuuguagccgagaauguaggucaggacaccgaggccaccaagcccucagcugacccugugauccaacaacgccgugaauucaucucccucagagaggagcugggccgaaucacugacuuccaugaaucuuucacuuucaaacaggccucaagccagccaguguucagcuuaggcaaggauaguggugcagcaggaaccaacaaagagaaccugggugugcagguagcaacuccauucuuggagacagcucugggcagugagggcccugcugugacuuuugguaaaacccaagaggaucccaaaccauuuugugugggcggugccccuccaaacauggaugucacccccgccuauaccaaagaaggaacugaugaggccgaauccaacgauggcaaaguucugaaacccaagccauccaagcuggcaaagagaauugcuaacucggcagguuaugugggcgaccgauucaagugugucaccaccgaacuguaugcagauuccagucagcucagccgagagcagcgggcauugcaggugagccccccaacccgaauuucacuaacuuuaucaguugucaguuuuuguaauguacaaaggggauuugggggaacgugguaggccagagcaccaggcagauuugguuaaugacacuuaugauaauuggaauguaugaaauguguucaauaaggggacggcaguaguagcuuuuaggagguucaugugucagauacuuuaagcuauucuguagacuauaugagaacucuacuggaaugcugauaacaaguuguaauuauuaugaaggaugucuaaagacugcaugacguuuaccuagcaauugcuuugaugucucugccuguaagauaacaaauauaacuagaagcauugcuuagaauaccuuacuugauacuugguggagauguguagcagucgcaugucugugggaaucgugcaauuuuuuucaccaaaaagaaagaacauucguuuaaagggauagaguauguauuugauuugcuagugaauuaugauagauguuguauaggaauuuccuuaagauauuuuacuuuuaauuaaaagaugaauaaagccaaauuguuuugcaauuguuaagaaaaaaauugguuuaugcugauaaaaauggaugaaguuaucuaaaugauccauugagugcccauuuuaauuacauagauggaaggauuacaagaggacaguauuuuaugucuacccgcugcuuacugugaggucaguucuucaaauuuuuauuacuagaaucuuccauaaaccuuuugaguuaaauuucauuuccaaauauacaaagggaaguuugugggccauggucgucuuuguucauuguacauuuuguuucuuuucuguuguguuuuccuuuuguuuuucuuugcacuguggcuuuauuuuauuuuauuuauaaccuucaaaagagaaugucugucucuaugcaaucguguauguauggcuauacauacacauugcgucuauaucucuauacacacgacuuuauggauaaagaaugugugacuacucacauauagacacucuuaaauuuuaucuguuaaacuuuaaaauaucugaguuguaucucauaaauugugguuggcuuugggcaagcuuuucucugaaaacacuuuccuuuauaguauaaggcacaugaaauagccuuuaugguaagauguuguguuuuuuuuuccaucuucguuuucuuucuagcgugcaaugaugcgcuucucagaguuggagaugaaagagagagaagguagccacccagcaaccaaagacuccgaggugugcaaauucagcccagccgacugggaaagguugaaaggaaaucaggaaaagaagccaaagucagucacccuggaagaggccauugccgaccagaaugacagugagagauguaaguaacccgagcagcugggcuguagcaucacauuggugagagcagagccacccugcuuccaaggccugagauggugagaggaagagggauuuguggauaauggcucaagguccaguuggggacugcucugagaaagaggcugcuguguggcccuuacuguagugaugucugcuuacaugcagcugggaaucuggugucuaugagauuuuuuucuaggacuuggucuucauuugcaaaggaacaccaggcucaaagugaaugacagcccaauacaauguagcaguagaaagcaggugguaaggaucaguucuuuuuuuuuuucuuuugaagcagcuagaaugauacucuuuagccuugcaccucucccacauggcagucuacgcuggaaugggaaaaguacuuagguuuuuuucuaucuagguuuuuuugaggugggaugaagguuggucaaagcaccagaaagauggcaacagguauuagcugaguuuguugucauuggaaguuaucaauagaacccaagaaugggguaugggaccagccuacaagacagauagauggugguuuauggucucggguaaaugugggaaaagguaagcaagcgccuuuugggggaucuuucagucuaaacgauggguucccuguugggcugggcuuuuggagaguuuuaaggguguuugcugugacacuucgugaaggucuuuagguuccucgaaugucuaugcuuaagguuugaggccugcucuggccuucagaaaccuugcuagggaaggcgaauuaggaugucaggggaaacauggaggagaguuguugcagaagccuccuagacaagccagucaguggcauugggugcuugagagcccucuauuguugcccuugaagguguaacacaccuggcacaguucuuggugcgccgucuuuccuucacuaccuccaguucaucuuuaagguccagaaaacgcucuggcuggccugcagcaacagucagacccaagaagauuugcugugagcuaguccuaaagaaaaagguaguuuuuauagcaagcaagugacgcccuugcccaagggacucaaacggucucugucaaaagauguguacgugacugcucuugggccaaguggcaaagguacuccgagugagcacagagcaauagaaucgccagugcuuugugaggugcuuggcgaggaaggcagcugcgaaguaggcaagguguuuccagaagggaggagcuagcugcaagugggaguccccuuuguucugagugaacgcugagagaugccauaagagggugagagguuggauggcuuccagccuuuggccuuuuuuuuuuuuuuuuuuuaaaguuuucaaguaauggagccaggccccaaguggccacugcccucagauaagaaucugugaggccucccaccuaccugccugggagguccaccuccuccccacuuguucugcuuuuggaguggcuugaggggccccuccaaggcucagacagugggcuauuugggggguaccagaacagggcucccgccacuuguaagagccagaaauuaccaucaagugcuuuggagguuauguguaaaaggcuugcuuuucaagaaggaaaaauguuacuauccccauacuugccugccuuuacaacucauagaugugacgggagaggggcuuggugggggggaaaucacggcuacaagagccaagcuuaggagaacuaggguagggauuuggaguagaggggacaggauucuaaacucuaccuauuucuuuauguuguuguuguuguuugguuuuggggggguuguuuguuuugggguuuuuuuuuguuuuuguuuuuuuguuuuuuguuuuggugggaauggaguaacacaaaucuuaccagguagcucaggcuggccuuaguccuccugccacacccuuuuggaugcugggguuauaggcauguacugucucugcucccuuccccuucugagggagccccucugcucugagauggugggggcaucuuguugggagggggcauggucaggauuuucauuugcccucuuuggcugaaugaugguagaaguugcuugaaugaguucagugcuucccuucacaccugacagugcaugggaaggacuucgccaggacauuuuagagauguggaagggcaaggaagcauuaacuuggucuuugcugaacaugagcuacuuuaccagucucuugggugggguagaccuggaaccugcuaaaggagagucugagcaggaacuggagggaacuugagucaaggggcuuugugggaaugucucaucuggggaguuuuucccccaggacagcaccagcaucccuuaugaacuagagagaugccuuggcacugaucaccuacucugcucagcugugggugacagagcuagcuaccugcagaggggaaugacaucuaggaugacccucagaagucuuguuuagggcucacugggcauggcugccacagugaugaaguugcuuuguugccauggugauuuguaaauguugccauggcgaugcuucuacaagguauaguauggcagcacagucaugauaaauuaugggauauaugugcugcaagucauaugaccaugcuauagggagcagaugucaaacagccacacccacauccgccuacauggcuugaccuagaggccaacaguaagaguagugguagguaguagagccuggugguuagggccucuguugcuuguucucuuuuagccuaucuuuuuuuugcucuaaggguaaucuugcugguagugguuggacuggccccauuugcagagguccaagugaaaaaguauuugggaaugaugcggagcauccuaucgcugauggcaguagggguauguuugcuucaagauuguuauuaguuccuggaagaccacccuagugcaggccuuugggggcuucucugaagggaaugagaaucguugcccuaagaggcuuggagaaaggaugcacagagguuucuaaggguuugaagaauggaggagaagcuggcuauguugaugguguguggacuaaugugaaucucagauuuauuagugagacugcuugaugguaauugggauguagagagaacaauaggcccugcuguggaguuuccucaggaugagguagagagggacuugccauacagcaauucacaguccccgagggucaggaauacaguggccagauggaugcggaaugaugaguugaaggagccagccucccugucaaggaggcguggaugguaacgggguggcgggggcacccacugugugcagguuugcucaaaugggaaaaucccagaaagggaugagcuagccaagccuuuagggaugcucuugucauguaaggaacugaggcaggccccucucagcugaugccagcccaugcagcagucuuccgggugguuuuaccagggcacuuugugcauaaggucaacugauuugagauaagcuucauuccacuguugugaguugacagugaggcugaaaguguuucgcucuccaagaaagauagcuuagacagugaugcaggcgccuccucgaaauccggaguucaacuguuaagacuaggaagugaauguaaaauacucagggcagagagagucuuagcgauugauuggcgggggaggggggugaugauggaacaggauaagacagggcagugggaucugggagcggccccccacugaacaugcugcugucugauagugauugauuccaccuauaggcaguuaugacauuacccaguuaccuccccuucacaucaccuacaaaagggagaggugaacgagguacacauuaagauucugggguaaauuugagcugguuuaaggauccugcauaaauaauuucucuggcccuucccuuuucccugagcagccaggguugaggaaggaagaggagaggcagcuggucaucauguucccacuuuauagcccagcgcggccaaguuguaaagugguguacuguuaguggcagagcaguuaagagggucacagaguggcuagcacaagugauaccccggccaugcugagugcaguggucuuugacagucugcaugccuucacugguugccgucaagccuuagggcuggacacugacauugccgaagacccacuuggaccauguccuugaguuauaaaguacucagagaacugcagugacauggcauacaagggauccagccgcuggcuguucugucucugccaccaugaggagggggagcgguuggggacauguagccauuccuuagcucagauuggauccagucccacguucccuaaggugcugcucacccgcaccugacagccacucaaugcuggauugcccuugagagaagucgaugaugcaugagcagagcuggucggaaguagggguggaauuucaaauguauugagcucauccuaugaggugaacguuuauuucaccggcaaaaugacuccugcggugcuaccaaaaugccagacccacauccucaggagaccgccacccccggggaaccuguggggucauguuagugaucuaugggcaagcacugagccuuauggugguugcuacauaguggguuuuguuguuguuguuuaggggauuuauuuucucugugugaacacaugugucacaauauguauguguaggcuagacgacaauucuuccaccauguaggucuccaggaguggagcccacuuccccggcuuaccuuuacccacugaggcagcucacugguuccuguaguguuuauauuuuguuggauauugggaaaacugccaccccagagcaaguugugggcuaguuccugguuacaacaauuuggaagugguguagggcuaugguggcucagggagaggguaggugccauaggugucuacugguccucuugucccuuggucugcuacagagaacugaaggagcccuggggagcuggagccaacaguuuaugcuugccuggcuacaaaagucugugaagguggugaggucuugucuauagauguuugcaugacagaaagagcacagguuaggugaccugaguccccguggggaccccuauuuuggacauuaaauggaagcagcagcuugauucagugauagguauuucugugggcagccaucagauugagcccuuugaaguuguagcauccuugcccuuggcucugcuugguccucuucucccagcagcccuggcucugcaggguucuuugcccccucgugcccauccagguccugggcuucuuucaacacucucccauccacauuccucaguuuucaucaucuuuugucuauucaaguaaacauagaugucgccccuuggggauaugacauuuuggggauauuucaucuuuuacuacaauccucugugucuccaaaucaugaccuaagagaugcuuccccaaagauuuuuuaguuuaagcagacuugguugagacuagguugggguagcucagcccuuucugaguuccccuggcucccaacuacaaaaagguuagcaagacaaagugcguagcuugcugacuuguuuuggcaugcccuuucucuggaaaguucugguuauccugcuuccauguucccaaugggcgaggaucucugucucccaagaccugugagguguucaucaccauggccuuggccaaggcuagccugccuacgccccauagcccgccuccauguagggagcuagauccugauuucugaauuuuuuuuuuuuugucuguucucacaggugaguauagcacuggaaacaaacaugaucucuuugaagccccagaggacaaagaucuuccuguggaaaaguauuucuuggagaggccaccugugagugagccacccagugaccagggggugguggacacgccacacagccccacccuccggcuagacaggaaacgcaaacugucaggugacagcacccacacugagaccgcuguggaagagcuagcugaggacccucugaaagccaagcgaagacggaucuccaaaggugaguguggucagcucccacugccugcuugggaggccuuugcaugcagccgcagagggcgcaauugagugugcuuguguggggucacagugggguuauugcagcaccucucccccuccuuccauagacagcuugccacucccacaacgccucccgaagcccuggggaggcggcacccaccuccccucccuccaaacccagaggcggccaaagaaaaauaaagugaccugccaagcagagacaguggccacacccuuccccucccccaccccauuggugcuauguaagacagguuuuuuuccuccccauggggcuuuuugauuaauuuguaguuauuucuccauuagaugacuggccugagagggaaaugacaaacaguuccucuaaccacuuagaagacccacauuguaaugagcugaccaaccugaaggugugcauugaauuaacagggcuccauccuaaaaagcaacgccacuugcugcaccuuagagaacggugggagcagcaggugucggcagccgagagcaaaccuggccggcaaagcaggaaggaaguggcccaggcuguucagccugaggucaccucccaggggacuaacaucacugaagagaagccuggcaggaaaaaggcagaggccaaaggcaacagaggcuggucugaagagucgcucaaauccugugacaaugagcaagguaugcagagaccaccucuuggcuacucacugugcuucuagaggauaggucaugcauuccaugggaacacggggacuugggccauccaagguuguggcuuuuuagugauguccucgaacacccccauugcccgucuuuccacuuuccuccugauuucccaguauauggcugggcaggaagggaaggcuggguggccccacaaccuugccaacgaaccuuccaggcucccgcugccucagucaucaggauuugugagcaccugagcccagugggugggggagagcaggaagaaccaguuucuguccucuuguccuggcccuuugaagaaaguuaccacuuggcauuuugaggguuaaccuauuugccauuugaaugugggauaauuaaaauauuaaugcuuugaaaacauaauuguuauaucuuuaaaaacugaagccgcuccagugaucagugcuaacaaugggcuuuucuuucugcaucggcuacaacuguguaacgccugcuucuucugccccucccccgcccggcaccgcccccucccccuccguauuuaggcuugccugugcucucaggcucuccgcccaugaagagccuuucauccaccaaugcaaguggcaaaaagcagacucagccaagcugcacgccagccucaaggcugccugccaaacagcagaaaauuaaagaaagccagaagacagaugugcugugcacaggggaagacgaggauugccaggcugccuccccgcugcaaaaauacacagacaacaucgagaagccauccgggaagagacugugcaaaaccaagcacuugauaccucaggaguccaggaggagcuugcagaucacaggcgacuacuauguggagaacacugacacuaagguaccuucugcccugcuccccaccuugugccugcuucuuaugaaggaagcucccaucuuccuggacugcacucccuugccaccgcuccugucuuagaggggcaugugcacuggguggccaugaaguuucaaauuaguaagagugaaaccccaccccaccccuccucugaccgaccauccccccccccccaaaaaaaagacaagugucuuucucuguggguuuaucacuugaagaggaaagggagaagaagcaauggggguguuaaagggucacagucuuaccugugcauacugcuuacucucgugacagaugacugugcggagauucagaaaacgaccugagcccaguucggacuacgauuugucaccaccagccaagcaggagccaaagcccuuugaccgucuacaacaauugcuaccggccacccaggccacccagcugccacgcucaaauucuccucaagagaccacccagucucgccccaugccgccagaagcucggagacuuauugucaauaagaaugcuggcgagacccuccugcagcgggcugcccggcuaggcuaugaggugaguguauacuuguggguacugggaauccgaagcauccagcugcugcugcugcaggcugggugcaggagcuucagggagggccuuggagagcggagcccagccccucuacaucaggagguguuccaaggcccagcaggauguuuguaucauacccacucuggcuguuggcucuuuguuuuuuugguuuuugggguuuuuguuuguuuuguuuuguuuuguuuuuuucgagacaggguuucucugugcagcccuggcuguccuggaacucacuuuguagaccaggcugaccuugaacucagaaauccuccgccugccucugccucccaaguauugggauuaaaggcaugcgccaccacuguuggcucuuugguagcuaggucugucaggguagaaaaaccaaagcaagccucagauguucuguuccuguucaggcagguaagccagccaugccacgcuugcucccuuagcucugaaagaaagucugacauaacccaggacuuggcaacugagguaaauuguaaugauuucuuuugguuugugauuaaaagggguguagagaagcuaucagcucuauuuaggguggcuuaugcuauugcugguagaaagguggucuugaggagucggaagugacuguggggaugguugguguggacccacugcuguuggggaagcagcccugacuggaaugacaucugagagagggaggcaaccugaggggcucugccccaaacucauugcugccaacuggaccugugcccucaguguuggcccgccugagugugcucccaagccugcaugauccacaguaauccauuuucccucucaucuucuuugggcuugcaacugcuguucucugcacuuucgguugacaaaaguugcagggggacuacagaucuuggaaagauacugacccugaacagugacggcaaagcccagcccugucccaucaccaccuuccccagcucuucuugguuggacucuucgcuccaaaggcuccagggggacccuuccugcaguucagaacccccuagagcuaaccuccuauuucugccccuguaugcccgccacgcccacuuaccaauugaaauuguggugcaauaggccacggggcaaaggccuuucuucuucuuuuuuuaaugcugacaucagcccccugggaguuggauggucagaaugaaaugcaguucagcaagcuguguguggaggugugaaggaaaagggugaauacccuggcccaccuuuggcuagggccagcaggauuuagccggcacccugacauccuuucauucugauaaccauuguacuucgaggugggaucgccuagcccuacaauaaccagugacggaaaucccagccugggaauuguagcuuuguaggugggaacuugagggaaggaugguccuugggugcacuuguguuucugguugugugugcuguuguuugcauuaauacaucuguguuuuauaucucaggacuagcucagagauagcuagaaggaaagauugguuaucagcucaguuacugugguuuaagugcaaguggccguugguuguuuaaccgcaagcagagagagagagcaucaccaccuaggacaagggugaggcuucgugcucugcaucgauuuccuuucaaggagcuucaccagugcuccacuugggcuucuggcaagcucaccaaaggagccggugagggaaugagggcucccucaagggcagcgggcuucuuugcucauagagaaacaaggcuucuuucuuagcccuuugaucucggcaucauuuccaaaggucuuacaccuuugcaaagagaaauggcgaggcucaagagacccuuguggcuucucuaaggaauaguuguuaugcagccgguaggucugaggucucugcgaaggagcacuuuuuuaggcucuguuccuuugauggcccggggaauauuuacugaacuucuccaugcaggcacguggaauuuucaaucuguaaauuucaaucccgggugauuuaacuguuaauguuaaccauuucacucacccagagucugccuuuccuggguuucuuuuggcagaauguacgguguuggaugauaggccauucagaugcggcaauuucaaacuuucuaaaugaagggcaauuuccugguccuguagggaacuguuggaaaccugcagcuauggaguucuuccagcagugaacuuuacuacuguuuuccuaguuggcuaaaguacaguaaaaacgaaaguccucucccccgacccucauucucuuucagcuagugugugucuagggguuuacagcaccccaucucuucaggggugucuuaacuagauagaccgcugaucaggcaggcaggcaagggacacugaacauuguuugucuccuaagaaggcuucuauuucucuugcuaaaauaccagcaugcaaccacaugcuugugcauuuaguggugaugguuaaauuuucuaugaauuaaauaaaucauguuuuuaaaaaaguuaaugaggcauuuaauuaauuaacaaugucgaguuuauggccuuuaugguuacauuuugcgguuaauggcauucggcuuauggccucuuaacagaauuguccaacaaaaacaguuugauuuuuguuuaggaauggguggguuguccuucaaacacccauuucugaugcaaaaaauaacaagagagauguaucaggcggcacacaucuuccccauucucuguugggaacagcaguuggcaucuguaaagaggccacccuuccaccuaggagagugguauuagcuugcaugaccucagcaguggggucggagggaugcugcugguaacagcuggauugaagcccucuagcuggagcuuuucauugggccuuucgaggcuucccagcagaccugggaauugguuugagugaugagucgaauaguuccccuugguugggaaucuuaaccccucuggaccacagucucccagaguguuggaugagaacacucccacuuuucuuccuggaguuuccuaggcuguggagagugguguggggcaagaucucacgccaagugacaucaguguagcugagugaggauaggccauggcaaauaccucaccuaguguguggccacugcuaccuucccagccuuccuacggggaaaagagcgaaucgacuuggccuucugcucuggcuucuuucauuucuagguucccucagaucugcccuguagcaagauaggcuuccaggugagggccauaauugucagaacaaauaaacccuggguugagagaggacacugggcagaccgccgggauccacauaaauugaucuuugcacagcagucaguggcgcucgccgaucccagagucacgugaugaggucucuuccuggcuggggcacacagcucauuagauugcagccguccacucgagucuggcuagcgagggccugcuaaaagagcagcagcuucauacgguauccuggauaccggugcucagggcagguggccugggagcucagagcauugugggcuuucuggcagguuagaaccugaaggaagaaacaccgagccaggcaugccuuuucucuuccuccccuuguuuuagaaaggagccgccguggugaccugaagcagcacggcacagauggucagauuucccagcaugcagcuuuaggcucacagggaggcaucuggaacauucuaguuaggaccuaagugacccuuaccuuugacugaacuguccuagaaagggcauaagagauuuuuuucacaacccaccucaugucuaugaguggccagcaggagccaugucuaacagauaaguuuccccaguguuaccugugagguuucccuuucacugauaggccauguguuaggccacccccacacuuacccccauucuuagaaguuaggacugaucuacuuggcaugacuuagaggaagauagcguaaccuguuuccuggcgacagauacuguucaauguguuugaaaacuugcuuaaucaugguaauaagacauggaauaaauuacugccgugcuuacugggagugguucauauuaauauuuuaacuugcuaaagaacugagauuaauaauagugauuuggaugcagacucuugacacugaccgccuuccgcagagggggaggggcgggcuuguucuaguuuguucuacuaugugaucuaucugauucuugucacugacguagguaaauaagaguguauuucauugauucagucuugaguagaaugagaagugaggaaaggugggucauuugaggucuuaguguccuugguggugugacugaauaaagcccagagcauggccuagcaagcaaaggcucuccugcugcacuacuccccgccuccccagcucucuguaugccuuuuuuccucacgugacuguuucuugggggggggguuguuuuguuucuuuguuauuaagaguggauuuugcuuuauaucccaggcuugccacuaaggcuggcaucaaacuuaaaagucaucccccugccucagucucuugagugcugggauuacagguguaucccaccucacuuagcuucaugccacuccuuggugaugucuaagauaccuggcaagaagccccaacuagagcccugccucucauccagaggccuggcugcccaaccucugccuccccucuguacacagggcuggaaucuaccugacccacccuggguugcgggguguggugacaacuuuuccauuuugcuugccuuugaucacucucacuuuuaucuaaacuuggcuguuuauuaucuauaauggcccugugaaacauaaaugccauuguacaggugaaugcacccuuggauuuguuuuguugaggcagggucucacgguauaucuuagaccagucucagauucuuguugguccgguggccucagccucccgagcauuagcaauuacaggugggagccaccaugccuagcuuugaaugagcccuuuugagaccuaugcagcugaaucucugcaugcucccucagcacugagccaaguagauuggggccucauagcuuugggccacacagagcccuucacacuguucugagccccucaauaaacauccaggcaccacccaaaccaaaguggguucucaggccccagugugcagucuuagaacuaugaagaagucuuccuugugaggugacuguguggugauuggaugguauuuccuguucccuccccacaggaaguggucuuauauugccuggagaacaaggucugugaugucaaucaucgagacaaugcuggcuacugugcucugcaugaagcuugcgccaggggauggcucaacaucgugcgccaccuccuugaauauggcgcugaugucaacugcagugcccaggauggaaccaggucaguggugugucuccuugcauccucauccuuccuuuagaggaacagacgguagcucuaaggggaugcagagaaccccugagagagagagagagagagagagagagagagagagagagagagagagagagaaagggagagaucgcaccugcacaaauuccagucuagaagugaacugaacagguuuuccuggcacguguagacaaaccccuccuagucuuggccaguucuguaguucucccacagaccaggacccuccauagaggcuaugucuuccugaagagucagagggugcugccuuuucaaacccuaaacuguucauuaccaucugggaagucauauucaaaguacuugugagcugaaacaccccuggcaacagacuaaagaccacaugucccucccuccacugcuuccucagucaccacccacauccaggcccugguauucacuuggugcuuaaccucugcucugagucagcacagcaucuugagggguacacugcugggagacggggcauagauagcuaaagguaaccugugaaucuuuuaggcuuuuguuuuguuuuguuauuuggacacagucuuucuauguagccuugcuuauccuagaaucacucuguacaccaggcuggccuugaaaucacagagaucugccugccucugccuccugaguguccugguuuccuaauaacauugacuccuguguccuccuuugaauauaccacugucaggcccuuaagacacuuucaucauagacuuaaguucuuccuuaggccuaaggauaaaauagauguguacuugagagcugacccuucacugguacuuuagaagagagcugcuucuuugacuuugagccagucguuuauacccgggugcucacuguagguggugugucuuugcuucuagcuuagaaggugguguguguguguguguauucacacaagcuuaaugucacugugugucucuucccaggccucugcaugaugcuguggagaaugaccacuuagaaauuguacgauugcuucuuuccuauggugcugacccuacuuuggccacauacucagggagaaccaucaugaaaaugacccacagugaacuuauggagaaguuuuuaacagguaugauguaguccaaugaauaaucuuacucaaaaguuugacucaccugugcacaguaugguuucgggcaccuacaguccuagauacucugagagcauaaggauggaagaucaugcauguaaggccagccagacugacuuaugaaggccugguaguugaacacuuagcacagggaaagcccugggcucucacucacaccaccuaaggaguggauggggugggaagagaugggaacuguauauuuugauuugggugugacuaggcagaaugcaaagguuguuuguuugguugguugguugguuuuugaugguguaauccuguuauagugaggccauuuggcuucuucaugguagcguucuuugauuguuuguuuaguuucccuuucuagaaaucuccuuuuucccgaaguauggcucauaaguuuacauagcaagucuguauggagucacacaaucugaugggcaugcaguuuggggugauguuguuugaucuuaggguaaagccaucuuuuaagccccaggcgcuaggagauuccccuaaacagaagcacagaggguuuuaugacucucaggcgcacuuacaguuugcauuccuuaucagacauucugggaagggauucccucagcuggaccaugacccacucaugcccaucuugaguuggacucacugggagaaguuacucaguugaucagagacaagguguagaaauacaguucuuccuugguuuuauaggcaaaagcugcagagcuucuucgcucucauuugguaggccaggguggccugucccucggcaagucaggauaacaguuauguaccacagaaggcuucuaagaauugagaggcuacgugcagacccauucauaaaauagccuaucaugaguucauaggagaaaugcacccuaaguagaucagcauuuuguuauugucaagugacguuuuguuucguguggggacaggagcccauaguggggcccaggcuggccucaaacuuucugggauuauaguugugcgacaccacaccuagugaucuuccaucacuaccccuguuucucugcagacuauuuaaaugaccugcagggucgcagugaagaugacaccagcggcgcuugggaguucuauggcagcucugugugugguaagcagcuuuuuauuguggggaguggauggcuuccaaugucuaugccuacccggagggagggcggugggcacuggaaaaacuuggucacuggagaagauuguuagaggucuggaugugguggugcggcugaaaucuucuguaguuaacggaucccucucucucauuugucuuacauuagaaccagaugacgaaaguggguacgauguuuuggcuaaucccccaggaccagaagacccagaugaggaagaggauaccuauagcgauuuguuugaguuugaguuugcugaaagcucccucuugccguguuauaacauccaagugucugucgcucaggggugagcauggcuauuucuggcacaaaguggccaagcugcuucuaaggcaguuugucccauuaggcagaugaagguagaugaguggguggcuccuuagcugucggcaaacuuuggcuuaggguccagauugcuugauuauuuaugcccaguggagauggggcuuaaccauagcaugguauagguugcccucaugagaaagcaggagcuuagagccaccaucuuggauauuacaguugucacccauucccgaacaaaucacccuaggaacucccccaagacuugagguauaauuggauuguagugauaaucuaccuccuuaucuaagaauaggacagucacacuuggaauccuuaauguguccucagauuugguuagaucccauguguccccuaugggugugcugcugcaccuucauaccguccucuggggcauacaucucaagaaacagcuaugcugugcuauguggggacaaaaguguuuaaugaguaauaaucuccucagcucugaaacgauaaacacauaugccaucacaaacagcgacagaaauucugaaggguauuagcuagcuauuaagaguauuaagaaaaaccgggugugguggcacacgucuuuaaucccagcacuuaggaggcagaggcagguggauuucuugagaucgaggccagccuggucuacaugaagcaugaagcaaguuuuagcuagagcugggugagcaggacuuuuucuccauuuguuuccauccucagcagacacagugaagcuuguucaaauccuaguacagguucuucguaggaaacgagaucuggccugaguucuuucagcugcaguuacucuccuuaccucaaaguccagugaugagcuauggugggagagagccagugggaggguugaccaaaagacagcuggcccugguuaguacucaaaaguagucaggguacuguaguaccuuuccauuuggccagaaaucuaagucccaccccuuucuauuuucuaggccacgaaacuggcuucugcucucagacgugcucaagaaguugaaaauguccucccggauauuccguagcaauuuucccaaucuggaaauugucaccauugcagaggcggaguuuuaccgacaggucucaacaagucucuuguucuccugccccaaagaccuggaagccuucaauccugaaagcaaggagcuguuggaucugguggaauucaccaaugagcuccagacacugcugggcuccucuguggaguggcuccacccuagugacacgggccaugaaaacuacuggugagccaccugccccgcccacccacuguguacaguguguuauaguguuaauccuugugcauaugugucauaauacaacaauuucuguaaagaaaggacacuauuacauaugaaaauaucucuucuuuauauaagagaaguuacuccggucagaagaacccagaagcccguguuuucuuucuaaaauuuuaagucaguuuuuaugaagcuguugaaaugucuuuauuuuucaguguacacaugcuuugaaauguauguucguuuuuacuuggaacauuuuucuuuucuguucuuuucuaaggagaaaaaaauaaaugaauaaaugaauaaaugaaaaggagcucugugcuuggcguaauuucauacaaagcucugguggcgggccauggguguauuguguggugaggacuauguguuugguuugcuggagugaauugggugaaggcacuugguggugguauacuuuuauguuuuguuuacagaguaccugcucacaccagguaaaugcuauuggacgugauccagugguauguaauauaaauucaaaccauauccacacacaacaacuaauuguaagaaacuuuuguauccuaauuuaaaagcugugaaauuacuuuucacacaucaaaccggauuguuuauauguuuaaacauuuuaugcucuuauuuaaagaagacuuugagcuauuuuuuucuguacucuguaaaauauugaaaacuaacauaauauguugagguugcuugaaaauguacauaaaacuaaaauuuucugaauuguguguuuauguuugaaaucuguguuuuaacuuuguaaguaaauucucugccuuuguauuuauauuuuacaaaaauuuuucuuaaaaggcaauaaaccuguugaggaaaggagcaaau

SEQ ID NO: 9397 - RNA, 29303 nt, Mus musculus
ugagaccuugucuuggagcggcuaaaggggaggggcuuggggaucggaaccgucgggagcgcgucacucggucgagcugcagugcucgcuugagucccggcgucccuuuucguguggcucaucuccgcuucagcaaccguggcaccauggcugugcuggucguucuccuguucuuucugguggcgggugaguagcugggaagcacugcgggaagcuagggggcgcggggacccugggagggagcggcugcuggcgggggccgcagugggggcggucugggcuuggcggcccucuucgggguucuggaccuugaucuggcucgggcggagcggccuuguggucucuggagacgagcagggccaccuggggggacuccggagcugacaucagccuuuggggguaaaggcgcguagccgcuuaggacccaguccucccauuugucugaucacuccuucccuguucaaggcccuuuggaggauggguuugcauuucuuaauacaccguugaaccacaacccacuaccaaggaaagguuagcuaacaauuuagcugccgcuuuuuagcugcugucuuuuuuccaccuucauuucuaaugguuguuauugacaacgggugaacccuuaccucccucauauauacauaucaggaugugaaguugagucaucguuuuuuaaauaaugauuauuucuuaagaugaucgcaauuucuuaguauugauuucaguucccaauuugaaggauuuggagagcaggguaugagucaugcuuuuaggaucacaugucaaauaaaugguagcuuucuuaguggaaccuaccuaggcucucuaacauggaauaagaagaauggaaaugagcuaauauuuggccuguggcuugaguaucauguaguaaugcauuucguuuacaguaauccuuagaagaaaguauucccauuuugcagaguaugaaucaagcuggguaugacaaggggaauauguaucaaagcugggcaugacaaggggaauauguaucaaagcuggguuugaagacagacagaucaguugacuuccaagaaggggauggaugccuuuccacucuguguguguggcacagggagugcuguguggcaacgugggaguagugggacagacgcugagcuugcagacaauaagauacaauaagucaagugaagccaggcauggcggugcaugcuuuuaaucccaauacuugggaggcagaagcagguggaucucuugaguucgaggccagccuggucuacagagugaguuccaggacagccagggcuacacagagaaacccugucucaaaaaaaaaaaaaucaacuggagagcaccuuggggaggaauggguguuuugugucaaagagauaccuugugccugugcugugugagaugcugguccuacuuuuggaauggcaguugaagugaaaaagaccuaguaaugguuuugagcaccaaaccucuucucugcccuggaggugcccagcccucuguguuaauaguuaacauauauuucaggccuccaaaguguuagggucuccuucauuguuguugguucuggaaaggccauucugauuuaaucaagauacuuuggggauuuuucaagguacuuugguaacugcuugccacaaaagcaugagggcaugaguuuaaaccccagcaccuguauaaauaagcacccgugugugcugauaaucucagggcuggggagguggagguggguggaucccuacaaguuccuugcuggccacuguagccuaauggguaaguuucacauuccaaugagagacaggguggacaguuccugaggcaagacgcugcagguugaccucagauuccacaugcuugcacauacauccauguguccguguacacacacacacacauugggagaauucuuuuguuuuaauuugguuuaaaaguuaaaaacgaaaccuuuccauugacacuguaguucagcuggacaucuguauccugccugccaucuuaugaagaccuagaugucccugaccucagagagaucugccugucucuaccuuaugaguaccacuguguucagcucuaugacauuuugagucagggaggucuugguuuuugguuugguuuuugucuaagguaaaauaauuauuucucuccaugguccggacaugcuagccuugcuaaagugguuuaguucauauaacaguugucugagcugcuggcucuugucaggugucaguacaguguuauuuuccauggugacuaagcgugauuuaguggaaaacaucuuuaagagcucagauuucacuguuugcuuugaaacaguguuagggaacuagaaagaacuagggaaccugggcuaugacuaccaaguuccgaggcauauuugaaaaaguucagauuuuagccuggagaaaaaggaccaagagcuaacacaugguauugguacagaugcuuguaaaggagggaguugauuuuggucucugauguccuggagacagaaguagcccauaucccuuuuuuaaguugauugauuuuguuccaucauucauagaagcucacugcacaagaucguggagucucugaggaagggacacuaacucccucucgaagacagacuggagaagcucaaggaaugucccccaggggaggugucucccaagaagauuauaggaaaggcugaggugggggaaagaauucaaauggaacagugugugcaugugagcacaggguaaugagagcagaagagcagggggcuuguugaaaucuuagaagucagcuuggugagcuggccaggggacauuguuuucccaaaagacucugggcagugagcacaagcauuuaagccgaagggugaauaaacagauuuguauuuuggaaauaugaagagaaaacuggagcugaggguaguaugacagggucauaggcagccagcugcagcaagccuggugagggauggccaugguagugggggggggguuggggguuugaggggugucaggaaauaaugaggaaaagagcagcugaaaccaguggaugguugguuguggaguggcagaagggcuuaaagaggaagcguucaagcagcuaaauggaagagagacuguagaagucucuggaaagcuagugaguccagaaucaaaccaacuguugaguuugagggggcagugagacuuacaaagaaaugucagugcugaguguguaggccuaagacugggggagagcuagacggggcuaaaagccugggagcgggcaguguaucggguguuuaacccuuagggguagauaggcucagucagggagcaugguguagaauugagucuuccgagcuuucaaauagagaguaugcuacaugauucgguugggugcugggaggauauacuagaauuuccuguauguggggugcuuuuaagccuuuuauuuuaaauaggaauggucagauguuuuaaacuuggguuuauaucaugauuacauugggaagaacauuguagagguuaaaauguuuuaugggugcuuuaucauacaguacagauuuguaaucaaugauuggcucuacauguauaucauauguauuauagaaacagguagagagaacugguauccgaagcccagcaccauagcucugacggguggaacaggaggagaacguggcaggagucagaggaauuggaaagaaaaccaggggccuugucuucaugaaggccaaagugggauuccaaagagggacucagugucccauguguggggaagugaggcaauugaggaaggagaacugugucucaggcuuuagugugcuguuucaggguguaggcagagacugggggccaaagcaggcagcacgagaugaaguagaaaagcgaagacuaggcaguuccaguuccaggguucuucuccugaagggaagcauuucaagauagcuuuugcuuuggcaaaacacuugucuucguggcucuaaguuuaggcagcagacaggacuuggguuugugcugaggagaaggggaaauugguaguuccgggugugacuucacucgcucaucagcccggcaaacaucugccaggcuguugugugucgggugcuauucucagcucugggaauguaugaacaagacacacugaaaucccugccuaccucuauauagucacuuaacucuugcugugucgucuaucuaaaaacuggaucaauaaaugguaagugaauaauuccuuagacagaugaaugaaagucugugagcaagccaaacagaagauuguguuagacacaguuuucuugugacuagaaguugaagcagcuagggacuguaggagagcaaguggguggccuagagucuguaggcuuucucugugaagcugggggcagguuaucuggagaucgacuggagggacacgaagcccauuucaguucaggacaaggaaaagguuuucuaagaacuagcgugcugggucaguggagcugaccucuggcagacaguguuuguaaauugagguggcacuccccccaucacugaguaagggacagcuggcaugaugccuguaacaugcagaaacuuggacaauguuacucuuaugacgcugccaaaggguuucugagccgugggacuguugggcagcugugguugaagguaaccccaaaggugaggcaguuacagcaugccaugggagcugaagguguggggccacaucucagaacaaagcuaugugcauggccagagaggugccugaaauggguguguucuuggaaaguauaggcuccuugccuguuuuccccagccuucacaaaguaaggcugucaagaugccugagguguuucauuuugagucuugcccuggaggcucugugcacuucuacuggguaauaaacccagauuucuguugccuacagaugaccauuccauucuaguaauuuuuuuuuaaaaaauuugcuuucagcuaaaaauuuagaaauuguugcucuggcccugggcugacuugaaacucguaacugggccugcauuuguacuagccugaggccuuuuauuuacugucaauaacugccugacuaaaacauugacuguuguugcuuucugcgucauucgcauagcauaggcuuaagcauuucuuucuugagcucgagggaaugacacugauacccuaccaaagccucauuuucccauagaaggccuggccaagauugguuuuagacuuggaacuaauuuuuuuccacaggaaccaaaaguuucuauuaacuacuugucguucuggggguguggcucaggggcggggugcuugcuguagcacuugaccgugggggaacagauccuccauccuuaggggaggucuuuaagucagucccuucgcuucucguccuucacuuuuuagcggcagauaaugcacacuuugauuaguuggugguuauagggucugcauguuuucucaccauccuggugugucaacugaaaacacuauucauggacuuugauuuccgaagacugaaguguuuuauaucccaccuguuaacaccugugcacacauagacacacacacacaucuuugacaguccugguuucacuaaguuaccuaugugguggcauaaggaaacacccuguauccagagauguagacuaaccuguaaggaugcacuggcccaccagccuaguaguaaaauaagaacaucauaaauuugcauauuauagaacaggucuggaagcagaauaaugcgaagauuucagguuuccuuccuuuuuaguaccaaaaagaaaaaaacccuuuuugcuuuuuaaaguccagagaacugccauugaugucuaauucuugcuagucugccacguucccccauuaagggucaucuguagacagguaucuacaucauuagaaggaaccucuuucagucccccaaggcucaggaacauuaugggaaaggcagagagcaugugagagccuggggcugaagagaagcuccgaaguuaugagcacucaggcucucccagacgaccuguguucaguucccagcacccacauggugguucacaaccaucugaaacuccaguucuaggguauccaauacccuuuauuggccuuuggcaccaggcacacacauggugcgcagacauaaaugcaggcaaaugcucuuagauguaaaauaaauacauaaauaguauacgagccugauagaaaggcugcuguggagcacucucuuccagguauguuguggcacuguuaaagccacagcagcuguaauucgaugcacccugccauaugcugugcagggcucaggaagcuucacccuuuccaggguuuauaggcaguuaacgggagcugggggagggagucuuaugaggccccacccaucccugaagaccucuaggcagugagugguugcaggguauggguggauuuucuugguguagccacugauaaggaacccauacacuuguaaauaauccuuuacccaugcuccgggauccaggccuuauuaagcucugguucacuaccccccccaaaaaaagacgugaaaauagaggguuaauuaggaagaggaaggaggggggucugggagaguggaaguggcaagagaggauaaugguaaauuggucaaaauucauuauagcucuauaaaaauaccauaaugaaacucauuaugcauacuuaauauuugcuaauuucaauuuuuaaaaagaauauucucuggcagaguuagauauguacccuguuacacuauauauauauaaaauauauauacacacauacauacauacacacacacauacuuuuuagcugaugcuuugggggguaaauuguugaugagucuuggagcauagcuucaaucugggauuagguuguuuaaaaugugcaguagcacaugcaccuauacuaugaagacuugcgugccaucccuagaaucccaccagaaauuucucuuauauuuaugauucaguauuuuguccaaauauaauuuagcauguugacccagugaagaauggggaaauguacuauguuuaauaaacuucaagguggaugcaaaagauauauaaugaugcucauuuaucuguuuucuccuuaggugcuuuagggaaugaauuuagcauauuaagaucgccagggucuguuguuuuccgaaauggaaauuggccuauaccaggagaucgaaucccagacguagcugcacuguccaugggcuucucuguaaaggaaguauguauacuuaaaaauaaauaguuguaacugcuuuuaaaacauuuuuuuauugauuucuuccuguagucaaaaagagcaacagacaaacacaaguacauuugcuacagauuacaaaacguuaaaggcucgucaguauuugggguaaucuuaaguacauguuucuaaaaccaagucuucauacaucauuaucaauaaaccucucuucaucgugacaaccuucauguguauagaugcaucuauccaguaauuuaaguauauuuuuauuuugaauugacauguaauuuacauauuacaggugugcugcuauuaauagguugucuuuuuuuuuuuaaagugcaguuaauuugcuacaaaugcuaaaaugccuacacaucucaucugaaguuagauaauguaacaguggcuguuuuccuaaaaucaggcugugacccaugguagucccuagcuacugauagaacuguaagagaggggccuggacccauucaguccaagaggccugaaacucaaaccuuaggaggacggggugccacuugcucugucuugcuuuuacagccucuugccgcuuuguaaguuggcugcugacaucaucagucacuugagauugcuccaggcaaucucaccccgauaguucugcuugggcacuccucagcaguugggcuaaggguccagcccacaggcucugguuucuuuggacagccugagugagcaggcucuguuguuuacacugaaggaugagauuuguaccugguucucugcaagcuuaaauuugacuauaaaugacuguuccauuaagcuucagaaauaauuauuaguaaggcaacaugaaucacgguuaaaggcauuuuauguauaaagugcuuaguggagagagaacauuuugacaguucuugcuauuucugcaagguaaaagcaaugcugugcauaaaggaaaaugauucaggggaagaaaauaacagcucgccagcuggaagagugcagagcacgcaggcuuucuuuacuugcuuccuuuuuacacaaaaguugugagugaacuuucugauaaagaaaaguucuuuacgaacauaaagaaggcaggcaggcaggcauccaugacccuccuuaggagauugugaccguugcuucaguaagaugcccaugucgccuuugagcguaccuagccagugucauccccggaccccuucacucugguuaguagguguuccuggggagauaguuuccauauuugagaauuaagaacuguguugcacauuucaaucuuuaggaccugucuuggccagggcuugccguggguaaccuauuccaccggccacgggcuaccauuauggugauggugaaggggguggauaaacuggcacuuccggcaggcagcgucaucuccuacccuuuggagaaugugaguauuuuuuacauaaacuuggugcacugcaaacuuucucugucaacugauaugaaugcaaaugaguucuguguaauagcauaaacagcacccaagauuaguauuauucuguuaaauauuaucucaguauuaccuaugcaaccuuauugcaguaucuccauugaauuugcauguguuugugugugcauauguaauuucaaucucuguaucuuucuuugaacugucuuuauuaucuugcuuguuuucuuauuuaaaaagugaaccguagucuaaaccucuuuuuugaaagcaaccucucuaaaacacaauuuccuuugaaauucuuuugaaaguaguuccuuuugacaaaaaaauuacauggugguuguaaguuuacuagaacguggucaugcucuaaggaggagaguuguaagguaaggggaggcugccuccguucuuuuucuauugcuguuauaaucuacugugaccaaggcaacacauagaagggcuuugggacuuaugguuccagagggauaauagucauggugggguggagggauggugacugagcaggacgcugagggcuuacaucuucaaagcacaagcagagggagcaagcucagaagggcacaaaucuaggcucugcaaggccauuccaguggcacacuucuuccaacagggugccaaagaggaaggugagcaggaguugacagugaaauuuucuuuucuguaggagguuagggacaauaaacugcuuccguuuguucuuaggaagaagucuaguaaaacugcagcugccucagaagggcugcccugcccuucucugucuugaggccccgagaaucaccuggaaacucagaauuacaguuagagagagagagguuccucccacagucacaugaucuccacuuugggaggcauuuccacaaccagggcuccuuugauugaaaauugaagaugagcugagcauggaggcacacacuuuuaauccuagcacuugggaggcagaggcaggcagaucucugaguucgaggccagccuggucuacagagugaguuccaggacagccagggcucuguuacacaggaaaacccugucucaaaaaaaagaaagaagggcuggcgagauggcucagugguuaagaguaccgacugcucuuccgaaggucccgaguucaaaucccagcaaccacaugguggcucacaaccaucuguaacgaaaucugaugcccucuucuggaguaucugaggacagcuacaguguacuuacauauaauaaguaaauaaaucuuaaaaaaaaaaagagaacaaaaaugaaggugaggugaauuugcaacuugaaucagaaaacagguguaguaagauguucauuccucuggaucuauaguuaacaggucagucccaaagaaacuuguacaugcauuaagauugaagauguaguggaauggauagccuaguauaagcaagguuauaggucccaucccaagcacugcaaaaaaugucaacaacaaaacaugcaucaaaacuggaacuuaaaggaaaaaaauuauaagacauuacugaugggugguauuuuuguuuauauuuuaauugaaauguugauugugauuccuuaauucauuuguuacuugcaaauauguuuuauugccaaaugucugagcucuuuuucaauaauuacuguuuuaauuucugauuguguuauguuguaagacugauguguguugcugcucacuuugggaaacuucuuuugcagacucacucugcugugauccuguuuauaaguacauguggcaugcuuauagaagcacacuaugcgggcuggaagucucuucauagcucagugcuggaguacuuaccuagcuugcaggaagcccuagguccaguuccccccccccccccacggccaugaccuagaccacaaggcaaagcugagcacaaugaggaaccagugucuguguaauccuagcacuugggaagcuaaggcaggaggaguacugcaaaauugaggcuggccugggcuauguaguaaguuugaggcaguauggguggcauaagacccugucccaaagacaccccaaaacccauguauuggggcuggugagauggcucagugguuaagagcacugacuguucuaccgaagguccugaguucaaaucccagcaaccacaugguggcucacaaccauuccuaaaaagauaugacucccucuucuggugugucugaagacagcuacaguguacuuacauauaauaaauaaauaaaucuuaaaaaaaaaacccauguauuugggucauacccuuuccccguccacuucccaguccugacuucgaugaaaucgacuaccuuugauccugcacaucagugagaucacuauuuguucagcaccaggauuauuucaguuagcauaauguucucacccauguugucaaaaagaugucuccacccccaacccccauccugcccugcggcccuuggaaggcuaaaugguauuuuuuuuauuuguguauuuacuuauuuauuuucgguuuuucaacacaggguuacucuguguagcccuggcuguccuggaaccuacucuguagaccagacuggccucgaacucagaaauccuccugccucugccucccaagugcugggauuaaaagugugcgccaccacuuccuggcuaaaugguauuucuauaaauguuuuguaaauggguuuuguuuguuuguuuguuuuuuguuuuuuuuuuccaagacaggguuucucuguauagcucuggcuguccuggaacuuacuuuguagaccaagguggucucaaacucagaaaucugccugccucugccucccgaguacugggauuauaggcgugcgccaccacgcucagccgguauuucuaauauguauauaugcuacauuuucuuuuuuuuuuuucugguacugggguagaaccuaggauggcuuguacaccaggcaaguacugucccauugaccaauacccccagcccuaggacauuuucuuuauccccauuuuuagaaagauacuuuguuugcuuucauaucuuugcuuuuaugacuagugcugcagugagcaugggggcauaguagaugucuucaguguacugauugcucuuacccuuauauaugcacccagugguccagagagaugguuugcggcuuaagagcauuaccugcuccugcagaccgcuggucucaguucucccagcucucauauccagccucuaacuccaguuccagaugauccuguacccucuucuggcuuugucaggcacacacacagcugcauaaaauuuuaauaaaauaauaaacccuuagcuaugucccuagaaguagcacuacuggagcaugcuuuagugguguaauguacugaacgauggugauaauaauuaacuucugccuugguuucuuuccuauugcugugauaaacaucaugaccaaaagcaacuuggagaggagcggguuugugcuagcuuguagcucacaauccaucaugaagugagaucgaggcagggacucggagaagaaaccuuaaggcaggaacugaagcagagacuggacgagcacugcuuacaggcugccucuccauggcuguucagcuuggcuuuuuauacaacccaagcucuccaggugguggcgcucgccuuuaaucccagcacuugggaggcagaggcaggcggauuucagaguucaaggccagccuggucuacagagugaguuccaggacagccagggcuacacagaguaaaccuugucucgaaaaaccaaaaagaaacaaaaaaagccuacccaagcuuaccuguccgggggugcuacugcagugggcugggccccggcccucacgugaauccuuaaucauugccccacagacaugccuauaggccgaucugaugguggcacuuuuuuucucuuaauugaaguucccucuucccagaugacaauggcuuguaucaaaucgccagaacgcuaaccagcauaaacauguuguacauuuuuauuuuuuuagcugucuuaagacacuccagaagagagagucaguucucauuauggaugguugugagccaccaugugguugcugggauuugaacuuaggaccuucggaagagcagucgggugcucuuaccugcugagccaucucaccagccccauauuguacauuuuaaauugucuguuagauuuuaaauauuuucaccacacaaaacagaaaucucaucauuucucucauaaaccagaggagcaagaaaagaaauaaaguaugauuguauaguauaaggcuaggcagcagaaaugaauaacauagaccuaagaaugaauggucacugguuuacugcaaacuccucaaaauucucauguaacucuuggagguguguggaggggacagagugcacgcuguggucggugacauggugaagucuucauuugugcuaauggauagugccuacuuaccaagacauaucaugaaaauguuuuauuuagaaagguggugauagcugggugugguggcgcaauccuuuaaucccagcauuuaggaggcaagaggcaggcggauuucugaguuugaggccagccuggucuacaaagugaguuccaggacagccagggcuacacagagaaauacugucuugaaaaaacaaaaaacaacaacaacaaaaaaaccaacaacaaaaaagaaagguggugauaaaaaggcagauucaccaggacaauuucugucauuuauuaugugauuacuaugaaaaucaccauguauuucauuaaugcauaucuauugcauuuauguacaaauauauaaaaccuagagcaccauuuaaaauuuauuagcauagaaacccaaauuugauuuuugagacagggucuuuuuuuuaauauuuauuuauuauauguaaguacacuguagcugucuucagacacagaagagggcaucagaucucauuacggaugguugugagccaccaugugguugcugggauuugaacucaggaccucuggaagagcagucaauguucuuaaccagugagccaucucuccagcccuuaagacagggucuuauuuauguagccccgguuggccuugaauucuguguuaccaagacaugccccgucaguauauguggugcuaggaauugaacccagggcuugcuucauguauaacaagcacucuaccaacuaagcccuguccaaacuaaacacuuuggaguagacuagccacacacugcaugggaagaagcuaugacaagagcucacuucauugacugacuuugaauggcugcuucugauuaucuuggaagaaaauggggaaagagauagaaggcccagggaacaauacacacacacacacacaaucuaaaggcagaaauaaccuuugaauucuacuuggcaaggcuuccuuuuguccuguuguaguuucaagugauccugauaaagaauuucuuuuuuuuuuucccuagacaggguuuuucuguauagcccuggcuguccuggaacucacuuuguagaccaggcuggccucgaacccggaaaucccccuggcucuaccuccugaguggcgggauuaaaggcgugcaccuuccuuaauuuguucacauucuugaacaaacaugcaaagcucucuaaaacagcgugggaaaaguuacuauguaccaaucacccaggccuuuuuuacccguugagcuuaggagucuauauaauuacuauauagacuguauaauuauuucuuuuccucccaaaucugguauuuaacuccuucauuagcuucuccagguugauuacuggggcuauacucuucagccuccaacuuuccugagccaggugaaugagguaggcaggcaaguuagugucauagguguuuccacccaagccugaggcgguguccacagaaggcaggcacuugagaggcugcugacaacaagcuuuugugaacuugguugcucuucccccucucguucuugugaccucauuuuggaaguuugggaagaguuuauaugcauguugaguaagaggaaagcaucgugucuguuccagucauggaauccugaaagugaugagcuucauuuggauaccaguauucugucaauaagcuuucuauacuucccugcauuucugccuggaccacauuggcauucauuugcugcuuuuugacaguagccuuuaugugguacuggaaguacuggaugaaaagucaccaagaaaucuccaguaaaacaaaaacauacuggguacaguguaauucagacacuugugaaguggaggccagggguucacauguuugaguccguaaugaagcugcauacuaaguuugaugccacuuugagcuacugcuuauuugaaaaaaaaaaaauacuccugcuuuaaacauucuuuuguagccagcuaugguaguacacaccuuuaaugccagcacucaggaggcagaggccagcagaucucugugaguucaagggcagccuagucuaccgaaugaguuucagcacagccacaauuguuccacagagaaacccugucuccaaaaaccgaaccaaacaaaccaaccaccuuuguguuugaguguauugucugcauguaugucuguguauccuugugcuugccuggugugguggaggucaagggagggcaucagauccucuggaacucugggauuagagaugguguuaaggcaucguguggguucugggaagcaaacccgaguccucuguuugaaagggcacaaagugcuuuauuuccagacucuuguuauuuuaauacucuaauauaaaaaguacaauaguuuuugagagaauuuuuuuuguaaucuauuuuuuuaauaguacagaacaaaacaaacccagcauagcauagaagugcaaauuuuggucacaccugaggguagggguggacaacuuugugggcacugcugguguucuugucuuaaucuaguuggauuaggagagugcacccacuuguacggcaggguuuguguacuguauuguacguaugcugcacuuuaauaaauuccaggggauagagaaauggcucagcaaugaagagcauugacugcuuuugcagaggaccuggcuuugauugcuagcaccacauggcagccagcucacaaccauucuguaaucuagagccaacacccucuucuggucuccagaaccuggcuuacacccuaucuuaucuaagggacuuaacucuaucugaaaagcacccguaaagauuguuagagcauuauaugaggccugcuucucuuuuguugaaauucaguaucucagauuuccucaagcucucucuuucaauggaagcagauaaaauuacagugacauauauguucaauugauauuacagcccaaauguauugcuguguaaaauacacaaagcuaagcauacauaccuauaauauauaccuauaaauaaauauauauauaagauuauacauacauacacacacauaugcacacacauauauaauacacacaauacauacacacacauauauuauacauacacacucacacacauacauauauauaauauuauacauacacacacuuacauacacauauguauauauaauauuauacauacacacacacucacacacauauauaauauuauacauauacacacagauaauccuagaacuugcaaguagagguacgaggaccaggauuucaaaaccccucacuccaaaaauacacaaauaaacaacaaaacuaguuuguguuuaauaguguccuaucuuuauguuugcaaauuauuucucauuuaggcacugggagauagacuuagcccacuaaggagcucuugaaucuccugugccuucaaagggacucuguguggaaaagauuugagucuucuaaguuuccaucaaaagugcuggugugauuuguuuauuuguuuguuuguguggaggguuuuuuguuuguuuguuuguuuuuuguuuuuucgagacaggguuucucuguguagccuuggcuguccuggaacucacucuguagaccaggcuggccucaaacucagaaaucugccugccucugccucccaagugcugggauuaaaggcaugcgccaccaccgcccaacacguggagggguuuuuuguuuuuguuuuuguuuuugaaagaaaaaacaacaagguuggguaggauauuauaugaaaaaauaccacaaaaaaauccugguaaauguuauguggaaccauaaagaagauugaaaaagcaugucauuugcaggggaaauuuuaauagaacaugaagcaguaauguuaggugaaaaaaaaaacccagaaucugaaagucaauauuacauguuuuuuaucauguagaaaccagaauccaacaggaaaagagacaaccgaaaaauaauagagggcguagagaaaagccuggggaaggaagagugaugggagagugaaggaugguagaagaggcccccauguucaaagcacauggcaaccugggcaucagagugaagccuguaauacgcacaguugauauauagcaagaauaauguaaagaguuguccucauaggugccuuccugaggcugcuugcuuauacaagcuggguuauuuuucuuuccacuuuguuucaaaaaauaauugcaguuuuacucuugcauuucaggcaguuccuuuuagucuagacagcguugcaaauuccauucacuccuuauuuucggaggaaacaccuguaguuuugcaguuggcucccagcgaggagguaagugacaaaguucuuaucuaagagccuuauaaagaacuguuauuuagugauaguuuuaaagugauugugugagaacugcgauguacuuugucugucuguuggacuuaaucugcagaaggcagcuaaccuagcacucuugacucuccuugcagagaguguauaugguggggaaagcaaacucgguguuugaagaccuuucagucacauugcggcagcuccguaaccgccuguuucaagaaaacucccuucucaacucucuuccccucaauucucugaguaggaauaaugagguaagugguucauuuguugagugaaucaaguaaaugucauuauuaaauucccauuccauaugcuacuugaaaccuuagcaagacagaaguuguagagaaugaagaauugggcucacuuacugcuggggcacgcucuuucuucuguuggggcaggguucaugacuaaacgcaccuuuucugaagugccauuuaguaaaucauuuuccuaccaguguugccaguugauccagacaggucacaaaccagucuucuuggagguugguugagcuaugaagaucuggugacucgaugucauuauucacagcuguugcuaauguggacucacaguuuuugcaucauguucucagggugcugcaguagagugacacuccugcuuuguucauuuggguuuuggaguugguuuuuuguuuguuuguuugguugguuggguuuuuuuuuuuuuuuuggagcuacacuuacuauuuaguaccggcuggcuuggaacuauagauggggcugaccucagacucacagagaugugccugcuuccuuuucuuggguacugcaugcaccaccaugccugccagccaucccugcuuggaucucuugcccuuuauagcuauuguggguagcuaggaaccauucuuccuaauucucugcuuugggaaguguucaaggcaaguaaguaaacugguccacugguaggaucuuaagacaguggggucaaugcucaggcauggcuucguuagaaguaagagcuaucaagugguagucacuaguauuuauuagggagugaccaucaccuuuuugguaggaaauaaugguucaugugcgugcuuuucugauaaugggccuugagccuugcaaauaauaagcauuucucuaccacagagcugccucguuucaauuagagugaaccuacaaggggaggaaaauaauauacauuuaccugauuaguauucagacuauguuguacuuuccuugauaagugaaguccagaucucugcuguguauuuaaagccauguccacucuuuggucucugaagguugaccugcucuuucucuccgaacugcaagugcuacaugauauuuccaguuugguaaguaggcugcuuggacuuugaaguccuaucuguuuugguuccuagaaaucuuuaaauaaaaugaggccaguugaaaagcuuaaguaugccccacauuuaugaucccaggaacacugagaaaaaaaaaucuaucugcaaguuaucuuguaguaagugguuuuuaaaaucauccucaugacugaaauagaucuucuuacuugccugcuagcuucugaaguucuuugccaaaccuuuuuaucugggcuggguucaaggaguuugaaagcuuagugcugggggcuaaggugguacucuggguggggaugcuggaggaagacacugaugguuccugaauuccucacaccauauccauccaaguaguuacugcuucaugcauugucucacaucuaaguuuuuaaaacuaagcaaugagauuuguguugaauuuaucagaaacccauuuaagggagcucucuuugcugccauuuugaacuguuuuugugcuauagugcaguggugugcuucuguggccagcuaacguagucagguauaaaacuugacuugguugcauuugacaucgccuuuguucauuuguucuauuuguuugucugaaguugucucgucauaagcaucuagccaaggaccauucacccgacuuguauucauuggagcuggcagguuuggaugaacuugggaagcguuauggggaagacucugaacaguucagggaugcuucuaagauccuuguugaugcucuccaaaagguaaauagcaaugcuaccuguaagagaggguggcaugugaccauuucagucucuugauggagaaaucuuuugaggaauguuguugguuaaagccuuuucuuuuuuccucugugcaaggguggaacucugggucucucacacacuaggcaagcagucacuccagcacugagccaacucaguucaacugaaagauuacuugauucuuugaagguucucuaauucuuaugucuaauaauaguguagugcuaggguuggggauauagcucagugucagaguguuuaccuagcaugugugaggcccuaaguucaauucccaggaacacgaccagaacaaguaaagaaugguauagggucagagguggauuuggggagguaugguggcauaggucucuaauaccagcacuggcaaggggaagacaggaaggaggaucacaaguuugagacuugucugggcuacaugguaagacccugucucaaaagaccaacaucaaccaauccucagguuuacaaaaguguguguuuggaaucucucuccaaugcuggcaguggcagcacugugccuuuguagauccugacaguauguauaaccuacagcaaaccauuugaaccguuucuagguuugccucauugguggugguacauauacuaagugcagaaccaucuccacugucugucugcagaguguuuucaucaccccgucggaaacucacacaaagcgcacuagcgcaguagccuucgggcgguugauguguaauaaguggggguuuacuagucauggaaaggaaagcucuucacugaggccucauugcuaaaccucugugagggccaugauuaacagagaacacugaagcacauuuccucaguucuccuuucugcuuucuacccuagcuuuauaugccaucaacuucaaucccucauuuauuuaaauguuugaauguauauuaaggcuuaacucuuuacugaauauuuuguuugguucuuuuuguuuuuguuuugucuuuuuuuguuuugauuuucaagacaggguuucucuguauagcccugcuuguccuggaacucacuuuguagaccaggcuggccucgaacucagaaauccaccugccucugccucccaagugcugggauuaaaagcaugugucaccacugccuggcucuuuacugaauauuuuaacauaagcaaaccuguaaggcuuuuuccuaucugagacacugcauauuaaagcuuaaacauauuugugcuaauaugcauuaauauuguauaauauguaauuuguaaagcuacaaaugauuuuaacaaauauggauuucuuuagauacaaaaauaaucaguaugaaagguaguguuaauuugcuaauuuauccauuccacaauguauauauuuuuugaaacaauacuguguauaugacauuuauauccauucuuuuuuucuucuuucuuuuuuguuuuuauauccauaauucuugucuuugguucauaaucaauauaguauaacaacuauccacauaguauuucaauaauguuaagugauauauauuuucuagagaugauuuaggauauacaggaugcugagcauagguucuaugcaaauacuaugccauuucauguaagaguauauaguucagacucuguagaaaguucuagaacccugugaauaccaagggacaguuuuacagaauuguuaaccaaagauacaaauguaaacaaaguguauguauuuugccacuagucauaauguuaaagaagugacuuucaguuugcagaugacauguacagucucuauggugggaacgcagugguagaguuagugacugucaaaucauucgacacaucccuugugaggaagucaaggaccauccuugaggcaaaacaagaggugaguaacuuuuuggauccugcuuuaaugcaugaaguuagcuuacuuuaaagaagaaaagccugggcugcuagcaaaauggcuagcagugaguaaagauacugugagauaacagugaguaaagauacuggcuguaugccuggcaaucuggguucgauucucagggcccacaugguagaagaggggacaaagggacccuugaacuuuguccucugaccuccagacccacacacuugcauacauauacaccuaaaauaaauaagauguaauuaagaaauucgaaaucuugaagcugagggugaugguguaggccugugauccuagcauuugggagguaaagacaggcagcccaggaauugaagauuaugcuugacgacauaauaauuuugaagucagccuggccuguaugagaaccugucucaguaacccccuacagaaaaaaaaaacgcagaaacuguuggucugugagggaaagaagaccuuucagugcguuuaagagaauuacuguuaaggaagcagcagaaguuaaugagagggggugggugccugucucagccucuagauucugcuuuucuuuuuuuuuuuuccauuuuuuauuagguauuuagcucauuuacauuuccaaugcuaucccaaaagucccccauacccacccacccccacuccccuacccacccacuccccuuuuuuggcccugguguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauauauauauauauguaucugccuucuacuucauagcaggagcaaaauuacaguacccucacaacacaaggaacuauaugaacgguugcagcauuagaaagggugagacccacugacauagagggucagagagaagcuuguugcccaugguaaaauguguguaggugcauuguuucaaacacaaagucucagcacauuugaccaugaagggaaagugcugcagcugucacuagacuggucugacaguucacaccuguaaucccagcaucugggaguccagagcaggaagauggaggacuuaaaggcuauccucacuuacaggguggguucauagcuaaccugggcuggguuacaugagacuuugucuaagaaaaacaaaaauuacuuaugggcccauuuacaggguccuccaugcucagucugaaggauuagcaugagaguauagcuauguauagccagugcugauuuaaggcagucuagagaugacuggcuggauauuguugccuuccagguccaagugagauggaagaguaucugcuuaagacugcauuucagugaggcucauaccuagaauucaaacacucagaaagcugaggcaggaggauugucuuaguuaggguuuuacugcugugaacagacaccaugaccaaggcagcucuuuauaaaggacaacauuuaauugggucuggcuuagguucagagguucagcccauuaucaucaaggugggaaccuggcagcaucuaggcaggcaugaugcaggaggagcugagaguucugucuuuauccaaaagcagacaggagaagacuggcucccaugugguuaggagagucucauugcccacccccacagugacacacuuccuccaacaaggcuacaccaacuccaguaaguccacaccucuuaauagugucacucccuaguccaagcauauucaaaccaccacauuccauucccugcuccccccaggccaggcuuggcccugugggaguaggaguguaacugugggugugggcuuuaaagcccucauccuaguugucuggaagucaguauucugcuagcagccuucagaugaagauguagaacucucaccuccugcaccaugccugccuggaugcugccaugucccugccuugaugaugauggauugaaccucugaacuuguaagccagccccaauuaaauguuauccuuauaaggguuuccuuggucauggugccuguucacagcaguaaaacccuaagacaaacgucaauugucccaguagucccuucuguucuugacucuaaagccagagccacauggcuaaaguugcugaguucugcugcuuucggggacuggaucauggccccuucuuauucuaguaccaucuuucugcuuuccaacucccuuauugccuaaauuuggcuguccugggacuugcucuguagauugaccuugaauuuagagaucuggcuuuugucuucugaaugcuaggauuaaaggcauguacuaccacaccuggauuuaagcuuuucuuugccuggaauuugcucuguaccacauuggccuugaacucugagaucugcuugccuuuaucuccagagauuaaaggcuuuuacugccacgcugggaccuaaacuuagcugggugggaucuugccacaaagacaccacucccucaaucuguuuaucuccuggaacacaggauuccgccccauuucacuuccuggugcccuauuuauuacuugaaccauaaauuuuauguuuccuuucucagcuugcuaugcuuguucaaaguguucuucaugagacuuaaccagagaacaaagucucugaugggcauuuuuuuuuugauacuuccuuugucaaugcaauuacuauaaaucccuuuaacuuagccucagccuuuucagaaaagggcagaaagcagccacauucuuuaccaaaguauuacaagaccagucccuuguccacauauuaaaauucuuuuccucugaaaccucuccacaguucaaaucacuuucacuaacaaagucuuccauauuccuacuaggaugacccauuaagccccacuuaaagcauuccacugcuuuccaaauccaaagucccaaauuccacauucuuccaaacaaaagcauggucaggccuaucacagcaauacacaagucccugguaccaccuucuaucauaguuaugguucuacugcugugaagagaaaccauaaccaaggcaacucuuauaaaggacaucaucucauuggggcuggcuuccagguucagcccaucaucaucaaggcggaaacauggcagugucuagguagaugugaggcuggaggagcuaagaguucuaugucuucauccaaaggcagacaggacacgacuggcucccaugugguuaggagcagggucucauugcccacccccacagugacacacuuccuucaaaaaggcuacuccaaauaauagugguacucccugggccaagcauauucaaauuaucacaagguuuggugucaauucaaggccagguucagcuacauagcaacacuuagccacagcuaaguccuggaguucuuucuuucuucuccucaguuuccacuauucaacuucuagaaguucuagauaaaaaauaaaguuucaaaugcauagcucagcucucaaauaaggcaguccuacaaaguaaagagggggaaucuguaguuagcagucugccaguugggugugccaagaggcaucgacucugugagauuggaacuaacacuuccuuauaaagucagggaggcagaaacagcugcaccugcaguaaaggggaauccugauaguaucuuaguuaggguuuuacugcugugaagagacacaugaccaaggcaagucuuauaaaggacaacauuuaauuggggcuggcuuauagguucagagguucaguccauuaucaucaaggugagagcauggcagcauccaggcaggcauggugcaggaggagcugugcguucugcaucuugaacugacugcagccaggagaaaagugacucuucugcacugggcagagcuucuaagccuauccuucggugacacacuuccuccuacaaggccacaccucuacacguaccacuccuuauaggccaaacauguucaaauuaccaaauuguuugccaaccagccaaaggaaacagaaagacacucagugguccgccucugcacugggagcaggacuuauuuccugggaccuuuuuaaucacagggauuucuuuauguggauuugaggguuaacuguauauugccuaggaagccuccaauugagaaguuaacauaaaaucugcucccaguccaauggcagcucucugguauugagcuaaaguaaauguaaaaccucgguuaguccuugccaucaguacacagggcagagagacccccacagcuagcccucccaaauacaaacucaaaaaaguauaaaacaugggcccggcuaauugaccaagaaacagaacaucaaauaacauacgggcauaacagauaagacuuagaauugauuagcaagauuguauguaucugggccugaaacauuccuuggaauaucauuuuagugugauugggcaccuaccaucagcgccaucacccccuacauucacaguauccuuagcuguguacuaggauggccuacuucacagaggacaagagacuccccugugaggugucuucugaguacgugauggucucagauuagacuguauguagucaagacugaaaaauucugugcaauacauauacacucagaaugcacauuuugaaauggaaccgaaucagcaaauaaauccaagagagagggacuuaauggaaguccuuuguaucagcuuugagcuccccacaggaaggcgcacacaguugugggcccaucgucuccucucugucuuccaguugaaauuagucucuucuguuacuuuaagcuguggugagaguuuaaggaauuaagccaggcaugagagcacacaucugcaaucccagaauuccggagguggaggcaggaggauuguuaaacgcaggcuaggcaaggcugaauagcaagucaaccaucucaagcaaaaagacuuugcauauguggaacacuugccaagucuccacaggcucucgauuucucuccauuuguuccuuagcacaggcaaauuaaagcagcaacagcaacuucaagaccuggguguuggguaugcccagaaugccuccugcugcaaugcaggaggaauacugccagacacccuugccucauggcuccuaccuugucuuucuauguuccagguggcccuuuccaagucaucugcugcacugucaccaguuagcuuugucuuuguuuugagacagggucucacuauguagccauggcuauccuggaguucccuauguagaccaggaugcccugaucugccugucucugccuccgcugcagccacugccaccuuuguuuauaaggcaaaucugauuguaucccuuacucucugccugaaaucagucaguggugucucccugcauauaggcucaaguccagauucuccauagcuucccuaguuuuagccuccucuccugccaucguccuacuuuugaaauuuucuagccagagugaaugacagacguguuccaaaugaucucuuucccaagaauaaauuuagcuuuucggacaguguacacaagggacugaucccugcccccaggucugacacguguaccaccucagcauggaaaaaaaggcagcugcaacaucacauuuuccacucuuaaguagcuaaucuauaauauaacugaagguaaauauaauacucuaucgggagagaaggcuugcucgugaucuuaucccucugcaaguuuucucuugccuuugacccuuucuaaaaaaaugaugcuggagacgaaaccagacauucgggcauuguaggcaagccucuagcacugagccacccccuaccucgcugucuccgguauccugggaagcgguccuuuuuuuuauaauuggaauguauauguauuuauucuuauucauguucucucuuucucucucucccuauccccccccccccaaugcuggcccuauaaagucuuuuuuuuuuucuuuuuuugagacagaguuucucugugcagcccuggcuguccuagaacucacucuguagaccaggcuggccucgaacucagaaauccgccugccucugccucccaagugcugggacuaaaggcgugcgccaccacugcccggcacuauaaagucuuaaguggugguucauuugucccagguuuguauaaauggaaccaaccugcaugcaugcuuacauguucuuugcucaguguuauuuaaaaaaaaaauaucacuggaggccaggcagugguggugaacaucuuuaaucccaccacuugggaggcagaggcaagccugauuuacagccuggucuacagagugaguucuagcgcagccaggggauacacagagaaacccugucucaaaaaccgaaacaaacaaugucaguggugcugcgucaucuuccugcucuguguccuacugucugaacaggccccaguuguccauuguguuaaagacagucuugugcacgucucuugguucacauagagaugguuguguucagggcuaggcuucuagaucacaggaucugcaaaccuucaauugcauugguuaccacagaaaauccucacaaaguuggacuuucuucuuuuaguaccgguaccgguaccagugucuucuccaggaagcugccgguuccuggcuccucugcagguagauaggcagcuauuauuccacuuaugaaguccuaaguaucuguuagauagcaaaucauagacauuuaaucagaacgauguuuuaaucuuaaaguucuuuccuauuuauauuuuuuuccuuuccucauuuguagaacacccaaagucccuauaaccuugcauauaaguauaauuuggaguauucagugguuuucaacuugguacuguggauuaugaucggcuuggccuuggcugugauaaucaccucuuacaacauuuggaauauggauccuggauaugauagcaucaucuauaggaugacaaaucagaagauucgaauagauugaauuuuccuuaugcuagacuuagacaacagguuugguaauuggcuguuuuguuaaaguauaucuuuuaguguuguuuaaaguagacgguauaccuuaaguuuauuaaaaagaaaacauagauuucauuaucuauuuugugugugccuauuguuucuuuagagugauuuauaguguugacaaguugaauugugauauagauucaaugugcucaaauauuguugacauagccauuuaauaauguaauuucauuccauuuaauacauguggaaauacgcacugagagaacuguaaaccacuuagucauguuacucgcgcuggagaacgcacuggguuucuuagagaaccuuaaaaugcuugacuucuugcacaggcuacguagugcagcuguuagucacuaugaacuauuuguaaaugucuugaucugcuguaaauaucucugagacaggaggaaauauguuaacuaagagcagcccaaaaauacuggauaugcuuauccaaucgcuuaguucuggacguguauaugacuagcaagcuagcuguuuuuaaucucuucugcaaguuuggugauccgugugguuuaguagagauauuaaaauuauuaaaaauacuauguugauuucagaagagacuagcuuuguggaauauagaugcuuguaauuagguacauaaaaacaaaucugugggggauaucuugaagcaugaauauaaaauauuuuuauuucuguacuuucccccugugaaguuacucuugguuugugugugguauggcuucaaucuguagacuauuauauggaaguggaugauugcuacuguucaugugcaaauggaccaauaucuauauagaaugacaaauaaagauaaugauucaaaaucugugucacugcaauucugaauuuauauuauaaaaaccuaauuaaacaggguguuauuucaccaggacuggcugguuuauuauacaaagggugaauucacauuguuuucuacauuugcuuauucucauugccuccuaagacuuuguaccaauguaaggaaaguauuuuaauugcuauuccuguuacugaacuugugcauaauaaauuuacacuugacuguguaggaaagguuuaaauuuuccuguagccuuuuaaaagaugaacaaacacuugguuagaaaauaaagggcuuucuaaggugaggaau

SEQ ID NO: 9398 - RNA, 5037 nt, Mus musculus
ucagaauaaccaugugcauggacagccauauacaggcccagcagcacaucacaugaacaacccucagagaacuggccaacgagcacaagaaaauuaugaaggcggugaagaaguguccccuccucagaccaaggaucagugaaaugcacauauuaacugguuccaucaagacugugcacccaggccuuacaguccaacuuuuuucugugucuggcuaauauuucaaacuagaaaaacuauuccuaaucaacauggaguggagaguuuauucauugucuuaucugcagaaauuugcugucaauauauaacccgccugcaguggaaaguguauaguguuuuguaauaaauggccugaugcuaauguguaaauggcaaagguguauauaguauauuaauguuugacuguuaauucuuaagcaagaauuuuuuuuucuucaugagacucacagaucuacaaaacuacauuaauuuucuuguuauaccuacugcucucugcagccaguguugccuaccuuguggcaguuggaucaccuccuuuacaaaaacaaaaaguaaaucaacaucaacaaaacagcccauucauucaugucacaccaauaguuuccuguucauuguuugccacuuggagucaauuuuacuaugagcaauguaaggcugauuaccuuugauuuauuugauugauguggaaaauuggugauguacuauguuucuagucuuucucauugccuuuuuauucugauguuagguuaaucacuuugaagcuauagauaugcuguaacauuuagcauggcuucacacaaguuaguguagccagugaagaaauauuaccauaaugacugcaguuguccugacaugacaccugcauugcucggagcuuuccuucuuaaacccuagauuauaaaauacagacugagggagaacuguggcaaggaagcgguucucaguuacacgcguguucuucucauguuugacagugugaucucuggguagaauaaagaacacuuaaacuuaucgacuugguaaugggaauuuugaaagauuuaaaacaaauacacaaaaauuugcuaugccaguaugcuggcuggagccuaguagacuguauuugaugugcuuguuucguucuuugcuagagcuuacuaagugacucuuuuucaaacuguccuuccuucugcuggaucccagugcuguggaaguccucagaaucccacagucuuuggaguaccucugcaccaaggucucuggcugauucucugcucagucauaauuuuacuugaaagcaaaaauuguccaagcuccuuuuccauuccaaaaauuuuaacauucaaagcagggucuaauuuaagaaauuacugguaguuaauacaauuaaggaauuaaauuuuagaauaaacaauuugaauaaagauaaaggaaucaguuaaagcuguguuucaaagaaaauuggugauuugaauauguguaauuuuuuuggaaccugucuaaaaccaaauaccccugcaaacagauaaaaccuacccuauuuaaauauuuugcuguuuuauuuuauagaaauuauuuugcugaauuugcaaauagaauuugauuuaagaagaacuuuuuguccugugguauguuuggggguuuugauaaccuucucugucugccugucucucuuuuuuugaggacugcauauuucuggaaagcugauuucuaugcauagcauguguagacauaaccagcaaugaagauuuuagucucauuaaguuuuugugcacagaaagaugggggucuuuggcucuuuacuaaagacuuggagaaccggauguugaugcuguaaaaguucccuaacaaucaaucuuguacuuuuuguauguuuuuauauacauguguauuuaaugagcacaagcuugguuguauuuuuuacgauucaguugauaggaaaauguuuuaaggcuauaguuggcauugaucaaagcagaagcaaaauugagcauuguuauuuugugauuuaaaaggggcaguauuuaagauaaagguuuagguaucuuauuugcaguauuccacaguucugcuucuagacuuccuguaauuuuagcgaccuuugacagcagauucuguuuacaucagaauuugcuuuuguuucgguuuuuuggagccuggggauccagaaccugaaguacuccaggcgagcgcucuaccauugagcugcgccuccagccugaauugaaguuugagcaaaguacaguguuugcaacuccaacuggaaguuuuuuaaaguucuucaaguaguaaaguagguuagcuuuguuuggaugaguaacugguacuaguuauguuaucuuaccaucugacaugcgacuuugguauuuucugcuucuuaaggaaauuaugaaauauguaaaacuuagugacuuccuagguaagaagaaaacuugacauuuucaaaggcugugaauuuuucuuggagggauucuacccccggcccccaguaguugcuuuaaguguauaagcccaccaguuccagaugauaggggauuauggagucaugguuccccucauuugaggaagagugggccuguguugugaccaggagugagggaaggugaacagaguuauuuuuguuuguuugugcaaauuauuuucuauauuaacucuuuaagcauuaauguauaaccggaaauuuuaagaugcauguuauuguaagcgcaacauaguggugauuuugaggucuuucucuaaaacauaaguggcacauuuuaaauuucaagucuuaaagugccugaaaguuauuugauucucucaacuaauuucuuuugagccauauguuuccuccuuuaaauguuuguugcagaaucacuagucuucguuugaaguacucccacauuucuaaauggcaugauugcucuauugaagacaguagaaucuguuaacguaagacugaagagauuuuauugugcaacuguguaaacuggggcuuugcccagucggaucuaaguauuuuuguguacaacuugguaaacaccauauugcugcuguuucuaaacccuccaccuaccgaauucucauguucagcaucgcagaggcagaaauacaagcauaaucauauaugggcuuuguuucuuuucauugauuuuucuuagugaugauuucccagccuuuuuuuuuuuuuugucucuuagcuauaauuauacagaccuagaauuauucaaauguuuucuauuuucaugauuaacuuuuauuaguggacaauaacaacuuaagucuuuaauccucauauugguuaaaaacaugaggagccuuuuuuauuugaauuacuuuuguaaaagaaagcaacagucugaauauucaggugacuacuuuggcauaguucggguuuuuauuaguauuuuuccagguuauguuuucccaugaacuauuuuacuuuguuaauuuugugcuuaauuugguggcuauauccugccuuauuuagaauuuuagaaaauugccuuuuugcgauaagugcccaguuuuuauuucuaguuugaagguacgaggacauacagacugcugauaaaagaaaccagcaccccuuugccccagcuuauguguuaccaacaaaaccauucucaguacugguuucauuguagggcccaaccagaauugguccugcaucuacaugaguguugcauauuugaaaaggguuugggugugauaaaucacuacagaagugcugaauguauuaagaccucgcugccgauuguauuucuaacgauuauuuuguguuugcagaaguauguagcacuuguccuccaagcuuucagguguaagggggaaaggugaaccacauuuuaaagucacuaaugagugcaauuuuuuuuuuuuuuggaauugggguucccaaaaggaaauuucaccgcccaaaucucacauacuucuuagccuuuuacaagccaacagauugacauaaagauuguccgcaguucguaagaucuagcacauauacaaaaauaaaacuuuauaaauuaaauuuggguuuuucuuucauuuauuaacauaggguuuuccccuauaucgguaggguuggcaugccuauauugcuaggguuggcaugcagggcaucgaauggauuuggcaagugccaugucacucagccacuuuuggcccuugaauuuuuuaagggacauguuuuuaauaggucguuuacuuugguucuugauuuuaaaucugaaaagucccuguuuugagggguuauuaaugugaauuuuucacuuuagcgugucaucugaaaugcugaaauuccuuuucaguguccgaaaaguacauuuggcuucugcagcagagccuguugaugcuucccuacggaauacugcuaaagaaaggcaucccacauagcccucacauuuacuuauguuuacugaaacagccaaccucuguagcucaagcuggucuggaauucacuguaaucagggugaccucaaacugaccuuuugucacagccucccaaaugcuagguuuacagcugauuuuccuguucauccuucuugccccacuuuuuaagcagaauaagggaaaaguguaguaguauaaacuaugugccuaugaaccuaccacuuaggaagaucaggaguucacggucaucaucuacuuaaauguaggcuaaaagcccuaccucaaaacuaaaagccaaaucaaauacgaaauucuucccuuuuugcaaacuaauuuaguggcccacuuauguuuaaauuuaagaaccaguugaguaucccuuagcuaaauaugugggacaagaagugcucaacaucagaaggcuagggaguuacuugcauauaugagaugucuugggaaugagacccuaauguagacaaagucauguggcaugcacagucugaguaguuccauauuguguuggucccuugcuuuugacuuuuagguauuuuggauugguuuuucaaagcagaguuuguguguagcccuugauuuuacuggaauucuuuagaccaggcuggccuugcacucauagagaucugccugccuuugucucccaagugcuggaauuaaaaguaugugccaccacca

SEQ ID NO: 9399 - RNA, 5037 nt, Mus musculus
uggugguggcacauacuuuuaauuccagcacuugggagacaaaggcaggcagaucucuaugagugcaaggccagccuggucuaaagaauuccaguaaaaucaagggcuacacacaaacucugcuuugaaaaaccaauccaaaauaccuaaaagucaaaagcaagggaccaacacaauauggaacuacucagacugugcaugccacaugacuuugucuacauuagggucucauucccaagacaucucauauaugcaaguaacucccuagccuucugauguugagcacuucuugucccacauauuuagcuaagggauacucaacugguucuuaaauuuaaacauaagugggccacuaaauuaguuugcaaaaagggaagaauuucguauuugauuuggcuuuuaguuuugagguagggcuuuuagccuacauuuaaguagaugaugaccgugaacuccugaucuuccuaagugguagguucauaggcacauaguuuauacuacuacacuuuucccuuauucugcuuaaaaaguggggcaagaaggaugaacaggaaaaucagcuguaaaccuagcauuugggaggcugugacaaaaggucaguuugaggucacccugauuacagugaauuccagaccagcuugagcuacagagguuggcuguuucaguaaacauaaguaaaugugagggcuaugugggaugccuuucuuuagcaguauuccguagggaagcaucaacaggcucugcugcagaagccaaauguacuuuucggacacugaaaaggaauuucagcauuucagaugacacgcuaaagugaaaaauucacauuaauaaccccucaaaacagggacuuuucagauuuaaaaucaagaaccaaaguaaacgaccuauuaaaaacaugucccuuaaaaaauucaagggccaaaaguggcugagugacauggcacuugccaaauccauucgaugcccugcaugccaacccuagcaauauaggcaugccaacccuaccgauauaggggaaaacccuauguuaauaaaugaaagaaaaacccaaauuuaauuuauaaaguuuuauuuuuguauaugugcuagaucuuacgaacugcggacaaucuuuaugucaaucuguuggcuuguaaaaggcuaagaaguaugugagauuugggcggugaaauuuccuuuugggaaccccaauuccaaaaaaaaaaaaaauugcacucauuagugacuuuaaaaugugguucaccuuucccccuuacaccugaaagcuuggaggacaagugcuacauacuucugcaaacacaaaauaaucguuagaaauacaaucggcagcgaggucuuaauacauucagcacuucuguagugauuuaucacacccaaacccuuuucaaauaugcaacacucauguagaugcaggaccaauucugguugggcccuacaaugaaaccaguacugagaaugguuuuguugguaacacauaagcuggggcaaaggggugcugguuucuuuuaucagcagucuguauguccucguaccuucaaacuagaaauaaaaacugggcacuuaucgcaaaaaggcaauuuucuaaaauucuaaauaaggcaggauauagccaccaaauuaagcacaaaauuaacaaaguaaaauaguucaugggaaaacauaaccuggaaaaauacuaauaaaaacccgaacuaugccaaaguagucaccugaauauucagacuguugcuuucuuuuacaaaaguaauucaaauaaaaaaggcuccucauguuuuuaaccaauaugaggauuaaagacuuaaguuguuauuguccacuaauaaaaguuaaucaugaaaauagaaaacauuugaauaauucuaggucuguauaauuauagcuaagagacaaaaaaaaaaaaaaggcugggaaaucaucacuaagaaaaaucaaugaaaagaaacaaagcccauauaugauuaugcuuguauuucugccucugcgaugcugaacaugagaauucgguagguggaggguuuagaaacagcagcaauaugguguuuaccaaguuguacacaaaaauacuuagauccgacugggcaaagccccaguuuacacaguugcacaauaaaaucucuucagucuuacguuaacagauucuacugucuucaauagagcaaucaugccauuuagaaaugugggaguacuucaaacgaagacuagugauucugcaacaaacauuuaaaggaggaaacauauggcucaaaagaaauuaguugagagaaucaaauaacuuucaggcacuuuaagacuugaaauuuaaaaugugccacuuauguuuuagagaaagaccucaaaaucaccacuauguugcgcuuacaauaacaugcaucuuaaaauuuccgguuauacauuaaugcuuaaagaguuaauauagaaaauaauuugcacaaacaaacaaaaauaacucuguucaccuucccucacuccuggucacaacacaggcccacucuuccucaaaugaggggaaccaugacuccauaauccccuaucaucuggaacuggugggcuuauacacuuaaagcaacuacugggggccggggguagaaucccuccaagaaaaauucacagccuuugaaaaugucaaguuuucuucuuaccuaggaagucacuaaguuuuacauauuucauaauuuccuuaagaagcagaaaauaccaaagucgcaugucagaugguaagauaacauaacuaguaccaguuacucauccaaacaaagcuaaccuacuuuacuacuugaagaacuuuaaaaaacuuccaguuggaguugcaaacacuguacuuugcucaaacuucaauucaggcuggaggcgcagcucaaugguagagcgcucgccuggaguacuucagguucuggauccccaggcuccaaaaaaccgaaacaaaagcaaauucugauguaaacagaaucugcugucaaaggucgcuaaaauuacaggaagucuagaagcagaacuguggaauacugcaaauaagauaccuaaaccuuuaucuuaaauacugccccuuuuaaaucacaaaauaacaaugcucaauuuugcuucugcuuugaucaaugccaacuauagccuuaaaacauuuuccuaucaacugaaucguaaaaaauacaaccaagcuugugcucauuaaauacacauguauauaaaaacauacaaaaaguacaagauugauuguuagggaacuuuuacagcaucaacauccgguucuccaagucuuuaguaaagagccaaagacccccaucuuucugugcacaaaaacuuaaugagacuaaaaucuucauugcugguuaugucuacacaugcuaugcauagaaaucagcuuuccagaaauaugcaguccucaaaaaaagagagacaggcagacagagaagguuaucaaaacccccaaacauaccacaggacaaaaaguucuucuuaaaucaaauucuauuugcaaauucagcaaaauaauuucuauaaaauaaaacagcaaaauauuuaaauaggguagguuuuaucuguuugcagggguauuugguuuuagacagguuccaaaaaaauuacacauauucaaaucaccaauuuucuuugaaacacagcuuuaacugauuccuuuaucuuuauucaaauuguuuauucuaaaauuuaauuccuuaauuguauuaacuaccaguaauuucuuaaauuagacccugcuuugaauguuaaaauuuuuggaauggaaaaggagcuuggacaauuuuugcuuucaaguaaaauuaugacugagcagagaaucagccagagaccuuggugcagagguacuccaaagacugugggauucugaggacuuccacagcacugggauccagcagaaggaaggacaguuugaaaaagagucacuuaguaagcucuagcaaagaacgaaacaagcacaucaaauacagucuacuaggcuccagccagcauacuggcauagcaaauuuuuguguauuuguuuuaaaucuuucaaaauucccauuaccaagucgauaaguuuaaguguucuuuauucuacccagagaucacacugucaaacaugagaagaacacgcguguaacugagaaccgcuuccuugccacaguucucccucagucuguauuuuauaaucuaggguuuaagaaggaaagcuccgagcaaugcaggugucaugucaggacaacugcagucauuaugguaauauuucuucacuggcuacacuaacuugugugaagccaugcuaaauguuacagcauaucuauagcuucaaagugauuaaccuaacaucagaauaaaaaggcaaugagaaagacuagaaacauaguacaucaccaauuuuccacaucaaucaaauaaaucaaagguaaucagccuuacauugcucauaguaaaauugacuccaaguggcaaacaaugaacaggaaacuauuggugugacaugaaugaaugggcuguuuuguugauguugauuuacuuuuuguuuuuguaaaggaggugauccaacugccacaagguaggcaacacuggcugcagagagcaguagguauaacaagaaaauuaauguaguuuuguagaucugugagucucaugaagaaaaaaaaauucuugcuuaagaauuaacagucaaacauuaauauacuauauacaccuuugccauuuacacauuagcaucaggccauuuauuacaaaacacuauacacuuuccacugcaggcggguuauauauugacagcaaauuucugcagauaagacaaugaauaaacucuccacuccauguugauuaggaauaguuuuucuaguuugaaauauuagccagacacagaaaaaaguuggacuguaaggccugggugcacagucuugauggaaccaguuaauaugugcauuucacugauccuuggucugaggaggggacacuucuucaccgccuucauaauuuucuugugcucguuggccaguucucugaggguuguucaugugaugugcugcugggccuguauauggcuguccaugcacaugguuauucuga

SEQ ID NO: 9400 - RNA, 5038 nt, Mus musculus
ucagaauaaccaugugcauggacagccauauacaggcccagcagcacaucacaugaacaacccucagagaacuggccaacgagcacaagaaaauuaugaaggcggugaagaaguguccccuccucagaccaaggaucagugaaaugcacauauuaacugguuccaucaagacugugcacccaggccuuacaguccaacuuuuuucugugucuggcuaauauuucaaacuagaaaaacuauuccuaaucaacauggaguggagaguuuauucauugucuuaucugcagaaauuugcugucaauauauaacccgccugcaguggaaaguguauaguguuuuguaauaaauggccugaugcuaauguguaaauggcaaagguguauauaguauauuaauguuugacuguuaauucuuaagcaagaauuuuuuuuucuucaugagacucacagaucuacaaaacuacauuaauuuucuuguuauaccuacugcucucugcagccaguguugccuaccuuguggcaguuggaucaccuccuuuacaaaaacaaaaaguaaaucaacaucaacaaaacagcccauucauucaugucacaccaauaguuuccuguucauuguuugccacuuggagucaauuuuacuaugagcaauguaaggcugauuaccuuugauuuauuugauugauguggaaaauuggugauguacuauguuucuagucuuucucauugccuuuuuauucugauguuagguuaaucacuuugaagcuauagauaugcuguaacauuuagcauggcuucacacaaguuaguguagccagugaagaaauauuaccauaaugacugcaguuguccugacaugacaccugcauugcucggagcuuuccuucuuaaacccuagauuauaaaauacagacugagggagaacuguggcaaggaagcgguucucaguuacacgcguguucuucucauguuugacagugugaucucuggguagaauaaagaacacuuaaacuuaucgacuugguaaugggaauuuugaaagauuuaaaacaaauacacaaaaauuugcuaugccaguaugcuggcuggagccuaguagacuguauuugaugugcuuguuucguucuuugcuagagcuuacuaagugacucuuuuucaaacuguccuuccuucugcuggaucccagugcuguggaaguccucagaaucccacagucuuuggaguaccucugcaccaaggucucuggcugauucucugcucagucauaauuuuacuugaaagcaaaaauuguccaagcuccuuuuccauuccaaaaauuuuaacauucaaagcagggucuaauuuaagaaauuacugguaguuaauacaauuaaggaauuaaauuuuagaauaaacaauuugaauaaagauaaaggaaucaguuaaagcuguguuucaaagaaaauuggugauuugaauauguguaauuuuuuuggaaccugucuaaaaccaaauaccccugcaaacagauaaaaccuacccuauuuaaauauuuugcuguuuuauuuuauagaaauuauuuugcugaauuugcaaauagaauuugauuuaagaagaacuuuuuguccugugguauguuuggggguuuugauaaccuucucugucugccugucucucuuuuuuugaggacugcauauuucuggaaagcugauuucuaugcauagcauguguagacauaaccagcaaugaagauuuuagucucauuaaguuuuugugcacagaaagaugggggucuuuggcucuuuacuaaagacuuggagaaccggauguugaugcuguaaaaguucccuaacaaucaaucuuguacuuuuuguauguuuuuauauacauguguauuuaaugagcacaagcuugguuguauuuuuuacgauucaguugauaggaaaauguuuuaaggcuauaguuggcauugaucaaagcagaagcaaaauugagcauuguuauuuugugauuuaaaaggggcaguauuuaagauaaagguuuagguaucuuauuugcaguauuccacaguucugcuucuagacuuccuguaauuuuagcgaccuuugacagcagauucuguuuacaucagaauuugcuuuuguuucgguuuuuuggagccuggggauccagaaccugaaguacuccaggcgagcgcucuaccauugagcugcgccuccagccugaauugaaguuugagcaaaguacaguguuugcaacuccaacuggaaguuuuuuaaaguucuucaaguaguaaaguagguuagcuuuguuuggaugaguaacugguacuaguuauguuaucuuaccaucugacaugcgacuuugguauuuucugcuucuuaaggaaauuaugaaauauguaaaacuuagugacuuccuagguaagaagaaaacuugacauuuucaaaggcugugaauuuuucuuggagggauucuacccccggcccccaguaguugcuuuaaguguauaagcccaccaguuccagaugauaggggauuauggagucaugguuccccucauuugaggaagagugggccuguguugugaccaggagugagggaaggugaacagaguuauuuuuguuuguuugugcaaauuauuuucuauauuaacucuuuaagcauuaauguauaaccggaaauuuuaagaugcauguuauuguaagcgcaacauaguggugauuuugaggucuuucucuaaaacauaaguggcacauuuuaaauuucaagucuuaaagugccugaaaguuauuugauucucucaacuaauuucuuuugagccauauguuuccuccuuuaaauguuuguugcagaaucacuagucuucguuugaaguacucccacauuucuaaauggcaugauugcucuauugaagacaguagaaucuguuaacguaagacugaagagauuuuauugugcaacuguguaaacuggggcuuugcccagucggaucuaaguauuuuuguguacaacuugguaaacaccauauugcugcuguuucuaaacccuccaccuaccgaauucucauguucagcaucgcagaggcagaaauacaagcauaaucauauaugggcuuuguuucuuuucauugauuuuucuuagugaugauuucccagccuuuuuuuuuuuuuuugucucuuagcuauaauuauacagaccuagaauuauucaaauguuuucuauuuucaugauuaacuuuuauuaguggacaauaacaacuuaagucuuuaauccucauauugguuaaaaacaugaggagccuuuuuuauuugaauuacuuuuguaaaagaaagcaacagucugaauauucaggugacuacuuuggcauaguucggguuuuuauuaguauuuuuccagguuauguuuucccaugaacuauuuuacuuuguuaauuuugugcuuaauuugguggcuauauccugccuuauuuagaauuuuagaaaauugccuuuuugcgauaagugcccaguuuuuauuucuaguuugaagguacgaggacauacagacugcugauaaaagaaaccagcaccccuuugccccagcuuauguguuaccaacaaaaccauucucaguacugguuucauuguagggcccaaccagaauugguccugcaucuacaugaguguugcauauuugaaaaggguuugggugugauaaaucacuacagaagugcugaauguauuaagaccucgcugccgauuguauuucuaacgauuauuuuguguuugcagaaguauguagcacuuguccuccaagcuuucagguguaagggggaaaggugaaccacauuuuaaagucacuaaugagugcaauuuuuuuuuuuuuuggaauugggguucccaaaaggaaauuucaccgcccaaaucucacauacuucuuagccuuuuacaagccaacagauugacauaaagauuguccgcaguucguaagaucuagcacauauacaaaaauaaaacuuuauaaauuaaauuuggguuuuucuuucauuuauuaacauaggguuuuccccuauaucgguaggguuggcaugccuauauugcuaggguuggcaugcagggcaucgaauggauuuggcaagugccaugucacucagccacuuuuggcccuugaauuuuuuaagggacauguuuuuaauaggucguuuacuuugguucuugauuuuaaaucugaaaagucccuguuuugagggguuauuaaugugaauuuuucacuuuagcgugucaucugaaaugcugaaauuccuuuucaguguccgaaaaguacauuuggcuucugcagcagagccuguugaugcuucccuacggaauacugcuaaagaaaggcaucccacauagcccucacauuuacuuauguuuacugaaacagccaaccucuguagcucaagcuggucuggaauucacuguaaucagggugaccucaaacugaccuuuugucacagccucccaaaugcuagguuuacagcugauuuuccuguucauccuucuugccccacuuuuuaagcagaauaagggaaaaguguaguaguauaaacuaugugccuaugaaccuaccacuuaggaagaucaggaguucacggucaucaucuacuuaaauguaggcuaaaagcccuaccucaaaacuaaaagccaaaucaaauacgaaauucuucccuuuuugcaaacuaauuuaguggcccacuuauguuuaaauuuaagaaccaguugaguaucccuuagcuaaauaugugggacaagaagugcucaacaucagaaggcuagggaguuacuugcauauaugagaugucuugggaaugagacccuaauguagacaaagucauguggcaugcacagucugaguaguuccauauuguguuggucccuugcuuuugacuuuuagguauuuuggauugguuuuucaaagcagaguuuguguguagcccuugauuuuacuggaauucuuuagaccaggcuggccuugcacucauagagaucugccugccuuugucucccaagugcuggaauuaaaaguaugugccaccacca

SEQ ID NO: 9401 - RNA, 5038 nt, Mus musculus
uggugguggcacauacuuuuaauuccagcacuugggagacaaaggcaggcagaucucuaugagugcaaggccagccuggucuaaagaauuccaguaaaaucaagggcuacacacaaacucugcuuugaaaaaccaauccaaaauaccuaaaagucaaaagcaagggaccaacacaauauggaacuacucagacugugcaugccacaugacuuugucuacauuagggucucauucccaagacaucucauauaugcaaguaacucccuagccuucugauguugagcacuucuugucccacauauuuagcuaagggauacucaacugguucuuaaauuuaaacauaagugggccacuaaauuaguuugcaaaaagggaagaauuucguauuugauuuggcuuuuaguuuugagguagggcuuuuagccuacauuuaaguagaugaugaccgugaacuccugaucuuccuaagugguagguucauaggcacauaguuuauacuacuacacuuuucccuuauucugcuuaaaaaguggggcaagaaggaugaacaggaaaaucagcuguaaaccuagcauuugggaggcugugacaaaaggucaguuugaggucacccugauuacagugaauuccagaccagcuugagcuacagagguuggcuguuucaguaaacauaaguaaaugugagggcuaugugggaugccuuucuuuagcaguauuccguagggaagcaucaacaggcucugcugcagaagccaaauguacuuuucggacacugaaaaggaauuucagcauuucagaugacacgcuaaagugaaaaauucacauuaauaaccccucaaaacagggacuuuucagauuuaaaaucaagaaccaaaguaaacgaccuauuaaaaacaugucccuuaaaaaauucaagggccaaaaguggcugagugacauggcacuugccaaauccauucgaugcccugcaugccaacccuagcaauauaggcaugccaacccuaccgauauaggggaaaacccuauguuaauaaaugaaagaaaaacccaaauuuaauuuauaaaguuuuauuuuuguauaugugcuagaucuuacgaacugcggacaaucuuuaugucaaucuguuggcuuguaaaaggcuaagaaguaugugagauuugggcggugaaauuuccuuuugggaaccccaauuccaaaaaaaaaaaaaauugcacucauuagugacuuuaaaaugugguucaccuuucccccuuacaccugaaagcuuggaggacaagugcuacauacuucugcaaacacaaaauaaucguuagaaauacaaucggcagcgaggucuuaauacauucagcacuucuguagugauuuaucacacccaaacccuuuucaaauaugcaacacucauguagaugcaggaccaauucugguugggcccuacaaugaaaccaguacugagaaugguuuuguugguaacacauaagcuggggcaaaggggugcugguuucuuuuaucagcagucuguauguccucguaccuucaaacuagaaauaaaaacugggcacuuaucgcaaaaaggcaauuuucuaaaauucuaaauaaggcaggauauagccaccaaauuaagcacaaaauuaacaaaguaaaauaguucaugggaaaacauaaccuggaaaaauacuaauaaaaacccgaacuaugccaaaguagucaccugaauauucagacuguugcuuucuuuuacaaaaguaauucaaauaaaaaaggcuccucauguuuuuaaccaauaugaggauuaaagacuuaaguuguuauuguccacuaauaaaaguuaaucaugaaaauagaaaacauuugaauaauucuaggucuguauaauuauagcuaagagacaaaaaaaaaaaaaaaggcugggaaaucaucacuaagaaaaaucaaugaaaagaaacaaagcccauauaugauuaugcuuguauuucugccucugcgaugcugaacaugagaauucgguagguggaggguuuagaaacagcagcaauaugguguuuaccaaguuguacacaaaaauacuuagauccgacugggcaaagccccaguuuacacaguugcacaauaaaaucucuucagucuuacguuaacagauucuacugucuucaauagagcaaucaugccauuuagaaaugugggaguacuucaaacgaagacuagugauucugcaacaaacauuuaaaggaggaaacauauggcucaaaagaaauuaguugagagaaucaaauaacuuucaggcacuuuaagacuugaaauuuaaaaugugccacuuauguuuuagagaaagaccucaaaaucaccacuauguugcgcuuacaauaacaugcaucuuaaaauuuccgguuauacauuaaugcuuaaagaguuaauauagaaaauaauuugcacaaacaaacaaaaauaacucuguucaccuucccucacuccuggucacaacacaggcccacucuuccucaaaugaggggaaccaugacuccauaauccccuaucaucuggaacuggugggcuuauacacuuaaagcaacuacugggggccggggguagaaucccuccaagaaaaauucacagccuuugaaaaugucaaguuuucuucuuaccuaggaagucacuaaguuuuacauauuucauaauuuccuuaagaagcagaaaauaccaaagucgcaugucagaugguaagauaacauaacuaguaccaguuacucauccaaacaaagcuaaccuacuuuacuacuugaagaacuuuaaaaaacuuccaguuggaguugcaaacacuguacuuugcucaaacuucaauucaggcuggaggcgcagcucaaugguagagcgcucgccuggaguacuucagguucuggauccccaggcuccaaaaaaccgaaacaaaagcaaauucugauguaaacagaaucugcugucaaaggucgcuaaaauuacaggaagucuagaagcagaacuguggaauacugcaaauaagauaccuaaaccuuuaucuuaaauacugccccuuuuaaaucacaaaauaacaaugcucaauuuugcuucugcuuugaucaaugccaacuauagccuuaaaacauuuuccuaucaacugaaucguaaaaaauacaaccaagcuugugcucauuaaauacacauguauauaaaaacauacaaaaaguacaagauugauuguuagggaacuuuuacagcaucaacauccgguucuccaagucuuuaguaaagagccaaagacccccaucuuucugugcacaaaaacuuaaugagacuaaaaucuucauugcugguuaugucuacacaugcuaugcauagaaaucagcuuuccagaaauaugcaguccucaaaaaaagagagacaggcagacagagaagguuaucaaaacccccaaacauaccacaggacaaaaaguucuucuuaaaucaaauucuauuugcaaauucagcaaaauaauuucuauaaaauaaaacagcaaaauauuuaaauaggguagguuuuaucuguuugcagggguauuugguuuuagacagguuccaaaaaaauuacacauauucaaaucaccaauuuucuuugaaacacagcuuuaacugauuccuuuaucuuuauucaaauuguuuauucuaaaauuuaauuccuuaauuguauuaacuaccaguaauuucuuaaauuagacccugcuuugaauguuaaaauuuuuggaauggaaaaggagcuuggacaauuuuugcuuucaaguaaaauuaugacugagcagagaaucagccagagaccuuggugcagagguacuccaaagacugugggauucugaggacuuccacagcacugggauccagcagaaggaaggacaguuugaaaaagagucacuuaguaagcucuagcaaagaacgaaacaagcacaucaaauacagucuacuaggcuccagccagcauacuggcauagcaaauuuuuguguauuuguuuuaaaucuuucaaaauucccauuaccaagucgauaaguuuaaguguucuuuauucuacccagagaucacacugucaaacaugagaagaacacgcguguaacugagaaccgcuuccuugccacaguucucccucagucuguauuuuauaaucuaggguuuaagaaggaaagcuccgagcaaugcaggugucaugucaggacaacugcagucauuaugguaauauuucuucacuggcuacacuaacuugugugaagccaugcuaaauguuacagcauaucuauagcuucaaagugauuaaccuaacaucagaauaaaaaggcaaugagaaagacuagaaacauaguacaucaccaauuuuccacaucaaucaaauaaaucaaagguaaucagccuuacauugcucauaguaaaauugacuccaaguggcaaacaaugaacaggaaacuauuggugugacaugaaugaaugggcuguuuuguugauguugauuuacuuuuuguuuuuguaaaggaggugauccaacugccacaagguaggcaacacuggcugcagagagcaguagguauaacaagaaaauuaauguaguuuuguagaucugugagucucaugaagaaaaaaaaauucuugcuuaagaauuaacagucaaacauuaauauacuauauacaccuuugccauuuacacauuagcaucaggccauuuauuacaaaacacuauacacuuuccacugcaggcggguuauauauugacagcaaauuucugcagauaagacaaugaauaaacucuccacuccauguugauuaggaauaguuuuucuaguuugaaauauuagccagacacagaaaaaaguuggacuguaaggccugggugcacagucuugauggaaccaguuaauaugugcauuucacugauccuuggucugaggaggggacacuucuucaccgccuucauaauuuucuugugcucguuggccaguucucugaggguuguucaugugaugugcugcugggccuguauauggcuguccaugcacaugguuauucuga

SEQ ID NO: 9402 - RNA, 764 nt, Mus musculus
gcucauuucacuuuuuuuuuuuuuccaucaccaaagagauuuuauucaaguuucuaacacaaaugaguuauuuugguuugaauuacagaacuaaguccaaacugaaaacaaaguuucugguuuuuuuguuuguuuguuugcuuguauuuucaagacacgguuucucuguguaauggagcccugggugcuuuggaauugcucuguagaccaggcuggccuugaacucacagagauccaccugccuccaccucuugagugcugggaugaaaggggugcaccaccacgccugucucccuugccagucuuuaaggucuaccaggccaggcccuucgcggccuuugcucugcuuuucccucguuucuuuucucucuuggccuucagucuuuuucuuugccucugguucauccacacuggguacuggccaugcuggucuagaagagucuuucuguuucucuuaauuucaguuuccauuuucaugucauccuuuuccucaucugcgccgucacaccgcccuuccucacacugcauuuucuccuggcgagguuuggcuaccaccacgguugcuaucuccucaacgucuuucauuagagcauccccguccacucugaggauacucuucagucuguugagcucccuuggcgcauucuucuuucucuucucggcccgcaucuuccucuuccacuuacuccacaggcuuuuagccaugcuucaccugagagacaacaccgcgcaccacgcgugggacgccaaccggaagucucauu

SEQ ID NO: 9403 - RNA, 13564 nt, Mus musculus
cucaggcaagagcacaacuuuauuuucaccucuaaaaguaaaccacaauugacaacaacaaaggagacugugcaguucaacuuuuuauuuuaauaaaaccagaauaugcacagcacaugcagugcuagcaucuaaacuaauacaauaagcaacuacuaaagcuacagugacuugagggucaaucuuuacauucagcaaguuuaaacccauucuuaauuuugaaacauaacugaaaauauugcuugcugauaaaacuugcucaaaugcuauugcugaauguacaagucacugaauaugccaauacaacaaagauaaccacauguuugaggauugcaaugugccagacauucacugaaaaaaaaauacaacuaaacaaaacucacacaacaaacaucugagaaucuggacacuuuguaucaguguuuugaaguguuucguuaauaucucaagacaaguguaucaaaaccuuggcaugauuuaguuucaagucgccaauuuuguuuuuacuaacaucagaaaguuauggcuacaccgccaaugccgggucugcuuaauuugacuuaagaguuuauuaugacuuaacauuaaaagcucacacuaccccgaaauauauaauuucacgcauacggugacauucaacauucaagugccaguguuuuuguacugucuuuuggucaaguuucuuuaaacuuucaaagaaucacuuuuaggcuuacaaaaauaaauauuugucaaaauguucaauaaauauuacauaaaacuagcagcaaaaaguaucuagaaaucugucgugugcaaaguuuucuucccaacuaucauucccauggucccaaauaaauuuuagaaucuagucccaucccuuuccuagacaagcugcguucaacaaucuccaagagacaaaauaagauuggaaguuuaaggacacgcacacaagacauauauauaaaauucucugaaugugcaauaaaagaaguacuuuguaaaaaguuaugggcaaaauguacaagggccuaaaccuagacuaauugaaauagcaccauaacaaaugaccucaauacugucaagugcaccuacuuaauaaaaguuuuagaacaaggcacaauacacuugaaaaucuauugcacuuuaggaaauuuuugccaucuuccuaugccacuguaaaaagauugaacauuuugaucacugcauucuggucacaaaauuaacccagaauucccaguggcauaggcauuuuagugguggacaaugcucaucuuuggccagauuuagcauaaacagacuauaaauacaauggaaaccuaugcaacuaaaacugacuaaacugcacuguagagcagaauugacaccuugugcaguuauguacauauuuccaaccugugugaucucagauuucaguuuguuacucuucuggagccauuuguuuuguuuuuuuuuuuuuuacaaagucuauaguaagccaguuuaacaucucaacgcagcuugaacagaguaaugugaaucggcauuuaaaauaaagccugcugcauaauucuuccuguucauucccaucuugaccaaaaaacaucaacacuagcaugcguuauuagaccaaaaaucauccagagcccuaggugagggcuggucauugcuguggucagccauucuaccauuucaauuuuuuauggcaggcauuuaaaaagucuaaguagaugaauucuccuaaaccuauuucaaguuaucagaccuuuaaacuuucccuguaauaacaugcccacauuuggcuagcucauaguuaacgaucugccuaaacauugaaagaggaauugcuguauuuacuugcauuaacuuugagaacagugcuuugaauguaugcauguauccauacaucaccucaucaugacuggaauggcuuguuuaaagacuauuaucagguucuaaauaccuauccaggauagagugagcaaaucagaacuuuuaacuuaauacaguuugccacauuagaaacuaauuccauuaauaugcuucaagacguuuguuguuuguuuuuccccaaucugcaaguaucaaaagccuuaagacaggcuaccacuugaguuuuuccuuauauuauuuauggaugaaucgaugauuccuguuaaguuguaucacaccugugugccaagguuugauuuuagcccaaguucaguaaauuuauuuugucaaaaacaauuggaaucuugagcauuacugagccaacaggacaucaaaauaaaaaguugucuaaaguuaaaggcacaguacauuaacaaacaaaugauccucagucacaaaauuauaaaugcaguuugggauagggguaggcgggaggggcguuaauccaaacuacagcaaugaagucuucaaaccaccuucagacagggcugcugauuguuccuuucaucuuuacuugugaccuugagcucccuuaaaaaaaaaauuucaguggagaaucacagcugguaauguacugcgaguucuugaagcuacacaagguauagucuggcuaaguuacaugugguuuccauauuagcuuguuuggcagggugaccuacuacagagcaggcucaguuaccccaccagucaacccccugggaguuauaauucccuccauauccaucacuguuguaaaagccuccguagccaccuagggaaagauuaaaaaaacaaauuauuaagucaucaagauugcugcuuuuucuuucaaaaguuauguauugaacuuccacaaauggucuuauguuuaaaacaaacuaccuccaccaaauccucgacugccgccauggccaccuccaccacuucgacugcugcuugcacggcugcugcugaagcuggaacugcuggcaccgcuacucugucgguagucucuggcaccaaacccuccacuaaaucgacugcugcaagggguggaaaagucauguugguauaagcacugauaguuaccuuaaacaauacugagaaauacguucucaugccccuaacuaugcaucacguguauaccuuaccucuuagaacguccacgacugcuacccuuguagugguguucaaaagccauguucucuaaccaagaaggcacuucuuguuuugcuucaacaagaagauccaguaaauccuuugugauauuuauauuccuuucauuaaagaaugagguggcaagaccugaaacaguucacacacauacacaaaaccacacauaaauaaaaaguacuacagaaaaguagcuuagcauucuuuccuuacuagguaauaaaaaauauuacuauuagcuauucaacuaauaaauccugucugcauuguaggaauccuaauauucaagauacuauaaaucguaggcgggugugcauggauuaaacagcuucaauccagaagucuagaggcagagauagcuagauucuuuugaggucaaggccaacauggucuuaagcaaaaagcuauaaaguucuuuccugugcuaucacaauaaaacaaucaggauauccgguaacuaaacacuuaccaagguuucccacacggccuguacggccuaugcgaugcacauauucuucgauaucacuaggcaggucaaaauuaauaacaugcuucacauuugaaauauccaguccucuugcugcuaccugaaauguaacuuuuguuagagauggcccacuaaauucaaguauuuggacauaaucaacuuugaaaguaaaaaaauauacauacugcuguagccacuagaauugggcuuuuuccugagcggaacuggugaagggccucuucccuaucucucugagaacggucuccauggauacugguacaagcauauccuucaugguauaagaaauccuccagcgaaucugcccccuuuuuggucuccacaaacacuagagucagggaauccuugccugaauuugaaaauaaaguuuaucacuauuaguaaacaauacuuuucaaguauguauauagacaaauaaaauggacauaauggcauuuuaaauaggauggaaaaugauggugauacaaacauuucucacuacagagagcuaaugacuauucauuacauaaauacucauuacauaaguagucagagagcuaguuuuaccuguugcauuuagaaggucaagcagaaaugaccuuuugucuaucuccuccacccaaaccacuuuuugugugauguucucugaaguagacccaacucuuccuacagccagaaauauguacucaucuaagaaaucacgggccagcaucugaagaagaaagccauucuuuaauuuuacaguuuuauuacuuguguauauguuuaaguguagauaucaaaaggaauacaacuugaaguugguucuuucucaucaucauguagguucagguagcaagcaauuuuacucacuggaccauuuugccagccccacuauuucuggucaagugugguagcacauuccuuuaagcauagcagcaggagggucagagggcagccugaccuacauaacaaaacucugaaaacaucuacugaaaucuuuaaauuagugaaaauuacagaauaguaccuguauuuccuuaggaaaaguagcacuaaacaucauaguguggcggacaccuuuuggaggcauagugucuuguucaacuauucuucguaucugagguucaaaccccauaucuaacauccggucagcuucaucuaacaccagguaucugccaugaaaaaacauuuaguuaagauuuugagaagaaaucaaggcaauuuaguuuuaucugcuaauuuaaauaugaucaauguacuuaacaauauuuaauacaguuaguuacauuggggaaaaaaggacucuugccaagauaaaaucauccaagaucagagccaacuagcuuacuuuuuaaacuguuuucaaucuuuguguauaugcacaaguacaaggcacaauacaaucugcaagaguauguuuuccaccaugaugauggcuggggcaauagaaugugucaugccaccaggcuuggcagcaagcaccauuacuuagccaucuugcggagcacucccuuuguccucggaucuaguuacuacccuuuacuaaagcauuagcugacuuuucaacauugauugaacuaugauuauuugcauauucucaguauuuacaagguaacaaacacauacuugcagaagucuaacccgaucuucccucucuccaucauauccacuagacguccuggaguggcuacuaacaaguggcauccacguucuaagucucgaaucugcuggccaauuucagcaccaccauaaaccacgcaaggacggacucuagaucgguaugagaacuauaaacaaagaaccuccaucaaauucaaugucaagauucuuuacauggauauuaaauauuuuauuagaaucaaugggcaagcuaugcaucacugaaaugcacuuacuuuucuggcuuccucauagaucugcacugccaauucucucguuggugccaguaccaaagagauuggauacuguuuacgacggccauaucuuccauuuuccuaaauagaaauuuguuaauuaucacuuauuauaagaauuucauuucccuuugcaauuuauauauuauaccauauuaaaaaauagucuuaaucuucacaauaacucuucuuuuauaaagacuacaguggucauacagcucaaugacagagcacuugcuuaacuugcaaaagccccccaggccucauucccaacaccaaggaauauuaccuucauagcccucagagcuucuccuggaccaucagcauagaucugacucaagaugggcaagagaaaugcugcaguuuuuccagagccuguuaagagaaauauguucaucaguagaccacaauaaaacccucauuacuucuaaaucaacauauuuaguacuuuuacuuuauggccaaacuuccuagaaauuucucuuuagcugacuaaaacaagagucagcaaauuuaggaacaagguacuauuuuuaaauaaggguuaauagaauacagccauuauuuauguaucaucuauggcuucuuugacuacaaacaaugaaauucaguauugccaaauguucacuguacauaaaccccuaaauaucuaguauucauuguacauaaacccauaaauaucuaguaugugauuuuuuacuagaaaagagugacauuuaaucaaugagcuuaccuguuugagcacaagccaucaagucucuuuucucuuugauaauaggaauagcaugcuucugcacuggaguugggcgaguauaacgaguaagcucaauguuucccauaauaauuucucccaucucgacaucacugaacuaucaaauucaauggcauaaguagaaauguuaucugaagcuguuuuauauuaauuugugaaugacaacaaacagcaaaauuuuagcauaugauuacuaaguuggguuuuuacauuggaccuauuucaaaaagcaaauuacuuauaacacaaccaaugucucccuuuccacaaacucuaauguaugauuauacagaauuuaagaagagagcaaguacuuacacuuucaauguguggaggacaguuguugccuguugcuucgacuggaaugucaucauauuucucaaaguuaaucccaguauugccuccagaaaagaguucccuggaauaaauagauugguaaauucacauauaauaccaaugagaaagauuucaucacauacuuuaaaaacuuaaacuuacuguuccaaucguucacuuggugggaguggcuuugaccagucaucuucaucugauuugucacaccagcgacuauuuccaccucuuucaaauuugccaaagccacuucuaucuccacggccaccaaugccaucauagucuccccguccacgaucaucaaaccugaguaucacaaggacuaaaauuagaaucuuaaccaucaucagaucacucuaagaacuaccucagaggaauugaucaacuacaaauugugaacaguucaaaccaccagauuauaucaucuaaaaaucaauauaauuucuaaagucauauaacaaucuugucacauacauucuaucauuuaaaauuaaagcuuuaaaaaaaaauuuaaaugggcauguagcccaggccuucaaaguguuuguuaaaauauauuuagcaguaaaaauuuaaaaaaaauagcacccccaaacaucaauuguucagauuauagacauuugaggaaaaaaauucacaugauaacuuuuuaaauaagaaaguuuuuuuuuaaaaaaaauccuuaccugaauaaagauguuuguuuuaugucuguuugccaaaaaucuggagaugggagacuaaccauagcuauuaggcacaugaggucaguuugucacacuuguauaaguguuuauuuuuccauaagagucuacaaagagcucaagcaaauuaggcuauucacuauaugaaauuacuucuaaaacagauuaauauuagaauuagagaaauacagaaacugacuucauauuugcauuuuuuaaaagauuuauuuauucuauguaugugaguacacuguagcuaucuucaaacaccagaagaagguaucagagcccauuacagaugguugugagccaccaugugguugcugggauuugaacucaggaccuuuggaagagcagucagugagugcacuuaaccgcugagccaucucgccagccuuuuguuuuuuaaaacaaguguuggcuguccuagaacucagagaucaucugccugucucccaagcgcugggauuaaaguguagcaacacuguaauuucaucugauuucuauguaauagguucaagccugcagcuaagaaacugcagugacuuagguagauagaaugccuagaaugccuuuauccugauaggguaaaaacauuuaaaguacuauucaauauauauaauaaaaguaccauugaauauauguaacgguuucacuuaccuuccccuugauccacuuccacgaucuccaaagaagcuagacuucccucuugaaucaccccgugauccaaaacugcuguaugcauccuuaucuuuacuagaacuccacccugaacugucuuugucauagaauccuaaaaauaaaaaacaguaaaauccuauuaacacauggucuuaaucuuucugaacuuuaagccuacuggcucuuuuaucccucugguaucaaaugccaauguaaauauucuaaagguggcagcaaaagauaacuaagacaugcaaucugacagcguaugaauauuuggaacuuugccuuuagcaagaugacuaugguacuaucacauagcugcguucugccauucacuuuauugaugugaaugaauuuacaaggaaacagucaauuagcaucucagauuauuugguuuaguauuuuuucaguuccaauagcaaaacuauaaugccuuguacacaugaaucauaguccaaaugguaucacuuuaguacuuuauuuacaagcuuaacaauaucaaaaauauuaaaaaaaaaacucucuccccuauaugcucccaauacaaagucaaauaaaaauauuugccuaaguagggaucagcaaugacaguuacauuuaagacaauuaagguugaaguagcuucaaagaccucugauuagucagggacauuuauaagcuccuuuccuuuugccuuugucucuacuauuacccagccauggguuuucccuagcaaucaagaacuuaauuccuucuccagguauuucuuccagcuguauguaaaguuuaagguccugccucuucuaaucucuugacaaagaauucuggugaaucacuaacgauucacuagaaugugccugauaguuuaacuuaucugugcuaaguccaucuucuugucauguuaagacaacaaccuauuuucauguaguuuguacuacacacgauggcacacaccuauuuucucacauuaaaagcaagauguaauaagagacuaauaaaucauacaaaaacugugacacugaaggcaacuuuccauggugugacaucaguuaagguuuucaaaguuacuaaguuccaguacuuuaaaaucaauuaugguagaaauguuuaggcuucccaaacugucucaccuucccuaggcuuugacuaauuucuaaaugaaucaagaauuacauuuaccaaacugguauuaaggacucaccuuuaguagcuucucuguuccuuaaaugaggugggauauaacgcccuucuaaaagaacacaaaauuaaucaaaaaaugccaaauaccuucauaguaaagcuuuucaucaaauuaccuauuaaaaaaucaaauagucccaacaacuucaaaggguuggugagcaagauagaaguuuaagauagguauuaugccuguauucccuaggcuacauuuaaaagagaaaaaaaaaaaaaggcaacuuuaagccuaguaaguuaaggcuggguguggugguacuugccuuuaaucccagcagaggcaggugagauugaguaugaagcuagcuuugucagccaguuaguaauaccugcacaccaguuaacuggcuacuaguggguauuuauccuaauucuaauucucuuugcacuucugaauuaaauauuugaaagguuuguuaggaugauagguuaaaaagauugugugugugugugugugugucaaucacaggacaccucuguacagaugcauacaacauccugaaccaacuauucuuuuuuagcagugauagggaugguacggcuuugaauaugccauucaaggacaugaucacggaccuauauaugcccagcacuucuaacuucuagccagugaaagugcauucuaccaguauucguuaaaaaauucuuaacauucaaggaaaagcuaucuaguucugauugucgauacauccauaaaaugcuuuacuuacugcuugcuguacuuccuccacucugauuaucugaagaguucaggucuaggccagcaaacuauaaggaaaucaaacuguuuuuaguuucaacguugaaugaaaucaaagaaaaauacuccuguuuccuggccccacguucaaauaguugccucuuggagcccacacaguuauuaauaaaauuuagaaugugaccaagaacacacuaaaguauagagucuaacacaaaauagugccacuauaaauaccacagaaagcaaguuacaaaaucagaaacuggauccaaauucaauuccaucuuucacaauauuuguucuguaaacauuuuccauaguaaagcuccuuauuugagaaacuaaaacuuuguuuugaugaaucuuagaauuuuagccaggcaugguguguguguaugugugugugugagagagauccacugcuuucuucuggcaaagcauuagaugguacagacaggcagacacauacuuuaaauaaaaacuucuaagagguuugaagucagggcagccaaacaaaugguuuuaaaacacuaacuaggugcucaggcuuaguucaguuaguagagugcuagcccauagugaaggaucaagcccugauuuuugauccccaguauaguacaaaguguaacgauucauggcuguagucccaggauuggagaaauggaggcagguggaucagauucucagcaauauagguagccugcacuaaaucagacccugucugaaaauaaaagccacacguuaugaguguaggauucauuuuaaccauuuuuaaaaauuuucuaaacagcaccaacuuuauacuugguauuauuuaguuccuuuacucucaaauacagcacaaauguauuaaauugggauaauacugccuaagacaauuuuaucaauacacucaccacuuagcacuacagaauaaaacuggaauaauuccuguucucccacauuuacuguaaacucacagaacuagucaugaauauccuuugauguucuuacuaaagggcauuuuacuggcuuuagccuccaaagucugcccaucuccuuauacugguuaacaagauuuuacaaaaaugcuacacacugcucgaggguguguguguguguugugggagggggggucccucacuauguagccuuggcuagcuagccucaaacucacuaaagaccaggcugauuaaauucaggucgcuguggucaucacgcuugguggcagaugccuuuacccacugagacauauugucgauauauaacuacuaucuauuuaggaguauaaaccacaauugaaaaacaggaagaaaaaaaaaaaaacaggaaaguuggaacuguuacguuuuaaggaaauguuacucgauaaaucugugccgauacuugcaaacuacuaguaucgcuaagcucccugaaaacagaaagcagauguaaccucuuugucauuagaaaaaauguugccaugccuugauacuguaacuaccguuuaaagccgcguuuauuaaaaucugaguuuugguuuuuuuuuacgaguuuuuuaaaugugcucugguuugccugcagugugagggugucugaucuccuggaacuggaguuacacaggcaugaccugccacgugggugcugggaauugaacccaguccucuuaacggaugagccaucucucuagucuacguagguuuuuuuuuuuaaucauuugacauuaaucgaagcaacaaaguugccaaaugcacuguugguacucauuacaaacuugaaccacuccgaauuccuaagcuuucgaaguuaaauccacuaccaacuuaugaaaggcucuuggaaauauaauuuccaauauaguucaacaauaguaucauuuuaguauaaguaucauuuagaauggaaaauguuaccagugucccuuaaguuacaaugugucacaacauggaagauuuacuguagcaggucauaggucaggcagaaggcaccagacccucaucuccuuggccucuaaaucuagaaauggagucucgauuaaguaaucagaaaccaggccugaccaaucucccaauuuuacuucgauggcagcaacaaguuaucuguugccauauucugggcauuuugccucuagaggaucccagagugggccaucacucgcaaggcgcgugguccucccuugcgcccagguaaagggcgggcgugcccggcucgggccgcgcggucguuuccuggagccuaaggcugagcaagggccgcgccggguggcucgcgucaccgccaagcccggcgcaagugcgcacgcagcggcccuggccucccucccccuccuccccccgcccaauccgcccugaaauuucugcgucacaaaacuuuccacucgggaaccgcggccuccccugccgcgacgcaccgggccggcggggccgaagcaacccagcuggcuugcaggcgaacccgcuggcgggcagacccggggggauggggaugggggugggggggcgaccgcgcagcaccgccggccugcgccacacaaaggaggccgccgccauuagcccgcgcagaggccagccccccucccgcggcgcccccucccacauuccagcgccgcggggccacucggccagcccgcgcgccgccgccagcucccuaauuuccaaaccacagccacuggggccauggaagcccaaagccccggaaauccggggccaaaaccauccacccgggccccgccacgccacgcggggcaaucucccccccccgaccgccccgauccccaccugcgggucacuaaucaaccaggggacgcgcgugcgcccgaaugcgcgcgcccccucccccuccgcucgccugcgcacagacacaaaagccgccauugugcucgggccagggacaauaccgcgcaccgagccgagccggaggaaucaccggcucuagcacuccccccgcaagcauccagucccuccagagccccuagccacuggccacccgccggcccgagccguccagggagacgggaaggcaaaaagcagaacuuaaagagcugcgccacaaggcaggcuagggcagggggcaaagugaugcagcgacccccgcggcucaggcucaccugcugguccagcccgagcgcauuuuccacugccacaugacucaucccugaagaguaccgagaaaucggagucuuccgcugcugagcaaaggcugccucuaccgcaaaggcccucucacgggagaacugcggcuuugaagcgcaccgcgcggccaccgaccuuauauaccgacucggaggacugcuacgucagcacguaagacgugugcccuccucucccgggcggccggccacugccguuaggagcucugccugcuuacggugcguugcucggcugagucccgugagauuuccuaaucaguccaguuacccgcguccucgucggcucauaaagaagccuuggguauaugugguucugguucuccuggguuugcuauccccuggucuccaccgguccccuaaucuuacuguuuucucgagaucucgcgagaaaugauugcugaccguccucuagccuuaaggcccuaagcuuuaaacuagguugauuggcugcuccuccccuguguacccaguuuucguccuucuuucuagcacucgucccuuccucuccguccccgggcguggagaugaugcagugggcuuugucuggccuaacuaaugagcccuggcucugcguggagggcagugggaucacgugaccguggguguccagcaagguggccaucuug

SEQ ID NO: 9404 - RNA, 894 nt, Mus musculus
gauggugacuucuucaaguggugagaaggaaaaagagcggaugggaggcguuucgggaauggccagccuuggcaguacaugagagcggcuucuaucugugcuggaagaucugggggucuucuccagggaacuuauagaaaugcuugcaauuucaagaaaucagaagcuguuacagcuggaagaggaaaaccaggucuuggaguugcuaauucaccgagauggggacuuccaagaacuaaugaaauuagcacuuaaucagggaaaaguccaccaugaaaugcaggcuuuagagaaagaaguagagaagagagacagugauauucagcagcuucagaaacagcugaaagaggcagagcaaauccuggcaacagcuguuuaccaggcaaaggagaaacucaagucaauagagaaagcaagaaaaggugcuaucuccucugaagaaaucauuaaauaugcacacaggauuagugcaaguaaugcugucugugcuccacugacuuggguuccaggagacccucggaggccauacccaacagauuuagagaugagaaguggauuguugggucagaugaacaauccuuccaccaguggugugaauggucaccucccgggcgaugcccuugcagcaguuagacugccagauguccuugcuccacaguacccauggcagucaaaugacaugucugugaacaugcuaccaccaaaucacagcagugacuuucuguuggagccuccugggcacaacaaagaaaaugaagaugauguugagguuaugucaauagauucuucgagcagcaguagcgauucugacugagaaagguguggcaugcacagacuccaguguugcagaguucuguugagggggaaaugaaaagcacagaccccuaaggagcc

SEQ ID NO: 9405 - RNA, 879 nt, Mus musculus
uuuagaagaccaguuugugaggauacauccuauuuguuagggaaaucuuggaucacggguagcucuggaguugaggaacagcuuuaaucuuuggcaaagcauccacagcuuuuugaucagccuuucacugcucuguaaucuuguauuucuccuugucuguguugaagaucucgcaguccugaugccugggcuugcccagcugcugcuucuugaaguaagugucauucagguguuuggggauuuuaacauugcugauaccaacuuuuguagagguggcaaugacaaacuucugguguguucugcgcagaggaauucuuuugauggcaagagguccagucacaagcagcaagccacuguccagcugcuucaggaaaaccacucuauugccccuguggcacccaaugaggaugaucaggacagucuaggaaaugauacuggagcuuagccuucucaugugcuggcugaagggcuucuggccauggcuuagcagcuuacucuuuggugggauaauaccuaggcauuuuucgaagcuucaccacacaggugccaccguucuuguccccaccaacucuuuuggugacaguagcaaggacuuucuccuuuuucuucuucuucucaaccuugggcuuggcagccgaguauuucccuuuguacaaggccuuccuggaguacauagaagaucaggaguaccugccaauuccucucaccaggacaggguuucggcugcaaugggcuucgccuucuugggcuuuuuaaccuuagggcgaaccuuuuuggcugcucuggcggcccggggacaggaggcagcagcaucaccggccagccuuguugggcacagguuucuucuccuuuguaucaggcaccuuuucaccugccauc

SEQ ID NO: 9406 - RNA, 3168 nt, Mus musculus
ggaucaagaacaaauacuaccuuucaagggaacauuuacuuauuccuagacccaauauuuuaagggaucugucacuucuuuuuuuuaauuagguauuuauuuuauuuacauuuccaaugcuaucccaaaagucccccaccccccacuccaacuucuuggcccuggcguucuccuguacugaggcagauaaaguuugcacaaccaaugggccucucuuuccacugaugguuaaccaggcgaucuucugauccauaugcaacuagagacacgagcuccgggggaguacuggguaguucauauuguuguuccaccuaaggguugcagaucccuuuaacuccuugguuacuuucucuagcuccuccauuggggguccugugauccauccaauagcugacugugagcauccacuucuguguuugcuagggccuggcauagucucacaagagacagcuauaucucgguccuuucagcaaaaucuugcuaguguaugcaaugaugucagcgucuagaggcugauuaugggauggaucccuagauauggcagucucuagauggucaauccuaucgucucagcuccaaacuuugucucuguaacuccuuccauguguguuuuguucccaauucuaagaaggggcaaacugucuacacuuuggucuucauucuucuugaguuucauguaauuugcuaauugugacuuauaucuuggguauucuaaguuucugggcuaauauccacuuaucagugaguacauauugugugaguucuuuugugauuggguuaccucacucaggaugaugcccuccagguccauccauuugccuaggaauuucauaaauucauuccuuuuaguagcugaguagcacuccauuguguaaauguaccacauuuucuguauccaguacucuguugagggucaucuggguucuuuccagcuuuuggcuauuauaaauaaggcugcuaugaacauaguggagcauguguccuucuuacugguuggaacaucuucuggauauaugcccaggagagguauugugggauccucugguaguacuauguacaauuuucugaggaaccgccagacugauuuccagagugguuguacaagcuugcaaucccaccaacaauggaggaguguuccucuuucuccacauccacgccagcaucugcugucaccugaauuuuugaucuuagccguucugacuggugugagauggaaucucaggguuguuuugauuugcauuucccugaugauuaaggauguugaacauuuuuucgggugcuucucagccacucaguauuccucaagugagaauucuuuguuuagcucugagccccauuuuuaaugggguuauuuguuuuucuggagucuacuacuucuaacaggcucaauaugauaugaauccacaaacccacagaugaaccaauaccuccugaagagcucuaucaccauuagugggcaugaagucaccaacacagaagcuuuuuauagguuugcauuucaaauguuauccucuuucccaggaucuucuccaaaaguccccuauccucuccucacucacccuugcuucuauuagggugcuccccaaccugcguacacacucaugccuugguggccucauguuccccuguccugugucaucaagccuccauaggaccaaagagcugcccucacagugaugccagauaagauauuccucugcuacauacacagcuggagcuauggguacucuuuguuuggugguuuagucccugggagcuuuggggguucugguuaguugguauuguuuuucuugcuuugagguuaaguucuuuucuuuuccuuccccaucagaaggugaaugcauuguucuaacacagccuucugucauguaggucaaugaaucaugaucugaagcaauuaaaccugcaaaucaaggcaaauauuucuccauuaaaagaaguugcucagguagaggcagggugucucuaaagguguugccugacuauggaauucaugccccaacagggcugacuuuucuggucucagugggcaaggaugcaccuaacucugcagagacuuaaagcaucaaggucagagggauacucagggguccccaccauuucagaggaaaaggggagaugugauugggaaaaaacucugugagggggagaauggguaggggcaguguuuggaauauuaauuaauuaauucaaaagaaagaaaauaaauguguuuucuuagugcaaauuaaaaagaaguugcucaucuaaacuaauuuguauauuuucuauaauuugcauauuuauaugguaacuaaaaggugauaucuuuauaccugggcacaauguuuaggcuuucggucugcuagauacuuuuugggauugcugguagaaaaacuauaauuuuuuuuuuucugcaguggaguaguuacuaccuaaaaaauaauucugucuuaacaaguuguucauuuucuaguuguuguuguuguuuuuuuucacagaauuagaaaauacuguacuugauauuguuuucuuacacaucaaugaguauuucaaugaguauuucuagauggccugccagcuucaccacuauguauccauuguguaugugcaggggagguugguuugaggauagaagcuaggaccucauauuuacuagucaauguaucuccacugaguaucuuaucucuuuaccccagcugucauaccuauuuuuccuuagguuauccacaauaacagcauuucacauuuucccuaaauguuacuagucagguaggguccggaggucuccaaauagacacugcauagugccauugaccuuuguuaccuaccaucauugcauggaaaaauccuauugcuaaagaaagaacauauauuuggugcagaauauaaagaaaucaaccucaaauugaccaggagccuuccuuccuuccugauggccagcuuucauagcacagaagacuuuugcaugauauggacagacacacuguuuuuccucauaugcuuguaccucuucuaucucuagguauggacagugcauugugacuuucuuccuccagauuuucccuuuauucuuuccuuauuauuuuauuuaccuuucaaauguuguccccaaacccagacccuuguccaugagcccccuacuccucuaaccuucccuucaucucuaacaggaugcucccccaccca

SEQ ID NO: 9407 - RNA, 187322 nt, Mus musculus
auguuuuaaaugguauuuuuaauagugcugguaaaucaacaauauaacaagcuguucugaggaacuacagugacaaagaaaauuaauugugguuuaugaauuuccauuuaauacaaaccuuguuucuuauuuuuuguuuguuuuaaaugaaauuauauuuauuaaaauaaacauggcauaaugagaacaguaaaucaaagagaguugaucaaaaccuucauagcauguuguccucuaagccauauacaucaaucaaaaagucuaaguaucuaacguauuucacaggaauaggugauggcauucccacccaaacgucuucacauuucuggaaagaaaacaaacauggacacaauuauagccacauuucaaaguucaguuuugaaaauucagugguacauuuuuuuaaucuuuaaauaaacuuuuguugaacuuguuucuggacuugagagaugggugguucagugggaaagaacauuuaguauucuugcacaggagcugaguuugauucccagcacacacacauaguagcauacaauugccuauuacucuagcuccagggaacccaacauugucuucagaccuucacaggcuccuaagacacacacacacacacaaaguauucacuuaaaagaaaagaguagagcuuucuauauucuacuuugguaucagaagggcuuugaggaagagcauaguguugcuuuuguuugcuucuucccuguauuagaauuacagguccccaaucuuuaccauguaacugcagcccuuuccauggagaagaaagaggaagaaaugaugaauuuuaaugaaggaguaggaauaagcaaagaaagaaagggggaggagaaagagaaaaagggaaggggaaagggaaaauuuuccugucccucugagagaaacaugaccacacaaauggcuaugauuuuugaauggaagguagcugucuugguuuuagaaugacagagauggagaagacaaggcccaacuuacaaucaugagccagacaccgcugggugacuuacagacacauggacaagaaaaaaucaaauagucuugugaaacacugaaauucucggaacuaggcagcaauaaugcagugacugucucacacaauauugagaacucaaauuucuauauucaagaugguauuucuaccagcugcuugguuacuguuucuucaaaaaaaaaccacuaaaaguaguagguugcucaugcuaugcuuagguauaucuuauauacagugggguacuacaaaauaauauuuuguaucaauaauguacuaugcaaaugacagugguuccauaacauuuugauaguagccaagauugguacuauacacuucuaaucucagggcccaggaggcuuaugcagguagauugugaguuugaagucaucuaguguuccagaguaagucuuaagcuugccugagcuauauauagugauaucuaaacaaaaacaaaacaaaacagcuuucuaauccuacacccuccucaagaaacuccaagaaaacaaaacaaacaaacaagaaaaccugaagaaucacaauagagcugauauauucuuauaguagcccagugcuacuguggcuaucaugugacaugcaguagcucaacauguaauucacauguguacagugauaaaagcaaaccacaaccccucugucagucaauuaaaguacaacacaauuaucacucacuuuuuauaaaaguuauugcauuuauguguauaugcacauacuugcccacaugaaucuaugacucggaaugcuuguagaggacaacuuguaaaaaccaguucccuccuuccauccuguaguuucugaguacugaacucagguugucaggccagcaucaacccuauaaucuuauguuuacaugucuugacuacauaauuuucucauguuugaucuuguguuguuuuauucauuuugguccuagaacaacaggcuauauauaccauauguacucaaauauaaauauaccauauaguccaguaucugcugugcugcaacaucucaguucauguaaagccuacucuggguauuuacaacaaugaaaucauuuaauggcauacuucucagagcaucauucaucaucauuaaaugaugcuaagcgugucuguauguauacacauacauauacauacaaacucuuugcauaagcugcaauggacaaucaguauuaagacaaaccagggagaaaaaucuacaacuagugcuacugucaagguuguuuuauaugcaauucucuauuucuucuucauuuuacuuuuccuuuuuucaguacuggguuuuaccuuugaaucuugaacaugcuagacaagaacuaacuuacacucauggcuauauaagaggcucuaacccuucauuaguauuccauuaauauccagaaucacaaagugucauagaaguacaggcaaagacuagaugauuuuuugugaugguguucuagaaguaucccgacucagugcugcuacugcuagggauuauggcaucaggacagcccaguguugaagcaccaaaggguguucuuuuuauagucagaaguauaagucaaagguccagagacaucaauaacuccuugcauuaaaaggguaaguaguuccauuuggucuagggcauauaaugcaaaguggcaaugaaaggagaaucuggggucaaagucuuauguacuaguucauaaacaacuagaggaagcuguuaaccagucauagccagaauaacaacaguaacaugauuagaaauugaccagauaauuugcuguauguugggagaauauauacaaaucaauuuguagugauuaccagacuuugcccaaaccaggagggaugaacuaggugggaugaaguggagcuccaaaucaggagcucccucagaaagauucugaacagaacaccucaaaguccaagacuugaaacaguaggaaaagaaaaggggaaaugucaggcuugaacuauaugccccuacagaaagauaugcuaacauccuaacccucuacaccucagaagguaaguauaaauguaaauagguaagcugaagaagaugaagccauauugguugguauaggguaaguccuaaauauaggaaagcaggauaggaguuuuuaguuauuuuaagugaagaaaugaggaucagagggagaaacuaaauacaaaauuggacuuuauuucaugugcuuauaucaagauaagagucuguacucaacucucagugggauaacgauaucacauuccacuuuuauggugcagagaucauugaagaagaggguguggaaagacuauaagaaucagaagcaguggaugacuacaaggauaauggugguuuucagacauagcagguacaugucaaggcauaguaguuuugacagcaggcacaaaaccugugcaagcucaaacuagacaaaaucguagcauguggaagagaggugggcacaaggucuugcuccuagcugaggaacuauuagcuauugacagcuacugguagcaaggcagucaguuuucuuuaaggauauggcucucaguagauggauucuuccaguagaaggccacacgcaucaaagaauacaugagcaauacaaauuggauguuuguaaaagaaaaaaagaacacaguguuggguggauagggaugugggauauuuggggaagggaugaauaugauuaaaauauauugugaaaauucucaaagacccgauaaaaaauggacaccaaaaagacagagguucugguaaauccuggaaauacaguuccauguaguguagagcuagaguucagcacuguacaaaauuccagugucauuggaaugugagugaucugucaaacuauagcaaucaauaauacuaauauagaaucagaagaacaccaaauaugcacaccuuuaacugggacacaaaaucugaaucuaagagauguguuaugauugugaacuaaucacagauuuuugcaggauugugucuuacaaauaccuuguagagcaguuacaagaaauauauuagacauuuacuauaugauaacaacuauuguuuguacaugcauuacauuauuugucacagaaaacuccuagcagguagguguuauugcaauaccuguccacaaaaaggaaacugaggcauagcaugaauaauuaauuccucugcagcuaaaucacaaucagcaggggaggaaacagaaugguaucccuagcaaggaagcuccagagcuguguuuauguauuaugcuaucuuccaugaaauagagugggccucuucacaagcaucugcuugacauccuacagagugacauuuggucacuauuuucacuaaggaaaguuaaguagaaaacaauguaguucuuuaaaaaacuauuuuaauuaaacauugggaaagggaagcuaugugaguacaggugccuuaggaggccagagagcauugggugucuuggaguuguagagccgaaaccaccaacuggaaguaugaaggaagugaugcuucagagagaugauggcaauauagauuugaaagggucuuauguacaguccauaccauguggaccuuaguaacaugcccuuccuuauaccugcuauuagggagugacccuggauauacuaaacacaggauuuuaaucaaugaaaaaaugaaaaaugagcucaauaaaucauucaacuccaauauucaacccauccucaaaaguuuucuaaaauuuaaaucaaugucugcucuuagguggcauguuaggauuuaaucucagcauagaggaaugguuuuauauauguguguguguguguguguauuuaaaagcauuauucccucauggaauuuuuuaaaauaaaaauuuaauauaaaaauaaaacauauuaugcaacucauauaguuaugaugggcuuauuacucaugaaauaggucaguauuaauaauucucccucaucuuacuaggcauaaaaauggcuaugguuuagguugcuuuuuagcaggggaucaugauguaaaugcuacggaucaaagagaaaaaugguaggaauuuauacugaaauaauaauucaagaauuuggauaugagaaccaaauuuauuagcaacaggcuaauaagcaaaaaaaugaaacucaaacuagguuucaaaugaugaguaauuugagggaagaagauaacagcagucuuuacauccugacuacuuugaacccuaaggccccugcagagcuuuucagacuucucucaugcugugcuuuguuucaauucaacaccuuuucccaccaucauuucuuucucuugccuuuguuaccaauccccagguuccuacuuggagugacuucugauaaaugccacagagacaugugaaguacucuaugaaguaggacugauccacugcuauccaucgauuuuagggagguugucuuagguauuaucuauaaacagacucaggaauuaaauauaggauggaaagaggacuggaggcagggagguuuucaaacauccaggcaaugcaaugggauuauggauaucaaugaagcugaaggauagguaucacauuuauaauuuugccuacacuuuggcauauggguggucccuuuuuuguuguuguuuguuguuuuauaaagaaacagguuuuggagugucuacaaaauccccaaacuaguaauaaccuauucauuuuucuuuucaauaaaucugcaagcauuccaaauauuauagaaguuuuaugaauaucuugguauugaguuaaaauauugaauuuucauuccuuuuuaaauuagugaguaaaugcaaacuacagaucacacaguguuuacagccauaaguuuuugauguggauuguuucuugcagacgauggaagucuggccuugcagaugcuaggcaaguguucuacuguggagcuacauucccagcccauggauguaaauugaacaggggaaaaacuguaugcacaugguaauccaacaaaaagaaggcucauccccagauaaugacacuuucuaguucaaauuaugucugccugugucucuguaagacaugcuccugacagcacauguuugaaauccuuuucugucacaggcucugcuagugccccuuccuagccucauacucuuucaaaucuagcucauaccagccugacuuccaacuagcagcaucucuauuccuuugccccgagcuucugguuagccucugaggcuuacuuuggcugccccuauugcaagccgcaagugccaggggauuauuucauuucuucuauguugaagagcagccuucaaucaaugaaugccuaaaggugacugacagauuaauacuauaauuuccuuauauuuuguccagaauaauucugagauacauguuuuuagcauuucccagaaccacugagcaacgucuauaucccuauguaacuaguuucauacuauauacccuuuaguaauucccucucuuccucugccacucuuuccaaccucuucuggguguuuaaauuucuucccuucaacuauuuuaacaucaaaauccuuguuuccaccucugcuucuaaaggcaaaaagcagcuuuacauuuaucaaaguuaagaacauguauauaaaagucaccaacagaucuugaaacaaagcaacuucuaggcaaacuguagguaaauccagucuccaaggugacuuaccgauaaaaugaaaggacacucaaaucucacagugaaauguaauguaaccuguaacauuaaauaguaugugccacacagcauuuucugcuagaaggaagagcuaaggaacacagagugaaaaucggcaacagaaaaaaaacaaaucuaaaauugcucagaaucaaugccucuaagagugcccuauaacauuccaagcuggcugucacuagagccacuuagaaugucaaagaaguuaguggguaaauuacuuacucaucaacagggaaaacuguagcugccaaucuauguacacacacacacacacacacacacacacacacacacacacacacacacacacaaagccagcaccagcacccugaaaugagaagaggacaauagaugaaaacccagugaauagcaaaacccaacugaaaacccaggggaguagcaaagcugcgugugagcuaauaggcccuggauuuauuugcuuugacauuuuuaaaaggaaauuuaauuggauuaugucuucuucuagcuuacaaauuucuacuguaguacuggucaccaggugcaugagugguaaagauugggagccaauuaaaguccaugcuucacugcaacagggcuauuuuuauucuucccaaauggaaggcugauagagucauguuagugauuuuaccauguuacucccucuacucucuuggaaaaggaucuuuuuuccuuuccuuuucagaaaagaguauuucuaugagacauaucuacaaauauauagaauuuuucccuuuccuuuuucuuuuccuucuucccucuucuuucuuuucuuuuccuucuuccuuccuuccuucuuuccuuccuuccuaucauauauuucuuuccuucccuucuuuuuucucuccucuuucucucuccuuccuccuuccuuucuuccuuucuuccuugcuugcuuccuuccuuucuucuuuccuuccuuccuuccuuccuuucuuccuuccuuccucccucccucccuccuucccuccucucucucucucucucucucucucucucucucucucucucucucucucucucucucucucuuuuggacuucugcagccuuagaaauaaucacauuagguauaaaaccauaaaagcauuuaaauuuuagcaagccaaauggaaguucauuuugaaaagagaauuuucuaaauacuacuugagcuaaucaagaacauccugagaauaagagaaagaguucauauguggaguuggauucacuaaugcuccuauccaugugucuccuuacaucaaguguuucauagcuguuucucuuuggcugagcuaucaucugcaucugagcugaacauaaguguagauuccgagaagggauuccuuucuuaaaaaugcauuuugggcaaauguagguuuuuaaagagacuugagugcuuuguaaauauuagugauagguuugcauauuacucaaguacauguuagucaaugcuuuauauuauaacagauacuccaaauaucauuuucuacuaagcuacuguuugguguuagacaaucaguaugaauuugcuaguuauuuuuaacauaaugagcacacauauuaacccuguauuucaacuguuaaaauuuauaagcauuagaaacaacuuugaaaacguugccaaaaagagagugaaaaacauugauuuuccaggcauugugguguacaccuugaaucccagcacucaggaggcagaagcuggcuaugaguucgaggucagccuaaugugaauagugauuuccaggauaauaacacgcugaccaaaaaaagaaacaaaacaaaaccaaacaaacaaaaaauaguugguacuacccaugacaauacauuccuuuuaggaaugcccgagucuuuguuaucuacaaaaugagaauauuuauuuggcaagguuugugagacaauaaaauaucauaaaaagugaucuuuaacaaguaggguauccaaagacauauuccaagguauaccugaccucuuacuuccuacugccauauaucauacugucaugagagagggggagcccuugaguaaacugauauuucuacaguaauaauccuccuaaagugaaucuauguccaacuuuucucagcaaugucuaaagauaugucucacaguauacaaaguuuauacaagaacugauaagaguguuauuguacaaaaugugacuuaggagauuaaucagacaggcucuaaauugugaaagccaaucugcuagauucuaacuaccauauaaaagcaagcaaaauagaauggaaauugagguguguaggcuaugauaguauuuugggcaacauucucagugcagaguggcugggcaaacgaacaauauagggaacagcacucuccuuccccaaccaggauacaggcaaguggcugugggucauagccagcagucaagauaguuggugauacccaauuugcaucuauacaugcagggacagcuucacaccauaugauagcagagcuaaucauagcucaacuaguuuuaacaagguuugcuuguuuguugcuggacuuuacuuguauuaucugaagccacuuaaccaccauguguagaaagggcacaucugacucuggaggacuggucuugacauuccacaaaaccaugccacagaaguguuggucuagguaaaacuuuagaucugcuuaaugggcuugcuccccuaagcaaauuccuuuauuauguuaacagaguguacugggucauugucuaucugcccuuaagaccuuucauucaucuuacucucugcccuggaagacagucccauguagaccauaucgcugagguucuguguucucugguuucaagguguagucugccagagagaaguguuguaagagucugggaaaguaaguuaagucagagauuaaagugucaauuuucucucuuuccccucguucucucugcugggccaugguuugauaguauccaucgugggacaguauuuagacccuucugccuauagaucuaguucuagcuauccuucuguuacacugguuccuccaugcuuuucuaggcccuaggcauaguaaauaaggccuuugcacucuugcuaguacacaacuguuugauuugccuauuugauucccuuaacacuaucugcacuucuucaauagucccuuaauguuaaaucaugcccacaaaagcuugagagcuggcucaauggucccuucugauugcugacaugugcuaacaccuaaauuccuuguuggaacuccuagaugacauaucugucaaauccuauaucacauguacccagauaccuauucagucucuaguuaacuacagcuacuacucaaaucauugaccuuuguccucucuaugucuaccccauguacuaaagucaaucaggcuagaauaaagacauuuuccaaauuccuauccaaaaugugauggauaguguuagucaacaacuuugacuagagucaccuaggcaaagagccccugggcauggcuaugguggaaauuugauuauguuaacuaaggugggaagggugcugccauccccuugcuggggucuugguucuauauacguggauagagaugggaguguggggcuaggcagcaaucugugaucaucacucugcuuuugacuauagaugugauaugacuaguuguuucaagcaucuucucucuugauuuccucuauaauccagaauaaccccauucuaacugaaccugcuuuuaacagaguauuuugucacaauaauaggagaguguaagacaucauauuagauaacaaugauauagacauuuaagccuauucagcuuccaucagccaugaugaccuuuuuaaaaaugugaugcucuugcaaggaagaaaucaugcugaggaaaacauucaaaacaggauagaaacaaaaagauuuuuguacuggcuaguuuugugucaacuugacacaggcuggaguaaucacagagaaaggagcuucaguuggggaaaugccuccacaagauccagcugcaaggcauuuucucaauuagugaucaagggggugguucccuuguggguggugccaucucugggcugguagucuugguucuauaagagagcaggcugagcaagcccagggaagcaggccaguaaagaacaucccuccauggccucugcaucaguuccugcuuucuuaccugaauaaguuccaguccugacuuccuuggugaugaacagcaguauggaaguguaagcugaauaaacccuuuccuccccagcuugcuucuuggucaugauguuuugugcaggaauaguaucccugacuaagacaauucugaauugugggaauagugauaaccuccugagagccacucacaccaccucuacaaguuaguaaaggccaacuaacgggccauuuccuguaccagaggaaaugagcaguuuucugacccugggaauccaaccugacccuacucccacacaggugcucagccugccauuccuugacuuuaaccuuguuauuccaaacucagugcuagaauacaaccccauuuuauaaugaaaaggaagaccuaacauuuaagcucucacuguugcugcaagugcccauguauagcaacuuaauccccaugacacccuuaauggaagaaauaccuuuaacaaguuuuuuuagauggaaaaagguugagaaacuuguacacagucauucaguugacaguggaaaacaugauuugaacugaagucuaugacacuguacuuucuuuacuaucugaaguccuuuaggucuagggcucagaaaugaugccaggcaacagagaugguagaugauaacauggauguacaacuacuauacauuuuuggccuucccauacuggcuggugauuuuucugugggugaugaaaucaacuuaaugacuugggaacaacauucaaauaggagaaaacaagagaugggguagggagaagagaaaagcaaagggauggggaggaaaauaagaaaggaaaagauguuguuccauauguagugaaaauaguaauuuuccaugaaacauuuauucuauuauaaucuacauacugaguuguuguggaaaaauauuuuucuuacuguguauuguagcacaaagggugauuaaauuuuauuuaagcucaauagucuuuagaaaaauaaaaauuaaaguaacaauuuaccacauuuucagaagcaagaaauugucgaaacaauuugaaugacuaacaacagggaaauuacuggcuaaauuguuuguuacauaaccacacucuaccuaaucaagaaugacuuaggucuaugcauacugaacuggaggaauucuccauaaugaaguagaaacaacagauaaauaaauauaugugguaugaccacauuucugaaucaucaauccugaaaugucuaacaguuaauugggugguagacuagaaggaggaagggaaaaaagagaaacagaaagcaagaaaaagaacaagaaaaguugucaaucaguaaaaauaaggacauacaucauucagaguuccuuaggaaaaagaguauuuccacaaccagaguaaguggcaaauaauuuaauacacugacuaccucauccuuuaguaucuaaaguagacagguugcaggauaacccacccauaauacagaaauccaugcaugcucaagucauuacauagaauggcacuguacuuauauagaaccuacacaagccuuccacagacuuuuaauauuuaaaaaaaaacuuacuuuauguuauguguaugagugcuuugccugcaugaaugcauguaccacauacaggccuaguacccagaguggucaucaaagaacucgaguuaaagaugguuauggaccaaugggucuucuacaagagccauaagugcuccuaacuguugagccaucucucccaccccuuccauacauuuucaaucacuucuagauaucuuauaccuaaccaaaugucuauauuaugaaaaaacaguugcauuacauuaaggaaacaauggcaagggaaaaauuaucugcaaauauucaggguagacacaauuuuuucuugauuauuuuccagguguuauugguugaggccacagagauagaaucugcagguauagaagauggacagccuuuacaauguuauaggauggauugggggcugggauggaggacaaaacaggaaaucuuccaguuuccagggacuguuaauagcaaauagucagaacaacccccugggucugaagaagcaugugagggcaguuacuggaaccuagaucagcaguuuaugaaccucugagcagagguuaaaagaugugacauuuagaggaugugacuggcaagaagggagguggucuuucccaucucucucccuucucuucccugucaguacuucccucuggcuauguagcugaggaugcuuaagggucaggggggcaauugauucagguuagaaaggucaggcccagggaugaccaagcagacucagaacaauggaagcugucuuaauaagacaagugcaugauaguuaacacagaauagaauggaaagguagaauacugaccacaccccaaauuguaccagguuaccagggcaaaugucaguacugauuuccuucucccuugguaucuuagacuuugguuaacugauuacaauaucuucaacaauacuuauaccaaaaagagaaauuuucuuucuauggcaggggacagugaauagaagguacuagggaauaaacucagggcuuugugauuucuaaacacauauacugccacugagcuauauacuccagccaauauuuuccauguuuacucuuugcaguagaacagaucugacuuaaaauuggcucuaccauauacuugcuguuuccuaauguucucaccucuaaaauaggaaugaaaguaucuaccaccucaaguuucuagaauggagagacaagcuaagagcuuuuaagaucucugacuagugguugguguauaguaaugagacaccaagaacuuccuaauaguuuuacucggcaaugggacaucaaagaacuucacaauugaucugugcccucucacccccaacccccgcagcuccaugaaagggcacaccuaugaaaagguagaugcuucuggggaaguuauugaugcaggugauagaaaacaauugcuccuucacugaggacccugugcuccauccaguggauggcugucugcaucuacuucuguauuugucaggcacugacagagccuuucaagagacagcuauaucaggcuccugucagcaagcuuuuguugccauccacaauaguaucuggguuugguggcuguauaugggaugaaucagcaguggugguaugaccuagcagagacagccaggucucagccuuggcaugagugaccaggaaggacuaaugccaacaggaaggcuggggaaaguucuuagcugugccucucucaacaaagcgaagaucagugaaaacuugaggccaacaagcauugcauagcuagcucuauaaacaagucaagcucagccuccagucacugucuauugaguccuuuuuauaguuccucaaaacaucauguuucuucuaugggucuugccuuagcacaugucuugccucaacaugugcaucuaucucaacugacaucacucucccaaucagcccaagucugcagaagcagcaagaaaauguagcauaccaccagaaguuuuuugguguguuucuuccuauggaguccugacaaauggagcuuaacuaugcaauguaagguggaccuaauguuguuaguaaagaauuccucaucacaugcccuuucacgugcuugcuuuagcagaacauccucucuccuguguaugcuuaggggaaauguuccuucacaagucugccuuauucuuucacccauguccacuucaggaaagcacuccuucauguguuugcugcagcaaauaccagccaacauaacugacuuuccaaaaacccuaagguuuccacuucacacuugauaauacuuauaauuugucaauaguacaucuuauaacaauuuuaaauguagucagaaugcuugucuaagaaagaccuagcuugcuuagcccugaauuugaucucaaaguacugcaaaaugcagcaaaugauugaaaaaaaauuuaagcauccagauguaugugguggugugugacuauaaugcuagcacaaagcaugaagaucaggaguucaaggcuauuuuucagcuacuuauugaaccuagguugcauagcaaccuguucuauuuucuuaaguaaugauaauugccauuauuugacuauuguacacauauaucaaauucccacacuauauuucauaaauguguauaauuacaauaauuuuaaaacaagaaauaaaaauagauauuuguuaguggccuuccagaauaauauucaaagcucgcuuaccccuaaaggcaucuccaaccucauucuucccuagguuuccccauaagccuucacucuagccauaggaauuucuccagggccaugcugggacaugucccagagcacuccuuuagaaaugccuuugcauagcaccacaucauguuacaauccuaccuuacuaacucacuauucaucucugaaaugucaaaugagaccuccucaagaugauguguuauuccucguucugacuuagaaguagauacuuucauuccccagcauccuauguaggcugcaucaauucaaaccccaaauaugaguguacugauuuuacuucaggaacaggcuccuucaaagggagugaugauauuauccuugaaugccagaccaaagcagagaaugugcugaguggauccuucauuuaucagaguauuauaucuacaaguggaugaagcuugaaauuuaauucacuugacauuguuuagauaagcgagugugccagauuucaaccccaccucuauuggccaauacugucccucaaccaacuggaaguucuaagauuuucccuaauacuccugagaagcuauaugcuuaagaggccuauugccagaagcacuaggcaagcucaggccagaaugaucuggacagcagagacagaauaaaugcuuguuuucugagauuaucaacuaacugacaauugcuuuaucaagggauauuccccccaaaaaauaaauuucuggagcaugcuaaaauacaaacaaacuacuaccugccugcccucuccuuaaagacaaagauaucuuagagaaugaagauaaauccacaauacuaaaggccuccaucugaucacaugaacuuuguuuuuccuaacuaaacauuuuuuuucuauuggaauuuucucuucagauugacuccagcauaaaaugugaauccccauacucuauuguuucacacaggguaaaccugcacacaaagccacagauauacuaagaugacauagacaucacuugagauuugcuguuauagauuauaauuauauuaccaaaauccauugacaagaugcuuauaucuuuuauauguauaaccuauuaucucaucuacuauauaauuggauguaacugggccauauauuugcucagcauggaaagugaauuagccuucaacagaaauacccagaaaaugcucuuuccaagagcaaugguguugcuacuauaauccauggaaaauaauuuaaagauacaugaucuuaaaaauauaacagagguagcuguagcuuauuucuaaaauaagcauaaaauuuaccucuuuaagguauggcggggcuugcaaauccgguguuggauucauucuccaguucaggacggagaaaaauaucucauaauuuauuugauggucuuugucuucaaaccugaaagcauauaauuugauucaguguauagaauauaggaccacaaugacagcuuaacuuuuaccuuaaaaaguauuaucaagaaugcuucaguagcuaauguuaucaucauuucuuauuagcugauuaucugcuucuaaucuacccagaauauauauucuuugauaacagggaucucaccuaauuuuucagugguaguaguugguagaaguucaauaaacauuugauguaguuuccaaauuuugguagccaagaccaccacuacauuuuguuaagaauauuugaagggcuuuuuauuuuauuuuagugguugauagaugucaauaaaaugaagcucucuuguaguuugaaauuacauauuguuuaaauguuuaagacuaguuuuuacuacuacuagauuuuuuucaaaaaguaaaagguauuuuuguucucuauaagcuuucaccuuucuuacucucuucucuagcccucuuucucuuucucccuuccccccucucuccauguggccauggccagccucucucuuucuaccuuuucuccuucccccugccuuucuacaauaaagcucuaaaaccauaaaaaagguauuuuugucacuuauuauguaaccauuaaaagggguuauuucgacccauguuagagauaauagaaauauguucuugacagaguguaaagaagguuauaaaguaguaugcacaguuuuuaagauuauuucuuuuguuucuauuauuuuuauuuauacauguguguggggguguguguguguggcauaagucuauguaugcauauaugcaugugaguacaguguccauggaucccggaagagggcauuagaugcccuagagccaaaguugcuggcagcuguggccugccugaugugugugcuaggaagcaaaugcaguugcaagaguauuacaaacacacuuuuaaucacucagccauuucucuagcccuauaugugcaguucuuauucugauuuauauuuauauuuauauaaaaagcaguaaagacaauacuaacaauauacuuuauauauacauacauauauacauauacauauaugaaaaucauuucuagaaagucaaaugaugauuuugucuuauuauaacuaguccauaucaccugaauugauuucaauuuauaaucagaaaaacaagccaauuuuuaauuggaacaaaggauaacaaauuauuaucaugcaccauaaaaguuagaucaaaacuaaacagucuuaaauuauggauacuuguuuaaauucaucuucaacuuuacauaacagaguuuugaucacuaagauaauaauuguaaugacccaaauagugccuaacugcuucucaauguaccuuaagccacuuuuccuaaauuuggcaacauccugccaaauuuuaaggcaaauuauuuauugaucucauuauaccaauauuuaaggaaacgauaaaguuaugaaaaagauaucacuccaagcacacugcuccaggauucuacucaaaaacaaaaacaaaaacaaaaacaaaaaaaaacaaaaacaugugcacaacuaaucaaaagaugguucuuuucaaaguguuaagaaaguaucucauauuuauaaauucauaaaaaaaaucacagcacacaaaauguuacaagcugaaguaauauagauucauccaucuaaagagaguagaauaaacagaguaccuagaaaacaggaaagggaauucuguaauucuuuggguacauuuucuuuggccaaaaauucugggauacaauuccaacaugcuggccccuaccacuguuuauucuuugagauuuagcucacucaucauuucuacucuuuuaaaggacaucucugugagcauacuuauagucaaaacguggaaacagaaugucuuuuaauuguguauguuucuggggaacuacuaaaacucaacuaaagauguuuggugagaauuguuccauuacagagagucuugaagaaaacauuucuuaauagucugagugggaccugaggucagagaagaagaucauauagcaucuuuugacuguucuaagaaacucuaggagcuacuggacuauuuucuucuaagaccuguaacauuuuggaugaucaggucccuuucaaauaccuacagugaaacuuaagcaccaaugugaugacaggaagugagauguaggggaaagccuuccugaaaucaguuuacaggaguaugucacaauagcacauguuuguaacuucaccacccagaauguaaauaaaggugauagagugggcuauaaguuuaaggcaugccugagcuccauacacucugucaaacuaccauacaaacuacuagaaauaaauaggauuauagaauagaagcaaagagacugcagauaacuuccuuguucuuucugccauguguggaaacaguauaaaggagccauucaagaagcaggugaugauucucaaccagacaucaaauagguuggcacguuguuuuuuaguuucucaccugccagaaucuuaaaaagcaguuuuaaucuaugggauauucuuguagcagccuaaaaagacuaaaauaggcccuaauauauuuuuauuauucaaacaaucucacugcuaugaguagaauacucuggucaccacagaagugguuaguaaucucucucaaguacuccacauagaaaugguggugguuuagacaaaagugcuaauagugaagaauuguccauucuggaugccacuuugaauauagguuucccaaaagacuauacacaccccacacaauaguggugagcaauauauguuugcaaaagacuugacagcuuaugauugagcaacuaagccagacagggcuacaagagugaggcaagacccaguguuuaguuucagauaugguacuguuaggaaagauuuuguaaaacaaaaaccaaaaaacuuuaaauguaugugcaugcguguauaugucugccuguguagguguguaacacauguaugugugcugauggaggcccaaagaagacaucagauacucugaaacuggagugacaaggaggugugaacuccccaacaugaguguuggaaaacaaucuccgguccucuggaauuguugcaaauacucuuaacuacuaagccauuucuugggauauauauauauauauauauauauauauauauauauauauauauauauauauuauuuucuaaugagaaguaaaaaauagagacaaugaggcuaaaguucaaggggggagucucugaagauuuaagauauggcagucauucacuauauagaugauauuuuaaaagugcaugcuauuuuaaaagacugggaaacuagaugcaaucaccaaugaaauaacuguuucuguugguuuucacagaagacaauguaauuuucaggaaauucccauaccaugaauuccagaaggcacucauucaauucuagaauugagaauuuuuauauuucacuaauuugguaaccagucaagauacuuccaaacuagaucuaggguacauccaaugccacuccucacacacacaaucuacugagcagucuuuacauauuacaaauguaccuaacuuccccaucucuuuuacuaaccucuaaucucaaaccacuuucaccacucacuaguauuagaguaauuuucccaccuugggcuuauuccuucuaucuacucuuaugcuauagccgucuguccuccaucagagaacucauucuaguccguccuccaucagagaacucauucuaaauuauagagccauucaauuacuuccuugcuugaaaucauccaauggauucccacugcauuuagaauacaacaugagauccuuugcaggguauacaagagcugaguuaaauuggucuuugcugacaucucugaucacaaacaucaccugaaaacucucacccugucugcucuuuuaggucuucuguaccuucugcuccuuuuguccaugcaaacucauuucaaauaacugcuucccuuaggaaggucuuuucccaaagugcaucuuagcuggagcccuuugccugaauucaauuugcacuggaacucagaaaaaugucuacaaguuacuaagggaagaccuauuagauuuuguuguaacuaacuuugauaucugcucaugucuccuaguuaucucccaacugcacuccaauuucuuucccaccucaugauauguaagauucaauauaucuaauuauuuaucuacuuagaaggauauuuaugagacauacuucugaaucaaaugauaagaaugaacaaaacugaugauacaaguguauaugucuuagauauguauaaaaauuguaaugaaaugaaaagcuuuauuuuucccaagucccacagccaggcuuaaacacuauuaguuaaugugguaagguuucuaguucuugucagaaaaccucuguguaugugggaauacccccaaaugguugggagauaggaagaacaaauaaucuuuugauuuaaagagauaagaugggcugaaguggcugggcauggugguguacgccuuuaauccuagcacucgggaggcaggggcagguggauuucugaguucgaggccaacauggucuaaaaagugaguuccaguacagccagggcuacacagagaaaccgugucucggaaaacaaaaacaaacaaacaaaccaagaaagagagagagagagagagagagagagagagagagagagagagagagagagagagagagagaaagaugggcugaggcuucugggaagaauauuuuguucuugggaaguagucagucaaucagaaugaaucaacacaaaauuuucucccucucuuuuauaccaacucucuccuuuuaccuauaaagaaaaauuuuuaaaaaggaauacaaaagaaauauacacaacgucaaagacagcugggaagcagagaggacagcaauggaaaagggguuucaaauguguugcaagaugaaaagcagaucuaggauuaacaucagacuuggcagagcagaagacuggaagcugaagcauuaugugaccaaggaggggagcccagauauucaguaacccacagaagucccaagagauucagggaauaaacuaugcauuaaucaagcagaaauaaagccugucaaugaagccaagaauugguucaaggcacaaguuaaaacuauagguaucuuucccuguguaguaaguaguugggaaagguuuuagcuuuagagaaauaaagaagcuaaagaagugccaguccaagggaggugaugcauauggaggcagaggagaacauuauguucugaauuuuaaaaugaucaccuagaugcaagcaccaccaacagaguacaagagauagaagagagaaucuuagguucagaagauuccauaggaaacauugacucaaaagucaaagaaaaugcaaaaaaagaaugacuaccucccaaugaagggguaaaccuagguaaccuauauguuuguagcaaaugugaagcuuggucuucauguauguccccuaaagagugaaguagaggaugucucaaucucuguuuccuacaauugaauaucuggacugcaugguugggccucagugggagaggauguggcaaguccuacuggggacuagauguuccaguauggggggucucccucuuaaagaugggguagaaguaauggggagaaggcuuuauaaggguaggacuaggagggggcugugauugggauguaaagugaaugaaaaaauacauuauuagaaaaauguaagcacaauauuaaagauauaacuuaaaugaaauaacaaaaacgaauuaauuaucugcucccuuccuaccccuuucccacuucuagaauaucaguuaccagguuuagauucuccuucccucucucaauccauccuaccucuuacugcagcagaaagcauacacacagagacagacagacagacacacacacacacacgauuuuuuucuugcaauacuaugaaugauucuggagaaauuuucagauuccaauuucuggguacucccuauugaagauggagugacaggauagaauuugugcaacgaagcucauugucaacaagacauuuccuguccucacuaaguauccaacauuaaggacagaaaucaaauggacaacaagggaaaauaaagggacuagagaaauaaaaacugaucaggaagcagauagcaagauguaaaaugaagaaauacauugcauuuaugaaaagaaaacagaagacuacaagaaaggaacaugugaccuaaacacauguucuuggcuuuaaaaauaugguaggaaaaagacaacuccauggaaagguuggaauauaaaaucaaagaaaucccuuaauuaaaaaaaaacaucccaauuaaaauggaaaaucuuaggggacaaaauauccaaacuugaaauucucacacuugagcagcucccacugcuaaaguguuuuccuaaagccuccauaaauucuucuuucccucugaugcucuagcaauccaccauuuccuccccuauacaaacuaagagacauguuuguggaggacaggggagggaaagcaaucugcuauucaucagagcaggaauagagaaaauuauuuguagaaaauucaucagcaacaaagggaagugucuccaagcuagaagaccccaaaaaguaguaaacauacuauauauacauuaaguuccaccauaaacguccagaauaccaggaauaaagaaaauaucuucagagcauauagaaauaaaaauaaaaauagaaucauaauuaugcuaacuucucaguaaucaucaaaauaguagguuaguaaguauuauugacaaauuugauaaaucaaaauacagcgguauguacaugcuacucuauuaauuacagaaguaguuagaaagguuaacauggcuucugaugguuagauuacacugacucuaagcauguaucaauuuuauacaaauaaaaauuuaaagggcauuaaaacagaugaagugaccucaaagcaugcuucucccaauaguaaagguaggaguaacagucuuggaaagucagggacauuccuaguugggauccuguucucuuggaauuagucucucuuuguucuuucuugcucuuaaauucugagcacagcuuuuuucuuggaccauugaugcggcgaauuuuuuucaugccaucauuuguuauuacaguauauauuuacauucacuauuuaucauguuuucauauaagaauguaagggaaaaaucuagagacgaggcccuuuuggcauuaaaaccaggacagguuggagaaggaggaaggaaacagcucagaaauagagaaaaguuugaaugucaggggagugaggccagacaggucacucagaaccaaagagcugccccugaagguuauugauucugucacuuaucauggaaagaucuuugucugaugacuaauggaacuacuuggaagucucaaacauccuuucaaaggauuucggaaaagccuaugaaccuuacagaaaauagauuucauuuuauaauugcacuaggcuuucaauccaaaacaugguccagauucuccaccugaguuucuacuuuaauccucaccaaaggacauuugguuuugcuaaaacugugaucuauagucaaaggauggagauuugccacucaggaagaaacucauuugaaagggcuuugaagccaauuccaaagaagaacuuucuauggcaacauuguugaaaucagugcauagccuuucagggugacugcccuaaagggcaaggcuaauucuggcuuuuaaguguuucuaugcuuguuaaaaagucagccuccuuauauucaagugccagcucccacugcuaaaguguuuuccuaaagccuccauaaauucuucuuucccucugaugcucuagcaauccaccaucuccuucccuauacaaacuaagagacauguuuguggaggaagggggagggaaagcaaucucucuaguuccuuucuacauaauaacagcccccaaacaugccuucugaggccuugcuaggugggaguucuuagaagcaagucuaaugggauguuugauguucaugcuccccuuuccaagaaugaugaauaguucaagaacugcagaagccagucaccccuugccacagggaauaaugcugugcugcuuuauuuucacccuccacagagguggaaggauuagugggcacuauauuucaucgaagacgaaccugcccccucuucugcuauacuggcuaccucaccaauuaggaaaugguccagaagagagggaaaggcagugaagccucacuuugacacaugaucgcacuuagcuuguggccauuacuucagaauccaggaagugugcucugaaacaccugguagaagucuguaaugucagaugcauaagaaaggagaagcucugggccacuguggugggugcaguugacaagauagugucacucgggcugacaguaagugguuauuucuaaguagcuccaucucuacauggaaaauuuagagguaccuugugagauggauaauggcugccaaauauggacuauacagauacucaauucucuguugaaugacucuacaucgugugccauucuaucagauuuuuuucaaccucaagucacccugcauuugaaccuacagaaaggcccuggguggguaugcauauuuaacacagugaagauagaggacaggagugaaugggacagagggaagggacuguuagaacaaacaguaaggaaaaacaugcacuccuuuaugaagaccucaagaguaccccaaacaauagccacauggcucagugcuugccuuucagccucacugccagguauuacuggagaaaacugccugagacugagcucugccucuaagaggggacagggcuaagcaaaucauaaugagaugauuuuaaagcccuguuaacuuuuuccauuuuaacugaucuuucuggaucaggcaccagcucucuugggaguccaguucuaaggcauucuaugggacccaaagccagcuauaaaaaacuagcuuguggcagagcugcugggagaagacugcauuugaauuccccaucuaguuucaaaaugucaaaauuagagucggccaccuuuuuuacucuuuaguucuacaaggaucacaugauggaaugaccuaagauuucccuucauauuuugagguuuaagaaggaaauugucuugcucagaaguacguaaggacauucacaucuaaacauaaauucaaggagguuaaauaaagaccacaaaacuagagugcuggugaguuggauuuuagaguuagauauaguguauucaagacacauacagugcuccagcaaagaacaagucuccaaggcuucaaagaugaaggggucagaguccuaucuccaggagcaugaauagaagcaaggguuuaguaucauacugaguuacaacuuggcauugaacaccccuuuucagugacucucauaucucaaagcuugcacuuaugaaauggugaauaaugcccaucaucaauuaaaauacagcuuuugacaggcucuucaccaaguguucucagguuuguaacacuauguuaauacaaugucacuauuguuuguuauuaauggguacuagccaccacuaaauagagcugaagucuaauaugcugaauuagugaaaugaacuugggugcugauaaagauggauucauaccagcucuuaaaacacaaacugcuaggaccugaauccacugccaaugagaagacuuugaaguccauacugcaucuuugguuguacuaauaagaaaaagaccuagcugaguccuaaagacaaagggaaugaaacagaagagaaaucuugccaccaaacacagggguagggaaaauguaagaagaguccuauucuguagccaccgugcuuuuaauauugugaucugaauucacaaauuucaggagcuacucagccucaccauaaggcagguaauaguucccaacccugggcacaguuugcauggagcaaaaacaagcuccaugccugccucccaugggggacugcagacgucaaaggggguucugguuagcaugccaugaagagggcuaugcagacaagagacucuagucaagcucuguaaagccuugugcagucuguggggaacaauaagaaugcagaaucuaaauguaagcugcaggcugaugggcccauuaggaauuagggcaguguuugaaaggaaucugcggagaugacgcaaaacaccaagcaugugacccaaaucauggcagggcacauuggauggagaagggaaugggaaugagccauuuucuaaucugauuagucugaaguuuccccugaguauggagaagggucacugcacaauuagaagcaaaguuagacugaacaugguccacucagcaguggagaggaaugaccuccucagcuauggaggcagucauacagagcuugagacagauuucaaaacaaguugcagaauagucuuuuuuaauuuaaugucaaaucauaaagacaaagacaaaauagucugcugagagaaugggaggaugauugguugcuggcuuuagcauuguguaagaacucugggguccugcagggccaggcucccacaucacuggacuuucuagcagaacaaauccucaagcucaucaagagauaaucuaauaaagaucugcagcuuccugacuaggagacagcuuaauguaugaaaagcauccagauccaacuaucacaaaacagggcucccagcauaauagacacaggcuccuuccaguuuaguuuugaaguucacuauauaaacugucacuucaggcuuaguuuccucuggcuccuaguuuccaggcaagagagaguaccagguacugugucauguaccucagugacucuucggaacgaggaggauggaaauauuaggauguaaauugaugauccaauuuuugggaagggauuugagauuuggacaggucaaaacucuuguauaaguuugcacagcuauaagugguucaaagaacuuaagagacaacaugaaaugcccaaacuggcaacuuuuggggggcagcuuguuacuuguucccaggugguaaaucaaaaacauuagaaauagguguccugggcuggagagauggcucagugguuaagagcaccaacugcucuucugaaggucuguaguucaaaucccagcaaccacaugguggcucacaaccauccguaacaagaucugaugcccuguucuggaguaucugaagagagcuacagugugcuuacauauaauaaauaaauaaaccuuaaaaaaauagaaguagguuuccaugugugaauggaccaacggucaagucacaacucuuuauuacuauguaaggaacaaaaaaaaacauagaauuuuaagaauucuuagaaaaagaaucaccacaaaacacagcuccaugucuguguugcuauuuucuacugaagaaacagccagauuuaaaaaaaaaaaagucggaagauagcacauauaugugcaaacaucagauaacucauuucucuggauuauggggaagaaacuggaggacuugggaacaugaugacuauagagaauuuagacuccuagguugucuacuuuauuucgacuacuuuacaucaggauguucuacuuucccucaacacugcuauuagcaaauaaaagggaauagaccuaaacaaguaagcaaucaaaaaaagaaaagagaagaauacaugguggugauucucuagagaauuccucuaggucaguucacugaacacauacaucuaucugaauuggcuuccucuucugauaacuuagaucccaguuccccagcauaggaauuauuuuuuuuucuucccauuacuuuuacguuuuauuucagaugaagacucuccaguacaccuguuugagaacauacucaaacaaaaaguucugagcuaacgacagaauaacuuaucuuucuauacacaacaaagaaauagcaagucagguaaaaagggcaacacaaggacauuuuugcuucuagaauguacuuagcugcuauguguaaaaacagaccuagaacugcagagauugguagaugaucaauaaugaaccccugcacugggcaggaagauaugcaggucagaauaagaguggugguaauggaaaaggaugagucugugaaggcagggaauggagguggaauuguuaagguauccuaauaugcugguuauuuguacacaaugauccaaaacuaucagaaagaaggggugagaacuggaagguucaaugaucagguuccagaucuucuucuagaauauuguaaccuugggcaaaauaccaucuuuuucuaaacuucaacaucucauguacaaggaagagugguaguauuucuguccacuauaaguuguucucaaaaaguacaugaaauauugcaucuaaagcaaugaucauauauagccaaagggaaaauuuucagaaugaucaagauaugugagucagagagcaagagagcuuggacuaacagcauaggacuuucagcauaaaugaugaaaauaggacaguauagugacagugccuuucauggcaccaucaucuguucuaugccuggcucuagagaaggaggcaaggagacaagcaaguaucccuaacuauaggucuucuuacuacauguccuuagacacuagucacuacugcuuucaaaagccugaccuaaauuuuaugacaaaaucguaaucaauaaaggcauauaauucauuuugccuuaggaacccauguuuauguauacauuaauguccaaagaugaaauaauaauuccuaacaggcauuuuaagaauuaaaaucaugacuaaguuuucuuuuauaauacuuauacagaaguaggcuaucaaugguaugaucaaaacagucaagagcaaaugaaagauaauuaaauaaagccccccccccaaaaaaaacccauaaaguucggucuccuugaaaagaggaucuucacuuaccuggacaguaagcaaucuagaaagucaucauccagagguagccuggaagacuugcacauccuucugaugucuuugguggguaauacaccuuuucuguauucaaagaaaguaaaugugcuuuuaugaacuguaugccauguuaguaagaguuauaugcuauaggaagggaaauauaaaugagauauauccuaaaaugaaaguaucaaagcuggcauuggaauggaaaguaaggaaaaacaguuauauugcuuuucaucaaugguuuccacuucaggggugaccagacuauucucagaaaagccuuccaagaucagauuccaauucuugguagguaguaguacagcauauuaaagcugaagccauaagugcugcucuaaguaacugaacauuuuuugaccauuagucaaauucauuuugauauuugaaaacaucuccuaauuagacaggcauuuagagccuccaccacaaguauaauaugauuugggcguauuuuuuuuuuuuacuuuuccuuggacccaaacccaacuggggccuucacuuugauuuucucagaaucaagucauguucucuacaggagagccaaagguuacuucacacagaauaauuuccccaguguucucagucaaccaguguucuuucaugaacacacaaaauuagaauccaaauaauaauaauaauaauaauaauaauaauaauaauaauaaugaaaguugguccuuuuuugcaauaaagaugccaagaucuagaauccaaacacauaucaagcuauguauaaaaaauaaucuggagcucgagagaugucucaguguuuaaaaaugcuugcuguucucucagaggcucccagcacccaugauggugacucaccaccaccugucacuccagcuccagaggacccagcacccucuucugacauucacagguacacauacauacagaguaacaacauacaaaaacacauaaaugaaaacaaaaaccuuuuuaaaauaauuuuaaugacuuaguaaaacuaaacacauauuaauacugcauuagaaauagaucccacagaguuucauuauuuuagaaaaagaaauagucccucccccaccccaaauccauagaagauuuauuugcaaggucucugcccuguauauuauaaaagccauaguuuacaaauccuaguuaguaccaaaauaauauaaagaugacagaucaucauuaaucccuauaacaucuuacucuauuuuagucaaaagcaccuagaaacaaaagaaaaugaaagagggcagccuauucauuuuaaagauagaagaucuccucuaucuguccccucuccuauaauuuaagauaguuuugcuaaaaaugcucuuuguccauuuucauaaaaauacauacauuucuuuacuacuuaaguucacauaaacuuaagugauuuauuugaaucaauaaaacaaaacucacuuuucucugucuucauacacacaguuauaaaugaacaugucaaaauucucaaauauauuuuucuugaacuuuucaugggcccgggcaauuaaguaugcuaagucuggauccauaaucucaggcacacgguaguggcgugcaaugguuauaagcuccuggucuaugagcuuccccauggugauacucaucaggauaucucugcaaauaaaguagaaggaacaacauucacaaaaugacauagaagaauauuuucugucuguuaaucagguucaaauuccauuuuauaaaacuuucacuaugucucaggggacaacuauuuuuguuaguuauuuugauacuauuuuccuuccuuugucagcacuaagaauuuaaucuaggccucuaacaugggaaacaaaccuuuuaacauugagcuauaaccuuaguccucuuauuauuguuauuauuauuuuuccuuugagauggggaguuucaguaauuuacuuaggcuggcuuugaauucaccuacauucaaagcaggccuugaacuugagauccuucuuccucagcucccaauuaggucagauuacagaccugugcuaucaggcccagcaauuguuuucuuugacuuaauucagauucuuauaggaacaucaaaaagacaucaacgcuaucaugggaaauaauaagcaucauacuauauagauaaauauuuuguucacuuugagaauaaucugcccuaccuggggauccaucccauaaucaaucaccaaacucagacacuugcagaugccaacaagagcuugcugacaggaggcugauauagcugucuccugagaggcucugccagugccugacaaauacagaaguggaugcucacacagucauccauuggacggagcacaggguccccaaugaaggagcuagagaaagugcccaaggagcugaagggauuuaaagccccauagaaggaacaauaugaacuaaccaauacccccagagcucccugggacuaaacuaccaaucaaugaaaacacauggugggacucaugucuccagcugcauauguagcagaggauggccuaguuggucaucaauaggaggagaggcccuugguccugugaagguucuaugccccagugugggggaaugccagggccaggaagcuggaguggguggguuggugagcaggaggaggggggaugggauaggggguuuucggaggauaaaccaggaaaggggauaacauuugaaauguaaauaaagaaaauaucuaauaaaauuuaaaaaaagagaaaaaucugcaauaacaaaguuaguuguuuaaauaccuaucacuaaguauauaacuuaguucaaugucuugucaucuuccuuacaagaaauaguaacugacuuuggguuucuguuuucccagggcacaggauuuguagcucaauaaacuagaaggauauuuugaagaugggaaaagcaguuguucacauuucuguugcagagcuaggaaucagagcuaguuccuugcacauguuagacaagaacucgauuaaugauuucuagccuugagcuaaguuuguacccccacaacagaaaguaaggaaaaaaggaagggaggagggauggagggaagaaugggagagagggaaggcgggaagugaaaagaacaaggaaggaaggaugaaaggggagaaagagagaaaaggcaugcacaacaguagcuagaaacuuucaauacacuucuaacuaaacuuauuauagcaccuccagaucauaaaaguuuauuuucuuuuucauuguauaaacugaaauuauccuggcuucacugaagcucaaauuuauaucuguugggcucccuguaugcuuguuuuaaauaguucaguaucucacagcauuccauggcuuuaugugaaagcuacacaacuaagccaccccacaguagaaacagaggcccaguccagcucugaagugcugcuuguauggcugcuauagagugagaguugggacuccaccccaggaucuccaccuggauguccaugcacagauguccaaaugguggcugcuacuauuuuacccugcauuucccauguucuucaggauucaaaacauauugccaaacuucagcaaacuuaacaagaaaaauuagaaaaucuuagcaaaauaguauauucuauuuuuuuauugugguacaguauaaacagcauaaaauguaccguuccugacauuuaagauuugaguaaugcugugcauuagaucacccccaaaagcacuauagccauuaagcagcuauucuuuccuuccuccuaccagccuucuccccuaccuggcagccccuaaucagcuuuccgucuuugcagauuugccaauuuuugauauuuccuauuaaauggaaucauauguaugcuuuuguuauuggguucucucauguaacaauguuuucaagguucgucuacaugguagcaugucuaaguacuugauuccuucuuacauuagaauaauaucucauuguaugaauauacuauauuuuucuuauuggcauauucacaaauaccuaaauuguugcuauccuuugcuaauguaaacagugcuaccaugaauauuugugaacaagguuuuguuugaauacuuaauuuguuuauucuuacuuugagauuauuucauaacccagguuagucuugaauucauuuuguaguccagacuggucucuaacucacaauaauucuccugcuucagccuuccaaaugcugggauuacagauaaaugcugucaugcuuaacugggcaccugguuccagcuuggaauacaugcauacucaggaauacaaugucuggacuauacaguaaucaguguuuaagcuauuaaggaacugucaacuuguuuucuucacacuccacuuuggcuuugcaaagccauaaaaacuaaugucuagcuuccaucaaucacagauagcccucaucuaaacaucuagacacccucaaaugaaaacuaaacugacauucuaccucaccaacuccuauccagucacugaagagaaauaaaaauacccuuuaaaaacuaccuaguauguaguucagcaguuaauagcauuuacagcuaucucuugcagaggaaccaaguauauuuccuagcacccacaaacugccuguaacuccagccccaggcaaucugaugcccucugcuggucuccaugggaauugcacucguguguguguguguguguguguguguguguguugcacacacacacacacacaauuacaacuaaagcacacauaauuacaacuaaaaugaauuauuuuuuuuaaucucaccuacuaacucuaucuugauaauuaauaauacuuggguaucuuaaauauuccaauaucaaauuacuuuugucuuuaccaacacugcauuacauucccaguacucacauuuucuacaguuuaauaccauguugauaacaguauuauuuaguuaauauuagaguguauacugacaugauucccguuuuguaacuaaaaucauaaggcugaagaaagaauggcaagcuguuggagaguggugaguuaacugcagaguccugaaccaugcaaugcuaaccagcuugagaugcuucaauuccauuagacucauuuagucacgcaacugggaaucaaaacuucauuuuaaagguuuggaccuuggaauauuuucuuacauauuaaaucguuaaaguuuaagcaaugccuuuuaaguauacuuuuugaaaaacgaguuuuagcauaaacaaggccucaagagccuaagacuuaggcucuaaggccugguaacaaaaaaaucugguugggucuaaauuaaagcaagcaacaguuuugaugacuguuagcaucauuucuaauuucuuucaauuugauacucaucaaauaaaauauguuuuuguuuccucuaaucauaaguuacacauggcugcucacauccugugaucccucaggcuuuccuucuaccugaaggccaaauaaauccccacuuuauuguuauuaacauucccugcauggcauacuguuggacuaugacacugccagacagcagaggguggcagauguaggugacagaauauaugucaggugaaagagagaugaaaacaaaugaccagagauucugcuaaggccuaacuguaguuuaaauccauuuacaaacucaucagccucacuaaagagcuaggccauuaccaucuucacagcuaggcuauaccaucuucacagaauacauuuaugaacauaugcuguuaagugguuuccucaaaagcuaugcaacaugguacccaugccaccgaagccaaagaacuccagaagagaggcaaagagaagagggucacuuaggacuauaagaaagugaucuuugccuuacaaggcgaggaaccuguuuugaacugggaaaugguguaguuuaaugggauugggggagcccuaaacuguaaaauuacucagaacugcauuaaaauuuuaguuccaaugaucccuagugagcgguaaaccaauucuaccuucugagccccugucucuaucagugaaacugggcacaagcaucugugucagagaagauuaguuugcuucaggauccuuucaagauauuaguaugaccaugcuacuauucuguuagaccuuccuagugcuuaucaucucuccaucuaagaagccaaaaucuuccugaugccuccagggccaaacaagccgaucuggucuucuaauauguuccucuuauaacucaucccuaugacccucuaauucuuccccaugcccuuaaccuuccaaacugugcuuccugcucugcuucaaagaagcuaggcaaggaccucuggcguugccauuucuucuagccaugauacucuucucuaagaaauuucuaacagcuuagaccuuggacaucuucucaucuggucagaugucaccuugucuauaaagcuuucccugaucaacccuguuaaaaguuguaugcuuccucuagaacuccaaccucuucccagcuauuuucugcugcuucuauccaucacacuuucgucuaugucucauuuucuuaaugucuuugcacaccaucuagaaugaauugcauauaaagaccaugacuacuugucuauucagugugcuaaaucugcaccacuuuacauagucccuagaauauucuaaucccugcacaauaaauuguuuguuaaagacaugaaaaccuaggauuaaguuagaaagcuaugaaaagcaguuagcauagugacuggaaugccaaacgauaaaugagagcaaauuuuaguauucacauuuuauaauggggauuguuucaagcugcauuaaaugggacaagugacuuuucuuaaguaaauuuaucuuggaggacagggaacuauuuuuaaugacuuugaaaucucagaacuugucugcagaauggcuagggaaaauggucugcuuguuuuaaauagucauauucagagaauaaguauaaagggauaaacuaacaagcuccaggcaggccuuccuuuaucuacuggcuagaucucaaaaccacaccaauaagaaauuuuuagaaaucaaauuagaagcacucuuucauuucuuguuacacauaaggacaggcuaucuucguuuugguuaucuguauuuggcaguggcacccaacauuguagcugcaaauuccacccauuucugucaagaucuuaacaguaauaagcacacugaaccuugaaauauauccuuuugaaaugaaagaaucuuaugacaguauaauuacugccaaauacaugugcuuuguaaaucuguuuuuuggauauauuuucuaagagaggugcaucuguauugaaaaucauugacccugauuucuuaauccaaauaacuguaagcagccucuuauuuucucucuauuaccagucucaucucauuucacaucaaaugccauggcuuucccuguuuugacauggaguggaaugaauguacaugauaauuuuaauuuauuuaguuugaaaugcacuaugucuuggugcacucaacaagggcuguuugaguguagccaaacaaaaagaucuuuucaugcaguuaagagcaacugcuguacauuauuaacaccauauucuucacagaggcauaauuuuagacagccuucaaaacauucagguauaauuccaccauuugggacaaagcauuuaaaugaauugaguugacagugauuuuuguuguuacuguuucuuaaauugugugaauauuucuuuuuuggaaaagcaaauggaaaucugggagaugaugauuaacuugcaguguggguagaaacggauaaauaagcauuucaauuuuuagcaaaggccuuguuuucugcuaccuaguuucccugagacuauccagugcccagggaucauuugucuccagguaaacacugcuuacuuggcuuuagagaaggaagagucuugcuguauaucccagccuggccucuacuucccaauguuccugcuucuacauuccaaaaugauaaagugacuagagggaugaugaccccccacguaaacccuguacauaagcucaauacaacaugggggccaauacccucugugugcuuauaaacaacucagaaguuuaacucccugcuaucgaacaagugcaaauaaaauaaucagagucuuuuucuaaaaacuuuaguauaaaaugauauuuacaauuguaaagaauuugaauaauauauaaaaauaagauuuuaaaugggaaaaugggggcugggguuauagcagugaaggaacaaaugcuuagacuacuugauguucucacuguaggaagaacagagagaagaagggcuggagaaagggagauggaagagaaggaauaaaggaaggaggauauauacacuccuggcacuucaacacaaccaaacaaaugcacgguacacuacuuuccaaucuguuuucuauauaggguuuuucucauuauucucuaaauugagauggauauauuuuauaaccuguuuuuuccucacaaauacuauaacauuucauuguuaucagucuucccacauccaaauauuauaucauuacaacauuuuaauaauuauaaaauauaauuauuuuauuuuauaucucauggcuuuauuucaaauuuuacaaacauaaugucuuaaugaguaccuguacauauaaauauucaucuaugcuuauaaguucucccuuuuagaucauguuucagaaauacaauuuuaagcgcaaaaaaauggaacauuuuaaaggguuuucaucugaugcucaguuacauccacccuccuaugagcucauagcaauggauacuacucacuuuauaauaauuuuuauuguuugaaauuauaauauaauucccccuuucuucccaugcaaaugccucacucucaaauucauggucaauuuuucuuucauuuuucuuucauaagggcuaaguggaagaucaguugaacgguacuaugcuucugcuauagcaacccucuaaauaugaauucaacaugaaaaauaaugccauuuuaaugacuaauugauaaauaagcuuaaauaugucuucuccuauuuguuagaaaauuauuuuuauucugguguguucuagauacauguauuugauaugagcacauuucauuaacaaacuuugaacaccaaacuucuuagcaaaugacagagaaaaagaaaggaauggaacacacuuaacuucuggcucucacuaccugaauccuagaguuagucacagccuagaaacaaugccaaguaaaagaaagaaaaacaaacuguuugcaauaaaagcaugaccggaaccucagagaggguguccaucaucugguuuggcacauguauacacacagggaaauucagaaagacaucacagaagaaguccgagaguagcagaccuugagggugaauggcaauuugcuaacuagggaaguguaaggggagacaggaaugauguugggaggaaaaggccaaagaaacauuuacuucaaaugaaaauuucugaaagaaagcaagaauaugacacacuagaagagcuguguuaagaauccuugaaggagacaagagccccgggguacugguuaguucauauuguuguuccaccuauaguugcaguucccuuuaguuccuugggugcuuucucuaguuccuccauugggggcccugugguccauucaauagcugacuguggggauccacuucuguguuugcuaggcccuggcauagucucacaagagacagcuauaucuggguccuuacagcaaaaucuugcuaguguaugcaaugaugucagcguuuggaagcugaucaucggauggaucucuggauauggcaaucacuagaugauccauccuuucgucacacuuccaaauuuugucucuguaacuccuuccaugggaguuuuguuuccuauucuaagaaggggcaaaguguccacacuuucgucuucguucucuugaguuuaauguguuuaacaaggccaucacuugaaagagaggccuauuggacuugcaaacuuuauaugccccaguacagaggaacaccagggccaaaaagggggagggguggauaggggaguggggguggguaugggggacuuuugguauagcauuggaaauguaaaugagcuaaauaccuaauaaaaaauggaaaaaaaaagaaauaaaaaaaaagaauccuugaagguacuuuuuucuuuuuuccccccuucccgaaaguacucuuuucaaguacgucaucugcuuggaauaauuuacugcccacagcaauccccucucucaguagacuuugaaucgccccaucuuaucaaugaaacacuaaagcccagggaacuucaguaaguuggucaaggauacacacauaguagucuguagagccaagguuugaaccaauauugucagaguucuucagauaacuaggcuacaguggaaauaaagcaagagaucaauuuagagaucugaccaguaaggcccaaucaguaaaggcaugcauguggaccaugcuaugacaacccaguuuucuucugcugaucaaagaacuaucuugaagagugcugaacaagacaauaacaacagaaugagacaucagaccacacacccaagaagccauaggaaggaaagcccaccacugaacacugcauagaaagagagaaggugagagagaagauuugagacauaucaacuagggcugcauguguuuuuccuuggaaaguuaggggaagugggagaaaagguagagaaaaauauacacaguaacucugaaagaauuccugauacauguuuaauaucuauaauuggaaauggucaaaccugaaguacuccaaaacuuuauuuauuuauuuauuuauuuauuuauuuauuaaauuuugugaaacagcauuuuucucuguguacagcccaaggugucauggaacucacucagguuuaaccaagguggccuuaacucacagagaucugucgccucugccaccugaguuccaggauuaaaggcauguaccacuacuucccggaaaaauccaaaaauguaaaagcauccauucagugcucaacaugcuauggauuuugguacauuucagauuugaggguuggggauuaaagauagccaacugguaaagucuacauaaauauucccugauauaaauagcuguaacaucuaaaaugcuuucuggucccaaauacuucagggccacuaggggcucagggggggaugauggugguugaauagaggauuucuucuugcugucaccuuguguuguucaguuuuucaugaauuagauguuguuaucugcuaacacuaaucaucuuagugguuugcucauaaaaucugugacuuucaauuuuacuguguaauaacuugaaauugccuuaaaauauuucaaaucauuauuuaccugauuaucaaagacaaaggugagaaauaauuauauucccagaugacacgggagcaguucagcugucuuccugucuugguaauuuuauuaguagcauaaacaauaguaucuacuuuuaaacuguuuuaaugacaucauucaccuauaugaaauguuuuaacuuucuauuuccauguacagguauacaugugucuaugaaaccugucugaauggucaauguugcuccauuuauuaaagagguccuuuccccuugaguucuuuucauuuuucuccccaugcucucuauuuauuaacguaaauuuuuacuuggaacaauugcuugaaaaguuguuuucauuuucuugaaguucugaaaucauuucuuaugacccaagcauaaaaagagcaacuuguccccacuuuguuuacccucagagcacugaagauuugauccugcacauccuucuguuaccuacagccacaguuuucugguuuucuaggucaauggcugugcugcugggcugcugguucuaugcccaucuuucuuugauguuuguaagagucuuuucuauguccuuuuaagccccuaccaagguauagugaucucuuuucuuauauuuuccuuggacagcgaauucuccugauuugcagauacacccucccuuucagcuuagaaaaggaaguccuagaaacuggaggaacaauuguucuaugaugcagcauauacuuaccaugggcuaaauccuagauucuauccauaacacuccccacaaaacagaaaggaaggaaggaaggaaggauggaaggaaggaagaauggauggauaugaaggaugauuugcuauuucauuuuuuccauugguugccucugucuuuaccuacaugucugcuuucuucauuguuucaauauguguauuugguaugauucugacacuaauucccugguuuacuuucucauuuccuuuauuguccaauucuccauuagcaucucagggcuaguuuuuaauuuuuaaaaaaaaauauguacuuuguaggcuuuaaauaggacuuuuccuuauuuggucuguuugcuucucaaaaugcuauauucuugaugagacuguaacacaaacaaacacaccaaauuuucauccaacaaauuauuuucagagucugcaugagaauacaggugcuauuuuguuguuguuguuguuguauauauaacuuuacaaagauguguauaaaauagucuugggugcucaugggucacaaaaucccguagacucuaucuuagaugguaccuauguacaaaugugugugugugugugugugugugugugugugugugccugucucugaauauguguauaagucuauaugugaauacauacuuggagugguuaaagaaagaaggauucaaucaauccuggccuaaauaaaugugccaaaucagcaggaaaagaaaucacauaugcuuaugggaaggaaugcuuuuaacuuggagauugugaagccacauuugggcugaauguucagaaagaaaaauaaagaggauaaguagcagaauaaaucugaagagccuuguccaaauacuuuaacuccuuugaacucuauuauauuucuuaaguagugacauagugcuaggauccuauagcugauuuggaaaugugcuccauugauaacuagucaucaaaguaauuaggucuccuauaccaacauacaacuccaaaaaggacuaggaaccaaauauaucaaaaggcuagaaagguggcucacugguuaagugugcuugcuguucuugcagaggaaaugaguucaaauccuaguagcuacauuaggcagcuuacaacuaccuguaacuccagcuccaagggaucugauaucuucuggcccuuguggacaccaacauauauguacacauauuuacacaaauacacacauguacacuuaaguuuuuuuaaaacuuaauaacuuaaaaaucuauauucuauccuauccguagaaaauuuucuucauagacaauuuccaaauuugaguuuucuaugaagacucugagcuuuggaaaaugcagcacugggcuucagacucaauuauuugaaucagaagucacagauacaauaaaagccaaccaccuacauuuugacaguagcugcaacguuuaaacuuuucaacaauaaaagaaauaacuuuuaguauggauaacuuaaugagaacuuauuuucaacacacugugcuuacagacuauguaacaaaccuuagcauguaaccacaaaacaugucagcccgaaguacaauaguucuaaaaguaaaagaagccuuucauaugccaauagcauccucucuaaugcauuacaagacucucuagcaaacauaaaacaaauuuuacuuauuaguauuuuacauuucugcuuauaaaaagaacaaaaagugcauguaagauggcucagcuggcaaaagcacuuacugcauaagcuugaaaaccuggguuuacucuucagaacccacaguagaggaagaaaaccaacuccuaaaacuuguccucuaaacucugcauucaagucaaggcacuuaugcauccacacucaaaacacauguaaacacacacacacacacacacacacacacacacacacacacacacacacacacacacaauaugcuuuuguauggggccacaccauaaaucucuggcugaguucccucugcguccugaguacuaggauuaaaggcaacugccacuguauccagccacaaugauaauuuuucuaacuaaaaaauaaagaacaauaagaguaugaguggauuaaaauaaaacaaaauggggaaucugguugucagucaugcuuucuuucccauuucagggaccagacauauuagcaggagugaucaucuuugguaagaauacuuucauaguucuucccagaccauugaacugucauucagacucuccaauuuaaauaaagcuuauuugcugcaacaaugccuagcuaugaccauagcugcuugauacaaaaacuacugcagagacaaauugaaccugcagagcagcaucaggaaucugucuauguaaaugggagaugaugaugugaaccuuuucuuccagguuuuugugauauauuucauuacuccacucaguacuuaacucuccauguauaugugcucuugucuauauuugaugucccaaucuauaaaagggcccaauuuucuuccuucaucuugacaauggaguugaucacaagacacauuuuugccaacaaaagaacauagaacucaaagugugccugagucuucaagaaggcauccauguuucucauucucugauggcacuuuuggcucacgaaaaugccuguccaugaaccugccauuccuuagaggacaguggcaguugagggguucagcaggaccuggcugcagccaucuugagcauaacucccaugccugucucugagcagcccuagucuguuuucccccacagaguuucccagcacacuauaaauagacacaaucauuagagugguaugaggagcuuuacgacccagacuauagcaccacaaauauguaugacaucuaagacacgagcuugagauaaaccagguacauuccaguuuggaugaagucacuuuuguccuggccauuauuuaagcccccuccuacuaagucauaaugcagggaucuaccuucuaugcuacugccugagaaaucuuccuguauccaagucccccaauaaauugcacuugacaauccuggauaagucuuccuuuuucuuuggucucauggaaccuugcaguugguucucauacauuaggaccauaugaaacaaagugauauuagcuggucccaauucaaaccaauggacacccagcagaucugugagcuaagagaaugcauaucuggcacaacacugaugcuuugagaucauuuguuacauauuggaauuguggcuaugacugauuuaugacugauugauucauucuaccaugccccacacucugcauucuucaaccucaggaaguuggaaggcuggguuaugacacaugaugcugauagcuuugaccaaggagcaauccuguaagaagccuuuguuuucuucagaguaguaagaaauagccaauaggagcacaucuuuacauaucuagcaggcaagcuacuaaaauaacaaaauaaccacucaucuaccaucuaccucucugugagugcuccgaggaaaaagguuuugcuuuaauucugcacuaggauucuuuauccucagccacugacuuacuguugcuucagaaaccucaggcaucacguaaauauucucagucuccuauuucacacuacuaccuaagaugcucagagcccaagcuauggcucugacagcuaacaacagugauuuuuagagucuauaugcucugugcaccagcccauuucugaauccacugcuguuuccuaguuucauuucuauuucuuuaaauguuuuauaagaaucucccuauuuuauuuuacuucauuuuauguauaugaguguuuuauaugcauguuugucgguacagcauguguaugccuugugccugugaaggccaaaagggugucagauccccguaugaagcaaagugacauuagcugggcacauuaguuacauuaguuacagacauuagucuguaacugaaguuauugacuacuaucaagcugucauguggguacugggaauggaaccugaguccucuugcaucaaguauuauuaaccucugaguauucucuucaucccauuuuguuuuuauuacuuguguauccguuuuaugguauaaaacugccuacauauuugugacacauuuuaauuuuaaaacaaaauaaguacuggagaaauggcacaauaguuaaaagcacuaguuguuguuguagaggacuugcauucaguucccagcacucacaugguagcuugaaacuaccuaauaacucuaguuccaaagagcugaugccuucuuuuggccuccauguguaccaggcauagguucagguaacuacucauaauauacacauaaaauaaaaauaaauaucucaaaacaagacaaaauagaaacaaaucuaagaaucaauacaauaacaagaaaaauagaagggguauauacccaagcaauuuuaacaucccuagcccuauuuuaaauagcagccuucuagaaaacacagacucaagcaaauugacaacaggaaaaacagagauuucaugcuuccuauaucuacagucuaacuuccaugugacuaauggaaagcggaagugaaugaaacuaacagcauggcuaguuccuggcuuggugcuucacauaccuuaauucauguaauggauucaguaaccucucauuucacaaaugaagaaucuaaggcacuacaaauaagaaccuucauuagaaugaucuaaaguucagcauaugaugcaauugcuaaacugcaucuuauaaauccaagauuuauaacuuaaugugaucauagcuagcacccuaaccccccugucuucuuaguuuucuuaccuucaaaauaggucaucauauaccauuuuuguuagagugcucuauaaaaugaauauacacuaauauguauaagcauuuucuacaguguuuguuauauaguaaagaauuagcuaccaucaguaguagaauuaauagaaugaacugacaaaauaauaaccuucagguucauuaagagacucugucucaaggcaguaagacagaaggagaggaagauacaaugcccuacuaagcuuuccacauggacacacauagacaugcacaucagcauacugucacacuuauaccacacauacacacacacauauacacacacgggcaugcuaaugcauacacauauauacaaauagaauuacaaacauuaugugagugaaaacaauucauauuguaccaccagagggauacucacuccgaaacacuguggaaaaaaacaaaaacaaauuugaagcccccaaauaagcagucuaagaccacagauaagcugaauccucucaaggacacuauacccaacucugaaccucucacccaacaggaggucuucuaugcauaacucauaaacacccaugguucaacauaacacugaaaagcaugccaucacacccaguaccucaugacugcaaaacuuacuugcauauaaggcggccaagcagauccugcucuaagguggcccuccugcucuaaguaaccucuuacuuuauacccucuauuuuacaucaugacucuuugucuggggaguuacaauuagccuuugcuuacuguuucaaucauuuaaaacauaaguuggacuccaauuaaagaaggagcauggguggcacuaacagggucauuugcaagcaacuauguggucacauagcucccuugcuuugaaaucacaggcacuucauuuagaaaacuggccauacuauucaauaaacuguuaucaacaugucuucucucuccaacacaaagaaaaaacaucagaugauaacuagaguuaaaguagaacagcuacacaauauuacuacacauuucaugagaguuuaugaugguucauugaauauaaaacaaaacugauaacuuaguuuugguuugccuauuugauugacuauguauugagagcaaauacuuuuucaguuggcuccauaauaaagccaucauuggaacuaaacuguaaaauugaguuugcauuuauaaauaaguuucacauauagagagauugauauguauauuugaauacauauauuuacuuacuacuguaaaaaugugugcgcauaaaaauguggaaaaaaaaaaaaaaaaaaaaaaaaagaaaacuggccauuaccacguagugauucugcauaaaauaguuguuaugcacuguuaaugauuuacccacucccacaaggacauaaucacggaaaaaagaaauaaacacaauauaaauguauauguccuuguacaacauagcacaagagcuggcguuuuuuuuccacucuuuuuuuuauuagguauuuuccucauuuacauuuccaaugcuaucccaaaagucucccauaccauccccccacucccccacccgcccacucccacuuuuuggcccuagcguuccccuguacuggggcauauaaaguuugcacgaccaaugggccucucuuuccacugauggccggcuaggccaucuucugauacauaugcagcuagagacacgagcucugggggguacugguuaguucauauuguucccacucuuuagaaacaagaaaaaacguaucuguuuugguacaauauuauaugguuuauuuauucuaacaugccaaguguuuuuuccuacuaucccauaaaacucgaguugauaaaaaugaacagucuuuuuaaaaagaaagaaaaaugucuaggaguaauuaugacuuuuaaauaggggcgcucauuuuaaccaggccuauaugaucacuaccaauuccacuucagcauccauguuaguaauaauauucuaaaaucuaagaauaaugugucuagucaguauauucucagauguaauuuuagagagcauuagagauugugugugaaaaauuauagaauaggcagcaauucaaacucauaguugaguuugaaagaaaacaggaaucacacuagggauuaaagcaaaaagggaucugauggccagagaagaagaccagcaacuuaacagcuagggcuauauguggaaccaaacccccuaaauguaugagcuucuaucucaaugguaacucaggcauguaagagaaggccuuuggacauggagaauaaaauuuguaaccucuacuuauggaaucugugcagaaagcuaguacuacaaagaguaacauuugaagucaaagauggcuuugaacuguuaguaagcuauacucacuggucuagaaguguaauagugaaauauuuuuugcuaagucugugcauguaaaauacacacacacacacacacacacacacacacacacgagcuuuuauauaauacauaaauguauuuauaugcauaaaauacguaaucugcuagaacucaaagccauuauuuuggguauucagaauuuggaguacuaauuuguucuuaaagcuccacugcaauaaaguacuaacaaaauuaaggugaaaucuaaccaccuaauuggcauuguaacugugucuucaaaaggccauuccaucuaucagaccagcugcuucagggugauggggaacaugguaagaccagugaauuccaugaucuugggccaacuguagcacuucucuggcugugaaaugaguuccuuggucagaagcaauacuguguggaauacugugacaauagauaaggcauucugugaguccauggauagugguuuuaguagaggcauuacaugcaggaaaggcaaauccauagccagaagaaguaucuacuccagaaagaacaaaaugcugucuuuuccacggauuaagugguccaauguagucaaccugccacuagauugcuggcuggucaccucgaggaauggugcucaguguugguuucugcugcuggcagaucuggcauucagcagcagcuguagccagguuagccuuggugaguggaaguccguguugcugagcccaagcauaaccuccaucucaaccaccauggccacuuuguucaugugcccauugagcaaugacagggauggcuggggaaagaggcugacuguauaugcuggcuuagagaggcaaaagcaaaaccacuuugaaaaauucuccuucuggacacuaaaauuugguguguuugagaaaauaugauauuugcauaguuuccaaguaggugucuucggguauuuauuagccacaaaagaaugauaacaaagauggucauuuuacaaugaagaaaucuggcagaaacuaccuuaaucaugugaucaaguuuaauaucaccaggagguaagacauuuauuguuugacaccaggaacucugacauacuaaaaacgagaaaacuucauuucuauaguauauucucagucuaaacauaagaaaacacucuacuuuaaauugaagaacauuaguguuaaggugcuauguaggaauuucuuccaaauuuaaaaccucuuccaaauguaaaaccuuccaucuuagagggaagcucauugacacagaauguuuacaagaagguaaacccuguccuaaggaggcaaaacauuccaugcuguaggaaaaccccuuacgcucaggaaguaaacaaccaaaauugcuucaggaaggcccugacacugaccagagucccuauuaaguaaagcagucaguaaccugagcuuccuggaaggagccaagaagagccaaguugacuggaagaggcucaacuuaagugaacuaucaacagguuuuguaacucauaccaggcuuccaacuuucuugagcugugcuggguuuccuaugauaguacagcuuucugugagucauuucuguuccuauaacuagucuccuacccauauauuucuauaaguaacccaauuaagcuuugggcgucaguggucuauuugcacuuuggucugucauugguuugcugccgggguugaguagacaguaacucccaucuccccaggauuagugucauaaaaauaaaacgaggaaaggcugaauaguuguuacagccugcagaauccuaagaauaaacaaugacuaaauacagagugggacccuggaaaggaucuuggaacagaaagaaaaaaacgacuuuagucaggguuacggggugcagcgaucuuuaaauaaggauuuugguuuauaguacuaucccaaaauuaauuuccuuauuuugauaauuaugccauuuaggauguuaauauuagggaaagccuggggaaggguauauggaaguucucuacaauauuuugaaaucuuuccugugaaucuacauaguucaaaauaaaaggcuuuuaagaacuucucuuguagagccaaccuaagcaacaagaccaccccaguggaagaagaaaguaguuucagaugagcuuauaaaauauaaaaggcaacaaaccuccauuaguaagagucagcagauguaagagaauaguuaggauccccuaagugcgggucaaaagaaggaaaauuagcaauaacccccaauauuaugguuuuaaacuuaucuaaaauauaggacagagaaacaauaaggaaagaaugaagaagcagagggauggcucagugcuuacaaguacaugcugcguuuucagaugauccuuauuugguucccaguacucuaguuccaguggaucugaucucuucuggcauccuuggccacugcauacauguugugcacagacauacaugcaggcaaaacacucacccacuuguaaaauaaaaacucaaaaaaauguguaaaguaucaugcaacagaacagaaacauccacagacagaugaugguggcugaugaacaacagacagaugacagagugaacugcacuuaaagaccaagaaagcacagccauggaaaaauggaacuccauaagagauuucaagaaaucaccaggaaugcagcacagaagggaaaacuauaugaauaaaugugugaacagagagacacuaaggcaaugaagaaagacugacagcuugagaagcaagacagaaaauaaaaaacagaagcucuuugaagggauauauggcauggauuaaaauaauucucaaauccaaggauuaaaaauaguuccaaggcaggcaugguggcaauguaccuuuauucccagcacuccagaaguagaguucuaggacugaacgguuacacaguaagaccgugucucaaaauauaaaaauuaaauguaaaauaggcccaagauauauucuaguuaaacuacagaaagcuaaaggcagaaaacagcaaccagacaaaagagaucaaauggcaacaacagagcauucaugugaaccagucauagacaaacuccauggugcaugcagaaaaaugguaaagcagaaucuucagaaacucaaaggaaaaauacuguaggucuagaauuacuugcuuaaaauuaaaaagagaaaaagaaauguguuucagaaaauaagggcuuuuaauaaaugugaugaaucaauaucauuaaaaacauguuuuccagcuaaauaccauaaaagggaaaucaagaacuaaaagcaaaucucauauacauuuagaaaauacaaaauucucuuucauuaauugaccaagguacuagagaauauuuauggcaaaugcuuagugaauggacgcuaauguaguacuuaaaagggaaauuaaaaucuuaagugaauucuuagaaagcauuaaaaaaaucaguaaaaacaaauacccaaaacuggguaugguggcauauaucuacaaucucaacauucugaagacugagucagggaauccauaaugaguuuaaggauagcccagucuacacagugaauuccaaacaagccuggacuaagagugagaccuugucuuuaaaaaguaauaacagcaaaucccugaaaaaaauauacucacuauucuaaaauaaaaauauguaauuaaggcaagaaaagaaaaaaggauauaaggacuuaggcaauaauaauaauaacugcuauuauuauuauuaacaguaggaaugauaaagaaaauaaguugcaaauugauuuuaaaaaacaagaugcauaaaucaacaguaaaagggcuuaagagaugacaacuauaagauucgagcaaauggaaguuucagaaagcuauauaauuucacaaauaaucucaagaggaaauagaaagcugaaguaggauguaacacacucccagagugaaucauuagguaaucuacucucugauaaaagggaacaucauaugauuugacaggcuuuagauaaaccuucaaagaacugacaaaugccuaacuuuuauaaacugcucuaagaaaccuagaagagauaaauccuauauaaaaucugcauuuacucaguaaugaaauacuguucauguuccuguaaagucaggaaaauuuucuuauguguugcauugcaggcaauauaguaagaaauaaugcacaaggacuagaaagaagcaaacuugucccuauauuuuacacugucucaaauuaacaccuaagauaaacuacagaauccaugaacucacaaaaaaaaauaaagaucuauauuuaaaaaucaauagccuuugaacacaccaacaaaaaccaacuagaaaauccaacuuuaaaauaaaauuauaauagcagcaaaacuaaaauauuauaaaacauauauacuauauuaauaaacaaaauguuucuguuucauagugacucaaauucuguccucaaauauacaaauucaacccaagucaucaaaauucaaucaaccuuuuaaaaacauagaaacgguguuuaugaaauggacagucaaaugucuugaaggaaaauuccuuugcuauauaucaucaugucucauuaauauagacuauaccaaucauccuugguucacaaaggugaagguaaguuucuauggcuaaagauaccaugcacuucagaagagccuaguaguuccugagcaguggucugaauaacugcccucucugagguuuaguuuccucaagagggaaacacucaacagcccuaugaugccuaugaaccacagcaaugaccagcaugguaugauaacuuuaacaguacaguagcagcauacauaucucaguaguaaccagcagcucccuaauuggacuucaggcuaccucaacaagagagaaaucauuccuuguacugaaaauuuagcuggugaauuaaagccauggaucuuggaggagaaccuacaacuaucacuuuacuaaaccagcauaauccaugaccacacacaaaauauuugucauaguuuucauuuuacuuaaagauagguauagucuucaucccuccucaaggaauuucuccuuacaacagauggaaaccauuucagaaaaccacaaccaaucaaaaugaagaguugugaaguucaguccuaagagaaauaucuauagcacaacaauaucaaaggguugggagucuccccacuaacagccuagauagaaagccguagaagagaacucuuaagaauuaugauaaagaugcugaagugcagcucuccacaauggauaguuucaggcagagcuguagguagggaaagacacugggcugggcgcugggaauuugaccaugcuccacugaguauauagacaauacaaauuggauuuuuuuucuuauuccuuuugggggggaugucaaaaggaaauggauaugggagaacaagaaaguaaguaugagcagggcucauauuguaaaauucccaaaucaucaauaaaauuauuaugaaaauaagucaaagcugaggaacagauaaguugguccagugauuaguuaagagcacuugcugcucuuacagaggacuggguucaauucauacccccucaggcaucucauaaccaccuauaacuccaaucccagggaauugaaugcccuuuuuugccauuaucaagcaccaggcauacacaugguauacauacauacauacauacauacauacaugcaggcaaaacacucauacacauaaaauaauaaaguaaauaaaucuaaaagccauuuugaagugaaagcugaaaucaaggauauucuauucauauucagauaauaauaaucugaauuaucuaauuauuaauauucagauauuuucauaugagaauaucuuggacauuucaauguagcagaggauuuuuagcaacaauguaaaaaagucaacaauuuagacuuggcaacaaaaaauaagagaucaaucauuuuucagaagucugaaaggguuaauuguuuguugcugcugcuguaguuacuaaacuuuugagaaaggucucauauauucaaggcuggccuaaaacucagcauguagccuauagguggccuugaaauuuugauccuccgucuccauucccaagaguugcuauuauaagcauacaucauuuugccugacuggaagguuuguuuuuguaaaagaaaaaagaaaaaucaaacaaaguaaaaccaucacuaaaagacacuugccacuaagccugagaaccaaaguucaauccuugaaacccacaugaugaaagaaaagaagcaacuccugcaagucuccucugacugccacauacauauugugacaugugcauauaugcaugugugugcacuugugaacacacaaaaagguaaugauuuuuaaaaguucauauacugaauaguauaaaaugaaugcaaaauaucaugcugaaugaaauaagccauaaaaguacauauuguauauuuccauuuauauaaaauucuggaacaggaaaaaucuaaaaagaaaauaucaaaacaguggauauuuccugaaugggauaugugaauugagauggacugggaugagacaugaagaauuucugggauagugacaauucucuauuucuuaagaggauguuaggcaguuacagauauauacacaugucaaaacucaguaaauauacacuuaauuuuguacauuucaccaaccauaaauuuuacaucaaaagaaaaugauguaaauaaaugauaagcauacagaaauauuuaaaggaaagaaaucuuuauacaaaaaauaaaagggauuaagauaaauggauacagugauaagcugccuccuaaguucuuaucuuuauacccauagauuagggaauccaucacccaucaucagagaacuuccuuuuuauaguaaauggggauuaauacaaagacccacaacuggucaaccaacaugcagagaauaaaagacuauggaguacuggugucuaaaugggacaucuaauguaauauucuccccccucaagaguuagggaucauugcagacaaggggacaaaaauauaaagagccaggaggaguagacaucuacaacaaaauaguauuugccaaacacaauagcacagaucgcacacaugagcucacaaaagccggaacugcuugcacaagaucaagacagccaaccucccagcauggaucagggaggagcucauacagucucacucuagauaaagagcuauuggcaauugaugguugcugggugaggaagacugacuuuucuucacggauguagguccugaaaggcuacugcgcaugcuuuaguagaugguaacacagccaugaauaaauagguaaugcuaaauggacucagugaguaugaaagagggcuaggggaaagaaagaguagagaaauagaaaggggaaggaagcacacacaugaaguugggagauauaagggagagguaguuuagaaacuggaaagaggggaauggggaggaauuucaucauuauauaaauguauaaauauuaaauaacacauuuuaaaauaaaauaacuaauaggaguaaauaauaaaaugaauuaagguuuaugggaaaaacuagggggcacgugccuuuaaucccagcacucagaaggcaguagcaggaggaccugaguuugaggccagguugagcuacaaaaugagucccaggacagucagggcuacacagagaaacccugucuacagaaaguaaaagaaaagaaaaugauauauaggaaaaugucuaaaugcagagauguuugaaaaucuuuauaaaauauuacauuaaaaggguaauaggucagauuugggggguuaaucugauaagaaugugaaaacuaagaaaaaaagcauucuaucugaaauuuuaauuuuaaauaucuagaauuguauaaucaugcuuauauauaaaauuaaucuaucuugauaacauuuguauaugcuuuauugaacuaauauauaagauauaaaagauaggugaaaaacuguauuacauagaacuuguucauauugaauuuugauccauauaagaagaaauaugauuucaagacaguucaaagucauggugauauugauauagagacuggcuguaagaauaaauaacugaucguuuaaaagcaaaaaaaggccccuauguccuguaguauaagaacuuuaagcacuuuaacauuaucugacucuaaucaauaaucagaagagaauauugaccagaaaaucuuguaccuggcuaugauucugaaaccuuugacuuuugaccagagcauucuguuaguagcaucuaccacuaguucuuucuggaaacuguaaacaagaaguaacuuccugcugcuuuuauucccugauauuauugaauauuuuacuacuguagcuuuacuuaacuaacccuggaauacucaucauuucuucagauguacauaucuacucuguagcauucuuaauuaguguagucauuaaaugacuaaggaauacaaaugccauauacuguaccuaacugucuacaauuggcauucugauuuuucauuugcuauuauaguuuguugcaaguaaguucauguuuaucuacaugaauacaagcacauguguauacacaauccugucaauacuuuaucaacccaccugucaaaaaagcuuuaaaugaaaaacaucuccaaaagucuaagaacuagguaaagauuccaaauaucacacagauacugccaauuauccucuagaaugaugaacuaacuuacacuacaaguguuagaacaucuguuccccagcauaccuaucuggaguuagcaaaaucuauucuuuuuaaaugguaggaauaaucuggauacagugguauacaccugaguuccagucacuugaaauguugaggcaggagguucaugagagcccaagagacaaagccagucugggcuacauagcaagaccuugucuuaaaaaauauuaaaacuacaacaaugccaacuucagugguauaucugauuauuuuuucaccuuauaucagcauuggccaccuuugccuaaguuuaaaggcaaaguauuuguuuugugaauugccuuuucuugucuuugaucuguuccuaucucuugguuuuagagagacuuuucuuuuuuaauaagucuuagauauuaaaucuuaugguucuuauacaauuuauaaauauuuucucuguccaucucauauuuuuuagauacaaacacacauuauagauacauacauacauacauacauauauacauacauacaugccuggcauuuaauauuuucucuuuugauuuuuagaaguuuuccccaacuacaaaauaaaaauuaugcuuuguaaugaauugucuccaaaauuucuacuacuaacccuuuuccccacugauuugaaauauccuuucuauccuauguuuaagaccuuaaaugugaauauuuuauugucuugguacuuuauuuuauugguacucaguuuauucuucugcuaggaaacuauguuuuaaaauaccuauaaauuacauaaucccugaauaucuauacucuaauauucuuaucaacauuuguuuugcuguucucaauacuuuaaucauuccuaaccaaugcgccaacuuguucucccuaauccugagaaaugaaaucaaacuuaauaacagcaacaauauagaccuauuauguaauucugauuagaacugcuuuaaauuuacagauuaauguaaacagacuagaauuuuuacauuaucauagagaugguauacaguuuaaaaaaauuguauuccucuugguuuugcuuauuuuggacccaaugcauuccuaagaucugauaacuuuuguugcuauaacaaauagcauccuucugagaccauucccuagcuuacuauagucaauaaaaaauaaagcuacuguuuugugcauaauccuauauuuagcuacuugccugacuguucuuaagcauuacauuuuuauauuaauuacugaaauucuuaaguauuuauaauauuugguuuccaauuaaaaauuuugucuuugcuggguauggugauauacaccuguaaucccaguacuggaaggcagaagcaaggaaaucucuaaauugaaggucacccugaccuacauagcuaguccuuugccagccagggcugcauaguaugaccuugucucaaaagaaaaacaacccuuaaguguguaauuagauggacaaaauaaaaauacacuguguucauguaugacaucacaaaauuaaaaaugaaccaagucuaaggugaacagguagcaguaggccacugcugauuacuauauaaugucuauuucccaacaugaaaagagagagauaacauggguuuugaugucugauugccuccuuuuaaagcauuaaacaaagcaaccaaagaaaaucaacaccaaccaaaauaauugcuaguuuucaauuuuugagcuuggaucuaugcuaauaccaucauuuaagauaauuuaaauuuagguucucaaauacugaaaaaaauagucaagcauaggugaaggcuucauauccuuuuuagugugugaaaacaaaauucucaagcaauaaaacaaggugguuugguugguuugcuaagucuaguucagucccuaauauuaacauauauuugcauggccuguuuggcuccuguuagcucggauuuuccauccuuacagaauguguggcaaugaguaagaugucuucuauauagcuuuucauuuguuuaccuauaaaguauaauugaaaauaaaaaaguauauaguuauaugauguauacugugaaaugauuuaaauguaguaauuaaucaucaacuaauuuacaguuaccuguguacaugugugcauacauguauguggggguugagaauauauaaaaucucaacaguuuccaaguaauuaauacauuacgauucauuauaaucaccaugcuauacaauagaucucuagaacuuauuuauccaauuaaaacuuuagacaaacuuuaaguaaucuuucuucauuuaaggaaauuuccacauuaaauuguuuguuacaggcaacaugggagucagagcucaguuuuccagccucaugagcaguuagaaauaugcaggugacucacauucuacgaaucaagaagcuuacaaaauauuugucucugacgagaguaacacaagaaaccagcucaggcaagccacacuuaguaucagaaggggccgauuggccagacugacaaaaggacucaagguagugaaaaaauggcaagccagacugacaaaaggacucaagguagugaaaauagcgugauaaaacuccacucuuggcagaaauacaaaguguagcaaugacuugugguuguugucauuaguaacagagaucauuuucucaucagacaaguucuacagcuuggugcugggcacuguuccuaaaauuuacuugcaagcuuauuuuuccagcccuuccaaagauauugugaacuauccaggauauuuuuaauaaauucuuuuucugcuuaacugaccaaagacaaguaguuuauaaaacuaagcccuucgcaauacaaacaauaccauaaaacagaauucaauuuuaaaaaaaccuuaacacacuuuauaguuaauguuuuaaggaagauuugaaaugucaguuucaaaaauucauuugcagguuccuaucucaaaaaauaugcuauaaauaauggacaaacuaccugauccaaacuagcucauauuuacaugcacagacuaguggcuuacuuaaaagguaucaguucacaauaaaaaccaguaguagucgggcagugguggugcacgccuuuaaucccagcacuuggaggcagaggcaggcggauuucugaguuugaggccagccuggucuacagagugaguuccaggacagccagggcuacacagagaaacccugucucaaaacccaaaaccaaaaccaaaacccaaacccaaacccaaacccaaacccaaacccaaacccaaacccaaaccaaaaccaaaaccaaaaaccaauaguaaguagaugugcacagggguacaugccuguaaucuuuuuuuucccauuuuuuauuagguauuuagcucauuuacauuuccaaugcuauaccaaaagucccccauacccaccuacccccaauccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccgccuauaggguugcagaugccuguaaucuuuaaacuuggugggugaggggcaugaggcagaaagaucaugaagcccaggcuaagcugagcucuauagaaaggccauaucucaaaagaggaaaaagaaauagcucaggggaucugaaugcuugcuguacauucaugaggaucugagguuaaauucccagugcccauaaaaauccagauauuguugcucccaugccuauaauuccagggcuguggaggauuccucugggaauccugggacuuacuguccuauacccuaguagcuacagcuucauugaaagacauucucucucaaaaaagaaaaggaaagugguagaggauggcauccagugucuucuucuggucuuuucacacacauguacaugcauacacacacacacacacacacacacacacacacacacacacacacacagguacacauguaccacacacacuauuuaacuauaacacacacauacaggaacccccaaaagcaaugagacaaaccaagacuuauguaauuaaacuaguucaaauaaagauagagcaaaagcacagaaagagagagacaacugucucagaaaagcaagaugaaaucauuacaauguucaaaguacauucacauucuauuucguugaaguaaaaaaucacuaaagaguaggugauaauaauguuuccagccuauauccacaaaugauguucauuauuuucuccuuuuuuaguauuuuuaaacaauuuuauuagauauuuucuacauuuauauuucaaaugcuauuccaaaaguucccuauacacucccccccacccugcuccccaaccuaccuaccccugcuuccugucccuggcauuccccuguaccggggcauauaaucuuugcaagacuaagggccccuccucccaaugauggccgacuaggccaucuucugcuccaugcgcagcuagagacauaagcucuggggguacuguuuaauucauauuguuguuccuccuauaggguugcagaccccuucagcucuuuggguacuuucucuagcuccuccauugggggcccuguguuccauccaauagcugacugugagcauccacuucuauauuugccaggcacuggcauagccucuaucuucaugggcucaagacuuuuuaaggcuuccauuucaaccucacauaagaauguuuuaaaugaaaccaccaugaggaaaagggugguuuacugaaauacugaauacauuauacaguuuguagauuacggccauuaccaugagaccagcuauuuacuguguugaguacccaccaugcaauagucugugcuacaauaaaaacuuugcaaacaauaacaaaucugucacuaaucacaacaguucuauguaguaggcauuguuauacauauuccauagaugaaaaauuguucaguaauguacccaaggccaucaggcuuguaaauaaaagguuuagaucugggucugccaacucccaaaucagcagucuggucuauuuauagcauaaaaccucucuuaagauaaauuucacuuuuauaagugagaacauuuacucaaggcucuaaaucuuagaagggauuuaucauacaauguuugcaaaagaaauauuggccuuccaauuaacaauaggagucccaagaaaagcuguguaauaauuuauuaugcucccuaaagaaaucuuggaaagacauaggugggaacuagcauggauucuguacucugagagcuuuauaccugaguagugagauaacaguagcaugcacaguaucaaaaauacauacagcuacaaaguuucaggugccgucccugguggcuagcauaagacucagagagguggucaggagacaugagccuuauguaucuucccugguauagaguucucaauauuacuaccaucugugcugggagucuugaugccacuauagaaagguucacuguaccuguguucccaauuacaugaaguccuaugccugugaaaccuacaccugguccugcuuccugcugauaucagcucucugucugagaaaggcccucugcacucucucugauaacaaucaguagcucuuagaggugaaacccucagagaauaaaagaucacggagaaacagguccaggauagaaacagaauaaguaauuucuacaggguaaaacagaaaugaccacugcuugaagaagaaagaaaagaaggaaccauaaggcuggagagagugcucagcuaugaaugagcauugagaauucuuguacaggucccagguucaguucucagaaccuacauggcaccuaaacauuaccuguaacuaugguucuaagggguuauauaccuuuuucugaccuccuggggcaccaaauucacauaaauacaugcacacaguuacauucaggcauacacaugaaauaaacuaaaucuaaaaaaaaaaaaaaaaaaaaaaaaaaaaaaaaaaaacuuuaaaaaaaagaucgcuacugccuaugacuuucugaccuguucucauauuccaucacaucuauauugauggaggccuccaacugagucuacaaccauccagggagcaggguguaguuucuuaucuccugaucccaagguuuucuugggaagaagauagggagccugaacaauacaagagguaugaguccuaaggucucagguacauagcagguagcaaauaggccucuauucuagaguacuggggccacagaagcaaagccuagaagccucuauuguguucuaucauuuccaugcauuaaccagagaugggaauguuugacaaguucauuguaaaccuacaauguaagaguuuaagaaugucagaguacagaaagcaccuaagagaccaaaguauggauguaagaggagguacaaggagguugcuuuucuggugaagacaaggccuagcuuuuccugucuucaauaagcuagagacagauugcccuuccauguugcaaaggaaucaguuauucauuugucuucugcaagcuuuaaacuuaacguugcuagagaaauugaaucauucauuaaauuauucaguaaacaucuauuguacuugacagaacgauggaggaagaaaaguaagcaacaggaaacucccaaugcaaagucaauuuauaauauuucagcauaccuauuagcccacaguaacugcucaauaaaucgagucuucuagaaaauuaugcuaacaaguuagaaauaaagagguagcaaggagacacuauugcauaugccagaaagauuuugcugaaaggacccugacaucgcucucucuuuugagacuaugccaaugccuggcaaauacagaaguggaugcucacagucaucuacuggauggaacacagggcccccaaugaaggagcuaggaaaaguacccaaggagcuaaaggggucugcaacccuauaggaggaacaauaugaacuaaccaguaacccccagagcugugucucuaauugcauauguagcagaagauggccuagucggccaucaauggaggagaggcccuugguuuuacgaagaucauaugccccaguacaggggaaugccagggccaggaugugggaguagguggguuggggagcaggguggggggaggguauagggggccuuggggauaacauuugaaauguaaaugaagaaaauaucuaauuaaaaaaugccuuaauuaaaaaaaaaagguaagcaaggaacagacugugaccaaacucaaauaauacaacugcauaagauuugucuuagagacaauaggaaguuaauauaggcuuuagaaaaaggaaaaaaaaaaccuagucagauuuuaagaggaucacuuggggaaaacuuuggaggaugaaaauuuuaaaugaagaccacuuacccuguucucuaaaauucaugacagugacugaaagcuuaacagcaaaaaugagauuucagauggaaagaagggaucuuuucuagaggagugaagaguacaauuccaaagaugagggaaagacacaaggcagaucucucgccugguccuacaacauauaugaccuuuaccagaauauaguccucaagugcaauucaaugggagaagaaaacaagaucaaagaguuguagagauggcugaauggucaagauugcacacugcucuuguagaagaccugaguucaguucccaguacccacagacuagccuacaaugacacuuaacuauaguuuuagaggaccauaugcccucuucuggcuuuuauaggcaccugcaugcaugugguacacauaaacucacacacagagacacacacacacaugaaugaaugaaugaaugaaugaaugaaacuuaaaauauaaaaugaugucauuuuaagaaagguuauucgggaugccuuaggaacauccaauagggaaagaguucaaagacacucuuauuuccaggucucuauacuucaagagagcaauaaacuugaggaaugaauacaaagauuucaacugaaacaccucuuugucagaaacagaguagucacggcuaggucaaaggcacucacuuaacuaacauuuaugaauuccuucuauuugcucagcacuaugacaaauauuauggcuaaaguuaaaggcaagaaagcaaaugucacuuucuccaugagauuaacuaaaagagagaagauccagaauauauacacacaaauauauacauacaagaaaaauauuagcuaggaaaaucauagagcaaauggcauuccuuugucuuugcccagccuaggaugugagaagcaaaagaagagacugaagaagugcggagacauauacuugcaaaccaaguacagaaggaaaguucggaucccaggaacucagugucaaaccugaagauguaacauggacuagaacaucuugacuacuauucuauacucuaauuuggaaucugcuuugguuuggaugccauuuuuuccauguugaaaguuugauuauuuuccaaguguagugacauaagagauauuaagaaucuuuaaaagauaaggcuugaaagcaggugguuaaaucacuaagggcacugccugaggaagagauaaauaggguucucaaggauuucucaugaucucuuuuagggggguuguuucuuaaaugaagacuaacuuccccacugucuuacaugcauucacaccacaaugcccucugccauaucaaggucuuugauacuuugaaccucugaaacugggagcuaaauaaaucucuuuucuucauauauuauucagcauugggcaucggguuguagcaauagaaaaauuucuaauauagaucaugcaguaaaacccccaaauuagagcaucuaggaacaauccaaguggcccauuucaguaaauaucugugucuguauccagcuuagcacuagaagcacagagauucuguaguguauaagaucaucaagguacuuucccucaaaaaguucacauuucuauuagaaaaaaaaauacacccaaguguacacacacacacacacacacacacaucaucaucaucaucaucaucaucaucaucaucccuccauguaaacaagucucuuaguaaaacaauuacaaauccuguuauaugcugugaagaaauaaaaacaaaggucuaagaauaacagugggaauuuucuuaggauugucaggcagaaacaaauacucugguaacaaagaguccuaaaauuuucccuaaaaaagauagugguaaggaccuuccaggcagagagaacugugugcaaaggcuugguaacagagaagagcuuuauguguuugaaaaacugaaagccaaccaauggggacaaaagacagggcuaaagaaaaaguugauagcauggaaauauaaacagacucaucacucaaggcccagucagggcaagccacuggagggguuuuucaggccagugguaaccugagcuaugaaacucgugggaugaugagguuguuuuuguuuguuuguuuauuuaccuguuuuuucuguaagcccacaaugcccaaugucuauucuuccaaucauacagugugguaugccuucaucauauacacaauaaaagugagguuuccuuuugcagaccaaacuuuuuuccuuggagauucauccuggccauguacuucccuaaaggccccaugaacucacaaaaauauuuccaauagucucugugaaaguacugggagaacugaugcuuuuugaaaaggacacaaaguaauaaagcaaaaccacucccucacuucugauggaaauuucuuguuuucuccuccagugcuucccauuaguucacagucugaguaauuaccuuuguuauuuauucuguuuccauuucuaucuauucuagaacaccacgaacauguguauauaauuaugcauaauaacaaagaacuauaaauucuuauugaucccagaacuuggguaauucuaaacaauaaaaauauguccucugccagcuccucucaaaagaacauguugaagcccccaaagagcucuauuacaacgacaaaugaacuccuggaaaacgcgaggcuccaggcuaccauguaaugaugcaacaggcgacuuuaaacauacauuuggaaaguccucauugccacaaccaucugggcuucucuccucauuuuccagucuacaucuugacugcaucaagaccaauauacuacauaccuuuuagcuaguauucuuuacaguagccagaacucucagcauaaaaagaaaguccugaaagcagugcaguuaugaugcagaaagagcaaaggaaaacaucuggcucauucauccccaaaugggugguugagcugccuuuagaagacauuccaauugcaaaggaagaugagcuuuggagaaauccucuuagaagccuaagcuugguguuuuuaucaguaguuuuuguuuggggcaccuuguuucuugcaaugcugaggcuucuggcaucaacauggaguggaccacacacaccaucugcagccgucuugacacauuuuguuuaguugguuuuguuacaucuuacauuaugcagaacuauuuuuguauaaauuguuuaaaaauuauuuaugggagauuugaaugcauaccaguggguuauuuuugcuuuuuuuccauuaauuuauuuauucacuuuacaucccaauagaagcccuccuccucuccucccaaucccacccucacaacccucucccccauuccuaccuccccuucuccucugagaagggaaggcaccccauggguacccauaccaguguuuuuauuauuuagauugccaacuguccuucagguaggagaguuaaccuguacuaugucaacauaaaaagcccaucuccagaugugcccaggugugacagggggcuaugaccuuucacuuaaaaagcauguuuaacuggaugcugagagccugccguguaugucaagaagcuacacaagcauguuguggauauguuuaaaguacaguccagguaaaacacuuugccaaguuucaauagacuucaccucccccucagacuuuuauaauacagacuugagccuuuacacuccaagcaugagcucuuguacucuacuuacauaggacuaauuuauaccaagaaucagguagaauaaaugugcccacacccuuuccuuuguccuccuccucucaaguguucaauucucacuuuaguugguaaguucugcaucccuuguuguuuggugguguuugcuaaccuuucccugaugcaguuugaccuuuguuggauuuauauaaacaacuguacaaaaaaaucuaaaaaauaaauaaaaauaaaaagaaaguccuccaucuauguuuaaauuuacauucucccaaaugcuccauucacuuagcuuucaagcagacaucaauuguacuagacccugaaaaugaauuucuccccuguauuucugcuauuugggaauuugccaaggucagcuacugggaagucccagaauuugauuuuaccuuugagaaaacauugcucaugauuucaucugcuaguucucacuacuauuguauauaacaugaccagaaacuagagacauucagacaaauccauugaugccuccugccuaucuuuugucuuucagaaugcagaugcaugugaacauacagagacacugaaggaugcauauggccuuuucucugaugauuaggaacugacuuuagucucuauucccaccccaaaacaucuuauaugcaauuccauaaaaccuuggaacuauaccaccaaucaaagaaaacgcauggugaaacauguggcucuagcuauauauguagcagaggauggccuagucagucaucaaugggagaagaggcccuuaguucuuugaaaguucuaugccccaguauaggggaaugcauggaccaggaugaggaguggguugguuggggagcagggggaggagggaugggauaggggacuuuuuggaggggaaucuaggaaaagggauaacauuugaaauguaaaggaagaaaauaucuaauuaaaaaaacuuacgaggauauuacagccaaacccuggguacaaagccaugcaaaggcaaagaaauuccaauuccuaacagaaaaguauuuagccaaaugacuaggaagcacuagcacucuuuggacagaguacagcuagcagaacauggcuuaccugaauguauuguaagguaccaccuucgugugauuauagucagcagccgcaaauacuugugugaucucucuugauuuugauuuuuccugcuucaguuuuuguauggcaaguucaaaguugcuauauggaaacuugaaagaguaaaaacaagaccuaugcaugaaacuucaagaagcugccaccaucaccgccgccgccaccaccauagucaucauccuuacuauuaguucuuugggaacuaguaguuugaucacauucaccucuucuucaacucuucauagguccccccaccuucucuacucacccaacuguguucauuuucuugcuguuaacccaagaccaauugguguuacucaaguauuuuuggauguguggccuuccacuggagugugguugcucugaaagcaaauugacacuucuuccccuagcagcuaacaacuguccauagcuccaggacuaguggagacauuucauauacaccuccacuuuccaugcugagauuugaccugccuugggcuuucacaggucacagauuguaugcaugcugucacaaccauugugagcucaugugugcagcugcccuguugugcccaguagacacuggcuccccuucauccacugccucuggcucauacaauguuucuguacccugauuccacaaugaucccugagccuugaggaaggaauaugguauaauguuccauucagggcugaacauuuugcagauuuuuauuccuuguaccucaguuaguuaauggagaccagcaagacaacauuaugaacccaaaggaagcuguacaugucuuuaccuagaaacuaaaucuuuaggacaaggacugacauuaauccagguucuagaucucaaacaauguauuuuaagggagagcagguaaccaaucuuacuaaccaaucuucuuauaacuuuuauaaauacacuucguauaacuuucagaaauaguccagauauuuucacacacgcugauauaaacaauacagauauaaaguuagcuaaauguacacauauuuucucuagaucauuaggauauaccugcuuggaauugcuggccaccaggcagaguacuguucauagcaaagcugggugucaacauuccacacagacaguguagucuacauuuauuuguugucugggcacccacuguuucucucaccuucuuuaugauuaccuuuuuaacuuagaaagaauauuucuuauucaauccaguaaagauuaauguuguaaguaauuacagccaagagaucaaaaguuagaagaugaaaguuuagauuaaaaacacugaugagacuuugguauaaaguucccucucuucuaccaucaaaugauccaguugguuuggcaccuauugaggcccccacuucuccuuuuuugcauuucuuuucaucuauuuccaugaugggaucuauuagcucuuuugaaaagacuacucagacugguaauaaagagugcauuaauuuuuaucuucuaacaaagaccuugauaaaaguauuuuuuaaugaugcaauuuuugcuugagaugcugauaccagguaaugucuuacccacuuuaucauacugaaagaauaaaagcacuuuauaccuuuaaaguauauauuguguuuuggcuggauauauaacugaaaggaauaguacuugucuaacaugguuaaagucaaucccuaguaauagaaacaaaacaaagcaaaagacacaugcaugguuuaauauacacaaagaauccucaauuuacagugaguuauguguuaauaaacuuauguguuaugugcuaauaaggugaaaaucucugaaggugaaaauguacaaauuguaacuaacuuacagaauaucccaagcuuagcaauacugcacacuauaaagcauggguuauuucucuucauaaucacaagccugaaugagagcugcagcucacugcccaugcccaguaucauguaagaagauuggacuauauaguacuuacuaacugaaaggggaucaaaacucaggacuucaguuucuaucagaaagcauaucacuuuugcaucacagugaagucaaaaauccuaggcuaagcaauucuaagaauuguauguuuuauguuaagguucuguucagaaucagaaccuugauuuauaacagcuacaaugacuaaccuaucaugggcccuauagaacucagucacucacacaaauuaucacauauaaccuccacaguaacauuaucaaaggaucacuguuguuacucuuauuuuaaaggcaagcagacuaaaguucagagaugauacauaacuaaacccugucauguauuaggguggagcucaguuuccaacccaggccugguggucucuggaaaucuaacugcuuaaucacuguauuucuuguuugaguccaaagccaucauauauuauagguuugcaguauuagaauaacccagauuucuaaaacaauaaacaaauagguaguauagauacucuggaagaugcugaauccaacagugacauggagaagagcacugaaccaccagccuucgacugucaacuucugcaugacucugaacuucucugagaaguaggcuguucagggaaccauaucggucuggcucagauuuucucuagacugugcuaacuacuuaaaguuuucccuagcuugcccuccuuccuugucuucucauuucacauggaucagaccugaccugcacugcacucaguagguaucagccauuccugguguuuucaugauccuucuccuuucaucccacagagcucgcuccccuaauuguggcuuuaacucuguuuugacaccuagcaaaucaaccuugugcauuuucuuuauaaaugagauaaguguguacuauguguguauaaauaguacauaauuaucuaaugaaccuuaaaauaaaaaaauccuaaauuacaaagcaauaguuuccaagugcauagaauuuauuaagucuacauuuaaaaacugagauuuuuuuuacacauggucuuuuuguugaacaacauauauauaacuuuuccauuauagugcuuuaaguuauaaaaacaaaaagaaaacaaacaaaacaaacaaacaaacaaagcaaaaaccuggccaguaacuucaauacccaaaagagaggggccaaaggacaaugaauucaaagccacccugggcuaucuugauauauaugucucaaaaaaauuaaaaauacagcacaacaacaagaagacacuucuuugagcucaguguggcaaauuuguccuaagauucuaauuuaugucucagguuaaagugaccagcaaccucagcaacucgguucccuugggguuuugucucuucgagucaaagacuccuuugcugcccuaugccaauuaacugggaugucaccgugcaugccaccagauuuucuuccuuucuuauaguuacugcauugccuucuaaaaacauuguugaugucagcaaaaaauccagaaaacuugauucagcccugggccugccucccacuggugucuggaaucugugaugcuaggcaguggagagcuaagcagguaaacagagcagacaaaaacugggccuaugugaugggaccuguggccaagucgcacagauccauuauucaugcccacauaugugaauaugcaauguaagccaguggcaagauacagaagaugcucuagagaaaggaaaacaaacacugcaaagggcagagaggcaagaauuacacaaagucuaaccuugucuguguuauucuccauguaguuuaagguguacucaucagcauuaagcagaauaaacagguagccauuaauauucacuguggcuccaauauagagcucuucagccuugauguauucugaaaauucacuuuuaaaaacuucuuguccaggcuuuuucacacgacuucuuuuuaagaacauuccaccagcauucccuaaagaaacagaauaaaagcccaugaauugcuuuauucuuaaaagaagcacaacuugccuuuaguuauauucucuuccaacacagacuguacaaauuaucuguaaagccauguugugcauugugagaaggaagaauggggcaaugggcaaagagacagcauuuuuuucuuggguaacucuuaaacaccacuggagaaaauguagauuaguguaguugcaauagaaaucauagcacacuuccucaaaaaucaaaaauagaacuugcauauaucaucuagccauauaacaugccuggguacaguucuaaaagguucaaagucagcuuacuacaaauauagcuguacaucucugugugucacaaugaccaaguuaugaaaucagcugcaaguauucaccaauggauaaauggauuaugaaaaauauggcacauaaauacacuggaguuuuacucugccauaaagaaugaaauccugucauuugcaggaacuggggaucauuaugugaagccuaauaaacuacacucuaaguuuaauuuaggaggaaaggacaugagauuaaagagagaagucauaagagaagauaacagagaaaaugaguauuaucuaaacauauuauguacauauaugaaaaucaacccauuacuuuguaugcuuuguaugagaaggauuuccugggugagugugcuaaagaauaaacuaauaugcuacuccaggcuuuucuuuccucuauuucuccuuaauccagaaaauauuuagcagccagaugugguaggacacauguacaauucuaaaacaugagaggcugaagcagaaagauaaugaguuuuagucccugccugagcuaugcaguaagacuagaagaaagggacaaagggagaggaaguuggugggaggaauggaaaaaaagagagagggagaggaagggagggagagacagagauagguagacagacacauagagagagaaacagacacacauaguuaugugggagagaguuagagacagagacugcagucugaugguucacuggacuucuucugguucccuccacauguuuguuuuguuucauuuauuguguaaauaaaucuuuucuacauaaacucugucuccaaauuuuccucuuuuuggaugaccuuacuaacaugaaacuucaggauaauauuaaguccucagugguggucacuauuuuguaagucuauuuuacacauagugcaauuugcuuggccccaucgauacuuucuaaauguacagaauugauauuuguugaccauucagagguuagccuauguucguccucauucaguuuccuauuuuaagauuuuucuauuagucaaaucccauuggggccugacuuaguuguacaaauuauguauuacuuguuggcauguuaacuggguaauggcagcuuuaguauacgaccugcuuguuacauuuucagacucuugcaugcuauuuuuuuuaacuuguugguuucuuaaacuugccuugaucaggacauucacaacauguaaacuggcaaagaguacaaaccaacguuuuuucauuuuuuucccucuaaagagccaguugagcugguuuuucuugugugucuucaggacagauaaaaguuguaaacauguugaaauaaagagcagagccuuacauuuccauaauuuguaagucaauggcuguccucagcaagagccaugggaucaacacacuggagaacauuccacaggacuggggucaagacauuuggcaauagccauaaaagacacaaguaccacagaagauggauucugaagauuaaaucuguauaucuuguauuccuuucuuaauguuuuuugguuuuguuuuguuuuuuuggggggaggggcguguugagacaggguuucucuguauagcccuggcuguccuggaacucacuuuuguagacuaggcuagccucgaacucagaaauccgccugccucuaccucccaagugcugggauuaaagccaugcgccaccacugcccagcucaggcaaagauuuuuuaauuagguauuuucuucauuuacauuucaaaugcuaucccaaaaaucccccacacccucccccccacuucccuacccacccacucccaguuguuggcccuggugcuccccaguacugaggcauauaaaguuugcaagaccaaggggccucucuucacaaugauggccgacuaggccaucuucugcuauauaugcagcuggagacaggagcucuggggguacugguuaguucauauuguuccaccuauagaguugcagaucccuuuagcuccuuggguacuuucucaagcuccuccauugggggcccuguguuccauccaauagcugacugugagcauccacuucuguguuuucaggcaaagauuuuauaagcuggacaauggaacauucucuuggucccuggcugugagaaugacuaguggcaggcaaaccaugacuuugaagccuggaaguucuacagaagugccucggaaaaagaaaugauaguggaaaaggggauuucuucuggguagccauccacacaguuuguuuuuuuuuuuuaaucauuuuacauguuucaguucacccuuaagacauuuuuuaagaugaagguuauugauuagaaaauuaucaucauagaucuucuaggcuaucaaauaagauuguacucccuaaguuucaaaagaaaaaggcaccuaauucuucugaggaaauguuguguaacguaagugucuuaccugaauuauucucuauaggcucaaacacugaaauugugucaucacugagauaaaaugcaaugacaaagauccuguccacaucagcgcauuuguguguaauuaguuuuccaaaauaucggaguauauugcuuauguuuccaaagcuaaaaagaagagauaugagaguuaguguuauacaaguaagccucuauuaauauauauuauuauggugugcuccacuauguucauagcagccuuauuuauaauagcuagaagcuggaaauaacccagaugucccucaacagaggaauggauauagaaaaugugcuauauuuauacaauggaguacuacucagcuauuaaaaacaaugaauucaugaaauucugaggcaaauggauggaacuagaaaauaucauccugagugaggcaacccaaucaaaaaucaacacacaugguaugugccaagauacaauucacagaccacaugaagcucaagaagaaggaagaacaacguaugaauacuucgauccuucuuagaagggggaacaaaauacccauggaaagagauacagagacaaaguguggagcagagacugaaggaaaggccauccaaagacugccccaacugggguuccaucccauauacaaccacuaaacccagacacuauuguggaugccaacaaguguuuacugacagaagccugauauagcugucuccagagaggcucugccagugccugacaaauacagagguggauguucucagccaaccauugaacugagcauaggguccccaauggaggagcuugagaaaggacccaaggagcugaagggguuugcagccccauaggagggacaacaauaugaaccaaccaguacccccagagcucccagggacuaaaccaccaaccaaagaguacacaaggggguacccauggcuccagccccauauguagcagaggauggccuuguuggauaucagugagaggagagacccuggguccugagaaggcuugaugccccaguguaggagaaugccaggacagggaagcgggaguggguggcuuggugagcagggggaagaggaagguagguuuuuuuuugggggggggggaagaggaaagagaauaaaguuuaugcuuuucuaaacaguuuaaauaucuuauuaccaagguucuaaauauaaacauugaaauauuuuucuuaguagauuaaaaucuuuccuccucuuuauaaguccaggaaauacauugaaaaccaggccuggugaacauggcuuaauaucccagcauuggaauggagagagaggcaacucucugagacauauuggcuagccaaucaagucuaauccaaugagaggcccuaucaaaaacaaaacaaaacaaaaaacaaacaaacaaacaaacaaaaacaagcuaugugacuccuggagaauacccaagguugaucucuggccuccaugugcacaugcacauacaugcaccuucauaaauauguagacaaccaaaauaucacacaacacacaaaagggucauaaacaccugcucaaugcaagugaauuaaucagcuguucucugaucaugaagcuggucaacaaucacaguaauucagucaugcagacauauaaacauuuaggauaaugaccugagccaaucuagacgacaugcucuacuggguuuuaggauaccugugucaaguuuagaacuguucugccuuguagcucauauauacuccucucuaucauuccaucucuccaggaucauccuuaacuccuuucaaggaaaacauuaacauuuccccuucauaaauauuaugaacacgccuccauuuuaaugcagguauuauuuguauucuauguagccauuacauaucuaauguuuuccaugggaaaauacugucuuauaacacuuuuuuucacauuauaauguauuacauuaaaugguugcagaaaguuauacucauaaagauuagagauauacuuagaacucuaugcaugauuaagugguuaaagauugaaucaaagccgggugugguggcgcacgccuuuaaucccagcacuugggaggcagaggcagguggauuucugaguucaaggccagccuggucuacaaagugaguuccaggacagccagagccagagaaacccugucucgaaaaaacaaaacaaacaaacaaacaaaacaaaacaaaacaaaaaaaaaagauugaaucaaauaaaauuuaaaauuuucucagguagcaaugguaucacacaccuuuagucccagcacugagagacuggguucauaagucugaaguuagccugggcuacacagugagacccuaucuuaaaaauaaaagaaauacuuuccaaaguugguuuugaacagugaacuaacucauugucucucaguagaagcacaacugcuuuuaucagucaguaaaagucagcccuccaacaaauaguaauauaaucaaaaccccacuacccuuaaguguucacuaaaaucaaccauguccuuuaucacuucccugcuauacucaucacuuguagauucuccuauucugaaagccagucucgguguccacacugauaugaacuacaacaaagauuucuaauuugcagaggccuaaagugccucuucaucccuuucuaagauuguacaggaagaaaggccagaaaagcacaguggcaaagcacagggcagcuugaggccuugggcaaaacagaacacaauaguuuauacagcucaucucagaguagccuggguagaccaauaguguccauauccaaggcuucggaucaaccuuacauaacaauuugggccaguuauacuguaucaaucaccuucccuaaaaaacagguacaaaaaauucaagagucuccucuuaugaaauacucauguuacagaugccuaaaauaucaauauaaaauugaaugagaucuaaucuaaaucuaaaucaauacuauucuaaauuuaacaucuuagaacuuaaguuuauaagugcauauauuuacuuagaauauuugaauaugccauucauuuucccccuuaauguuuguauucuggagaucucaucaauuggcaauauaaaccuacuuaauaaaauugagccauucaugaaguuuagcauacauaaaagucaccuggagaaacuuuuuacauaugcagaauccauaauaucgcuaccagagauauaggcucacaagugagcuuauauaugcagaagacugcaauauuaauaugcuaccaagggagccugacaagaugauccucaaggaaauuguaagaaccuucaaguguguguucaaauauuuccuucauauaaaccaauuaucaagugccuaaacccuucugaucagucuccacccacauaucccuugcaucaaccauaaugccacacccaauuuagcaacuauacaguuagcaacuauacagucuuauacucuuggcuggauaucuuaaaauauguuuauucucauugucccauacaaaauuguaaacucuuagaucuaggaugcauugggcuuaauguuuucuacacauagcccaauguuaccuaucuuuacugcauugaacucuccccacugucccuuucccuuugucuuccccaugugggagauagcgccaaagcucugaaauaugccaguaaaucauaucccuagcucauucccauuacacuuaugucuauuucuauuaguaagagauuacuucaccuaaaucucucuaacaaucaacuccacaacgcccaauccaauccuuagccuuucccccuguaucuaauuuuauuaauuagcaacuucuuccaugacacucuugaucacuuggcucacugcauuauguauuuucuuagguuuaggugauuccuaucuccuucuuugccucaugucaucauccuuccaugauuccuucucuuuucuccaaacacuugauuugggauggccccagguuuauucauguaguucuuaacaccuacucauccuuggugauccagcacaguauaaaagcuuuaauccaaguuggcaucaugaauugaaaugcuaauuacauacugaugacuucaaaauuuacaucuccagcucagaccugucuacugaacacccucaauacauacccauuuucauuucauaucgaauuggcaucucaaguuguucuaaugaugaacuuguguucuugcucccaaaccuauuuuaacuauaguccugccuguccaauggcugcaucucuucuccacccuuccaauuauucagguccaaaccuugagauaucuguagcucuucacuucuuucacacuucauaucuaaucuguaaggaaauccuauuagcucuauauuuaaaauacuugcagaaucugccauuucauuucaucccugccacaguaucauccagcuauaauaacuuuucucuuagacuaaugaagcaaucucaucggucgucauacauagacuacugucuuuguacaguccauucuuaacaguucauuggagagauucuuccaauaagacagccugaucaagucauuucucuugucaaaucucucaauacuucuauucuucagaaaggucaaccagagcacugacgaaaacugcaacuagaaauauccaucauuuauauacgccuagauccuuugcaaggaaaaugaaaguuuuccuuuuuuaauaugguacuuuaaaaaucccauauacuauuuaauguacucaaguauuuuuacuuucuugcacauuugccucaacuagaauaaacuuuaugagagaaagugggcuuuuauggcugcuuugaucacugaugaauuuaucacaagcaccuacguaaauaaaugccuaucauacagaagguccuuggaacauauuugugaaccaacuucccuaccacaaccuauaccuauaaacuuucuaaaaaucgacaaacaggaauaaaaaccucuaauauaauaguuucuaaaacuggaaccuuuuaauagcacuccucaugaggcagugauacccaacuauaaaauuauuuucauugauacuucauaacuauaaucuugcugcuguuaugaauuacaauauaaauauuuuugaucccugugaccccuuagguugagaaccacugaucuagagauacacagucaauaagagucgauaaagacucuuauuuuaguaauaauuagaaaaaguaagggaguaguuuguggaaacaaucgagggacaagaucugaaaacagugaaauaugaauauuaauauuaaaaaacaaugacuuuuuggaaacuauaugaccagaauagaugaaguaugagaugcaaauuuuccuguuaagaagcuacccguucuccuccuuuaacauuggucuaucacuauaaacuggauuauuggggcuggacagauggcuaagcacuuguugcuguugaauaggaccuaaguccaguuccuagaacccacauagcaacucacaaccaccuacaacaucacuuccagaagaucugaugccauccucuaaaguccaaaagcaccaagcaugaauaugguaaacauacauuacaugcagacaaaucacugauacaacagacacaaaauuuuuugaagaauaucauuagcaaacauuuuuccuaccacuauacuuauucaucugcacuuuuucuuacuggaugaaauauuugccauacucuuacuucaaggaguucuuagucuaggggagcccauauuuuauauacgugaguaauccccaggucauguaauaaguaaaaauuuuaugguaaggaaggugaacucccaaaguagcauuucccaggauuugauuccuaguuaaacuaaaaacuaagucugagguuguacaaauuguagggaaucuuauuuaccaucuuguuuuccucuuuugaagaaugggugcaagaauaucaccugcuuucuucuaagguggguuuagggauuauaugaaaucagauuuuauaaaaguaguuaaugcacagcaaacuacuaguuacuuguuaucgcuaguacuauuauuauuaugaggauauucaacagaguguugugggcacacagagaacaaaguauuuaaguacugugaagccaguuugugccaauuaccauggaaacaagaucacuguguagggggagcuugaaggaaguauaucccugacgcaaaacaagugguagacaaaaauaaaugaaauucaagacauuugugccuauaucaccauccuccaaacaaaacaguauuacuuacaugugcaauucuaucuguagucaggguucugaggacaacuuuaaagggcagacagagaaauuaagucaacuacccacaaagaacuguuuuucccugagucccagaaguaacacccuggauaauauuucacauuauuuaguuauaagaaaauuuccaugucccuuuacaauagggacauucuuuuuaccuauaucuuccagguggcccuuaaaaauaguaguuacuaaaaaagaguccaucaaagucuaccccagaaccuaaccagaauacugucaucaacaagagaacauaaacacguugauggcccucucacauguaaaaaucaauugauucucaaacaccaguaugccucacaacuguccaugaugccuauaaaaagagguuucugggucucaccccaagauuucauucuaagucuauucagaagaaagcacaauaauuaacauucuaucaaguaugaggaccaugcuuuaagaaguggagaguuacuuuuggcauagcauuggaaauguaaaugaggaaaauaccuaauaaaaaauuuaaaaaaaaagaagaaguggagaguuuaaaacuuuaaaaaaaugaaguauuuaaaaauaaagugauuucuugaaagacaaauaacaucaugucacagcaaaggcauaccuucucacauuccauacaauucauagccaggcaguuaaaccauuuuuauagacagaacaaaauauuuuguucccuuuccuucaaauuuucaacagcaugggaccacacucaguuugaccaaauucaggaugcuuuuuguucuucaagucuuaacacauguucccuuuaccauuuccucccagcaucuccuagccuauaaucucuguuacuuggagcuauaauuuuuaauuuacauccuacucaaacaucugcaacauuuccccacaauuuuucccugacauuuuuuuaucuaagaccuacucauccugaagaaccaaaaaguagucauagccagugcucacauuuucuauguacaauuuggaagcagauugugucucauguacauuaggaauauuuuggaaaaucuaucuuuauaaguacauuuagcaauauaagcaguuuacuccuauugaacucaaaccaaaggucuaaagucaaaguaacaugaguuuucuaaaauuauaaguugaaaaacacuuauaaaccauugaacucucucuagcagugguuggcaaacccaaaucugugagacagaucuggcuggccaccuguuuguaugccuuguaugccuuugagcuaagugugguuuguauacuuuuacaugauugaagagaaaaauaucaaaggaauacuauauuacaaucuguaaaaguuuuaugguauucagaugucaguguccauaaaauguuuuauuggagcacaguuacacaugugcuuacauucuguccauguagcuugcacacuauaaugucauauccuaguggcugugauggaggcuguguggcccacaaauccauaaguauguacccucugauccuugaaaucuguuaacuccuccucugcauuauuuccucaagugagagaaagacagacagacaaauagaaguggaaagucaacagguagggguugauauggucuuauaguucuccaaauaacacuucaaaauaagcacucaaaagaagaagcuggcaauaucugugcauucaucaaccucauuagaaagcuacaguaacuugucccuggacucaaaaucagaugaguuguguaacagcucuugcaacaggagggcuauaucauaaauuccaaagagaaaggacuauaaucauggucuccuuaggcaccugucuaguuccaugaauuuuuugaaguucuuccgaugaggugugggcuucaggccuacacaggagcggaaagaauccucuucagacccaaagccaguauaagguggguauuuccuuucuaucuuuggaagaugaggaggcuugcaugaaaugggcguaaaguuaucuacaacaaaacacaggcaaacaaaacaucaauauuuuuuugcccugauuauagcuguuuggaaaggucuguuauuauuucaagaugaacauggagauuuuguagacuauuuuaaacucuuucaaacaaaacaugguaaaauccuaugagagucgguuuuaaucauauuuauaaaaaccacagagcucacuuaauagucauuggcucaaaagagaaaaaaaaggagaaaucuuugucaaauaaguaaauauuuaauuuuuuguccucacauuccaaucugugaauauuauuuuucucuucccuugauuuuuuccaaugauaugaaaacucaaacuuggaacuuaugccaucaauucuguauuuuaaccuguaauuuggccuucuccuaucuucagucaacacucacuaauaaaaauuauuuuccaaauaggacugacuucugacugcuuccuucuuaacuugaccuauuagccagcagcugcuccuuggauucauuuuaaagcucucuuccuuaccucuaauucaaccccaaaacacuguacacuucaguguuuacuaaaaaucaaacagaaaaguaaaaucccaucuugucaccagucacugcuccaggucacuuauuuuauuacucaagauaaaacugcaacuguagcuguaaugaagcaaaaagcacaaacagcuaaggcuacaggauugucuccacucucaaagaagugugaugugaucaauacuguucaucuuauuuuuuuacuuaucagguauaagaaaggagaaguggggacaaacuuucaauaccuguagaagcucuuagguaaucauuuauggggcuauguaaucucuaaaagcaacugugcuucuuagaacaaauaacauacugacccaaucuuucuaagucacuguguuugacccaccacaaaugguaaagaagauucuagaacaucuccuaaaacaaaacuaagacacauggaccacuuuucaugucuuccucaagcuugauaggaguuucaguuuugaacaacaggaguucuacaaauguaaauauuuccuuuuauuuuccauagucaaacuucuaauagaagaaagaaucuacauuuuugguacacuauuagaaaaaaaaauacccaucaauuugucauguaaaacagucuaauucuacaacugaaguacaucuuuuaacucaucaaaaugcuaagaguguaaaguaauuucuaauuccaauuugaaaacauuuuuagcuuucaacuuuccuuacauuuccuagaugccuuugugugagauuuccugaugcacaauccccagaagagaauuguuccaucuuaacagaaauugcucacagcagacauguugacaaauauuucucacuggcugggugaaaggggaaaaguaguauguccuuacagucuccugauccucuugcaaugcucuuuuugcaacugaagagacaucuugguaauaagagaaaagcucaaauuuucaaaguugaauugcaguagacucuauccuugcucaccauuacaucaaaaucacuacugucugcuaccucugcucucuucuagugccacagaaauggcaggaaagcuuuauguaaugagaagaucaauggaggccugagcaauuucuuccaacagggggcauauacauacaacucuacauccuaaucugagugcacuagacaaaaauugugauuuuuaaucacaaacucauuuaggaauauauucuccagucuucauuacuagucauaaagaugguguugcuuucuuaacuaccuaauuuuugcaacacauuuaaguaagaaaagaaacaauuuagagcuuuccucugcacccacagugccaucuaguguauaaaaacugagaacucuuccacugccucacccuugacuuuuauaacauacagaccuguuuuggaaaucuuagcucaagauucaacuuuaagucacaucucccugaauagcucacauagguucauaaagccacagaaucaucugugaauaagaaguuggcuguaaugaccaccccauguacccugccuauucagguacucagaaacguugagcaaaugaaaaggugcauacuuuuguacaaaggaucuccccaaauguauucuaugguugguauuuagguagacacugagacagucacgucuuccaaauauacugauuucucuaauuccaaaugacuuguacacauaucugaauucaauggcuaaccauggcugacuagauucuaacaaaaugcagagagauuguguauagaaauuaagucuaaugguucuacuugccaucucagguggaagcacuauucagggaagucaccaaauaauuaccucaaaguugccuuaugugaucuaacaacccaggcuguaggaaaucugaagcauaauuuugaagaaaugcuuaaagcugaaggaaugucggauuauuaaacugacuuuaggccagggcuuuggacuaggaccccuaaaaaggaagaaccuugaaaacaauacaaccauccuaagcuucaaagcugcuuguagccaauacuuagauuaaacaauuagugaaguaaacaaucucaaaacucaaaguucuagucuaaaaucauccucacuaacucuaagggugguugggaggauguaaaacugugaaguccaucaaggccaugugauaaaaucauaaaccaguucuauauuuuuuguuacaaucucaagugaucacugacuuuucuucugccauguccuccuccuucuuucaaguccuaagaauucagagauagccagcacugaauacagaaaaugaaaggcauuuuuuguuuguuuuuguuuuugguuuuuuuuuguuuuguuuuuguuuuguuuuuucaagacaggguuuuucuguauagcccuggcuguccuggaacucacuuuguagaccaggcuggccucgaacucagauauccgccugccucugccuccuaagugcuaggauuaaaggugugcaccaccaugcccagcucgaaaggcacuuuaaaauuauuuuccaaccauaaucucaauauaaguacucaaaaccauugagaaugaaugauuguuacuguuuuaguuuugcaugucacaaaaaucaaugacuagauaauauuacuauaaacuggguauggugguauaugccuauaaaucccaguauugggaggcugagucagaaaguuagcguaaauuuauggcccguuuguguuacauagggauuaacaauucagccaggacuacauagcaagacaguguuauagagaggaauggagacaaaagagagaggguaaacaggguagagagaagagaguagaaaaaucuuauuaauaaauaaccuaaggcauaaauuccuagauaagaacaguuaaaauucaaaucuuggucuucuuaguacaagaaauacaaucuagaagucuuugaaucuauuuaaaaucuucauauauaaaaaagagcaacugacuucuaccugguuuuguccacaucaacaaggaggaaaugaacuacuacuccauccuggcaggcaagccaccagcagcaagauagccacggugguugauauaggaguuacacuggacaagacugugcgagacagcuauaaaauuaccaucuccuuggaauacuaaaauaaaugaaagacucccaucuuucuaugagacugcaucucauacagagguccaaaugucuuucagaauucuaucaagccuuguacuucuacacaaauacaagagguaaccauucaaugucuuugaauugugaccaacuucuuuucuuugucuggcauuuuuuucugcccuaaaguaagauuacuuugcaagacaauaaugcauuagagauuccccuggcggcuggggagacagcucaguuggaaaaguugaugcacaagcaugcauaucugagaucuauaccaacuauccacauaaaaaccaggcauauguuuauaauaucagcauggggagauggggauuacuggcuagccagucuagcagagcugauaaagucuauguucagugagagucugcaucucaaaaauaagguagaaagccagggagcaagacacccaacauugaucucuugccuccacauacacaugcacuuagcaacagggacacagaaacuccccugcccugcuuucuucaaagaucacaauuacuaguagcacuaguucugcuuuggguuucaauaacacuaaaauauaauguauaaaauuucuucucaucaauuuuaaggccacaugaauuauaagcaaaauuaucauccuuaccauaauaaugcugaacagaugauucauuaaaauugcuuuuuaauguuuaugucaacuguuacaguacauagaaaaguuucucauccuuauaaauauuuuuaucaacaugucauagccacuaaugaagaaaaauaaagaucacuucuuuaauuuuuuaaauguuagaaauaacuacauuuaaguaacaugaaauauauucauuuaacuugauaaaaaccagagaaagcaaguguaaaguuuauuagagaauaucaacccacuucucuagauucugccauagauauaaucuacagucauuuguaacauuaagugugguauuaaaacuuaaaaauaguuauguaaugguauuuguuaaauaggacauuuuaacaugcugugagaaauauuaaaaagucacugugacuacaaaaugcauccuaauuuuguauuugcauaauuuucuuaaaaauaugcuguuguauuaacguuaaaggcacaaaauacauuuuuauauaauauaauaaaaucuauagagggagcaaaggaaauggaugaaaagauauugaacacuaggacaauauaacuggaaugaauggacuucaggacauuugaagaagauacauauacccaggacagcuaggcuuggggcacaccagagaagucacauuacaucagaaaauucccuagagaagcuacuaagauacuacaccauucauuuuugccugaagcaaauauuauagucucaaaucaagcaaacaucagccaacuguugaacucucuguuuagcaaaucauaugcuguuuuggaauuguuacaguacucagucuucuaccaacaaccuuaaaugaaaguaaucuucagguguuuuuaauggcuuucaguaagcugacauccaauuuccagucuucauugaagguguacugauucuaaacagauaccuauauuuauuaagggcaaauucuccuccccaaugaauuaugguccacuagacaauucucuagagcagcucucaucugcacauuucuggaugauuuuuguuuauaauccuugaaguaaguauguucaacuguguccacucaaagaagcacuuuuagauauuagccaccaaaccugacucuuguuagaucuagacauguucaugaaucuagaauauagauguguuaaaacaaauucccuuuguacaacuggaaguccuuuuuacucuaauccauuaguguucuuuauucaccuucccucaguauauagcuucccaggaaauguuuaauacucagugcauauacaugcaagguaggcaggcaggccuucucuuauucuauaaacaaaacaucuuguauauuuuuaauaacuuuuucauauaauauuuugaccauguuuucuccuccucuaacuccucccagauccuucucaccuccccacccaccuaacuuuauauuuaauccuucucuuuaaaaacaaaacaaccccuuccacaaacacaaaaugaagaucaaaacaaaaaugcaaaagaugaaacaaaaacaugucaaaaugaaacaaaauaucuaagccucuuauuuuucaggaaguacauuucacagaaggacacaucaauccuccuggucagugaagaauacacaugcucaaauucaguccacuaugaauuuucaaaagcacuguaucauguaugcaugcuuuuucugucauuuccccuaaacaauaacaacuauuagcauagcacuuaaauugaauuagguaucagaaguaauauaaaaacugauuuaaaguagcaaggcaccauaacuugcuuguuaccuaaccuacauagaaggcuaaggugaaagaauuguaaguucaagaccagacuaagcaauaugauuagacccugucucaauuuaaaugaaugggugugugaauacauaaugauguguauagguuuuuugcaaauacaaaccauuucauguaagaacauuaggcaccccucagagguagguauagaggaagggccaguaauaauuugcugcaaauacugaagaaggauuauauagagaacuagguaccaccacaguaauuccaaaucucacccugguagguuagcaaauccuauccauuuccacagcagcagauacguggaccauggguagaaacaaaccuuaggaaguagguagagcugacuggccgaacuucaaaagacugagaaugagaguuuaacaauugaaggcuuggauauuagauuuuaaagcacauccucuacuugcuucuagacucucauaauauugugcagugugcuauaggucccagauccccuuuucuagucuauaaaccuagccuacuguacugaccuaaguacaaaguacacauuuaauaaaucacuaguucuuacuaaacuacauuuacuugccuagaauggaauuaagucggccaucuuugggaagagaggccccuugguauugcaaacuuuauauaccccaguacaggggaacgccagggccaagaagugggaguggguguguaggggaggagggcuggggugcgggggaggguauaggagacuuucgagauagcauuugaaauguaaauaaagaaaauaucuauuuaaaauuuugaagaaaaaaaaacacagggggaaauagaaaaaagaaaagacaaacaggagaccuagcugggccucaccagaaaaugcaaagcuaacugguacacaagagauuaccguagagaacuugagugaguaucauccauuguaagcaaaaauuaagugaagagauuuaacauuucuaguucaaguguccuaccaaaauacugaguacuauagcaagaaagacacuuauaggggggaacggaagccucugacaugagguaauugaauucuuggcucuuucucucuguugcauaaccuuggacaacugagcuuagugggccucaguuuccuuuccacuaacauggagacaaugaguccgcuuauagaagcuuauuuuuaggaauaugaagagaacaaaaguaaaaucuuaaccagggcauaaagcagccaaaguguuaaaaauauuuucuaaccaacuuaucacuuaccaacuccauacuuuguccuauaauaggucuugguaaacucaucacagucacagaggaggacuuuucuuccccauacauugaugguggcaccuauagacagguccuggucuguguaaaagucuugcucuacuuuuccuagcugauaaaacagaggaagauagcauuggcccuauggaucugcccaagaacuacaugccuuuuccuaagaaaauaauuuuuuaaagcuuaauuauauuauuuauaacuaaauuuuaaaaucaaauuaauuaauuuguauccuuuuguguacauguguguaugguaugucuuguguacauaugcguacaguucaugcugaguauagauguacaagugccacacaccguggauguguggauacuuaccuuccaucuuauuugagacagggucucuuugcuguaagguacuguggucgcuagacgaguuagcuuuugaguggcugaagauuccccucccugcccuuccuauaucacccauaagagcacugguauuacagaugaacauuacugugucugaauguauauauguuuuggguggaaugguuuuauauuuaggucuucacauuuguacagcaagcgcuuuccccacuuagcugucuucucagccuaucuaagcauuauuugaucauuguaguacuuguacaagcaauacaaggcauauauuucuauaugcauuuaaguauguuuaauauugacaaagggcaauaaaauguauauauucuauaucucuugauuucauucacuagcucacaggcaagaauauacaauucaccccaauauccagguuucucaaauucucauuggaaaucaguuauaaaacuucaggauccucaccugguauuuauccagcagauagccaucugcucgccauucugacaagccuccauacacauugagaacugcucgaucuguuaucugaccugguugguagauuccaggugggccauacuguaaaauaaaaccaaaccaugauaucuguucuccaugaaagagauggugcagaaaugugcauugcaugguucuuuccuaacaucugcaagaagccacacaguuuaucuaccucuguucuacugccacacaucuucacagcccuaacacacauuuuuuuuccucuaauacuuccaugcuauagguuuucagcuuuuuugcucuuuuacuuuuguuucugugacaagguuucauacacaagaaaaugaccucaaacuuauguaguucuggaucuuccuucugaucuuccucugcuaacucccaccagcugagauuaaagcauaugucaccacacccaggcuucaagacuacaaguagccaucugcuuaguuccccauacacuguagagggaaucuuuuguacaauguacagaugcuucgucugucaauacaaaagccuuuggccgaugaggugaggcaggauuagaaggugggacaucugguaggggaagagacuggauuucugggauggagacaggcacugagaaggguucacccugguacacugauggagacagcagcaaaauacugaggaccacauggcagccacauggcagaacuuagaauaggauaacaggaugauuaaguuauaagcuagucagggaacaauucaaggcuuuuguccuaggcauuuauucauacauaagaagccucagagucacucuuuugaggaacuuggcauggguggcaaagccaacagcuauaauguaccaugagcucaagacacuuucaauauuucuccaaguguugugcaagcaggcaucuauuuccuaaacugcacucauccccaaggaagaaugacuggcuccucuuguucugucuagcaggcugucuaguccaaaggucaggaaaugguauacaccugguagccugacauuucucucagaacuucagcuucugcaacccucucaccucaacaacauacuccuugcuuugaguauccaguguauacccaucccuucuggaucucaaccccaugagaaucuauacuccacaaagcaggacacaagccauuuucuuuuucauuauagcccaagaguugguacacacaacucaauaaauaucuguugaauaaauaaauaaaaugaagcuacugaugauuaagauauacugcaagugucaagugcaucauuguaucauauuuaaccuauuuuucaaagacauucuaaaaacagauuuaccagguaccuccugguggccugcugugcauauucuagagcucucucaagaacaaauucuaccucccccuacacagccuugaagcaacacagcaggacuucuggcagaagguacagagaaucugggagagaauccugugaggauugaauggccagugguuguuuacauaagaaaugagugcucuugauaaccuucucaaaaacaguaagaaugugguuuacauauuuuauccaaauuagaaauaaaacuccaaauagaccugugaaaaggaauaguguuucucuguaaccugacaggaauuaauaaauggaucuucagauaguuggucuugccauaacauuucguuuaaccugucuaguuauggaagcuguuaacuucauuuuaaagauguggaaauguguguucaaagagcaugagugacuugcccaugcucacauggcuaucagagacaaauccacaauucuaaucuaugugccauuccugcugugccaguuauauucccucucaaauucugacauaauuugcagaaacaaaucuuacaaaucuccauacuaaugaaaaugccaauggcauacugucacugguuacuggcuauuuggugacuagucacuacacucaaaauugugauuaucucuuucccauauacuugggcauaugaguauauucacaugucugaguaggugcgugugugugugugugugugugugugucuguagccagaucaauaccaugggaucucuuugguaggcuauaggagcuuuugaguauuccacucaaagcuccucaauuaacuucaagaguguccaaaauuucauaauacagugauaaacaaaaacuagguuccuuccuuuacacaucuuccuuucauuuacuugccauaagugugcuagcuaguuugguuuuuucccuuggggggggaugaggggggcuguccuguuguuugauuugucaacuugacauaagcaaggguccuuugggaagaggaaaacugucaucacagagccauccacaccauuccaaacaaugauucaaaccucuuggcccacaaacauacucaaaacugcuuaccuugggaagcuuaccccgccgaaggaaugaugacauagcaucccggccugaauuagauggcaguacuucccugauuucaacaguaccaucacacaggaaguaaugcaggacaaauucucuacgguccccaaacagugagguugaaucaucccacaagcagaagaaacgcaaaaccuucccaucauacuggaugaaucguuucagggugucaaaagacugauagggacgaaagggauccacaaacucuaaugucugcaaauggagaaagaggaagaaauguagcaagcuuuauguagucaugucugggaggcagauaguauaaaguuuuuuuuuuuuuucuguagacgauucugucauccuuuuuaaaaagcuuuuaauuaaauacuaugccauacagguauacaaauucacagucaguuuuaaccuuaagaauacagguaaauauuaggaagcuuuucauaauuguuaaauaacauuuuaacauacuaaacuauauuuccggguuauguuggaaguggacuuuucuuaaagccuuaaauuuuauuaagaaugaacaaaccuaauuuauagugagaaaccagaacaguaauugugcccucccccgagccuugagcaggcuggcucagaccuuguuugccacaguugcuagcucaccuaggguggaguccucugaccuaaguaaagucuacugucuugccacaucugcugcuuccuccaagaugccacuaccugcugagaggcugaaccuguuuuccugacaagauccugacagagcaaugagauccuggcaaagugggagauggguuccucucuuuauaaacucagauucauaaguaaucauugggccuugaucagagaaauuugucuuggcucauuauuucucucgcugccuuucccauccaaccccagcuuguaguggccacuggcagcuacaaguaauuguuucuguagaggggauauaucaagaaggagugucuucaggagacuggacuaaaaagggaaacaaaggaauauuuugauguuaugggcaauagucuguaucuuuuauuuuuuuguuuucugccauguuguugagcaucuuacacaugcuguggaaauguucuaugggugagcuacauccccagccccaaauauuuuacaucuuuucauacugguuacuuugguguacacauuuuccaaacacugaccugcauuaacuuaagauuugaccugcauugauuuaagauuuauaaacccaauccuaaucugauuauauuuuuacuuuaaaaaugugucuuucuccggggccuagcaaacacauaaguagaugcucacagucagcuauuggauggagcacagggcccccaauggaggagcuagagaaaguauccaaggagcuaaagagaucugcaacccuguaggugcaacaacauuaugaacuaaccaguacccuggagcucuugucuuuagcugcauauguaucaaaagauggccuaguaagccaucacuggaaagagaggcccauuggacuugcaaacuuuauaugccccaauacaggggaaugccagggccaaaaaaugggaauggguggguagugaagugggggggagggcuuuugggauagcauucuaaauguaauugaggaaaauacguaauaauaaaaaauauuuuaaaaaaugugucuuucuaccagaaaucacucaugucuauguguaugcaugcaugugcauguguacauacauguguguauaugcaaagauaagagaaagaaauguauuugugguuuaauuuugcucaaaaaauuucagauauccaagaaauggacauaggaacauggccaauggagaacuuccacuccacacagaaacccuaucuagcuagacucugcucuagaaucauugagauccauggucuucuuggagcaucuuuccuucaauuugcaaccucuuagcucugucuuaaaguauagcugccuccauucuaucuuguauaagcaaaugauguuguuauguaagaaaagacucacuugggaaauguuaucccaaauugaauuauauaaucauucuauaaauuccugaaauuuuggguuuauucagggcagucuagccuuacucuuauuucaagaggaaaacaaaaaagccuucuagaggcucuacuauccuuauccuugauauuuaagugaaauuaugggaccucugcuuuuaugaauuaaaaugcuuuuaauguauaagugccaagaaaugcauuauuggucauauaccauuaagaucuuguucaguuuaagcaaaauaguuuaacuuuacauaucaaugcagcagcaaacacuuaacuaaauccauaaaagccucuuauuaaacucuuaauuuucccaagauuucuaucuuuauucaugaguuuucuuugcccuaauggaauaccaaaaugguucccaaagucugaaggaaaauuauuuagaacaucugaguuuccuugguauuuaccuccaauuauugccacaaacuuuuucuucccuagaagacuauaagaucugacaguauguugaauuuuaugaaauuaauauaauuuaccaucauccacaaucacuaucauacaguaauaacuguugguggauacauguagacauaugcaaggagcaacaacuuauaugguccuuuuuccuucagauucucucugaggcuucaaaagacuuuguauuuaucauucacggcacaugaaagacauaaaaaaugagcccaaaccucgaaaaucuuuuacauugauauaaaguuauucuaccuuagauauuccaggacuaauaauacauauacuucaccggaggacuuuauaccuacaacaucaaagaauaauuugcuaaggcgaagagccagguauaggggaaugaucucacacauaacuuuuaaugagagauuaaaaaacagaaucaaagggaauuucauuuuaaauuuuguuaaucugaaaggaaaugaauuauaaguuuugaaaacaguaaaaaucagauaaaaucaaccuauggagagaacaauuauaauaguaguuauccugaaaaaucaggagugaguggguuggugagcuggggaggggagugggauaaguauuuuuggaggggagacaaggaaaggggauaacauuugaaauguaaauaaagaaauuaucuaauaaaaaaaaagugguuauccuggaggagaaaaaucuaggaggaagggagaaguaacuguucaauauuuuaguuuggaugcagguuaagacucauuccaaaguacauuuagggcuuauauguuuggauauguguagucauauaucaacaacaaaaaauaaaagugguagcacacaucuguaaucccaauauuuaagaaucaggaaaacagugaauucaaguucagccugauuuacacagugaauucaaaacucuccugugucauuuagugagaaccugucucaagaaucugcaaaugauuaaauacaaaauaaaaauacaaagagaaauaaaugacacuaauggaaauuaagguaagaauccagagauuuccagucuagucccaauaaggaguccugcuagguuugugaccuaaccaacgauucuucuuuagguauuuagagccuucuagaaaacagaaaacuagggucaagugaucaguuuaaagaacugcagaacaauaacagugagucuuuauuccuuacaguaaaauaagauuuuaaacucaaucauaucucauaacuggaauaaauacaaaccauaguuaauucacucuucuagaauauuccagcauacauguucacaaaguuccaagaaugaagaaagggcauguucaaaguuugguuuaucuaaucaguuguacagaagacauuuuuuuuucccaaccagaaauaggcaacuaaacccagaaaacacaggcagaggaaaugugggcucaauucacauucuauugguaaccacaaaacuaauuaugggcuccuagaccuuuuccuucuuacacaguucacuaaauaugcuacagcuggaagggaggaucccaaaaaguacuggagauuaagggugaagggaggcagcaagaaagggaaugagaggauuguuccuguucuguggccaccauuuggguuuccuuucuauccaaagaacaagaagacagcucucauaaccauaguuuucucuggagauaacaagucacauauguaucuguucuuaccucucuccgcaucuucauguagggaucgaguggacauuguccuggaggguucaauuugauuccuauuuucuucaaaaaguuuuuuguaaauggaucgcaaucauaaaucuugaaugugcgcccauagaagacaacacuuauguugauauugaagucauauacaguauaaaacugaucaucauugggagggggguaaggaauccguugacgccugauagaagugccugggaaauaaauaaaaugcaguuuuuagccauuuggcuagcaggaauuuaugguauaucuaaguaacaauggugagugcuucccuuuggcaggauagaaagcaaggggcuguuucuaagaagcaacauuauacauucaaacucaaguaaaagugaaaaagacuuuuuagguccagaguucucugaccagacugauaagaaauuugaauuuccuaaguguuguuagggaaguauuuuuauaagccauaaggacuagaggacagugauggauauaaaagaggaguaguauuagcaugguaagcaaaaaugccacucugucauguacuuaucuguccuacagaaaaauaggcuugcuuuccguuacuauagggaacuuaauacauucaaauaaacaaggcauuaaggccccaaaguaaagugcucauaaaagauacaagaggcuaaaaaauaaauaaauaaacuaacaagaucuaguuucuauguagcagcacuaugauuuauagcuucaauaagcaugaaugauuuuaggcugcuuggaaacuuuauaagaauccuuguucauauagaaauguagucuuccuucuuccuccaggagcucugcuuauauccacccaaccaccaccaaaugcagauuucuagagacuucauagguucuugauuuuaucacaucuuccauauacaauccuauggugcuaauugucuucuuaauagagaaaaaaaaggauaauucacuauccaauaguaguaaacagcagcaaaagggauaagacaacaccuacaaauauaagugguacaaaagaagaacccugauuuuagggaaccuugaccuucugcgggcagcuaggaguuuuacuagacugaacaauaaacaugucuguccuuucugauucaggaaaggacuuccucuaucuuucaaggcuguaagucaaccugcacuggaaaacaaggcgauuuuugucuuucuaaagcugucuguguauauaaagagcuuugaggagugagcuuugagaaaagugcaguccauauaucaagauauacagaaauggaagcuacacaugcagaguuaucucucaagaugaauuacugacuugggccugcaaaccuacccucagaguaaaggggaaaagaacugaaggaccucacauugcuaauaauccaguaacauguggauugugugacuucaguauggaaacauuuuaauauaaagauauuaacuuaugcucuuaguguuguauauaguauugagaauaguaccuuuuugcaaaguguaaaaauuauuaaagcuuacucauuacuguucauuauaacaacaguuaaugaauaauauguaugugccaggaacugugcugggcacuguucaauuacucuacuuaucuuuucaguuuguugaggaaacuuaagcaaaaucauuuucaucuacuuuucuuuauagcaaauuuuaauuacuuaguacauuaaauuaaaaugauacaacuauaaaauuagaacuggcauagacuauuuuuaaacauacuacauaaaagaugauauaauuuuacugcaaagaauuacacuucaacuaguuuuuaauucaugucauugaaaacaaaaugcaaauuauuuaaucauucaaaauuagacauuuagagaaaauugcauacuuaaaaaucuauaaaaggaugggcauuucagauauuuccaggaacuauuauacaucucuuuaaaaauaguuggauuguggcagguuauuaaauacucaacaauguagagcuucuucaaaacuuucaucuauggaacuagggaaguagcuccacggauaaagcacuugucuggauccccagaacccucagaaaugccuggcuggaguggcagcugccuguagcccuacuacucgggaaacagagacagagauagccagggcaagcuuccagcuguccauauuagaaugaaucugugagcugcagguucaaugagagagccugcuucaauaaauagagaacaaggaagauacucuggcauugacuuugacccuuuacaugcacgcacauauauaugcacacuauauacacaagugcaaaaaaaguguaaccauagugugaugauuugauccucaauaauuuugggcaauugaauaccugguccccaauugauuacacuauuugggagcuauaggaaguguaaccuuguugggagaaguaugucacugguggcaggccuuuaguuaguucugcuuugugcuuguuguucaauaaauaaguccuuaccuuccuuuuuuguugucacaccuuaaguccaccaucauggacucucacccucuggacccauaaguucaaauaaaccuuuauucuguaagcugcuuugggcaugguguuuuaucucagcaauaaaaaaaaguaauacacauacuuaacauguauacuucauuuuaagaaugcaaauaagcuauagcuuuguuaaguggggcucuaaguaggaauacuaucacuuucaagguauguaggaguagaugacagugcauuuaaauaauaauaaccaccauugccaccaaagaccuggaauagacuuuuguugauacaucuagucuucaauaauacuagauacagagagcauaugaaagaucaauguuuacuucauagaugagaaacuaaaguuaagaaugcuuaagacucuagaccaauguuauaaucuaagaaaugaaagaaaaggauuuugaacuuuagauuucagacuaacaaaacaucauuuuccacaguuuuuaaugaguuauaucucacuguauaucauccagaaaguacuuaagugaaggaaaagaggaauaucuaugggcaaaauugaauagaaauuggcuaaugagaugucagcuacaaggaaaagagaaaaugauggucaugcugcucucucaaaacauccugucccccuucuaaggaauaauuuccagagacagccaccuguuccauguaucacccagcauuuucaccuuccauagucuacaucucagaccuccucauagcuuccuuaugucagcguccauuacaugcuuuugaaaauaccaggaaaguaguaacagaaaacaaucuugacuuucuaugagccagaaauagaaaaugggucuauuaaccaacaacaacaacaacaaauuacgaacaaccaaaaccaaaccaaacccaaaaauaaauaaauaaauaaacaaaauaaacaaacaaacaaacacaaccacuaacaucacaaggugagucagaaacccagaguggagcauuugaaauauguaugguuucuguaugguuucacauggaaguuauauauuucugugaccucucaauuguguauucuagggauuauaccauauauggaauuuguguguuuauaguguuccaugauaaaaggcaaggacucuaccaaguguugucuauagaauaccaaagaaauuggcagggugccaugucuuuggcacacacugaaaagcaguuguagucauuaagguagaccaauacaaaggaaagcaccacaccauggcaguccuuuaacuuuucagauguuuaucuucucagcugucucauaaagcuaacuggaacacacauccaagcauccagugcuugcccucuaguuuguccucaucucucuaccaccaccccccaguccuacuuuaacucucugugcuuaauguuuccaugucauucucugugcuuaauguuuccaugucauucagucuugccuuagauuuugcucccaucuaaguucagcuuuauagaauucaccuuucagaauuaaaaguccaacauuuagcucaaccacuauuguaaggauaucuacuuuauuucaguggcauugcauaccuaagguggacaagauaauauuuaugugaaugaauauaaaaacagaauugcccuugucauuguaucuacugaauuuaugaugagugaucgguuauggcagagcaccauuuccuuaucuugugcucacuuuguucauccacuaauaugacugcuccaguuuuaccauuauuuuucuaaaacaucaucuuugcaguaugaguuuuacaaaaauaacauuuucauauaccacuaaucugacauauaccuagcaaaaaaauaaaauauuaaacauccuccaucuuugaacagaaugaaaaauaauaagcauaauacaagaccccauuaacaauucuaucaguacaaaaauauauccugguauauuauguaacauccucuugcauuacuaucucugugccuaguuucauuacacauucuaugaauaccagccaaccucuuggcccacgacuuccccacauuuuucuuucauguuaucccuuuaggcugugcuuuguuucucuuccaccuuuaacugggaaaacuuuuuaggcaccucucagauucuaaauuccuaaguggcuuuccuacuucuaaucccucaaguaucugguaccaccgaugauaucugcauuauauaacaagcauuauaucccacuucccauuucccuuccuccuuucuuucuuuccuucaucucucauuguuuccacucuauuuuauugaauaguauaaauacaucuuuauucaccucugcucuuaaauucuuuuuaaaaaauuuuugugugcuguauacaaacagauaugucuauguguacaugcuaauauaugugugucucuguuugucucucugugugucuaugucuguauguguaggccagaggucaacaucuauugcugucugccuuuuuaaaaagauaguaucucuuacucaaccugagacucauucaauaggcaagaauagcuggaagaaagguccugugaucuuaucucugccuucccagugcugggauaacagauguguaccaccaugccugccuuauuacauggcugaugaggaauccuuacuuaggucuuugugcuuguaugacaagaacuuuacugacugugccacacccucaguccuuguggcuuuuaaauucuauuuuguuccauucauuuauaacuccugcccaauguuuaucuccuaauaucagauuuagcaaaaugaaauaaagaauaaccaauuaaacccaaauuacagaaaaauaacaaagaacauuuuacuguaaguguaucauaugcaguacuuaggauaauggguauacaaaagaacuucauuccuaaccugaaauucaaacuuaacugcucagcucaccuuuuaucuggcaacccuacugcugacccucucuacuuuauguaauaaaauacauagacacagaauaugcucaaguaaugauaaaaauauaaacaauccaaucaaauaauacagauuugggguaucuugugacuucuagcuccccauuugggugaucugggugucauaguaggaaagcuaauagaaagguaaacaaaguuugguuggggaacaugagagcaaaauauguaaggaaaagccuagaagaaagaauauuuuaggaaccacagagacagcucagugguuaauagcucuauguuguuucagaggacauaaaugcacuucccagaucccacauggaagcucaaaaacugccugaaauuccaguuccaugggauccaacacauucuuuaggccuacacaggcaucagacaugcauuuagugcacaaauaucuaugcaggcaaacacucacauauauaauaaaagaucuuuagaauauauuuuuuuguaaagcaauacuauccacaugcuuaacugaaaauacuaaaguaacacauggucacaaaauugaaaaguuguaauuuucuccuuaaguucaauacuuuaaacauuucuaauauguacuuguugauuuuguuguuguuauuguugauuuuguguuuguuuguuuguugucuuagggauugucuugcugcaauaaaaaaaaaaaacaugauuaaaaaguaaguuggagaggaaaggguuuauucagcuuacacuuccaaagggagucaggauaggaacucauacaggggaggaaccugaaggcaagaucugaugcaaaggucacaaaggggugcugcuuucuggcuugcuuccucucuaauaacucuaguuuguaucaaguugauauacaagaccagccaauauguuuguuuauuugacacaagguaucucuacagaguacugcuuauccugaagcugacuauguauaccaggguggccugaaacucagagaucuuccugcaucugucuccuaagugcuaggauuaaagguaugaaucauuaugccuggccuuacugauuuaaaaaacuuucuuacauuuggaaaaaaaaaucccuaagagucuaaaacuucuugucaucuucaugaaauaacgucacauuuuuagacuuaauguccucuaaaaguuuuuuuauuuguaaugugaagguauauuuauauuucuuaaaggauuuagcacauaauuguugauacuggccagggacaaacauagcauaagagcugagcugcaucauaauagagccacuuacacucagaaaaaggaaaugggcugguucugauuauaaucuggugccagauucccacuccagcucuugauuuuacuuuucccuacaagguucuaacugccugguaaguaucguuauccagaugucuaauacuccuuuaaagaugucaugccgcucaaugaacuacagcaacaaacuucaucuuauucuaucauccauucuugggcuuuaugaagauagguauucaacaaaucuuggcaguucuaccuggcucuaaauucaucauuccacauaccaaauagacuauaacuacauuauuaggaagcuaucagaagauccugaacacaccucaauuuccucuuuaaauucaucaugauaaaucauuauggagguguuagaccuaacuaaguaaaaauuuauucaacaugcacagaaagcaugaaacauaacaauaagaaaguaggaaauacagaauauauguguuaaauauaaaaaagaaggauggaaggacuaaaagguaacuaacuuucaggcaauauuaaauauauaugaggcaccugggcucuaaauauucauguacacuaaauauacaagucacuaaauauucauaaguccucaauauucaugagaucuuaauucagccacucauacauuggugacauccauucuggccccaacugcacucugcccaagaaacacaaacaaaaaccuauucagcggugcuacuggugagcugcagcuguggccaagcauacucauccccauacugauccguuugaguaaguguguaccuuuggcccaaaguuucuccugccuugauucuucuuguuuaaccuucaauauuggucucuaaaccacacuacuugcuaucaagguuuauagagggguauguguguguguguguguguauguguguguguguguguguguguguguguguauaugagcuaauaucuacccuaggaaucagguaccauguacuuuucuuccauuuaaacuugguccaaagugucucuuucuuccugcuccucacuguauuuuuuuaaagauuuauuuauuuauuacauguaaguacacuguagcugucuucagacacaccagaagagagcgucagaucucguuacagaugguugugagccaccaugugguugcugggauuugaacucuggaccuucggaagagcagucgggugcucuuacccacugagccaucucaccagccacuccucacuguauuuuugaauugucugacuguuuaguuaguuggcuugauuuuguaguaugggaaauggaacucagcaccuuuaaugugcuggguaagggcuuuaaaacuaaacuauauacccagcuagcccuugcuaagcauuuuaaauuauuuuacuguauuaugugauucauuaauuuuaauuuggcccaugagccuuuucuuugguggucuaugggagagucuaucuacauacuucuuggaggccaacauuacuuugagguacuuauauaagugccacauaaagaacagauaaugaguggaaaggaaauuggagacagaguguucauaguaggcagcugucccauuccuauaaucaagcaacaaaaguagcauagguuugaauaauaacaaagagaacaaaaagacauagacauauguuuugcugagaaucaaaaagcaggacaguagguuaaguaugaagaaauggggaaaguaaaaagugguacauauuguagucagacagagaaguuacaaagugugaaauauuacagguagcaauacuccaaaagagaacacacacacacacacacacacacacacacacacacacacacacacacacaguaaaacaucauggcuccucgaagaauaagaaacagcacuaagaccaaacaaacacucaacucuccuauauuccuacugugcuguuagugcaaagaguaucuaaauaaggcacucacuuacccaucaaagauauuugagucucccuauuucaaacaucuuuuguacugcucucuaacacaugacaaauugucaguccugccaucaucaugauugauaucccuugacagcaucuagaauccagucucauuucagaggaagaaccacagcacaaaaggaaaugucauuuccuuuuaucucuaggaucagcuucccuguggccacaagguaaacucuccuuuauagcagaaguggaacauugauaaagacgacaggcauuuacagagaaagaacagggcucuguugagauacuauggcaguuaaucuugaugauuucauuggacucagaaacaccaggaaacuagaaauacauaucaugguuacaucugugagggcauuuccagaaugauuaaauuaggauagucuugaccuaauaaacaggauaacuuagacuuuaacaaaggaauuaauccauuaauggauucaaaacaugaaggguucucuuuggaacauguagaacuuuagccaguaggcuccgauuggagggauuaggccauuagcauaucauuggugguuguaccuugcacuggcuccugcuucuguucuagucagcuugcugaucaucacaaugucugcugccuacuaagcuccuugcccagccacauacacacacacacacacacacacacacauacaagcacugagcagaaagaaugaccaaacagguauugccucccuuaaguuguuuccauaagaaauuagucauagcaaugcuaaagcuaacugucacaguuaaacaaccaucaaggucaugauaauuuccauaguguuagcaguaggugaggagaaacaggaugacacauguggcagccagcaaaaucaugaaagaagaaacauugucacccugaaauuuacagggggggaagcuuucuuuuuuuauuauuuuuguauuagauacuuucuucauuuacauuucaagugcuuucccgaaaguacccuauuacccgcccccccaccccccaucccacccacuccuguuuccugacacuggcauuccccauguacuggggcauauuaucuucacaagaccaagggccucuccucccacugauggcugacuaggccauucucugcuacauaugcagcuagagacacaagcuuggggggagguacuaguuaguagauauuguuguuccuccuauaggguugcaaaacccuugagccccuugaguauuuucucuagcuccuccauugggggcccugugcuccauccaauagaugacuguggacauccacuucuguauuugccaggcacuagcauagccucacaagagauagcuauaucaggauccugaaaacaaaaucuuguuggcauaugcaacagugccuggguuggguggcuguuuauaggauauauccccgggugggacagguucugggugguccuucuuccagcucagauccacacuuucugucucuguaacuccuuccaugguuauuuuguuccccauucuacuaagaaagaucaaaguauccacacuuuggucuuccuucuucuugaguuucauguguuuugcaaauuguaucuuggguauucuaaguuucuggguuaauauccacuuaucagugagugcauaucauuugaguuccuuugugauuggguuaccucacuuggguauccuccagaucuauccauuugccuaagcauuucauaaauucauuguuauuaauagcugaguaguacuccauuguguaaauguagcacauuuucuguauccauuccucuguugaggggcaucuggguucuuuccagcuucuggcuauuauaaauaaggcuacuaugaacauaguggagcauguguccuuauaaccaguuagaacaucuucuggguauaugcccaggagaggucuugaugaaucugcccauaguacuauguccaauuuucugaggaacugccagacugauuuccagagugguuguagcagcuugcaaucccaccagcaauggaggccuguuccucuuucucuacauccucgccugcaucugcugucaccugaauuuuuuaucuuagccauuuuaacugguaugagguagaaucucaggguuguuuugauuugcauuucccugaugauuaaggauguugaauauuuuuuucaggugcuucucagccauucggcauuccucaggugagaauucucuguuuaucucuguaccccauuuuuaacggggucauuugauuuucuggagucuaguuuuuugaguucuuuuauauauuggauauuaguccccuaucugauuuaggauugguaaagaucguuucccaaucuguugguggccuuucugucuuauugacaguuucuuuugccuuacagaagcuuugcaauuuuaugaggucccauuuguugauucucaaucuuauagcacaggccauugcuguucugcucaggaacuuuuccccugugcccauaucuuugaggcuuucccccacuuucuccucuauaaguuucagagucucugguuuuauauggaguuccucgauccacuuagacuugagcuuuguacaaggagauaagaauggaucaauucgcauucuucuacgugauaaccaccaguugugccagcaccauuuguugaaaaugcuguagcuuuuauccacugaaugguuuuaguaccuuugucaaagaucaagugaccauagguguguggauucauuucuggaucuucaauucuauuccacugaucuaccugucuguugcuguaccaauaccaugcaguuuuuauuauaauugcucuuggggucaggcauggugauuccaccagagguucuuuuauuguugagaauaguucuugcuauucuaguuucugcuauuccagaugaauuugcaaauuucuuuuucuaacucagugaagaauugaguuggaauuuugauggggauugcauugaaucuguacauugcuuuuggcaagauagccauuuuuacuacauuaauccugccaauccaugagcaugggagaucuuuccaucuucugugaucuucuucgauuucuuucuucagagacuugaaguucuuaucauacagauuuuucacuucuuuaguuagagucacaccaaggcauuuuacauuauuugugacuauugugaggguguuguuucccuaauuuuuucucagucuguuuauccuuucuguggagaaaggacacugauuuguuuaaguuaauuuuauauccagcuacugcacugaagcuguuuaucagguuuaggaauucucugguugaauuuuuagggucacuucuauauacuaccauauggguuuagugcagaaaucuaucagaccuuaaaagaagaucuaauucccauucucuucaaacuauuccacaaaauagaaacagaagguacucuacccaauuccuucuaugaagccacaauuacucugauaccuaaaccacuaaagauccaacaaaagaaagaaaacuucagaccaauuuuccuuaugaauaucgaugcaaaaauacucaauaaaauucucacuaaccgaaugaaagaacacaccaaaauaaucauccaucaugaucaaguaggcuacaucccaggcaugcagggauggcuuaauauacggaaauccaucagcauaauccacuauauaaacaaacucaaagacaaaaaccacaugaucaucucauuagaugcugagaaagcauuugacaaaauccaacacccauucaugauaaaagucuuggaaagauuaggaauucaaggcccauaucuaaacauaauaaaagcaauauacagcaaaacaguagccaacaucaaacuaaauggagagaaacuugaagcaaacccacuaaaaucagggacuagacaaggcuguccacuuucucccuaccuauucaauauaguucuugaaguccuagccagagcaauuagacaacaaaaggagaucaaggggauacaaauuggaaaggaagaaaucaaaauaucacuauuugcagaugauaugauaguauauauaagugagaagagcuuucuuuucucccaagaaagaagcaauagcauccuggaugaugguacuggggugauauagcgacacuaaagaaaccaaaagcuuuaaauacauggucauagacacaggaaaguuuacuauacuagauacaguaauauagcauauuacuagggggagggcaaaaauggccuauguugaguuauaaguggcagaaauauaugucacuauugugaacuacaggcuaacaucauguuuacauucacugcugccuauaacugagaugccuaaguauuagcaugggaucuuucacaaagcuaaagacagacaauauauaaaggcaggaguugaaagcaaaaauaucauguugcaguuuuaaauagauaccuugaggcaguccacuauuuaucacuucugguucauuuacuugaauggugucaucuucaagguagaaauagauuuuguaguaucuuauucuaaagauuucuugucuuuuaucagauauuucaucuuccaaauaggcaucaaaagauaacaccuguuggaaccauaauuauaaacugugaaaaaaacagcaaacuuaaaauuaauaaaacuauguccuauacaaccuuuguuaaagaagaaauuugguuuucuccaagacauucuauauaucagcuaaagaaaacaaauauaccaaucucaguaauaguaagugaaaauuauuugacuuucaccgcagucugguuacaacaucaauaacaaaauuauauuaaauuaauaauuccuucuuucaguucuucaaaaaaguaaacuuuguccaucuuuggaaucucaaaauaggauucacaguguguguuagaagcacgaaauacuuuuucuuucaugaugaacaaaacuuuauuuuucucauuaaaaacagcacaaagcuacuuuagcuauagaauaaaauuauucugagacuuagucuuacugauugcuugccuugacuuagcucaaaaagaccaaucugaaagccuucuaagagcauggauacuccaccugcuauuucuccaggaagcuaaauaaucuagcacugacaugugaauggggaaugaaauugauucuaaagugguuaugguaaaaaaucagaaacaguuaaaacacugaauaaaaaugaggauaugaccacuccaagguaugguucaggagaaaguuuuuacuguauauaagagagcaaguacagccagaggcauccagagaaugcagagcaggaaaagaaaguacacuaggcauggccacuaaaucaagccacaggacaaaagagagagaggaggaaagcuagugaggaauagaagauagagaaguggccagaggaagcuaagcucauugccuggagagguuaaggcucuucuuacuuacccuuaaccucucuaggcccugaguuuagcuucucuuuccccagcuucugauucuaauauaccuugccauuuuagaucuguaauugcaguacucauggccaaauagaaagcugagacaggaaaaucagccaaagaugcagguauguaauauagugacagaaacaagaguucucgccucaaaaacaaaguggaagcagauaucacacucccaaaaguuguccucugaucucuaaauaugugcccacaccaaacaaguacaaaaguaagugauuucaccaagguaaaugaauuccaucuaucaaagaauucagaagagggaauuuaaaaucuguuagaaaugaaaauguauagaaacauaacuauaagucuagucuaguaauuaaugucuauaauucuagcacuugggagacuaaggcaaaaggauugcugccaguucauagcaacaaagaguuccaugcugaaacuauauacugaaacuauaaaguaaaagucugucucuaaaaagaacaaaaaaauaguggagaugaugauaaaagguuuuauaauuuccgaguuaaaccuagaggacacaaaugcuugaaauuuucuuuuuuuaaaguguguguguguguguguacaugugcguacauguacacaucauaggggucaaaauacgacuugaaaaacuaguucucuccuuacuugaugcugguucugcggaucaaacucagcucugcagccuuggcagcaaacaccucuacccacugaggaauuuuccagcccuccuucuuaaaaagaaaugcuauuuucuuaaaaacagagugugaauggcauuugguauaauauguaaucuuuauuuccucacacacuucaaaagucgccacaguauuuacuauacuagguuaccucccugaucaccaagguauuuggagaguuuuaaucauacagauuacaggauauaaaaucagcucuuaaaaaaaagguacaugaggaaaaacaguuuuggaaggaaaaauuuaagguuuauauuucuagauuuaggaucauguuauaaauaaagucgagaaauucaaagcagucaaaaaaaguacauuuugaugggugacuugcaauaacuugacacaguacaauuuuaguuuucaaugaaaaaguuaaaauuauuuucaugccaacucaguuauuugcuuuugacuacauaguccaagcuggauuuuaacauucauuuugauucuuaucuuacccuuaaauuguuaucagcgauuacugucuagugaagcacugacaugaaauaguauugcaugcagaagucugucuacuauccauaaaaagauaggacuuauaauuauaaggcuaaagcaacagccuaaucucucagaacaaauuacauauuuuuaaaugaggguuuagaguaaucaaugcauaaguuuuagggauuauuuacucaagaacuaacaucuaaauguaagacaggucuaaugucugggaccuccauucccagugcuaagggggacaggacuugggguauagaacauugggaauccgaacaacacagugagacccugucucaagaaaacaaacuccaagugucaaaaucuuacauaucaauuucuagagaagcuauuaggaaagauaaaauaccaauaauguccaagaaggcuugacacuuugaaaaagggagaucagugucacgggucaguugaaauuuaaaauguuuaggaagcugagcaugaugguacacacuuguagucccagccacucaagaggcuaaggcucccuacuuaagcacagauuuuccaagccaaccuagacaacauuguaagacccugcccacaagaaaaggcugggguggggcaauaagauaaagaggaaaagagaagaugaaugggucagagaugagauaagauagagaauauagcacaagugaguauauaaaaagaccuggguuugauucuagaaccacaaaaaauauuaauaaaaauauuuaggcuccauuuuauaagaaaggaacucugagguaaguuaugaaauacuaaagaagguaugaauaacaguauaaagaaaaucaguagagugcaaaaaaucuaauaccacagauagaugaaauucaaagaaaaaaaaucacaaaaaaucaaucuaaaaaugcuuuaaauaaguaaaaauucagaagagcucaccaagagagacuauauauaaaaucagaaaugagacacuaugugaucuaaaacuuguaagauucauacuggggagaagccuuauaaaugugaagcaccucuuagaguacagcacaaccucccugagaggauugacaucuaagaaaacugauaauugugcuacccagugucuaagggcagagugggguuaucugggaacaccucuacauuugagguuccaggggaaaucccuaaugaacacagauucagaccaauugguggugaagcuucuagaagcuuccuacugcccucuguaucccacucaggcuggucccagagagaagauacuaaacugaugaucugcauuguuucuuggaaccagagcaaguaaagccaggugucuuuccaggcucagauggcccaagauccucaaggcacgaagacccaagcuucaggugcucacauggcuacuguucuucccgguuccuuugcuggucugccuagaauggcccacucugugccuucguaccugcuuccccacaauauuacuuuaugccuaacuccaagucagacuugggaaguugccucuccaugccaucccucuaauguucucccugcuuuaauccacagugucuguuuucucuucccacaucuuccucccacaucucacaggcuccagcccuauggauucaccucaggcucaucucuaaucuagacccuccugaaguaucaccuccugugagcucaccuugggccucccacuggauuuuuaucagggcucucuuuucucaccucuuccugccuucauuccaucuccacccacuuucuuccaggcgcaucucuuucugcuacccagaucacaguaaaucauuccaugacacaauauguugucagugagucaccuccuuaacaaacaagcaugccaggauacaugucauuuuggcccaagcaauuacucuagguauccucaaauguguauaagaauguugucauuugucuuugagcacagugugugaaagugauuucaaagaacuggucugccuguugggcaaaauaaaagaaagaaagaaagaaagaaagaaagaaagaaagaaagaaagaaagagagagagagggaggaaagaaggaaggaaggagggaaggaaggaaggaaggaaggaaggaagaaagaaagaaagaaagaaagaaagaaagaaagaaagaaagaaagaaagaaagaaagaaagaaagaaauuagguaauauaaaaagagaugaaauaaaaauacuaggaagaaauaaaacaucacuaugggcagacagguaaaagcuaaauagguaaaaguauaaaauuuaauuauaaacacgaccuaauaaaaauauuauaguuagaaaauauaacaggaagacauaugcucgcaauacaaaagaaaaauccuacacaggaccagugagauugaucaggacauagagauuaugaagccugaugguugaaauucaauaccuggaaccuacaugcuggaaagagaauauccauuucugcaaauuguccucuauucauguacacaguggcacaugaacauaugcacaccuguuugcauacacacuuguacauauuagguaaauaaauguaauaaaauuuaaaauuauauaacaaagcaguuuuaauuaaaacuuuguuccauauaaaacccaaaacauuugcuauaagauacagaacuugacuacaaaucaauuauauuucuggauauguagacuacaauauuucauuuggugguuucauuggaauuaugaacugucauaauaauucuuaguaaaucugauuaaaaauaagccagguacuauuaauaacaacagcaaaaaauuaaggagcaauagagaccuagcucacccagauuuuauaaucaaauggcacaauuauuaaaacagaacaaaaccagauuauugagacacauaccauuugaugauaaagaacagauucuauagccgggagugguggugcacgccuuuuaucccagcacuugggaugcagaggcagaggcagguagauuucugaguuuggggccagccuggucuacaaagugaguuccaagacaaccagggcuacagagaaacccugucucgaaaaaccaaaaaaaaaaaaaagagagagagagagaauagauucuauugaguacacaaauuuaauacauaauaaaauaaucacaaaugacaauuacuaacuuaaacaagcuggcuguauaucuccaccuaauuaaguaucagcuuuaucccaacaaaucaaccucuuucaggacagacacacacacaaauaaggaggugaaggugacagcacauaggaagaaggacagaaugaugggacacuguacggaauucuaggauuuaaagaaaauaaaauggaaaauaugaaaagaaacaaacuuggcauuuuauaauaauuuuuacaugaacaaagaauucucacccuaggaauaccgaaaggcugagaaacaccugaaaaaauguucaacauccuuaaucaucagagaaaugcaaaucaaaacaacccugagauucuaucucacaccagucagaauggcuaagaucaaaaauucaggugacagcagaugcuggcgaggauguggagaaagaggaacacuccuccauuguuggugggauugcaagcuuguacaaccacucuggaaaucagucuggcgauuccucagaaaauuggacauaguacuaccggaggaucccucaauaccucuccugggcauauauccagaagaugucucaaccaguaagaaggacauaugcuccacuauguucauagcagccuuauuuauaauagccagaagcuggaaagaacccagaugucccucaacagaggaauggauacaaaaaaugugguacauuuacacaauggaguacuacucagcuauuaaaaagaaugaauuuacgaaauuccuaggcaaaugguuggaccuggagggcaucauccugaguaagguaacccaaucacaaaagaacucaaugaaauguacucacugauaaguggauauuaacccagaaacuuaguauagcgagauauaagguacaauaugcaaaacauaugaaacugaagaagaacgaagaccaaaguguggacacuuugcuccuucuuagaauuggaaacaaucaccuauaaaaaaaaagacuauauaaaagaaauuagaaaaacaaaugaaauguuuacuuuaagaaauuaccagauacauccaauuaaaauugccagaggccucaaguuuguuacuguauguuucuucuguuaaaaggauaguuaaucauggaggguuuggguuuauccugaaacauauuauuuuucuguuccaggcuggccaugaacuucugaucaccugguauugcaguauuacaaaagaaccaccaugccucaguucauauaacauuuuuaaauauugcaguucuucugagacaauguggaacaauuuuuaaaaauccuaaaccuauccuucuugagacucgggaagucugggcacauagccuaaagagagggaaaaaucaaacuagaaaucuuaaauguugcaaagauauuuuacugcauuuuuuaauuauaagggaaaaagaguagaaugggggggggggucuaaaagguuugaaacgaaauaguuugguaaauuaaguguauguaguuccugggauauauaaacucacuaauacaguuuuaagaaccauauaguaauaauaaaauuacuugagacaugcagaaauguuaaguuaaaaauuacaaagaaugguuauaugucauaauuguuuuaagaaguaucuaagugggcuaaaggauaagcucacaaccaaaaauauaggaaguauguaaguuuaguuauacuuuuuuaaaacuauaccuaugcuauuugaaaagagggagaauguaggaaggggacuaaauacuugauagauuaucagcuuuauguuaacaaaucaaccucuuucauuuuccucccacaaaaaugggguagauugaccaugguauacuaggaaagauaccacaggggucacagaaauaggaagccaggacaccaaagggcauuccaguauuucauaaauauaagaaauauaggugaggauggagguguuaugacuugaggaggacaggaagagcaacaaaaacaacaacacggacccuugcagucucccagggagugaaccaccaaccagugugaguacccacuggcuggaccuugaccccugcauauauguagcagacaugcaacuugguauuccugugggucccccaacaacuagagugggagcugucccugaaucuguuuccuaccuguucaucucuuuccccaacugaaccacagugccuggccucagugggagaggaugugccugguccugcagaaacuuguggagggggggcgggggugauacccgagggguucccccuucucagagaaaggagggaagaauggggggguguucugagugaagggguacugggagagggagcugauacuaugauguaaagugaauaaauacauuuguaaaaagaguuggggaaaggagaaagggggugggaaagggggcacauagguuuaagggguaagggagaaaugcuaauacauagguuuaaauuauguuuucaaagacacaacuguauuauucauaauaggggcaagggcaacaagccacgaguagagagcgaacaaaguggagacauaacacaaauacauacaaaauggcggcaacucaccaccggaggucuagcgaggaccacauaaccagccacaagaaagaagcggaaccaagaaacaaaaaggcuuauggagaaaggaggugggguugaggaggggcuccaggcuucuggccuauccacugugaauaagaggaacaauagaggcugaacuauuucucuccuagccaguagagguaaagucgggaggaggggcccugaaccccaagccaaagguuacauuguuugaugaaccggaaguaugucaucaaacaggaaacaggggcuaaaagucgaaaauccucgucauucugagaagcucguccuggcguucggucgcugugugaagcuucuccggaauccugaucucuaguuuuuccagagcacuuugaaaguacggcggaagguccugaacaaaguugaaacaagaagaaagguuccugaggcaucgcagaaggagccgcgugaguuccagcaccauuugaguggugcccacuuauaaaccccucacaucgcaaauaguuuugccccggggacuugguuaagugacuuggugagggcuaaaggcccuaggggcuucaagggccaaaaaggccaggaagacuuugugaacucugaaauuuccccuguggcacauucuauagcucaauuucuccccuuaauuucaggcgugaggguagagcuaauuucaggcgugaggguaguugccuccguagcugcuacagugggcaguuuucugcaguuuuggggacugacuuuucaaauugccacccaguuucuuaacgauggcuucucuagaggaugccuacggugguaacaagcauggcucccacaauucugaauuugaaacugaagcagaaggucaaaauaagacugaggcaccaaaaaccucucagagaaagagggacaaaguucaagaacaggauucuucugugauuuaccagaaagcuaucuugggaaaaucaacacaaaaagaaaggggagguucucuggaaggaaaggggauggcuccaaggacaaaagggcuaaaugguaccccaaauggaaaggagggaacgggagcccuaaguggaaaggaggaagcuggugccccaaauggaaaggaggaagcuggugccccaaacggaaaaggggaggcugguguaccaaagggaaagagagagacugauucccuaaaaggggaagcuggugaccccauagggaaaggggggccuuguguuaauacaagauccagugcaggagccccccauaagccugggcuggagauuccuaagauggaagcagagcauuuuaaagcuggagcaaagacuggaguggacugccucaaggcuggaguggaguuuaagccugcauccucucuggcaauacagucuccaaagccuagaagggaaaggaggacuccaaaucccaacguggagccuccaaagccgagagcagagccuccagagcccaugguggaaccuccaaagccugugguggaggcuccaaugccuagugcagagcccagggcagagccucuaaagcugggaggaaagccuccaguacccagaguagcagagccuucaaugccuagagcagagcccacuauucuccaagaagagcccucuaagcccagagcuaaagcaccagcagaguuuacuacgacccaaggggcaacauguucuggggcuggaauggagaauccuaagaugggcagaagacuaucuaaaaaucuuccuuuuguggcccagcuuccuaagauaggcaacuuuggagagaggaaauggcuucuccguggauuuaaaacagcuagugaggaguuauuuggugacaaaaaugcaaucagcuaugaaaaaagccuucugcucccaaaauaucagagugaggauaauuccucuucauuccaaaagucuaaagaaagaggaaugacugaggccuccaacucuucaguaaguuacaggucuaauguuaaggccuccagagcuagauucauucaggaugcaucauucuccccaagacugccagccauuucacagucuuuauccuguaagaauaagaaugacucccuacagccuaguucauacuuuagcccucagaauaccaacccuuguacuaguccuaccacauccaggaaugagagagucaggaaagacaucccaguuggcuauucuuacuauacuucugaagagauaagcggucguuugcagggaaaagaugauaaggaauacuguaauucccgcguaauuuuaucuuccaaaggcacagaaacacaggcaaagaacacauaucaagagaaugagcugccauauauucagggagcuggagcaugugcaucugauuuccugccaaguggaaaucaaagccaaauggaagguuucaucgauacucauugucacuuggacaugcuguuuuccaaguuguccuuucaaggaagcuuuacugaauucagggaaauuuauagcuauacuuuuccuaaggaauuucagggcugcaucacugauuucugugauccccguacccuaagaaauggucuauggaaagcgcuauugagugaagaucugguuuggggugccuuuggaugucauccucauuucgcacguuacuacaaugagcaucaugaaagaaaccucuuguuugccuugcgccaccccaaggcuguggccuuuggagaaaugggcuuggacuacucuuacaagugcaccacaccugucucagagcaguuuaggauuuuugagcgacaacugcgguuagcuguaucuaugaagaugcccuuggugauucacugccgagaggcugaugaagaucuaaugggcaucaugaaaaaaugugugccuugugacuauaagauucacaggcauugcuucacuggcaguuacccacucauugagccacugcuagaguacuuuccuaacaugucuguaggcuucacagcaguucugacuuauucuaaugccuggcaggcacgugaggcucuaaaaaaaaucccacuggagagaauucuuauugaaacugaugcuccuuacuuucugccucgccauguucccaaaagccuuugccaauaugcccauccaggcaugggccugcauacugugcaagaaauugccagaaucaaaaauaagccacugucucauguccuggccaccuugcgggagaauaccucuuaccucuacaacauuuaaaaaagaaaggacacagucaagagucuugaaaaaguguuagccugacaaaaucaaaggauuuugaacaccuuuaucuuaauaaucuauucugaguucauaaaaguagagaguaucuggacaagaugccuuccucaaaaucgcuccuuaauauaucuacuucugauuggacugcaguaagaugggaacagagacucuggaggugcugcaaguguuaagaaccaaguaagguugagugugaaccacugagagucuugaaucugaacuuaaaauguaauugugaagcucuucagaucucaguacaucaucauaacauuggaaaauugauucagacuuuagaaaaaauacuuguguuaaugaagcuuacugugguguggcaacauacauaccacauuuuugggugagaaaugaaaggucuuuuacccuguaaaaaacugcauccagaaaagauggcuuaccuccaucugucuuugugcucaaaagucacauucacagaaauguuaucucugacuaccaaucuaaagagacaaauaauccuuuuguuuauuggaaucacagcacuuauuuagcauguuuuaaauacauuugugcguucaucaguuauaguuuacuauguuguaagcuuucaaacuucaguguuguuauacuuaaccuuacucagucuuagaauacuacuuaggaaguaagcaaagacuuuuugacauauaaauuaguaacuaaccucauuagcauuugggggaaguuaauuauaauaugugggauggaagaugauauuaggagaauaauagagaauaagacauuaugccccucuuugauguaaaaacuaagacaaaaaauaaugggauauguacucugcuuuuagguaccaaauauaaaguauggcaagccuuaccagaaaacuggcauaucguacuuuauauaaauaacagaauauaucauagauuucccccuuuguuugagaauccagucuuuugaagaaaaaguuuuaaaugcaaauaagcuguguuuuaacagaacuagaaaaguuaguagaauguaacaagcuugguuucauuguaguuuucaagacacaaacuugaaaaauucuuugaaccguguaucuuuuucccaguuaauuaauuugcuauugcuuaaaguauccuucaaccuacaggggccugaccuuuuagaauacuguacaaaacaagguuuuauaaauacacauuuuaggaaaauaguuguauaaaaucauauguagucuuuuaucuguuuuaaauuuuaagguuugauguguucuuugauguauuagcauguaccauaaauaaccaaaaagagacacuucuuucuuuucuuagagauuaaugcuauaaaacucaaccacaaauucuccagaaauaccaguuugggaaauucuaccuuagccauacuauguggguagguaugcccuuaauugcauuuuucaaaacucuauucaguguauuucaguauccucuuucauuuaccuuucuuguuaccuuagcuuugugaaagagggaaaucagugaugccguugccaagugacacugucaguugaacauuucaaagauaaguguaaaugaaaaauuguaucuugaacugaggguauggcucaguaguagagagcacuugccugauacuugaaaaguccuggguucugccugcagcacccauaagcaagcauauuaccaccugcuucuguaaauacacauucagccagauaaauaggcucuacaaauaaggaaaguauuuuuacuuuccaaaauaauguuacuucuacaggaaaacuaucuuucuaacuuacuuuuuuugcuaccuuuuuaugguaaauggcuggaguguauuucuuaauaugcagaacacuucaccauauuuuuucaggaaugggagugagcaguauaguccuaucugaaugaccuaaaucaaaaacagcaauuuucacuuacagagucuaugauuagggguaaggaaucuuuaaaaauagauauucuguaaauguaugagauuugggccacuuugugaauauuuuuuguuguuuccuaugggguuuuucuuuuuguuuuuguuuguucuuuuugauacaggaucucacuauguagaccugauuggucucaaacucaagagauccacuugccucuuuuuccuugaaaguuuagguauugaaaguuagcacuaccauguccagcuuuuaaaaaaaaaaugugaagguaugugcaugugaguguaggugccuuuaaagaccaagaggaaggugucagaucugcuggaaaugaaauuacaagcaacuaugagccaaccaauauggcuucugggaagagaacucuguccucugcaaaguuaguaugcaaucugaucagcuaagccaucuccaguucccuguaaauaguuuuguacuuaagcaacaggcauuuuuuuuuuuuuugagcuucaaagaauuauuuaccccuccccuuuuugguaugguacuuaguguguccauuguccuauuuuagauguaucaggccuacuagggcagccagugguauagaaauguaacuuacuguuagugaucccuaagccauuggugacuuaguccagaaucacagggcuccucaaacuuauuaacagccaucaccucucugaacccuggcguuccuuuuagagcacuuaaaauugggauagagcucucuguaacaguguauguuuagcaugcagaaguuccugguuucagucagcagcacuuaacaaaaauaugaagcaaaaauaauaaaugucagcuaugucuauaaugaaaaaucaaaggcagaaaauagggcacuuugucuuuaaagacaaaugauuuuguucuugaggcuuuuauucauaccuaaaucuaacuucaagauucauaccugcuuacuauugaguuuucaggauuccuaauugaaaacaaaaacaaaaaacaagaaacaagguagaaacaguaaagugugagggcguaauccaaccacaguagcuaaguuuuggagugacuuucugccaguugucuaauauuuccauaguuacuggcuaauccauuccugaaccaauuuugcuaauauuuguuacaguaguuucuuuacuagcauauaaacuacauuacuccccugaauuugugacuuaaaucccuuuuuucuguauuuauuucaaagcaaacaagugugaaauguguuugauuuagauaauucuugggcugccugggcuuauucaaauuucuuuuguuugcugcuuuaugcaacugggcuuuuaaacuuaacguuuugcuuugcacucugauguuucauugugcuuucucugaugcacuaagcuauaugguucauuaacuuuugccuguaauuauaauucugcuacauuugaauuuuuuucuuuucagaaaguccccuuuauaaagauucauaaugcauuacaaauaauaugacaaggaaugggaaaaggucccauuuuuauuuccuaaaacccacuacugaugguaucuuuuauauaaguguucucauauagcuauacuaacuugcauauuauuuuaaguaacuuguuuucugauuauaagaggaauucucauacuuaacgacuauauaccaccaaaauguugucaguaauaaguaggagauuuugggguuuuuuuguuuauuugggguuuuuuugguuuuuuuuuuuuuuuuuuuuuugguuuuuugguuuuuuguuuguuuuuugguuuuuccagacaggguuucuuuguauagcccuggcuuuccuggaaaucauuuuguagaccaggcuggccucauaaaucccugccucucccucccgagugcugggauuaaaggcaugcaccaccacgcccggcuaaauagauuuuuaauauucugguaauuuaagucaaaacuacuucacaucauuuuccccuuuuaauuugaaacaaggcuuucuauauaacccaagcugaucuugaauucuaucuagauccuuuuaaguuucccaagaacuacaaagagcauauauuuuuaaaacagaguuaaaugaaaaacauuccgaggucauaaaggugauaaagaugauauagagacaauuucuuucuccuccuggucaacagauuuuaacuauuacuauaauuuuuaagaaauaauuucaagcaucccauacauuaauaaugguugaaauucaucugaacaaaacuaguauguuauuuccuguuucuauauuguauauggaguccauuuguuauccuucuguuuuucaauaaaugcuuaaaauguuuaauugugcuuuuaauuuauuucuauuuccuaacuacguauugacugacuaguuuguuuguuuguuuguuuguuuguuuguuuuucaagauagggucucucuguauagucauggcuguccuaguacuuguuuuauagacuaggcuggccucaaacucagaaauucaccugcuucuuucuccuaaaugcugggauugaaggugugaacugccaugccuggcuugauuuguuuaauuucuuuaauuggcugcaguguaucuucaagugguaugcugcaugguuauaaaauuucuggucacaaacuuguuccucuuaagagauacauacauagccgggcgugguggcgcacgccuuuagucccagcacucgggaggcagaggcaggcggauuucugaguucgaggccagccuggucuacaaagugagugccaggacagccagggcuacacagagaaacccugucucaaaaaaccaaaaaacaaaaaaaaccaaacaaacaaaaaaaaagagauacauacauuacucuguuggcucacagcauuuaauaaugcagcuccucccuuuagagcagcaucccucaguguggcuugaugcccuuuggaggucguauaucagauauccugcaugucacauauuuaaauuaugaaacauaauagcaaaauuacacuuacaaagaaucaaaauaauuuuaugguuuggcgucaccacaacaugaggaccuggaguaaagggucgcagcauuaggacaguugagacacacugcuuuaggcuggaaguaccauuucuagcaguguuuuaucauuucccauuuaucauuuaucagucuuuguauuacuguaguauaaaacuaucagaauauguauaauuuacuggguuuuuuucccccucagggacuugguacaguauacauacucacuuugcaggccuaguucuuucuguaguucaaaaaaaaauguaguuuuuauuuucuuauaguaugcuuaaucugcuuggcuuugaaucuccaucuuucuaaacugucaucuuguuguucuuagacuugacuuuuaagagauacuaucacuuuucuuccuaauauuccauucucccauuuuuuuuucuucacauggugcagccuguaguuugcuuacauuauuuucguucugcagcaaccugcacuucuuauucggcagcauuuuuaacuuucuguucuguuuccucuugcagcucucgcuucucaggguuuucacugcuuucuuuguauccuuuccacuuguucaagagaaaacacaacuugcaucagaacccaaaacagucauuucuuaaagaaaacauacugucuguuuguuuguuuguggcaggcucucauuaagcagccuuggcuagccucaaacugcgaaucaacauacuucugcucccaccgcaaguaguaggauuaaaggcauacaucuagccuuauuguguugcaauuaaauauauaugcagggggugggugugugcaauugaguacaaguacccuagaaauccacaagagaguaucagauacccuggaggugcuuugaaauggguacuagguacugaguggggucuccugcaaaagcagacagucuucuuaacugcugagccacuguugacuccagcccccaaaaccuacuuuugaaaugagauuccuuuuuuuguuuuguuuuguuuuguuuuguuguuuugaacuuuccccccaucuacguuguaucuuuucagaagucucauauuggguuucgucgucguucauugcugaacaggcuaucagguuugauugccuccuaaauauugcaguuuuccccauccauccugaugcuccuaaaucccccuuucuuagaguggaacugauacaaauuaaggugugacauggaaaaagaauuggggaggggggcguggauaguaccuagcaggaaaaucuuccuuuuaauuuuuucauauaaacauuucauagauuggccugaccuuuaguccaggaacaaaguggcuagucuuuuguguacuacugcuuugugucacagaaagaccguaauugcaagcucugcuuugagcucaguauauuucuggacuuuugaugguuaucuuaagccaucaacauuugcaaacauaaaccagauuaaaagucucaugcauauuauucugacgccccccccauuucaguuuuuuuagucaaguaaaaugacauguuaguuuugguguauauuuagaaugcacccccaucuacacucaguuguuaaguagcaauuccucaaaagugugucccauguacaugaaccuucuauaucuccccaccuccccaucccuaccuccacuccagcuuccaacacuaaaguaauuucuucuuuuuaaacuuugcagucauuucaauugggauuguggaagugagaguacauauugaaaucaauacucaagucauaauuucuaaauucuaguucuuucccauuuucgaaaaauuuguguuucuauggauacuauguuuauacauaucuuagggaaacaaauucugagucucauuuagaucguugaacuaaaagaauaucaauaaguuaaauaacugaauaaccagagggauaaauuauaggaagaugauuuccacaggauuuuuuuacuuuauaaaaaauaacauaaaucuauaauuaaccuaccaauuuuuaugacuaaaucugugguuuaagaagaaauguaccugcacagauaucauaagcauucauuaacauuagcauauuuauuaugcuucaagauggggcuuuacaguacauaaaagaagaaagggaaauaucucaaaugugggaauauucuuguaucucaaucaccaauuaacuauauaacuguuauaaaccacuuuuuuguuauucaccuuuuaggaaaaauuagaaaauuggcauuaguugaucacaagauauugcagcacuauuuaaaggauuaaggaaaguauauauacuauagcuguggguagaauaugaaauuuauaaaaauacugaauaauauauaagucaguauaggauacaaagcuggcagcuuaaaauacugucuucauauucuuguagagucuacagagcaaagcaauuaaaauacaccugcuauuaguaagaaaagagauccagaacuacugugggaagauuuccuggggcuggagagcaggcaaguuuaggaucugauguuuggaucuuagcccauguuaggcuucuuacaaacauaacucacaacuucaaggaaucugauguaucuucuggcuuucacaagcaaucuuuuucacauguguguacauaaauucacacacaugaauaaaauuauucccuaauauucuacauuuauauuagaauuaaaacaaggaagccaagcuaucgaagagaaauuauguuacuaaccaacaagcuuaaaaacugccauagucaaucaauaugguuauaauucuagcaguuacccaauaaaccaaaccccuuugucccccaguacuuuggaauaaccuagugguugcuaaguauuucaauacccagaaauguaucaacaacuaaaucacagaguagguauuugcagccaacagucuccuuugcuaaaacaacauaaacuagccaagguauagaaaaacugcuaaauuuaaacuuuugagguagauaaaaaaaaaacuuaguaacagucacucuauguauucagagaaaaucauguugcuaaucaacacaucucaaaaguaaaguccucugaccaugcacaaauacacaacuuuuuaaaagcaauaugcuucucagcauauuuuacugaaugccugucguucaucagauauuaugcuaggcacuaaguauugaaaucuaaauaaaaauaaccaacauugauuuuuuuuucuaauuuaaaaauaggggcuugagaucgggucucacuauagaguguagccugccugaacucauaaucccccugccucagguucccaagugcuaauggucccugaaauguuuuguuuauuuuuauaccgcuuaucucuuuucuuucuguaaaguaggucagacugugauccuuuucuuauagaagucaagguuugggaagugaagugaaauaguuacccaagguuucaagguaaaagacuaagacagcagagaaagggagcgggguaauaggagaaggauugugggaaaggauagccuggaaaggggacagugagugggauauaaagggaauaaguaaaaauaaauuaauuaaaauuaaaaaaaaaaagacugagacaguugagaggaaacuuggccaaacccuuugggcuaucacagaagcucuacuuaacuugcucaaaggacggugcaaaaauuauuauuggggcuugagaaaaugcacugaucauauauggaagccagugaaauagccagugggaaaagaugcuuguugccaagccugacgaccuaaguuggaauccugagacccacaugguaaaggagagaacucacucccacaaguuguccccugacuuccagacguguacacacacucacaaauauguuuuaaaauaauaaauuuuauuuaaacaaacaaaugcaauuuuaaaagauaguauggagaagugcugucucguaugaggcuaugccaguaucugacaaauacagaaguggaugcucacagucagcuauuggauggaacacagggccccuaauggaggagcuagagaaaguacccaaggagcuaaaggggucugcaaccuuauagguggaacaacaauaugaacuaaccaguacgcccagagcuuaugucucuagcugcauauguaucaaaagauggccuaguuggccaucaguggaaagagaggcccauuggacacgcaaacuuuauaugccccaguacaggggaaugccagggccaaaaagugggaguggguggguaugggagcagggaggggggaaguacagggaacuuucgggauagcauuugaaauguaaauaaggaaaauaucuaauaaaauuuaaaaaaagaaaagagaaaaaacaaacaccacaauuaaagugagucugcaaaagggacagaagaucaagaaagacacagguaaugaaggaaacaauaugcaguguuccagcaugaauguuuucuaauaaacaggaacuuuaauaggaagucaagagaggacaaaagucaacuguuagcuaacagguaauggugauuauacuaugcuuaaacaugagccuuaugcacugacuuagcacuuugauacaaagucaagccaauguagcugagucucacuauuguauuagugucuuagcaaaagagccugacaacuaaaugcaguggaaaaagaugucuuaccuuuccuuagauugcugaaaaacaaaaccuaaaaaguaauccaauugauguuccacauccauauaccccccaaaaaaagaucuuuccugucuucuauuauuuuauguguauaaaugcuuugucuacaugcauguaugugcaccauguugaugccugguaugcagaaagaggcugugggucccuuggaacuggaguuggaagcaguuguaagugucugauguuggugccaagaacuaaauccuagccuucaacaagaacaccuuacaugccacuaucaggacaucucuccagcauuuuacccuauuauuauuauuauuauucucucaaaucucaucaccaucuuucuuuccuauuauuauuauuauucucucaaaucucaucaccaucuuucuuuccuauaucugcuaauccuaaaauucugaaugaacaugcucaugguucgugcuguugcuagaaacuccauucuccuucugugaagagcuugggggcuacuauuacugugauaucaaugauggcagaugcacagcugagagggaagagcauagaaggccccucaagccuccccccaaagcaacagcauagacaggaaucuaccaaagagaacucugaaaaaaugugauagaaguacugaaggguagcccuccacauugauggcuucugacagagguccaggaggagauggagucaauucuauuuaaggggcacuaagaguuugaccaugcuccagugaauauagacaacagaaauugggcuuuuccccucguuuuuauuuuuacuuuuggggggguuauaaggagagcuggacaggaaaggacuauggaagugaguauaaucaagguacaugauaugaaagucccagagaaccaauagauauguuuuaaaaaucccaacugaaaaacucaaaggaaccccuaagaaauggagaaggggacaaaguggaauaagaagggcaaguuugcuacacaaguauuauauaguaaauagaaagcugagagcacacaguaggguccccauuacauauccaugagaagcaaagcuuuaauaaaggucaauucaacuagaauggaacauacaggguuuuuuuuuaucuauuuuugaaacauaaaugccaaaguaacugaccuguaaagucagguggaagaaaaucaccaaguagaagcaacuguagacaacuucccuuagaaaagauuucauggcaagagcagaaaggagaaaacaagauggguugcaaaauaaauagcauuacaauaaacaaaauagcuauguuaauuucccuuaaccuagacaaaugacaaugcuaugaaaucuguacaaguucugcacacucagaguguuagcaugguugucaguuuauuacugauugcucuuaguucagaauaaugaaaacagguauguagguauugacauucuccauaaaagacauuaaguaauuuugcuaaaacaaaacaagacaucauaaacccuuguacuuaaauacuagaagauuuuaaaaacuaucuguaguggcccaagucaaaauaguacauagaagaacaauugggaaugguuccacacagaugacuuaauggcuucuugauagaacaccgugaaaucaguggcaaaagcugcagacuuguucugcuauauguuguaauugauuucaaaggaaaauauaagaauccugcaacaugggugauagccugugauagucuuaagugucuacuuuaugcucccugguaacacugaccuucugacacuguaaagaaacaaagcaagccugaggcaaaggauggaaguuaauucugcaugacuacuagcauggguuugaauguuugauauccauuauccauuugaugucaagggaaacucuaagguagauucugucauuugcaaugaauagaugaggaaacaggaaaacggagauucaaaauguggccaagaugguaaauauagguucuaagcugucuuagagucaagaagggccaaguuuccaaaggaccacucccucaccccaagcacuagauguagaguuaauuucugauaaugauccacugcaggagucagaugcacagaagcuccaaaucuggggguaaaacaaaggaagauaacucugauaauauuauugauagugaugauggcuaauguuaaaaaaaaagcagccagcaacuccaaggcugcaaacaggaaaacgaaguagggaaaaggaaggauuuaggauuuucaugguuaggagauggaaagggauggaaauaaauguuaauagaaugaauaaaaagaguccauuaaaugagaaaagaaaauagaagcauggccagagguagaagcaacaaagaaacgaaaaccacaggacaaaaauaaaaaagacaaaacaacaaaaaacaaaaauaacaacaaaaaacaaggagauggagccacacggaagaaaaaacaaagauuaauauuucuggguaucuuuaaauaacgugcagucauuuucuagaauagacagccuuauuccuucguuucuuuguaauuuugauaaaagguuuacaaaagugauauauggcuuuauccacacuuaaaggaaacuaggaagggguccaugaagaauggaaaugaaggcuuacagcauggggcaaggaagguaauacaugguaugcaaguagaaggaggaaagguaggggugagagaauauacagcagaaaacaaaauagaauuggagaagagaauggggguauauagcaacaaaaauuaaauaugcaggauaaugcagcaaaaauaaacauucuauggaggaagaagggggagauaaugacauguguuccuagagaauauucauuaucaaaagacuuuuugucacacagaauaacacaaugaacauccuacucaaaacauguauuuuuuguuuuuauuuaaaaguguuuucguacaguauauuuagauauuguuuuccccuuccucgacuccucuuguuuauguuuucucccucucucucucaaaaugaaaaccccaaaggaacaaauauuaaaacaacaacuaaaggcaaugcccaaacaagguaaauagaggaguauuauuaaaauaaauggaaagguauggacaauuuuaacuucuucaaaugcucucaaagaaccucagaaggagaugagagcagcaguguauuuuggggaaaacacaauuacauguuuaaaaauggggcuaucaacccagaagacuaaaacccacaguaaagacacccagaaaucuuucaugggaauuuguuauauuugauuucuauauauauauauauaauauuaucaaauguauauuucauaucuuauauaagucugauuccagauucuauuuacaugaaaugcaagaacagauaaaacuaaguuauagugaaggaacucagaaaaacuuggaggagggaagugacaauauggcucaauagcuaagagcacugcuuugugcagauguuagauuauagcacauacauuagauggcucacaacuucuaacuccaacuccagggcauccagugucugcuucugcccuccacaggcaccugcacucauauguacauacccacacauagauacauaauuaaaaauaauaaaaauaaaucuuggggcuagagaaauaguucagcaguuaagauuacuggcugcuguuucagagggauaaaguacaauucccagcaucuaucugguaauucauaaucuucuaaaacuucacuucuguggauucugauaccugagccucuguagguaccaggcauauaaguaguacaaagacacacauaauacaagcagaacaaccauauacauaaaaaucaaaauuauggacuaaaggugugacuugguaguuaagagcauuuguagcucuagcagaggauccauguuuguuuuccagcacccauauaguggcucacaacuauggguaacuccaguuccaagggaauggaugccuucugaccucucuagacaccagguaugaacaugcuguuuauaaguaaauguagggaauacgaacauauaaauauauaaaucuaaaagaggaaaacugaaaaguuauaaaauaaauacaugcuguuaaaugggaggaggacuaagugaagaggacauaagagaacuaucgaagggaauugaggugucuugguuucuuguuaugguuaaauaaaaugucauuguuagggaaaucugaagaaagggcacacucacuguaccauuuuguuauuuccaugaguccaauauuacuucaaaauuauuuuagaaaucaggaauaugguucacauacaauucacaguuaguauuuguacuauuucccacuauuaguauucaaauggaaagucaaaaaucuucaguaauuuuaaauguuuaaaauaaaccuucggcugguuuaaaaucacaaguggaaaauauauaaguaaccaugacuucuauaccuaaaguuuaucucaagaaaugacaggauuuuauauuuuuaaaaaguccaugcacacagugaauaaccauuugugaaguaguggggagggggguggggggggagagauagugaucugccagucaaggaggcaagucucaagagaauccaacccuacuuugacauuugacacuuggcuuccaaccuccagaacugugaggaaaauacaacuuauuuuuguugguuuuuaaaaagauuuauuuauauuauguauuugaguauucugucugcauguacaucugcaugcuaaaagagggcaucagaacucauuagagaugauugcaaaccacaaugugguuguuaggaauugaacucaagaccucuggaagaacagccucuggcuauuucuucaaccccuaagaauauacauuuuguuuuuaagucaccuaguacauaguauuuuugugggacaauaauucaaaaccauauauuaagcugucauuuuuucaguuuuuuuaauuaaucauuccauuuuuuuuauaucucaaaugauaucccacuucaugguuacuccugcacaagaccccaucccacaaccuuccucuccucccucccuuuuaccucuaugagggugcuccccaccacccacccacccucucccaccucaccccuccagcaucucuuuacacuggggcaucaaaccuccacaggauguaggaccucccccuuguugaugucagacaaggccauccucugcuaccuauauaucuggagcccuguacacuccuugguuggucccugggagcacuggguggucuggccagcugauguuguccuuccugugggguugcaauccccuucaccucuucuaguccuucugccacuacgcuguaauuuguauaccauaaaauuuaccuccuauaauuacacuggucagucauuggauuuuuauaaauuuauagugcuguauaaugauuuccacaaucuaguuuaggauagucuaguuuaggacauuccuauaacccuugaaauguuucccuccgcaugccccaagcagggauugauuugcuuuuuccuauauauuuucuuuucuagaauuucauguaggugaaaccauauacuaugaaggcuucuauauuucauuuaguaugcuuuugugguucacaagaguuuauauugcugaauaauuuuguuuauccauuuuaagugaauagauguuuauguuauucccugguugagcuacuguaaauaaugcagcuauauaaauaaauaaauaagugaaggcugaagaaaugauuaagucuuugaaguacuugugcaaucaugagguccugagugcagcccccagaacucacauaaaauagcuagucguggagagcauuuguaauuucaaggcuggacaacuggugccaggaaaaccccuugaucucacuggcuagccagucuagauaaauagaugaacuucagguuccaaugagagacccugucucaaaaaaaaauguggcuggcuucugagggaauaugugaggccuccacaugcacaugcacacuuucacuuacacaaacauauguacucuugcauacauacacaaaauuuuuaaaaauucacauacaaaaaaaagagagagggguguuggagaaauggcucugcaguaaaaaguacuugcugcuccugcagaggaucugguuuuaguuuucaguaccaacaugagggcucaugaccaucuguaacuaauucuagaaggucuaagucccucuucugaccuuugacaguacguggaauguacaugguguacauauauauuagcaagcaaaccuucauauucaugaaauaaaucuauuuaaaauaaaaauaaaauguauaaguguguuuugguauaugugcuucaauuuuaguuugauagguauguaggagugaaaucauuugaucaugugguaaauauaugucuacuuuaaaugcuaccauacugucuuuuaaaguggugguauggugguaucacacuaggaauguguuguuauuccuuuuaaauuauagccauucuaaggacgcagauguagcugucucuugugagacuaugccggggcccagcaaacacagaaguggaugcucacagucagcuaauggauggaucauagggcucucaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacauuauaugccccaguacaggggaauaccagggccaaaaagggggagugggugggcaggggaguggggguggguggauaugggggacuuuugguauagcauuggaaauguaaaugaguuaaauaccuaauaaaaaauggaaaauaaauaaauaaauaaauaaaaaaaauuauagccauucuaauaggauagguacuaaaguuucagcuuaaaaacacuuaaaaggacuuuaggcuaaugagaauaagcuauggccuguugcuuaaaaacaaaaacaaacugggacugaagagauagcucagugauuaagagcuuacuuguacuacucuuccagaagauucaaauuugguuuguagaacauccacuucaggcuauaagccaucuguaagcucuggggagaucugacauacucuucuggcccuuguauggggaacugaagccacacacacagcaaccccacaaacaauuaaaaauaaaaauaaaccuuuuuaaaaagcauauacauaucauaauaaaaauaaauauuuuuuccuuuccuuuuuuucuuuuugagcacagacccauggaaaaggucuuaaaauuuugucagggagucaauuuauagauuauauagaaaagagagaaacucuucuuuaguaaaauacucauuuaugaaucucauucuuuuaauuccaaaaaaauuauaccaguuuucaggauacuuuuuaauuaaaugcuuucugaauuucaaaagaagauuaaagaaacccacauuguauaaugaaauuggaaacucucauuuuaacauaaauuuaaacacuguaauuguguacuuuacucuuaaugauaaauguaggauacauaguugagaauuugggguaucaaauuugauuucagacaggccuuuugauuucuuuucuaaagcuaaauagcuaaagauuuauauaauugugaguaaaacaugggaauuagauggcaacauacugcaauuacacuguuauaauuauacauauuggucucuuauaaaauguuucuaucagaaaucagaucauuuaaaaauuacauaaacuuauagaaaaguuuccauuuacaauuugagguacagcuuaaagguauaguaccugacaauuuucaaaguguaacugucuuuuaauuugauacacggauuauauuuuauaauauaccuaauugacuuuaggcaagauuccuacaaucuguuuuuaugcauuguucuuuguuaaucaugugaaacuuuuauguaguuaacuaguccuaaaucacccuacagaaaaauuuggaagauuuacugguacuggacuagaaaagaaaaucagccccugaggccuguccaccuaauacugucagcaggccugguguuucacuggggaacaagaauaauuucaaucaacaacaccagacagggccacccuguaacuaugauggauaaagaaauaccaagacaacuccauaaucaugugugacagaaaauaaaugauauccaggauuccccccgacacacucacaaaaaaaaaaaacaaaacaaaacaaaaaaaaacaacaacaaaaaaaaaacgucaaacucccccuuuucugguucauagguagguuuucucccaauuacagcaauagcuacucucuagucugaucucucugucaaagagauauguuaacauuucccaacucauaaaaguacuccggcuuccugauaauaucuaauccagaacaacucuucuuuucaauaagcccucccccaauaucccuuacacaaacucuaaucuuacuuuaugucuuuucuaauaccugcuaagaaagcaauaagaaacuaacuuucucaauuuuuaagucaggggcucagugaaugacagaaaaaugacuaucauguaugacacccugaguucuaucucuaacauaaaaacccaggcauggugacacacacuggagacagaaacaggaaucauugaaauuuugauggccagccagccaaaccuacuuguugaacuccagaucccagugagaaacuguuucaaaaacaaaguggauagcuccugaagaaccaaccauacccaagguuaacccacugacuuucacaaaugugcucucaugugcguguguaugcacacacacaugcacacacaaacacacacacacacaaccuauucaagcacaugaacacaaagaaaaucaaggugacccaaaagacugaauuauuuuuauauuguuuaaaguagaaagauucauaaaauacuauauaauuagcucacuauaaacucaaagucaauuaaugggaaguaauuaaaauucuaauucaguggucaguaguuuuaauuauaauuauguuuuaauaaauggaaaaaauaaaauaguacuuuuaaaugaauguauacuccauaagaucaaccuuuauccuggcauuuucuauaauagaaucauuuaugaaauagcaaauaaauuacacuaacuagcugccacugaaaaaaugaaaagaaaugagagcauaauuauauaguuaauguaaauggugcuuaacauccagauaaaagucauagaaaagcacuuaguuaucuacacauuucuaaauauuuugacuuuuuauaaaagcagcuaaccauaggauuauauauaauaguaaccaacugcaacauaucacaaacugcuaagaccuacacauacugcuaaauacugauguaauuaaaacccuaggcccaauucuagcaugaauagaugucuaaauggccagaggcaaaaacuucuuagaaaucaucuagucaagucacaugaagucaaggcagcugaugcuuagagagguagaaugacuaagcuaugggcacacagauaguuaaugguccauagcacuagaacgagugccuccaacacucaaucucagauccuagcacuucuugugaauguaugauuccuuauuuacauauucauuacauauucacuccaauuauuucugcuucuucuuaaugaagguacuaggaugguagcugggaaccauuaagagugaaugacgcauuuugugguuugaacaacauucuuuuuguuuguuuuuguuucuaguacugggaauuaaaccuagggucucacacuagaaaaguguucuacugagcuauauaucuaaccuuguuuuuugauugauuguuuuuuguuugguuguuucuuucuuucuuuuuuuuuuuuucguuucuuuucuuuucuuuuuuuuuuuuuuucauuuugagauagagucucaggaacuugcccaaacuggccuugaacuuacucuauuuuccaggcaguccuugaacuuaaugucuuccugccuuagacaccugagugguugacauugcauguccuagccaccaagcuuagcuguguucauguuaugugcuccaguaugacuguagaguaguuggacuuuuagcuuggcauaugauggccuucuuuuccuuagcuaaucaaugacaucaauagcuuuucagaaguggagaguaucaagcaaacuuguuuuagcuauuugcaucaaucaucccagugcuaaguguuuuaagacaaauuaggcuuucucaacagaagcauggcugucauuuuagguaaagugauucugugcaguacaggguugccuguuucacaugcauuuuggcacccaggcagucauugguagcagaccucuuaguaacuacuaccccaccuaugagguaguuuaaaacuucaaaauuaauguaaaaaaaaucccgaugaacaaaauauagaaaugcuaaaaaugaaaaaaaaaacaauacuacuaagcuuuucacuucaggcuaaauguggaucgcaugacacaguuauugauccuaccauuguuuaguauguuauuuugcuaauugugacauuuuuacauuuacucuuaaauacauuauaguaaauauuauccagaauaauuguuaaacuuagggaucaacuuaaauggauaacccaaaacaaguaccucucucaauuuauccuaguauaaccuuacucuuuacacuuuguggugaauuggaauaccuccaccacauuuccaaaugcuucuauaaguggagaacuucugaacuagggucugauuuuucucacuuaagaagucuagaaaaagucaguccaggcuuguacauguaggguccauuuaucucuaccauacucaaagaguggcuacuagagcugacaaaauuuucaguaauuacaaacaagaaaauggugaauaggaaaaaucauaccaccugagccugauuccuuucacuaaaaaacaagaacuguccuagaauaaacauuaacauauauaucauuagcagaaaguaauaugcaccacugauuggaugaaaugagugguuauaagaaacaaggaauacagcuacaagguaaacaauuuuaaauagucacauuuccagccugaauaaaacugauaguccaccuauaaaauaaucaagugaaugaaugaagggugacuggcaauauguauucacagcaggggccaugauaacacauacugacuuuuuggugacugcaaauagaacuuucucuacuggucaggugauggucugucuaaccggaguauuuugauagucaccuuuacaaccacagauauaacuguaauuauccuaggcugggacauacaaaaguggagccugaaacagggauuuaucuuguggggcauguggaccauugcaccagaggaaauggcacagaaguggugagguggagcaugcuuaaaucccauaaaucucaaacuugagaccagcaggaguagagcuaacucucuuccuguuuccaugccugccucagagcagguugacacagguaguuuuucacuuucccaccaccugaaaugccucuacaugcuaaugaggcuccucgguagccuuagccuucagccaaugaccuuucccuaccuagauauucucacacccaucccuccaaaauauaagacccuuuguucaccccaaauaaagugcaugucuucaaauccaucaccaguaaagaaauacaaacaagguaagaucucaaagagcuguuucauuaaagauagucagagaaggccuuuguuuauuuaaagaggaugaaacacuagauucuacuguugagguuugguuuugcuguuuauuauaaugcuaagugugggccccggaagaucuggagucugcagguaaacccaugaccaugcccccacauuauuucuaacuaauugguaaauaaagaugccaacagccaauagcugggcaagagagacaaaaguaagguuuagguuucccaggcuuggagucugaggagaaccuugaggaggagaagaaggugaaggaagagagagaagccaccauggguuaggugagucaugaaaacauggccaugagggcuggccaauuggaguuuagagcaggccaaaugaagcauaguaaguaauaacucaggguuaucuauaggaaaguagauucuaauaucagaggauagauaucugccuagauuuugugcuguuugaagcuuacuauacauauauaaagguuguguguguguguguguguguguguguguguguguguguguguguguguuuuaucagggaauuaaauggucaaaguuugaauagaaaucccaguuugggauuaaaaauuuuuuacaacauauuggcaccucaaagucuggcaaaaacuuuuuuaaaaaauaauuuaauuucacaucgccuaauggaaaacacaugcuguccauuuaagauagaaaauagagagaauucguuucugagccacacaguuuuucuccaagauccucgggguuuaggacuggaaauauacagauuuggcgcacaugauucagggguucauaggauaagcuaagacacagcugugccccccccaaaccaaacaacaccccaagcagcaggcucggacuucggccuagccuaaggucuucucaaaugcugcucuaugcugccuuagagaugcagcuuaagcauguacauucuaaaaagcccccacugugcaaugaagcagacaaaguccugcuguucauagagcagaaugcaaggcugcaugccuccugcaaucaaaaaauuauagaaaauaaaaugaauuaacauuucaacacuaccuuaagcacaugauacguauauguuggccugaaaauaggcuuauacaguaaauagaaggacauuuaaaugaaguuaaauauaggaaaggauauugauucaauuuauauaaagaggaaauagauauaaguauauuuaucuagagauauuaaucuccaaagacgacugagguacagaauuauaaacucaauaaguuaaaaugauaaaauacuuuaucuaaaauggcaaauauaauggacuacacauuauaaauauauauuauaccuuauauuuuucauaauuauuuuaauuuuauucaauucauaucugagagaauaugagccuuuuauuggacuaaaaggggaauuguugagguuggccuugcucucuacuguaaugccaaguaugggcccccaagaacuggagucugccuguaaaccugugacccugccccccacaaguuauuucugauugcuaaauaaagaugucaacagccaauaguugagcagaaaaagccacaggugggguuuagguuuccugggcuugggaucauagaacaaggagaacaagaagguagaagaaggagaagcuacgaucaguuaggugagccauaaaaauauggccgugagggcuggccauuuggaguuaagagcagcccagaugaauaguaaguaauaguucaggguuaucaauaggaaaauagaaauuuaauagcauagaguguagauauuugcccagcuguugugcuguuuaaggcuuguuguauauauaaagauuuuguguuggggaacuaaauggucaaaggcuggguagaaacccugguuugggauuacauuuuuuuuuuuacaccauuaucagagaagucuccacuuuacccacuccuggccugguaggcagcagcauaugacuccugaaaggaaaagacauacuauggaccccauccaguuuggacuuguccuguccucucugaacaaguguagcagugguauccagacaccucaucaauagaaguggaaucuggaaccacuaugcccugugcucucugagcucauauaccagcagcaacuggauacugcaagaggagaggcagaacugguaccacaucuugagaggauuuuuuuuuaaagauuuaauuauuuauuauauguaaauacacuguagcugucuucagacacuccagaagagggagucagaucuccuuacggaugguugugagccaucauauaguugcuaggauuugaacucaggaccuucggaagagcaguuggugcucuuaccgacugagccaucaaaccagcccccuugagaggaauuuuuaaggacgggauaaaagcaccaaaugaagggggaauaagcaaagcaaucaugcauucacagagcaaguugaacucuggccuuacaauccaagggagccuggaucauugcauauaauugguucaccuugagagaaugaagcagaaccccuuggcuuugauuaaucuugucagcuucuagggaagggcugggauaugucugggugcuucaacuuccaucagcaugggcaaggcuccagagagguuuauaaguguggaaaagcagucacagcagcuaggggcugggaauacaccuccuaauguggaccugguuaggcaucaauaacauuuaauacagauacucauuugaauauggccuccaaagaauugccuucacuucuacuuuguauuauuugagaguauaaccuuacacauaucucugggauuaguagcuauuugaaaagcugacaacauguuaaaagugucucauuuuaagaaaacaaaugauuaacagguguugacuucuuuuguugagcacuuuaugauuugcuauggguaguaacuaggaucugcuggcuagcuuaccaucuugccagggcacauuaauaucucagagucuuagggucucauuuaaagcucaaugaauauuuaauuguuguugaccaaaaaaauaagcaaaagaauuauguugcauuuagucauauuugaaaggagcaagcucuuuauuuucucaugcagucucaggcuacuauaauuccaccuucaugaaauauucuacauaauuuuauaaguacuuacagaagugaaaaugugucuuuaaaaagcauauauuaaauauugaaaaaaaauaaaauaaagagaauuuucaaaguuacaugcaagagaauggugcaggguauauuauuauuuccaugcuggauuaaaaauauuaucaacaauuuuuuuuuacuuaagaaguaaaaauagaaucuuuucuuuggcccuuaaaauuaaauauucuaaaagauacagaauugccaagucagucagcccagaaauuguuuuugagcuuuaagucuacaacagaaccagacguggaaaaaauuuuaaagaaauauuggcccguguugaaaaucaagcugcuuucccagggaagaagcgucccuguggucuguuacaucucuuauaaguaucauaucugggcugcaaauagcaugagcuuuaacugauguauaauaucccagaugacaugggaaugugucacuucuaccauauuucaggacauuuugauuauuaucaaaguauugccaacugauccauguuaaaacauacuaaaaaaauaaucacuugauaaacugagcauauugugauuugaauucuuuaucuagcccugaauucuuuucaauuuacagggaggaacuaaaacaauauaacaaguucauuuuagagaacaaagcauaaagcugugauucaggauugcuguaaacauggcacauccauaugcugccuuauagaaaaaaacugcuugccuuggauuucuuuccuuuguucuuuuucccugcuauagauacuaaaauacugaugguauggucaacaacagagugcuagccuaacaaguuuaagaacaucauuagaguccccaucuuuagagugggagagagaaaaauagaugacaagacauaaacugcauucccccuuuauugaacuauuggcuguaucucuguguguauucuuugcaaacauguaccuuaaaauuauuaagguauaaugguguauauauguaauccaucccucagaagacagaggcagaagaaucaggacucuaagaccagccuuucaauauaaauggguuugaggccuugacuaauaauggcauaucuuccguuuacuuuaacaguucuuaucaccucacacuacaguaguuagggauggagaacuuaauuuaguaugcaacauaggaaacauuuuuuuucaauuccuauuuaaugccucauuuagaacauacaagauuaguuaauggcaaaaguggcauggugaccugacucuuagauacuucugucuagagaaaggcaugagaugaagguugauaagcacuauuugggaaagauaaguauuugauacccuacaacaaaagugccuuaucagaaacaacugagcaaagauaauuuuucuuuguuuaagguaccuuugcucuugaaguuuuuugucuaaggcuaggcaggaaguaaccuugucuaaaggauacaaaauuaaaacuggauagaaagaauaacuucuggaaauguagcacauaccacagcaacuacagauaauaguaaugcauuauauacuuaccaagaaaguagauuuuaagcauucuuaacugggcauggugacucacaccucugaccaguacuuuguaagcaaaggcagcccaacuuggccuauaugguguuugagaccauccuagucuauauggauaguucuaggccagucagggcugcauagugauacccugucuuuaaaaacaaaacgaacaaacaaaagcaacuucuuaccaagaaaagccugaaguaauacacaugcuaguuugcuugaauuagccaauccacaauguguuacauauuucuuuuuuucuuuuuuauuagauauuuucuucauuuaaauuucaaaugcuauccccaaagccccccccccccgcccugcuccccaaccuacccacuccugcuuucuggcucuggcauuccccuguacuggggcauaugaucuucauaauaccaagggccucuccucccauugauggccaacuaggccauccucugcuacauaugcaacuagagauacagcucugggaggcagugguuaguucacaucguuguuccucccauaggguugcagauuccuuuagcuccuuggguacuuucucuagcuccuucauuaggggcccuguguuucauccaauagaugacugugaguauccacuucuguauuugccaggcauuggcguagauuuacaagagagaacauugucaagguccuguaagcaaaaucuugcuggcauaugcaauagugucuggguuuggugguuguauaugggaugaauccccaggugguacauaguucaaaaacacauguuguacauccuaaauguauagucaucccuugguaucugcagggaauuuguuccagagauaaacaaggauguuugaguaugcauaauguaugcauaaaaccuccacacagccucuuauauucuaacucauuucugaacaaccuaugauaccuagugcaauguaguccuauguaauuaguugccaaaggagauuguuuggagaauaacaccaaacaaaaaaguccauauacacucuacauagauauaccccaucccaaauauuuuagacugcaaguugguugaauccauaucuauggauccugcugacacagagggccaacuguucacauuuuugucaacuuagaaaaaaaguugaaaaaauuuuaugcacaaagucaauauguauaaaagccaaaaauuaaaacaacauuaauauacauaucgaagaugcuauuuccuauaucuacauauaaaacuugacauuuuaaugucuccccaauaucaugugacuuaccugcuuaucaaaagcaacccaggauggugcaucgguuccaucuccuuugggaaauacacuguguuuaggcuuuaucuuuuggccauauagcagaucuccaccuacuccaggcuuauucucacucaccagcauccugacauuguugcaaaagccccaauguugagauuuauggaaccucuccuuuccuaucuguggguacaaaagacaauaauaguaaauaaaaauggccaaaguuacucuuuuuuauuuuucuuacaauaaagacuuuuccaacauaaauagauugucccauuuguuuuucccaucauaaaauguaugugaagagucaaguaacugugggcaaucucuauccauaaaguugugccacauuuuauauucaguuuauuuuaauuaauuuaaaacuuugagaagcagaaagaauaaagcuaauauuccaugcuauuugcaauauuucagaaugauuacugcaagugaagauuuugaacaccggcuugcuaauuggacuacuuuacucauuugcaaagaauacaaaacagaaaaaaaaaaaacuuaauuacuucagagaagaaagccacugcuuuucacagaagccuaacuaaaaauuacauuuaccaaaacagaaaacaaaaucuuguccucaucaacauuaauauaaagggaaauucuucacagcugacauucucuuaauuaugaaaccuugccuuccacuaguuuuuagugauuuggacagagaggaggcacaaguaaugccaagaguugaaaaagaugaaucggggauuggaggaugagguaaaucaggcaaagaagagauaggaagauauucccagcaagaccaugagaaguacacuucugagugugaagagcaauagauagcaguucugagugugaggacaaauagacaggaauaggaauagaugggaaagucuagucaaaaaagaagucaaguucaagcuugaaaggaagguucacuggaauagaauaucuaaaaagguccauaauguggaaagucauauauugaaauaccuugauagucucuuucagcaagcuuccagaauagucaaugaaccaggccauauucuugauaauauauuauaaagauuaagucauagucaaccuccauccccuaaagaguucuccuaaugguucauacaagucugcauguauccugguuuccacaaucuaaaagcccuugauuguuagaaggcuucacuuguugacuugacccauauaacuucauaaaguauccacauguauccuccccuuuggucagauaauuuucucaguuugcaccuugaggcccauucaguaauaucccuggacagguuccacauaaagcucacuuuccucaagaaucaaguaaugcccuaccgcauugucaucuuuccuauaaauaucauaugagaacucacuuggugcugaguuauguagacuccagggauauggcuuugggcaaaucucagcuaucugucauagucuagaagccaguuacacccuuagauuuaacaauagcuuuuuagauaugacaccaaaaagauucagggagaggggaggaggggaggacaguguaaggaagaacaagaagggggaucagcaauugggauguaaagugaauuaauaaauaaguccauuaauuagaaaguucauuuguaugaaauucucaaagaauaaaaauauauuuuaaaaauuauuuuuaaaaaaucccugcacacaaacauuuagguccuauuuccaaguaugauggcagaggcuuacauucuaucuucucccuuucuaugaagggagaguaaaaucuuaguucaauaguauaaugcugaauuaauuuugggcuucugacauauuucucuaaccagaacaacagaaaacaggucuugacucauagcauccaguguaaagacaccauuuugguuuacccuuuuucuuacuaugaucuucaacucuuguaaaguggaucuaguuuccacuuuaaauguuuaguuuuacugggguuucaacugacagaguuauuaauuauauaauugauuuguuggacuguagaugcuuuauuuuuaauccugaaagugacuugcaugauggcaaaguuuggcaauauaugacucucugaggcaaaugccacagaaauaaguugaagaaacuaagagaagcugggcaugguaagucacauauguaauaccagcauuugcgagacuacaguuagagaccagccugaucuacauggcaaauuccagaucaaccuaggcugcagagugagaccaugucauaauaaagaauucaaaaggaggacaagaacuuggguagagaaaacagugaucuuagcagcaauguaacccuuagaagcugugucaugucaugcaugugugggcauaucauaggugcuaggaaacauagaaugaggauguugaaaagacauugcacagaauaugguaaaaacccauaccacaaaggaaccaagagugacuacaaucaguuagcaguauccacacucagauucuaacuaccucuccucgaauuauggguucauuugucucucugguguaggagcuaacagcuuuaacuucccuguagauuccuguguagagaaaccuaaagauacucaaguguuacacauuacagacaggcaaagccuccucugaccaagaaucuuccuucugucacaaucuucacacccucccaccugccaccuucaaguaucccaaauagcaaucugcccuuaccaacaguguuuucucccaccauuugcuccugcacuuuagauuuccauguuaccuuaccuucuuuuuuggccuuaccuugccagacaccgcauaaaucuagcuuaugggccaauggagcauuaacugaacacaugagguggaggucauaaauacaggcugcugaaaugacuuggggguauggggguaaaggugcuugccaucaaaccugagaauuugagugcaauccauaagucuccuguucucugaccucuagacaugugucacagcauauauaauauaucccaccucuccauaaauaaauauaaagcuaugagcuccacuagauagacuucagaagcugugagccaaaauaaacauauguucccccaccccuacucccuauauuagguauaggcaacagaacuacaaaaguacuacacuggguauauuguggcagucuaagcaaaaggugaugguggaccaaaguagauggcuggaaguaaugacaauggaaauguagaucauaaagugauuguggcuagauuagauaagggguacagaaaaaaugggguacauggucaauaacuacaaauauuuuggccugggaaaauggacaugaggaguuuuacauacuaggauaugaaacagagccccaaagucaauccagagcucuauuuugccauguuaaguuugauaaaaagcacagagaaaugaugauuaguaggugaugguguaagucugaagucuaaagaagaguuuaaagcuagauaucaaaauaugacauauaacagcugaggucuaguguuuaggcaaucuaauacuggauugaaugaugguacaguaaagaaauccaagacagaaauuuaaaguuuaaaauauccccauguuacaauucagggagaugguauagaauuagcaaagaagaccaaaaaggacugucugcaagacaggaagaaaacaggaagauuuagugucauggaaacuggaaagaaagcauuugaaugagggcaugauuaacuaguuuaaaugccaaugauaacccaagugaaaaugagccuugagacuucaccuuagauuugucaacaaagaaagucauaaacuugaugagcaugcuuucugcagagucacaagaacaaaauaucccgugagccauauguuuuuguuuugucuuuuaaaaauuauucuaaguaagauauugcaaaaucaaagcucuugaguuucuaguauuuauaauuucuuuaaaauaacuugagcccagaagaauauaagaaauaaauaaaagauugucaaaacgccaucucuucuugaaguuccuccuggcugcuagaaguagaauguucuguuccugcauagauuaucugcagacgucaugaaguucacccuaucuuuaaaucauuuuacauacuuacccauugauuucuacuaguauuuccaaggccagauauaguaccuagaacacaaucaugaagaucuuugcccuugaaaucagcaguaguauugugacaggacaagacagugaagugguuccucuaucuuguauucuugcugaggucauuuuaaguuuaacuagaauuugaucuccuugauggagaaucccaucucuauucuaggaaggucaggauguccugacuagcuuauuuuagcuucuguuaaacugucuguuuauguggaaccccuccagcuaacuucuugucucagcuuaugugaaacugcuugcuucaaacuguuuacuucuaugaaggccccugaggcugccuuuuaaaaacccauguucugauguucuggauaguuggaaucaugccuagguucuggaacauuugaguauggucccagcugacuggaagaaagacuugcagaugacuauaaacugugucagauuggucaucucuggugggcuacccuaaacaguacaaagagaaacaaaaaaaaaauugcacaagguuucuauuggaucgauucacucaacaaaugagccacagcuucauguccauaauuucuagauagccaucuguuuacuuaacauguuuuauaagucgucuuuugauaucuuuauguuugauguuagacuucuuaauuacuaaaaauaaggaugacaggacuuggcacagauucaacaacaacaaaaaaaaccuauugagucaaacauaaaggugguuuauuuuuaaaugaagaugauuggauguugucaccuauucucuccucauacacauucaagagugugcacauacuuuagaguggcauagaccucuuuacauagaauauaaacaugaauuauuggaaacaaagcagaaccagggucuaaaggcauaaacuuagcaauauaaagaauagaacagaaaacaagcauuugaugccauuuccauucagguuuggccauauuuguaccauuucacccagaagcacuuucucuucucuagaggcccuucccuuuagcaucucuaaguugagaauaggaaaagcuucuuuguaggaccuuauuuagaacugagagaguaucugggauuguggcugucuacuagcacugauuuuguucuuaaaaagaacugaauuaggcuuccaauuaaaaaugauaauaagagcuaaagagauaacucuauggguucagagcacugguuguucuuacagagaaucagauuuugauucccagcacacacaugccaacucacaaccaucuguaaccccaguucagauuugaagccuucuucugaccuccuugggcauauggugcacaaauacaaauguaggcaaaauacccacacacaugaauaaaugauuuuuaauuaaaauuaauaauuauuauaauuauaauaauaaaaaagaagcagauccuauacccucaauuacuuguguuauuuuuuuucucuuuucccaaauauauuuuuugaaacuuuucugauuugguuuucuggcacagaguauguaaccuaggcugaaccaaaccugagaugcugccugaggcgaucaacugcuaguauuacagguauguccaaugauauccuuuucuauuaaaaauauuaaaaguaauacaaugaauauuuuauaucaucuuagcuuccuacauuugauuaaauacuuuuauagauuuaucucuacucaguacauuauugguuagaauaguuuuucuucaacauguaugaacuuucuaauuuuccuuccuugacugaaaaucacuuuuaacaguguuccccugagcuacaugaaugugggauuuauuucuuaauaagucuuauuucacauauaguguguagcaaggguuugagaaacaaaaguuaagugcuggaggcuauuuguguuuuccacuccccuaaacaaguuaggguaugcuugaucacauauaagcaggaggaaugugaacagugaggaacacgggcugcaggaaaaacugaauuguaagcugacuucagcuugagccugcuuguucccacuuugaacucuaauuaauagaaauaccaggggaaaacugcccugggcuggagccaaucagggaauagaggaaaggugccuaaaauuccagagauuaucuauaaauugcucaaacugucugaaucuaaucccugugcaucaggauacugcuugccaaauaaggugacugccaggcuggagacccccauucgccucucaaauuaguauaagagcccugucuacuugggguugaagcucucagcaugaaucugcugcauuggaggagacuuaggggcagagcuuaagcuugaauaaagacucugcuuuuguauacagauucaggcaccugguggucuuuggggacccugaaaucugggcacaacaaacaggaaauaugucaggauguauaauuguccuucucuggauguaggcagaagguacacaggcaagaauugccuuaggguguaugcuugccacugauuggacgcgauaagaaauucgguugugcuuuuuuuaagucccuguaaaacaugacucagggccauuuucuggaaacccagagauggaccuggccagagcccauucaccuggccaauauguaauuaaggcuugcaaauguggcuuuauauugugguaguggucuuauucucgaccagucagucaaucacuugugaaauuaaauauaccuucuuuuuaaagauuuccuuuuuggcaacuaaguguaacaaauagcauaugacuaaaggacauaggaacucaaggauccccacuuagaaucuucuauaagacauuaucuuguagaaagagaaaugugauucuggguauguuagagacaagaggcagacccagcuggauugaggagcauuuucuacaugcauagaaaauuacguuugagaagauacuauaagaguuaauacucucauacauagguuguggugugaacuugacugcugacuagguaggucacagugagcuagaaccucaucucugcagguacaaguauuucuuuugcuauaauggcuaauaaaacuucaauuccuguuccaggcauucaagaagcacucagcuuucuuaaucucagagaaaaauuacauguauagcaucauuuuauaaaugagaauuccaaaggaaagucagaauaauuuuccgauguuacaaugauuaaucuaggaugcaaacccaaacucugggccucagcaucaggccuacauccuuuucuuccuuccuuccuuccuuccuuccuuccuuccuuccuuccuuccuuccuuccuuccuuccuuccugucuguauuuccuucucuucuucauuaucuucuuuugcugugcauuggagaguauauguauacaauguacauguguguguguguguguguguguguaugccuauguauaugcauaugcacaugcacacauaauguauauguaauguacauguaauguauaugugauauauguguguauguauaaauuagauuacaaauuauaaauuagguuaguauaagaugucuucaauggcuuuuccaacuuauuuuaaaauuuugauuuaucuauguauucuuugagaauuucaacuggagagauggcucagcaguuaggagcacugucugcucuuccagagguucugaguucaguucccagcaaccacaugauggcucauaaccauauauaacaaaaucuugugaccucuucuggccugcaggcauacacucaggcagaacauuguauucauaaucaauaaauauaucuuuuuuaaaaagagaauuucauacauguauacaaugcauuuugaucacauccauccaccuccaaggagagaccacaucccugaagaaaauggauuaacuucucccuagcagccaguaauugucaauaccucucaaacagggguguggagcccuucucccauuuaugucuccaguuuauuuuuuacaauauggacuuucacugaaccuagcgcucaccaauuagcaagaauggcuggucagaaaaccccagagauccuccccagcaccaggauuauaggcaggcaggcuucugaggguuugcacaacauccucauuuucaugucauaagcacuuuacuaacuaugcugucuccccagcaccaguucucauauucuuuggugccuugcugcagaaaaggaaauacucuucccuuguuuaacucauuggaguugaauagucacuuuugcuuuugacaagugcuauugacauuuuggcaaaaugauugcuaugaucuugaaaggaaaagaugggucaaguaacagacuggauuccuuaaaaguucagcauauaugagaagacaguucuagagaaucccuucuaugccauccaguuauagaaauguaagaacugaagaaaaaccagauaauacuuagcauuccaggggcuagauguagcucagugauauagcacuuuacugacaaucacugggcccuuauucaauacccaagauuuaccacugcaaaaacaacaagcaugguggcaagcaccucuacccacuaagccaucuuacuguccuaacaauacuuuuuauacuuuucauacuuugaagaugaagucuuccugugucucuagacuggucuggaaucugggauccuucuggccuuggccuaauaauacugggauuauaggucugagacacugaaugacagcaucuaauuaauuucugacauagaauaaucuaaaaaucauuugucuuagauauaccuaucugauuauauuauggacuaguuuccuucuauuccaagaggacuguggguuuuuucuccugccuuaauaucauauuugauuuagaaauucauuuucuuuuuucucuuauacuuuuauagagaagucauucagaaacuauuuuaaauugcccugagaagacaacaacaaacugucaaauguuaggguucagaaccaugagaguauaaaagcuaccauuacuuauuaauaaacucaaaaucacugaaggaagcccaaacacgaaaauaaaaaaaagcauacaaaaaaauccuccaacacucuuaagcaaauuuuucucuuugcaaaucuaacuuagaaaaaugugcaugugaguauuagcuaucaacucaauauagcaauaaaacuguuuuauauaguuaauaauguauuucaauuggaaaguaaaaaaaaaauuaagucaagaucuagagagauguauaacaucuuccccaauguucugauuuuuuucucucuaaauaauucaacucaaagcucuaguuaauaaagagaaugauuucagggcuuucuccuaaagucaguuaaaaucaaaagcucacuguaguugauuaguuagugucucaaccucuaaauuccuucucccaugacaauaugcacuuaaaaauccacccccccucccaaaugugaacaaugcacuuguuuucuuagcuuuguuuucagaaguuuguuuugagauucuagaauggguuuuuguucuccugagccaggaccuaauguauccuaggcaaaugcuccaccaccacauacccaggcauuauuuuaacagaguaagaucauuuugugaucugaaugaugauuuucuuuauucuuugggaaaaaauaagaaaaacagaaagaaaaauccuaacagaagcaaaguagaagcaaucacugaccaugacauuaaacguugcuaaguagcaacagcaauaaaaauaguauggcaaugggagauggaaggacacaggucgauagaacagaaagaaguauccagaacauacauaugcucuaccgaauuuuuuuacaaaggugcaaaagcaauucaggacuuuuuaucaaugguucugggaaacugagcauccaaaccucauaccuuauauauaaaaauugacugagucauaaacauuaauuaaaacuguaaaacuauuagaaaaaagagacauucuuaggcuguagugcugagcagagaguucuuagccuaggccaggccaguuauauggguuaggagcuugcuaucaagccugaugaccugaauucaaucuccaggaccuauguaguaaaaggagaggaaugauucccacaaguugucuuuuauguccaugcauuuccacguaaauaaaugcaugugcacacaugcacauguaaguauaauugaaguaaauuuugggacuuuugcccuuggaaacaguguuaaagauugauaaagacaaauuguagacugaaagaugauaugugcaaacuacaucccauccaaggaauugucaaaaagucaacaguuaaaaauuuagaacugagcaaaacacaagauaacauuucaccaagguagagcuauagcuggccaauaaguacaugaaaacauaguaaauucauuaaccaccacagacugaccuauccuucuguguguccuaguuugcuuccuauugcuaugauaacacauucugaccaaaagcaacaugggugggaaaaugcuuaucuggcuuacaugucccagucacagucuaucacaaaagggacauaggguuaggaagucaaggcaggaaccuggagucagaaauaaaagcagagaacauguaggaauacugcuuauugacuugcucccuauggcuuacucagccuuuuuuauuuuauuuauuucauuauuggguauuuauuucauuuacauuuccaaugauaucccaaaagucccccaaacccucccacacccacucgcccaccacccauucccaccuuuuggcccuggcguucccuguacugaggcauaugaagucugcacaaccaaugggccucucuuuccacugauggccgaccaggccaucuugugauacauaugaaguuagagacacaagcuuuugaggaguacugguuaguucauacuguuguucuaccuauaggguugcagauccucccaacucccuggguacuuccuccagguccuccauugggggcccugugauccauccaauagcugagcaugagcauccacuucuguguuugcuaggccacagcagagucucacaugagacagcuauaucaggguacuuucaguaaaaucuuccuaguguaugcaauggugucagcguuuggagauugauuaugggauggauccccagauauggcaaucucuugaugguccauccuuucgucucagcuccaaacuuugucucuguaacuucuuccauggguguuuuguucccaauuuuaagaaggggcaaagugaccacacuuuggucuucauucuucuugaguuucauguguuuuccaaauuguaucuuauaucuugggucuucuaaguuucugggcuaauauccacuuaucagugaguacauaucaugugaauucuuuugugacuugaguaaccucacucaggaugaugcccugcagguccauccauuggccuagaauuucauaaauucauuguuuuuaauagcugaguaguacuccauuguguaaauguaccacauuuucuguauccauuccucuguugagggacauuuggguucuuuccagcuucuggcuauuauuaauaaggcugcuaugaacauaguggagcauauguccuucuuaccgguugggacaucuucuggauauaugcccaggagagguauugagggauccuccgguaauacuauguccaauuuuuugaggaacccccagacugauuuccagaaugguuguacaagcuugcaaucccaccaacaauggaggaguguucuucuuucuccacaucuuugccagcaucugcugucaccugaauuuuugaucuuggccauucugacuguugugagguggaaucucaggguuguuuugauuugcauuucucugaugauuaaggacgcugaacauuuuuucaggugcuucucggccuuuugguauuccucaggugagaauacuuuguuuaacucugagccccauuuuuaaugggguuacuugauuuucuggaguccaccuucuugaguucuuuauauauauuggauauuaguucccuaucugauuuaggauagguaaagauccuuucccaaacuguugguggccuuuuugucuuauugauggugucuuuugccuuacagaagcuuugaauuuuuaugaggucccauuuuuugauucuccaucuuacaguacuagccauugcugcucuauucaggaacuuuuccccugugcccauaucuucgaaauuuuuccaaccaucuccucuauaaguuucauugucucugguuuuauguggaguuccuugauccacuuaaauuugaucuuaguacaaggauauaggaauggaucaauucgcauucuucugcauaauaaccuccaguugugccagcaccauuuguugaaaaugcugucuuuuuuccacuggaugguuuuagcucccuuuucaagaucaagugaccauagguguguggguucauuucuaggucuucaauucuauuccauuggccuacuugucugucucuauaccaguaccaugcauuuuuaaucacaauugcucuguaguacaccuuuaggucaggcauuguguuuccacuagagguucuuuuauccuugagaagaguuuuugcuacccuagguuuuuuguuauuccagaugaauuuggagaauacccuuucuaauucauugaagaauugaguugaauuuugauggggauugcauugaaucuauagauugcuuuuggcaagauagccauuuuuauuauauugauccguccaauccaugaacaugggagaacuuuccaucuucugagaucuucuuuaauuucuuucuucagagacuugaaauucuuaucauagagaucuuuuccuuccauaguuagaaucacuccaagguauuucauauuauuugugacuauugagaaggguguuguuucccuacuuuccuuuucagccuguuuauauuuuguguagagaaacgccauugacuuguuugaguuaauuuuauauccagauacuucauugaaccuguuuaucagguuuaggaguucucugguggaauuuuuagggucacuuauauauacuaucauuucaucugcaaaaagugauauuuugaaaauuccuuuccaauuuauauccccuugaucuccuuuuguugucauauugcucuggcuaggacuucaaguacaauguugaauagguaggggaaaauugggcagccuugucuagucccugauuuuagugggauuucuuucugcuucucaucauuuacuuugauguuggcuacagguuugcuguagauugcuuuuaucauguuuagggaugggccuugaauuccugauuuuuccaagacuuuuaucaugaauggguguuggauauugucaaacuauuccacaaaauagaaacagaagguacaugugguuuugaguuuguuuauauaguggauuacguugauggauuuccguauaguaaaccaucccugcaucccuggaaugaaaccuacuuggucaggauggaugauuguuuugauguguucuuguauucgguuagcaagaauuuuauugaggauuuuugcaucgauauucaaaagggaaauuggucugaaguucucuauccuuguugggucuuucugugguuuauguaucagaguaauuguggcaucauagaaugaguuggguagaguacauucugcuucuauuuuguggaauaguuugugaagaacuggaauuauaucuucuuugagggugugauagagcucugcacuaaacccaugugguccugggcuuuuuuugguugggagaauauuaaugacuucuucuauuucuuuaggggauaugggaguguuuagaucauuaaccagauccugauuuaacuuugguaacugauaucugucuagaaacuuguccauuucauccagguucuccaguuuuguugaauauagccuuucauagaaggaucugauuguguuuuggauuucuucagaaucuguuguuaugucucccuuuucauuucugauuuugcgaauuagaaugcugucccugugccuuuuagugagucgggcuaaggguuuaccuaucuuguugauuuucucaaagaaccagcuccuuguuugguugauucauugacuaguucuucuuguuuccacuuguuuaauuucgccccugaguuugauuauuuccugcccucuucuccucuugggugaauuggcuuccuuuuguucuagagcuuuuuagguguguucucaagcugcuaauguaugcucucucuaguuucuuuuuggaagcacucagagcuauguguuuuccucuuagaaaugcuuucauugugucccauaaguuuguguauguuguggcuucauuuuaauuaaacuccaaaaaguccuuaauuucuuucuuuauuccuuccuugaccaagauaucauugagaagaauguuguucaguuuccacgugaauguuggauuucuauuauuuauguuguuauugaagaucagacuuaguccauggugaucugauaggaugcaugggacaauuucaauauuuuuguaucuguugaggccuguuuuguaaccaauuauaugaucaauuuuggagaagguaccaugagguucugagaagaagguauauccuuuuguuuuaggauaaaauguuuuguagauaucuguuagauacauauguuucauaacuucuguuagauucacugcgucccuuuuuaguuucuauuuccaugaucuguccauugauuaaagugguguguugaagucucccacuauuauuguaugaggugaaaugugugcuuugagcuuugcuaguuucuuuaaugaauguggcugcccuuguauuuggagcauagauauucauaauugagaguuccucuuggaagauuuuaccuuugaugaguaugaagugccccuccuugucuuuuuugaugacuuuggguuggaagucgauuuuauuagauauuagaauugcuacuccagcuuguuucuucagaccauuugcuuggaaaauuuuuuccacccuuucauucugagguagugucugucuuuuucccugagauagguuuccugaaagcagcagaaaguuggguccuguuuguguagccagucuguuagucuaugucuuuuuauuggggaguugaguccauugauauuaagagauauuaaggaaaaguaauuguugcuuccuauuauuuuuuuguuaaaguuggcauucuguucuuggggaugucuuuuuuagguuuguugaaggauuacuuucuugcuuuuucuaggacgugguuaccguccuuauauugguuuuuuucuguuauuauccuuugaagggcuggauuaguggaaagauaaagugugaauuugguuuucuuguggaauaguuugguuucuacaucuaugauaauugaaaguuuggcuggguguaguagucugggcuggaauuuguguucucuuagugucuguauaacaucuguccaggaucuucuggcuuucauagucucuggugaaaaaucugguguaauucugauaggccugccuuuauauguuacuugaccuuuuucccuuacugcuuuuaguauucuaucuuuauuuagugcauuuguuguucugauuauuaugugucaggaaaaauuucuuuucugguccaguauauuuggaguucuguaggcuuuuuguauguucaugggcaugucauucuuuagguuugggaaguuuucuucuauaauuuuguugaagauauuugcugucccuuuaaguugaaaaucuucauucucaucuacuccuauuauccguagguuuggucuucucauuguguccuggauuuccuugauguuuugaguuaggaucuuuuugcauuuuguauuuucuuugauuguugugccaauguucucuauggaaucuucuguaccugagauucucucuuccaucucuuguauucuguugcugaugcuagcaucuaugguuucagauuucuuuccuagguuuucuaucuccaucuuucccucacuuuggguuuucuuuauugugucuacuucccuuuuuaggucuaguaugguuuuguucauuuccaucaccuguuugguuguguuuuccuauuuuucuuuaaggacuuguaacucuuuagcaguguucuccgguauuucuuuaagugaauuauuaaaguccuucuugauuucuucuaucaucaucaugagauauaccuuuaaauccgggucuagcuuuucagcuguguugggguacccaggacuggcugaggugggagugcuggguucugaucauggugaguggucuugguuucuguuaguaagauucuuacaucugcuuuucaccaucugguaaucucuggagucuguuguuauaguugucucugguuagagcuuguuccuuucgugauucuguuaaccacuaccagcagaccuuggagacuagcucucuccugaguuucagugguuagagcacucucugcaggcaaguucuccucuugcagagaaggugcgcagauaucuguuguucgcauuugccuccuggcagaagaugaaggccugaaacagggccuuucccagaagcuguuagcuucuguaguccacaaucucaccugugcagacuagucuugacaggaucuuauuuuauuuuuaauacaacccacgacuaccuuccuagggauggcuggauccuugacacaucaaucacuaaucaaggaaauaucccccaaaacuugccugaguuucaauuugaugauuucaugcuauuaauugaaguuccugcauccuagauggcccaggagauuguaaaguugacaaaaacaaaaaccaagaaaaauaaauaacuucaacaguaacacuauuccuacagacuagcuaaaguaaauggcaacacuaaauguuaaccugguuaaggaugaaguagaucacauauacauaaccacugaccugaccguguaauauagugucugaucucagaagugguuugauaguaucguuauaaaauuaaucauuauuauaugauccaagaauuguacucuugguucuguaucucagggaaaugaaaacuuacauuuacaggcugguaagauggcuaaguggguaaagcaauuugucacuaagccugagaacuugaguuagauccccaggacucacagauaggaggagaaaaucaggcccugaaaguuguccuuuaacacgugugcuguggcauacauccaaccacauaugcauacacacuauaaauaaauauauuuuaaaaacuuguuuauacaaacuccugugcacaaacauuaauagaagcuucaucuccaauagccagaagcuaaaauuaccccauguauccuucaacaggcaaaugauuauagaaauuauggugcauacauaaaauauuugaguuuacugcuggguugcaaaaauuuaauaauaauaaaacuuggauaaaccuccagagacuuaugccaagcuggaaaaaaaaaacccuagagucagaaucgcaggugggaucaaugucagcauacuggcugaaauauaauaccaacauuuugcaggauguuuccacuggcagaaacugaucaaaaggcaucuauaaccuuuauguguuauuuuuaaugucucuaccuagaaaccuacaauaaaauuuucaaucacaugcaaacaggaaaggaaggggcuggagagauggcucagagguuaaaagcaccugcugcucuugcagaggaccaaguugaguucuagauaucccuuccuuuaagauaccaguuauagcacuagaaaaacagcagagaaucuggccuucaaguggucaagucagccacuuuugauaauggugcugccagaucaaaauugaacauucuguagccuagguaaggaagggguaaaaaugucuacuucucacuugguccugcuuugggcaaucuucccaaccuuaaaaaucugcaucugcucuuuuagcauuuguagugcacagaauacagcugaggagauggcaaaggaaaacuuuugaauuugugcuagggagcucuggagucccacuguagggaacaccucucccuaagagucuccccugaggaguaugcauaaaaacuauccguuucucccaacaaauaugaaacaaauaugaaacucuggagacagcuucaguaagacagcucauuuaaugggggaagcaaaggcuacuuaaaccuuugggagugguuaggggcuuucaguauaugccauugucauaguuaggguuuuaaugcugugaacagaaaccacaaccaaggcaauucuuauaaggauggcauuuaauuggggcuggcucacagguucagagguucagccuguuauuaucaaggugggagcauggcaguguccaggcagacauggggcuggaguagcugagaguucuaccucuuauucugaagacaucuagcagaagaaugauuuucagacagcuaggaugaggguauuuaaagcccauggccacagugagacaccuacuccaacaaggguacacuuccuaauagugccacucccugugccaagcauauacaaaccaucaucaaccaugaucagggugcuggggaugccucauuugcauaaagaggaaaucuagcugcuacuggauuuauaaggggagaggaaguuuauccugucuacuaagcuacaugaccuccuuccuuggaggagcaaaauuuaggggcacggggcuaugugaauugaaggacagagcaaggaggagugauccugcagccaaucucaggaugacauuucugggaacuggacaggccuugucccaacucuugcucuagacugauucccuuauuccuugcccauuuguccucgccccacaaauacccucauuauaccacagacacauugcuuugaguuacaauuugcauagggacaucuggaugcuuugcuggcuaccuuggcuaagccaagcuuaccaauagaaaguguucugcuugguuuuugucaacuugauacaagcuagggacaucugaaaagaggaaacucaauuaagaaaaugacucuuaucaaauugccugugggccauuuuguugauuaaugauugaugggaaagagcccagcccaacaggggguggcaucaccaguaugguauaagaaagcaagcugagcaagccauggugucagguuccugcaacagcuucccuucaggaaggacuguaagcugcaagauaaauuguuuccuccccaaguugcuugugaucaugaugauuauugcaaaaaggaaaaaaaaaaccaacuauggguauccugggucccaaagagacaagaauccacaggagugcaugcugggcugcagaagcaacauagcuucuggagcaaggucccuuuaccggccucaaucuucagccaggaagcagagcugagcuccagaccucuguacaccuucccugcaagaggagagcuugcgugcagaggguaacggaaucacaagaggaacaagcuccagccagugacagcuagaacaauuaacaccagagauuauaggacugcaaaaggcaaacauaagaaucuuacuaacagaaaccaagaacacucaccaucaucagaacccagcacucccaccacagcgaguccuggauaccccaacacacacaaaaaucaagauucagacuuaaaaucauaucucauuauucugguagaggauuuuaagaaggacauuaauaacucacuuaaagaaauacaggagaacaugccugaagguagaaggccuuaacgaggaagcacaaaaaacacuuaaagaauuacaggaaaacacaaucaaacaaaauaggugaaggaauugaacaaaaccauucaagaucuaaaaauguaaggagaaacaauaaagaaaacccaaaagguggcaagucuagagauagaaacccuaggaaagaaaugaggaagcauagaugcaagcaucagcaacagaauacaagagauggaagagagaaucucaggggcagaagauuccauagagaacaugggcacaacaaucaaagaaaagcaaaaugcaaaaagauccuaaugcaaaacauucaggaaacccaguacacaaugagaacacuaaacuuacuaggaguagaugagaaugaagauuuucaacuuaaagggccaguaaauaucuucaacaaaauuauagaagaaaacuucccuaaccuaaagaaagagaugcccauuuacauacaagaagccuacagaacuccaaauaaacuggaccagaaaagaaauuccuccagacacauaauaaacagaacaacaaaugcaauaaauaagguuagaauauuaaaagcaguaagggaaaaaggucaaguaagauauaaagccagaccuacuagaauuacaccagacuucucaccagagacucugaaagccagaagauccugggcagauguuauacagacacuaagagaacacagaugccagcccaggcuauuauacccagcaaaauucucaauuaccauagauggagaaaacaaaguauuccaugacaaaaaaaauuugcaccguaucuugccaugaauccagcccuucaagggauaauaaagggaaaacaccaacaaaaggauggaaaguaugcccuagaaaaaccaagaaaguaauccuucagcaaaccuaaaagaagacaaccacaagaacagaaucccaacucuaacaacaaaaauaacaggaggcaacaauuacuuuuccuuaauaucucuuaauaucaguggacucaaugccccaauaaaaagacauacacuaacagacuggcuacacaaacaggacacaauauuuugcuguuuauaggaaaccuaucucagagaaaaagacagacacuaccucagagugaaaggcuggaaaacaauuuuccaagcaaauagucugaagaaacaagcuggaguagccacucuaauaucgaauaaaaucgacuuccaacccaaaguuaucaaaaaagacaaggaggggcacuucauacucaucaaagguaaaaucuuccaagaugaacucucaauucugaacaucuaugcuccaaauguaagggcaggcacauucauuaaagaaacuuuaggaaagcucaaaguacacauaaccccacucaagaauagugggggcuucaacaccccacucucaccaauggacagauccuggaaaaagaagcuaaacagagacacagugauacuaagagaaguuaugaaacaaauggauuuaacagauauauacagaagauuuuauccuaaaacaaaaggguaugucuucuucucagcaccacaugguacuucaccaaaauugaacauauaauuggucacaaaacaggccucaaaauauacaaaaauauugaaauuaucccaugcauccuaucaggucuccacggacuaaggcugaucuucaguaacaacauaaauaauagacagcuaacauucacauggaaccugagcaacacucuacucaaugauaccuuggucaaggaaaaaaauaaagaaauuaaagacuuuuuagaguuuaauaaaaaugaagacaaaacauacccaaacuuaugggacacaaugaaagcaguccuaagaggaaaacucauaccucugagugccugcaaaaacaaacaagagagagcacacacuauuagcuugacagcacaccuaaaagcucuagaacaaacagaagcaaauucaccuaagaggagugaacggcagaaaauaaucaaacucagggcugaaaucaaccaauuggaaacaaaaagaauuauucaaagaaucaaccaaaccaaaagcugguucuuugagaaaaucaacaagauagauaaacccuuagccagaauaacuagaguaacagggacaguauccuaauuaacaaaaucagaaaugaaaauggagagauaacaacagaacaugaggaaauccaaaacaucaucagauccuacuacaaaaggauauuauauauacucaacaaaacuggaaaaccuggaugaaauggacaauuuucuagacagauaucagguaccaaaguuaaaucaggaucagguuaaugaccuaaacaagcccaaaucccauaaagaaauagaagcagucaucaauagucccccaaccaaaaaaaaaaaagcccaggaccagauggguuuaguguagaguucuaucagaccuucuaagaagaccuaauuccaauucuccucaaacuauuucacaaaauagaaacagaagguacucuacccaauugauucuaugaauccacaauuacagagauaccuaaaccacauaaagacgcaaaaaagaaagagaacuucagaccuauuucccuuaugaauaucgaugcaaaaauacucaauaaaauucuugcuaaccgaauccaagaagacaucaaaaagaucauccaucaugaucaaguaggcuucauuccagggaugcagggaugguuuaauauauggaaauccaucaaaguaacccacuauauaaacaaacucaaagacacaaaccacaagaucaucucauuagauccugagaaagcauuugacaaaacccaacacccauucaugauaaaagucauggaaagaucaggaauucaagucccauaccuaaacauaauaaaagcaaucuacagcaaaaagguagccaacaucaaaguaaauggagagaaacuugaaguaaucccacuaaaaucagggacuagacaaggcugcccacuuucucccuaccuauucaauauaguacuugaaguccuagccagagaaauuagauaacaaaaggagaucaaggggauaaaaauuggaaaggaagaagucaaaauaucacuauuugcagaugauaugauaguauauauaagugacccuaaaaauuccaccagggaacucauaaaccugauaaacagcuucagugaaguagcuggauauaaaauuaacucaaacaaaucaguggccuuucucuacacaaaggauaaauaggcugacaaacaaauuagggaaacaacacccuucacaauaaucacaaauaauaugaaauaccuuggugugacucuaacuaaggaagugaaagagcuguaugauaagaacuucaagucucugaacaaagaaauugaagaagaucucagaggauggaaagaucucccaugcuuauggauuggcaggauuaauauagugaaaauggcuaucuugccgaaagcaauguaaagauucaaugcaacccccaucaaaauuccaacucaauucuucaccaaguuagaaagagcaauuugcaaauucaucugcaacaacuaaaaaccuagcauagcaaaaaccguuuuaaacaauaaaagaaccuuuaguggaaucaccaucccugaccacaagcuguacuacugagcaauugugauaaaaaaacugcaugggacuaguacagugacaggcagguaaaccaauggaauagaauugaagacccagaaaugaacccacacaccuauggucacuugaucuuugacaagggagauaaaaccauuucaccaguggaaaaaagacagaauuuucaacaaaugaugcuggcagaauuugagguuaucauauagaagaauacgaauugauccauucuuaucuccuuguacaaagcucaagucuaaguggaucaaggaacucuacauaaaaccauagacacugaaacuuauauaggagaaagugggaaaaagccucgaagauguggacacaggcgaaaaauuccugaacagaucagcaauggcuugugauguaagauugagcauugacaaauggaaccucauaaaauugcaaagcuucuguaaggcaaaagacacugucaauaagacagaaaggccaccaacagauugagaaaggaucuuuuccaaucauaaaucagauaggggacuaauauccaauauauauaaaaaaaaguuaagaagauggacuccagaauaucaaauaacccuauuaaaaaauggaguacagggcuaaacaaagaauucucagcugaggaauaccgaauggcugagaagcaccugaaaaaauguucaauauccuuaaucaucagggaaaugcaaaugaaaacaacccugagauuccaccucacaacagucagaauggcuaagaucaaaaauucaggugacagcagaugcuggcaaggaugucaagaaggaugaacacuccuccauuguuggugggauugcaagcuuguacaaccacucugguaaucagucuggcgguuccucagaaaauuggacauaguacuacgggaaaauccagcaauaccucuccuaggcauauauccagaagauuuuccaacugguaauaaggauacaugcuccacuauguucauagcagccuuauuuauaauagccagaagcuggaaagaaaccagaugccccucaacagaggaauggauauagaaaaugugguacauuuacacaauggaguacuacucagcuauuaaaaacaaugaauuuaugaaauucuuaggaaaauggauauaucuggaggauaccauccugagugagguaacccaaucacaaaacaacacauaugauuugcacucacugauaagcggauauuagcccagaaacuuagacuaaacaagauacaauuugcaaaacacaugaaacucaagaagaaggaagaccaaacuguggauacuuuguuccuucuuagaauggggaacaaaauacccuuggacagaguuacaaaguucggagcugagagagaaaaaaguacuauccagagacugccacaccuagggauccauuccauauacaaugaccaaacucagacacuacugcauaugccggcaagauuuuacugaaaggacccugauauagcuaucucuugugaggcuaugccagugccuggcaaauacagaaguagaugcucacagucaucuauuggauagaacacaggggccccaaugaaggagcuagagaaaguagcuaaggagcuuaaggggucugcaacccuauaggaggaucaacaauaugaacuaaccaguaccccccagaacugugucuguaauugcauauguaguagaagaugaccuaguuggccaucaaugugaggagaggcccuuggucuugcaaagaucauaugccccauuacaggagaaugucagggccuggauaagugaguggguggguuggggagcaggguggugggugcaagaguguauagggaacuuuagagauaacauuugaaauguaaaugaaggaaguaucuaauaaaaaaaucuaaaaauaaaaauccaaaaacaaaagcaacuaagcagccauguuaggcaacacaggcaaauggcauuccuuuucccuuucuauuuacuacugcccaaauaagguuuauuuuguucccuagcaacaguggaagacaacaaugagauguucucuuuggacauaaucuucucaagcucuguuugccccugucuaguucuuaaccauggucacugaaggucaaggguuaauggacaaucaauuauucaggaugggccuuggauaagaaacguaccaagggauaacccaaagagcaacugaucacaguuucuacauuagcugagaucuacuaccucaucacaggugaacaaacccaauuuaagcagaauccuaggccagaagcuaaaccugagggugccagcauacuagcuccaaacucuugcucccaagaagcaaaaggagguaaugaugagaaaagcaagcaaggauuuaaaucaaaauggcuauuugaggaauguucuaguuugcuuucuguugcuaucauaaaacaaccugggggaggggcagggaagucacuuaguggaggaaagaagguuauuugacuuauaauuguaaguuacaauucaucacugcacaaaagucagagguaaaaacuugagacagcugguugcuggggacacagagguccuugcacucacagagaagcacuaagggaaccaggaauguuaauuacaggggcaucuccuaauggcuaaaaucaaauaccugcauuccauccagaaggcugaaaguggagguuguuaaggaccuggugacuuuuguuauacaggcagaccucaugcauauuccugaaaaugauuaucccagacucuucccucuuuagaccauuacccauccuuaggggagaugucacaagaauuuuauggccagcugaugucuaugcuauuggucagaauccacacuagauucuaggccuuuaagcuauagagcccacccucauagucacauguacuuuguaaaauaguuucuauguagccccaucuuaagcuuuauugugcagacuaauuggacugauuguugccuggaaacauuuucccaaauggcaccauguuuuaaauauacugacaaugaaccaccugccacuacacucccagaauucugauccagguugacaaagucaauauacacuggguuuucauucuuaucucuuugaggguuuugcuuccuuucuuguauacuugccgggacaccaucagcuggccacauuaaauccauggccaagggcacagacaugaauauaccuaugccaauauauccuuuuuuaguuuuguaguauuguacaaaaugcaauaugauguugcaugcuugauaugcaaauuaaaauguaggaaaaggggcucucauuucuagaguccaaauuaacauuuaggaauaccaucagaauauuaugugauuuuucaaaguauagggaggaacuucaaggggugacccaaaccagguauaguagcacacaggccaccuugggcaacauauuaaguuuaagguaagccuggauggggcacauagauccugucucaaaacaaacaauaacaagaagaaaaagagagguggcuuaguccaaaauaauaaccuuucaguagcuauugggaacaaaaugacauaauucuuuacauuaaaagcauccuguccaaguaacaggaccugaguucaaaucuacugcacccauguacaaaucugggugcaguaguguaugccuguaauuccacugcugggaaggcaaaagacaagagaaucccugggccuugcuggauagccacccuagcccaaagaaugaacuuaaaguucaaugagagacccuaaaaaaaaaagauggaggguuuuuaaggaagauauccaguguugaccucugaccuucauacaacaugugcaugcacacucacauguauacacagucaaacacacacacacacacaaacauguacacauauagugacaaaauaacucuuagaaauuaaaaaauacgguuccgggacuccgccgaaaguagucugcacaggugagagugugcacacagaagcugacagcuucucagacaggcaggagccacagagcuucugaggcagcgcccuuuucgggcuccagacauccgaccaccuucccggccagaggacaggugucugcccagcccgggaggcuuuugccucaggaucggcaggagccaucuugguuccgggacuccacagaaaguacucugcacaggugagagugugcacuaccgaagcuaacagcuuccgggacaggcaggagccacagagcuucuaaggcagugcccuuauccggcuccuaacaucugaccaccuucucggccagaggacagguguccccccaccugggaggcuuuugcuucaggauuggugggaaaaguagucugcacaggugagaguguggacaacagaagcuaacagcuucugugacaggccauagcaacacagcuucugggaaagguccuguuuugggccuucaucuucagccaggagggagguccgaaugccauauaucugugcaccuucccugucagaggagagcuugccugcagagagugcucugaccacugaaacucagaagagagagcuauucucccaggucugcugauagaggguaacagaaucaccagaggaacaaucucaaaacagagacaacuauaacaacuaucuccagagauuaccagauggcgaaaggcaaacauaagaaucuuacuaacagaaaccaagaccgcucaccaauaucagaacccagcacucacacuucgcccaguccagggcaccccaacacacccgaaaagcuagacccggauuuaaaagcacaucucaugaugaugguagaggacauuaagaaggacuuuaauaacucaaagaaauacaggagaacacugcuaaacagguagaagacauuaaagaggaagcaaaaaauucccuuaaagaauugcaggaaaacacaaccaaacaggugauagaauugaaucaaaccacccaagaccugaaaagggaaguagaaacaauaaagaaaacacaaaaugaggcaacgcuggagauagaaacccuaggaaagaaaucuggaaccauagaugcgagcaucagcaacagaauacaagagauggaagagagaaucucaggugcagaagauuccauagagaauaucagcacaaaaaucacagacaaugcaaaaugcaaaaagauccuaacucaaaacauccaggaaauccaggacacaaugagaagaccaaaccuauggauaauaggaguagaugagaaugaagauuuucaacucaaaggaccggcaaauaucuucaacaaaauuauauaagaaaacaucccaaaccuaaagaaugacaugcccaugaacauacaagaagccuacagaacuccaaauagacaggaccagaaaacgaauuccuucugacacauaauaaucagaucaacaaaugcacuaaauaaagauagaauacuaaaagcaguaagggaaaaaggucaaguaacauauaaaggcaagccuaucagaauuacaccagauuuuucaccagagacuaugaaagccagaagauccuggacagauguuauacagacacuaagagaacacaaauuccagcccaggcuacuauacccagccaaacucucaauuaccauagauggagaaaucaaaguauucuacaacaaaaucaaauucacacauuauuuuccacgaauccagcccuucaaaggauaauaacagaaaaaaaaaaaaaaaaaaaaacaauacaaggacggaaaccacguccuagaaaaagcaaaaagguacucccucaacaaaccuaaaagaagacagccacgagaacagaaugccaacuuuaacaaaaaaauaauaggaagcaacaauuauuuuuccuuaauauuucuuaauaucaauggacucaacuccccaauaaaaagacauagacuaacagacuggcuacacaaacaggacccaacauuuugcugcuuugaggaaaccuaucucagggaaaaagacagacacuacuucagaauggaaggcuggaaaacaauuuuccaagcaaauggucugaagaaacaagcuggaguagccauucuaauaucuaauaaaaucaacuuccaacccaaagucaucaaaaaagaaaaggaggggcacuucaugcuuauuaaagguaaaaucuuccaagaggaacuaucaauucugaauaucuaugcuccaaauacaagggcagccacauucauuaaaaaaacuuuaguaaagcucaaagcacacauugcaccucacacaauaauaguagacuucaacacaccacuuucaccaauggacagaucauggaaacagaaaguaaaaagggacacagugaaacuaacagaaguuaugaaacaaauggaucuaacagauaucuacagaacauuuuauccuaaaacaaaaggauauaccuuauucuuagcaccucaugguaccuucuccaaaauugaccacauaauuggccacaaaacaagccucaacauauacaaaaauauuaaaauuguccuaugcauccuaucagaucaccauggacuaaagcugaucuucaauaacaacauaaauaauagaaauccaacauucauguggaaacugaacaacacucuucucaaugauacuuuggucaaggaaggaauaagaaagaaaucaaggacuuuuuggaguuuaaugaaaaugaagccacaacauacccaaacuuaugggacacaaugaaagcauuucuaagaggaaaacacauagcucugagugccuccaaaaagaaacuagagaaagcacacauuagcagcuugauaacacaccuaaaagcucuagaacaaaaggaagccaauucacccaagaggagaagagggcaggaaauaaucaaacucaggggcgaaauuaaacaaguggaaacaagaagaacuagucaaugaaucaacgaaacaaggagcugguucuuugagaaaaucaacaugauagauaaacccuuagccagacucacuagagggaacagggaaagcauccuaauuaacaaaaucagaaaugaaaagggaaacguaacaacggauccugaagaaauccaaaacaucagauccuucuacaaaaggcuauacucaacaaaacuggagaaucuggaugaaauggacaaguuucuaggcagauaccagguaccaaaguuaaaucaagaucagguuaaugaucuaaacaguccuauauccccuaaagaaauagaagcaguccuuaauagucucccagccaauaaaagcccaggaccagauggguuuagugcagaguuuuaucagaccuucaaagaagaucuaauccaaguucuucacaaacuauuccacaaaauagaaacagaagguacucuacccaacucauucuaagaagccacaauuacucugauaccuaaaccacaaaaagacccaacaaagauagagaacuucagaccaauuucccuuaugaauaucaaugcaaaaauccucaauaaaguucuugcuaaccgaaucgaagaacacaucaaaacaaucauccauccugaccaaguagguuucauuccagggaugcagggaugguuuacuauacggaaauccaucaacguaauccacuauauaaacaaacucaaaaccacauguaccuucuguuucuauuuuguggaauaguuugacaauauccaacacccauucaugauaaaagucuuggaaaaaucaggaauucaaggccuaucccuaaacaugauaaaagcaaucuaccgcaaaucaguagccaacaucaaaguaaauggugagaagcaggaagaaagcccacuaaaaucagggacuagacaaggcuccccaauuuuccccuaccuauucaacauuguacuugaaguccuagccagagcaauaugacaacaaaaggagaucaaggggauacaaauuggaaaggaagaauucaaaauaucacuuuuugcagaugaaaugauaguauauauaagugacccuaaaacuaccaucagagaacuccuaaaccugauaaacagguucaaugaaguaucuggauauaaaauuaacgcaaacaagucaauggccuuuuuguacagaaaggauaaacaggcugagaaagaaauuagggaaacaacacccuucucaauagucacaaauaauauaaaauaccuuggcaugacuauaaggaaaugaaagaucuguaugauaagaauuucaagucucuggagaaagaaauuaaagaagaucucagaagauggaaagaucucccaugcucauggauuggcaggaucaauauaguaaaaauggcuaucuugccaaaagcaagguggacuccagaaaaucaaauaaccccauuaaaaaaaauggggcucagagcugaacaaagaauucucaccugaggaauacugaauggcagagaagcaccugaaaaaauguucagcauccuuaaucaucagagaaaugcaaaucaaaacaacccugagauuccaccucacaacagucagaauggcuaagaucaaaaauucaggugacagcagaugcuggcgaggauguggagaaagaggaacacuccuccauuguuggugggauugcaagcuuguacaaccacucugguaaucagucuggugguuccucagaaauuuggacauaguacuacaggaggauccugcaauaccacuccugggcauauauccagaagauguucuagcugguaaaaaggacacaugcuccacuauguucauagcagccuuauuuauaauagccagaagcuggaaagaaaccagaugccccucaacagagaaauugauacagaaaaugugguacauuuacacaauggaguacuacucagcuauuaaaaacaaugaauuuaugaaauuccuaggcaaauggauggaccuggagggcaucauccugagugacguaacccaaucacaaaggaacucacacaauauguacucacugauaaguggauauuagcccagaaacuuaggauacccaagauaaaagauacaauuugcuaaacgcaugaaacucaagaagaacgaagaccauaguguggacacuuugccccuucuuauaauugggaacaaaacacccaugaaaggaguuacagagacaaaguuuggagcugugacgaaaggauggaccaucuagagacugccauaucuggggauccaucccauaaucagcuuccaaacgcugacaccauugcauacacuagcaagauucagcugaaaggaccccgauauagcugucucuugugagacuaugccagggccuagcaaacacagaaguggaugcucacagucagcuauuggauggaucacagggcccccaauggaggagcuagagaaaggacccaaggaacuaaagggaucuguaacccuauagguggaacaacauuucaucauccucacaggaaaucucaauagcagcaaguccucauuauaccucuugcccuacacagccuaagguaaacacucauuuacuuguuccuccuacacaucaggccacucauaucuuacacaaacagggauauauauauauauauauauauauauauauauauauauauauauaaacagggacuuuuacauauuguucuuuaaugguucagcuaugcuauaacauauaugaguaucacauuucuuuuuuggccaaauaguauucuagcaccaagcaugauagcacaugccucuaauccuaacaaaaagauuacaaguuugaggucagccuggccuacaaauuaagaaugaagacaacuucagcuacacugagacccuauaucuaaaaaccaagagaaaaauuaaaaccauuugauuguguguaaaaaccacauuuucauuuucuaccagucaguugauagucauaggcuguuucuauuuugagucacgacaaagguggggauauugcuucugugugcuuuguuuagcauguacaauagcugaaggucaauccuaggcaauaaugaugaugaugaugaugaugauaaaauuuauaaaauuauaaacaguucucucauacacauuuuuaugcauagcauguuuuuccuuggguagauguuuaggagugcugugucauacaguaacucuauauaaccauuucagaagcuaucagacugcucucuacagcacuagcagcuacauuucacaaucccaccagugauuucucuauguguuugccaaccuuuauuucuuuuuuuccugcagucaccuuauaggucuaaaguguuaucuaauuguauuuuuaaugauuugcaugccuuuaauaagcaaaucuauugagugucuuuucacaugcauauuugccauuucuauauuaucauuggaggaauguuuauucuaacuacuuccccauuuuaauuagauuauuguuguaguuguuguuauggagauucuuuauauauuccaauucuaaaucccucaucauauauguggcuugcaaauauuuuccccacacuaugugcuaguuuccuuuugaaguauaacuuuguuaauguacuauagcauuauuuauagcaaaagauuggaaacaguaaguggauagacuaaauaaacuauuguuaaguccacacaauagggcaacucuaucacugugaagagcaaugaggccuagcucuauauccuauuaagugacuuucaagauauuccauuaaaaugaaauuaaaaagauuaaagagaauaagaaaaguagguuacuaucuauuuaacaaagagaaagauggcaaguacuuuuaagaaguuguuucaaaaacagacuggagggagacagacccaaaagaagaaaagagagaaaugaggaacagagauaagaggugggaaaagagacagaaaucacuuuuagaguuauuucuagagagaagggaggagcagagcuguaaggucauggcuaaaagcuaguccuguuucauuuuguaaauuugacuuuaaagccauaaaauguaaugaaacaacaacaacaaaaauaagaaucaaaagcacaauaaaaauaaugaagcuaauuggguauggagcaggugaugaaacucuacucacaucaauuauauaaguaaaauugaaaaugagugacugagagcauuuucuuuguagaagcuauauacuggguauaagccauaacauugccaaauaaugcaugcuucaacauuugccguaguaauuuggaaauacauuucuaaugaaggauaucuuuauaauagagauagcuacaaagaacucuuuuaaaauuuaaauaguuaauaaucaauaaugucauuguuggggcuggaaagauggcuuugcaguuaagagcacuagcugcucuuccagaggaugcaguucaguucccaacacccccacggcaucucacaccuacuuauaccuccaguuccagggaaucuuacaugcucacauaacauacaggcaggcaaaacaccaaagcacauaaaauaaaaauaaagaaagaaaucauuuuaauaaugucauuguuauuguucagaaauucuauggauauguacuuauggugagacauagcaaguaauuguugaccauggaaguaaacucaauauaaaaucaaggaaguuuuaaaaaauucuaggaugcuuuacuuucauuggaaauaucaguuugaaugcaucuugaauccuuuucuuuaaaauauauguguauuucuuaacuuuguuuuaagagcaauaaauucaagcuacaaacugggagaaaauauuagcagcccacauagcaacaaugguuguucauuaaaaaaaacaacaacaacaaaauaacaacaacaacaacaacaacaucucaaaaauaagguaacaaucaaauuaaaacaaguaagagacacuaauggacauuuuucaaaggagaauacaaaugguuaacagucuaucaacaucccagccguuagggaaauuaagauuaaaaugagauauacuacaugucuauuagaaugguuaaaauccaaaauauugacaacaccaaaugcuuugcauaacacagauuuauugcugcugccaaugcaaaacaggccaccaaacacaggcuucucgaaguacuaagagaauggaggcaggaggaucaugaguucaagacuaaauaugaauuccaacugaggccagacugggauauaugagacccugucucaugguaggguauuaguuucuuaucaaguaaaacauacauaaaccauauggccaguuuguacauuugugugaaagucaagugugcccaagaaaggucucucuguagcccuggcuguccucaaauucauuaugaagccagacuggcuucaaacucacagagauccaccugccucugccucugcuucugccucugccucuuugccuccucugccccucugccccucugccccuuugccucucugucucucugccugagcgcagggauuaaagguagguaaaaaugaauguucaagauuacuagaaagucagggaaaugcauauuaaaaacacaaaaguggggcuggguggacuggagagauggcucagugguuaagaaugauugcugcucuccagaggacuggaguuugguugccagaacccucaacaacucacaacucccuuguaacuccagcuccagagugucugaugcucucuucugccuucuacagguacaugaacacaugcagcaaacacacauacaaauaaguuuuaaaaauuaaaauaaaucuuugagacugcaaaggauuguaguucagccacugaacaaaauauguaaaauugaaaagacuaaacaauauaggcauuuagaaacaaaaacacauaauuaaaaaagugcugguggcaaugagaauaaugacuuugcagggcucacuaacgcuuucuguaucagugucauacaauugagcaaucacagugaaagaaaugaacaagagaaccauagcaagaguauuuguaaacaccccccaaagaagcuaucaagaauaaacuaaauauagggaucuauauacaugacauauucauacaaugaaacauuauccacauggacaaaucucacaaauauaaugcugaaccaaagaagucacagaacaaaaagcacaggauauuuccgcauauaaaaaguuccaaagaagcccaaucuaacaauagcaacaaaaguuaaaauagugguuccaguuggagaaugauguacagguuaaaggggcauggacagggucauagaguuccacauaaaaugcaagcuacucaguuaaaguugaaucugaaacaacaaguaauauuuuauaauaauagguucagguaauauucagaacguuuauuuuuaacugcuacaaauggcaugcauagucaagggggcugcuuuuagaguagugguaguauucuauuucuugauguucauuuugugaucauccacugcacauuuuuucuguacauguguuauucuucccaauaaaaaaguuuuauaaaaagcaaaguacacuuaguacuauguugcugauuuuaaaauaucucauccaaacacucuuuuucccuucccacccuuaaucacuucaugugagagcugagauacuucugcaggcagugggcaucaguaaucagaagcauagaugagccaaaagcuguaggcucugcuuacauauuuuauuaaaauuacuuuugcacagcaugcuucuuuauuucuggaauguuuuuucaugcccuccuucuuggagccuuucuuauucugcugacuuaauuuucccaaagagcaucgcuucgcuucagaggccagccucuaacuuagucaagaaacaaaaugcacaagcaauuguucaaaguugaacggacuagcuaaugugagggguuaaaacucaaccuuaaacagaacaucuacaacaauacuggcucuuuaggggcagcaacucagauacagacacuucaaaaucugucaauucaguauacuaaguguuuugcaaacuuugagcugagguuuacaaacaucuugaguggcuccaugugaaucuuucucaucaguguauauuaccuucuccuaaagacauuagcaaacccaagcaaaaggcaguaaccccuaucaaacaaaagccugacugguuuuccuccuguuagguauguggcuacguaauacugaguucuuugauguucuaggggauuguaauguuuugauuuugugcuuucaucuuguccuccagguuuaagggccugucuuccuaguguggcacuaaacuuuauaggcuaauagaaggcuucccuaucugccaugcuuccuucuguguuucuucuauuuaguaccaacauuuguuuuugcacacaguguacuaaagauaauaauuagacucguggguuauaaagaccagcugccugaaagaaaacuacuaucaccacgaagaccucaguuuccucagcuguaaaugggaacaaaaagaucuaauucaaacagcuguugagaauauccaaggcaauuaaagcauagcaccccacacacauuaaaacacucagugauucuuuuuaucaucacugucaccaacuacuuuggaugccccugcuaccuguacuucgaugucauguaggaaaagcauucagaugcacuuugagaaaaaaggaagagggaacaagaaguuugagguguacucagcacacaggaguaaaaggcaggagcuagcucacagguaggaucuaguaagaugaacacucccagauccuguucuaaaccccaggaucuggccaggaucucaggcuuccugccuacuuacauugcgguuaaagcuguugccaggcagaaacgguagagccauggcugucaacguccgaugaggaugcaggguccaaccaaagagagaugaaugcccucaaccgcugcuuguuugaccccugcguuacc

SEQ ID NO: 9408 - RNA, 1332 nt, Mus musculus
ugguuaguauuucugacagccugugugacuucuuaucuaaccggaagucagagcugggggcuggacuucugguagugaguggagccuuuuagucuagcagaaaaucucuguucuucugacugguauggccuccacuugagcaucagaauaucugcccaaauagggguagugguacaacaucagaaauggaugauaaugguggugucagcaccuugaaucuuucuguuaugaaucaagugggagguguucagauggccacugggucucuuaccuguuuuggcuuuuguggccugcuccugagcagcagauaucaacccaaggugugcauggagggugcuaguggcagggugggcaaugagacacugaaaggagugucuguacgguuggucuuuccagucacacaaaaggagggcaggugguaggugggaauggauagaaggguggggugcuguuaguugcuugagucguugugcuccaaacugagggaauaggaggauucugaguguagguagggcucugacccauucugcuuggcauggccugcaccuguucuuccugguguagccucacagguaucuucuuuauuuuaguuuuauuuaugucugugugucuaugaguauguguguguacaggcaguugccuaagaaggccagaagcagugcaucagaucccuagacgugaaguuacaagugacugugaacugaccaacauggguacuuagaaccaaauuaggguccucugcaagagccuggaguucucuuaacugauaugaucuggauaucucacuccuaaguauguacccuauggaaaugaaacuuguauguauccacaaaccugauugcaaaaguagcauuacccauaauugccucaagcuagaaacaacacaaaugguuucuucaaugaguaaauguguaaacauuguggcauccauaaaauugaaugcuucucagcuauaaauuguugcuaacaugcauuacaucauguauuaaaaucucacaugccuuuugcuaagugaaccaagcccaacuuaaaauuccauauuguauuucaucugugaaagaacaaaauaucuaagaugccaggacauagauggggggggcacaugugaauaaaaaaguucugcaugagaagguuugugcggcccaguccaguucuguguguugauuauggcaggagugacaacauuugacauggaaauucaucaaccugaucuggcacuguggcuucuaccuguagucuugauugcacaugggacugagacagaaugaucaccugagcucagggauucaaggcccaugaaggcaacaagugaggauuucucuuuuaaaaaag

SEQ ID NO: 9409 - RNA, 15764 nt, Mus musculus
uggcggugacgcgacugugugggcggggcgaggaggaggcugaggaaaaaagagagaccauagacuuccaacucggccuagagcguccuuuaaagugguggggagaggcgggcagggaccacccccaacuggccgcuggcgguaucauggcaucccggaaccccccuccccaaggugagcagccagggcccgaaguagucucugggacgcugcccacagcacucgaccuuuuauugcuaugguguuucucccuuucccuccuccaguguuucuggggcucugucgcuguacagccccuuugcgagagccccuuugaaccagaggucuccuuucccucucugcggaauuuagcaugcucaccuacaccuaaccaaggcuagacccugcccugcccugcccccaccucgagcccuucuccaucuugcaaaauuaggaggguuggcggguugauuuccaugguugguugcguuuuaguccugcucugauuuccucuugcuagguuccugacuuuuccuuucauggaaggaucauccccucgcccccuuuucccacagauggaaauguacccugcccugaccuuauucucauugugcgggugaccgcccacugcuuuguaauucaacuggccucuggcugcgugucccuaagccuugggaaaggaaaugccgaugcuguugcuaggcccuuuaugcuugaggcccuagucucccagaucgaguuaaucacgcuccuucguuuacaucugggccuuuuuaguuguagaccagacaugacaguguguuggcccacagguuuuaugaaaacagcuugugagacguuucagacuguagaaugaauguuuuuuuuuuccauuuuguauuuuuaaagacuaugaaagcgaugacgaaucauacgaaguguuggauuuaacugaauaugcaagaagacaccacugguggaaucgaguauuuggccacaguuccggaccuaugguagaaaaauacucaguagcuacucagauuguaauggguggcgugacuggcuggugagaacauucuuuucauuaaauuuuagugggaaccuggcucuuguccuuuuguaaauggcacagccuccauaaaucuucaguggcuccccacuuuuaaauuccagaagaacacaacuuuggggcuuuucccggaucuuauugguuguaucagccuucagauaguccugguuggauuuugaugauuucccucugucaaaggcccaccauaguuccacuuccacccuuuacacuuccuuuaauucauuaacaaauuuucaacuuaagcaaguuaauuauaaguaaguuguuacuugcuauucagugccaauaacuggaaaaaacaugagaacucccauugcagaacuagccucuaagauucucagcucuguacauagaagcauuaauggucuguaaaaauuauucacaaugaugcaucagauucuacauuuuuuguguacugguucugauuaugauagugcuuugaagaagaucugagaagauugccuuugcuuuagaauuaaugcaaugauuacuuauuaugcaauaauuuggaguacaauaaggaguggcuaauaaccauuaaucaagcaacagcucauguaagcacauauuuacauuguuguuaccauguauuuuaauucuauuauuuuuggaauaaaauauuaaccagauaaaaaggggcagaaacaguucaguauuuugaaauauguugaugacucuuuuuuuuuugaagugacagugauuaaguuguaagcauuuuuuuucuuuacauuuaagguaaauucaucuugugcuaauuaaaauauuuacauacuuccucuuggcaugggaaaaugacauuuauucauguguguuuuccaugaaccucggaauaaugaugccccaugccuucuuguaaaugccauuucauaauuuaaaacaaacaaagaacaauuauggugaagauuccauggagcacaggcacaguauuaauacugcuuuauugaaaaaucauacaguuagaagggaaauuucugcucagggccucggucaauuagaugauucacuguaggaugauuacaacucugcccccuuaaaugcauuuauaauuuggugccagaggugauugguuagugagaaucauggcggaaagccagaucguugcacauuuucuucuuacagaccuaaccugcuaagaaggcccauaacugccaggucuuccugaaaacccuaauggcagagcagaaguuaguagugacugguacacagcuuguguagcuguagcauucaaccugggguuuaaugaagaccucacuacuugcuuuuuucuuuguucuuccuuacugacuccuguauaagaaccauauucuugauaauaauaacaacaacaacaguaguaauacauuuggauugucaguaucagacaaguauucaacccaggagcuauguaauaguuuguggguauuuguuuuuuacauccaucuauuuguguggggggcacagaugugucccaguauauauguggaggucagaggacagcuaguaggaguuugaucuuuaccaugugaguuuuggggaucaaacugggcucuuuagacuugguagcaagugcuuugaccugcucaacucucucuaugaccuggucuguguaauaggacacuuauauucagguggcuuguuuuuguuuuuguuuuaugugggcacaaauucaggaccuugcaagcauucuaacucuaagugauauugccagcuacauaggugauuuguuggaaugauuugaacuguaguuuagauucagaguagaaaacauuugaaaucuuuuuaggauauaacauugaugugauauuguggcauaaaagaggaacaguuaauauaggcauaaaccuaacuuaacacuugagaccgaccagcucaagacaugaauagccuaaggagauuggauuuagccauaaguuuuugguaauaagaaaugaaaacuaguaugagaaaaggugguugcuaggagaccuggaggccuugaauacugaaucugcuuuuagagugugauccagaagcagagcuauggaaucccaacauuacauuccaaagguaacgaugccccuaagaguggaaaggagggcuggcaagauagcucagcaaguaggcuugaugccaagcuuggugaccugaguuuuauccacagguaccacaugguggagagaaccaauucauguacauugugcuuggccaugugugaauguuuagacacacacacuacauaaaaaauuaauaauaaaaauaggaaggagaaaacagguaauguuuucuagaugggguauuugaagauaaggaugggagucugagaugaauaugaccuggcaaaugggggauacuaccaucaguuagaaauuggggccucaguagcagcuguuugggcugcgugugugucccugugacaugacuucuauugaauuaagggcuacugugcuccaguaugaccucaucuugcuuaauuacauaaacagugaccugauuuccaaguacagucucaugaaggacacuaauuuggugggaagaccaauucagggcacaagacuaggauuagaaaucugcgauacuuuuguagaauagugaagggaccaugaguaugcucaggagguauaggcugacauuacaaaguuagaugagacaaaacaauacagaaaauuaauacuagauaaggaaggugugagaaauaugggcaguguaaucaucuaaguggaauaacacaaggggcaggaaaguuuuucauaggcaggaaauuaauaacacaaagauguugaugcauuugaaacuaacugcauuggagcugguuuggauagagugaguguuguccagguguuaugaaacacccugaccgcauuaagcaaaccaaacaagugacuacugugggaaauuuuagcuuacacaaaugcaggaguauaaugaacccacguacuccugauuguuuucaauagcugcucuuuugauuuuccuuuuaagucucccucuucucaccuuuuccucauuucacagcaaauccuaagacauuuuagaguuugcauuuuaaccacccuguaugacugaaggaaaacacugaauauuucugagugggcaaaggagacuaucaaaagaaauugaaacacauuaagcuuuuauuaggaaagcaauaaaauguagacgaaauuuaguacaucaaugauuguucucaucuuuuguuauuucugucauuaaaggugugcaggauuuuuauuccagaagguuggaaaacuugcugcaacugcaguagguggugguuuccuucuucuucagguauguuaagaccuuuauaugucaauguuugcaaagagcagagaauguuaccuaucuauuucauuccuggucauuucaauagaagguauaauuuuucuuuuacacauucguuuauagaagaaccauaaugagcuuugaaagcuuguaucugucaugcaagaaaacaaauacuucuagauucucuacuaugcucacagugugaugugaugucugagucccagcuacucaggaggcagagggaggaggaccacaaguccaaagcaagacauaaucuucaaaccaaaccgaacagauuuggggauguaucuuaguaguugagccuuugaacuuuaccaguauccugggcuuauggaugugugcagccauaccugguuuagaucgcacuguguauacauuauaguuuucccauaaacuaaugcaacacauugagcaacuaaucacguuucugacaauuuuuuuaaacugaagaaccagagccaaguguggugguauaggccuggaaucccagcacuucaaaggcugagagagguuaagacagaagaauauagaaauccaggccagccuuggccugccagauauauauugagacauucugggggagagaagucaaaaaggaaggaagaagcagaaaguggaaauuuaacuuuaaaaaaauaaccauaauccuaucuauaguccuauuuccgcaacagguggauuaaaguuuuaauuuuguuccugcucuuuuagggguaaaauccuuugcuagcaagaauguuuaugaggauauuaucuaccauuaugucuguuugauauauauuuuccuuaaaauagcauuuccugaagaagaucaaauacaguaaaucucaaaauugaagaucucugggaauaaauguuagcaauuuuaaagaugcagagaacuguuaguuauaccagauuuaagaaaugauugcuguucguggcgaccagaaucugacuuuagugccuaagccaucgauccuguaauaaccaacauagucaucuuacgugcaaagagauagcauuuauaugaauugagugcugguguaaguaguuuccuagccagcuguuuuaaggcuauauuuucauuaauaacaauauuaagaauaauauuucuugugcuagaaguaaaguaaugugauuaauuucuaaauuugguuauuuggauguaugcuaguauuuauacagaagaggauuucacuuaugcugauuuggcuugcacuuguauagaaugauacagaugauaugauagauagacguaagucugucaguauuuugaaaacugaguugucauuucuguucagugugaagggcacuagacugaagcagaguggacuaaaacuguugacagaauugaauuguguguuuguuuucaucuacuuuugcauguuugccucuuagaagucuauuucaguuguucaguauucacuguugaaauccacauuuuuaucaagguacuuccuacuuuucuaagccugucauuuuuggagucuaaagcagaaggacauagguccugucugagucaaaucacuuuuacccacagauauaauuagccuugaaaacacaguaagagggaccugaaagaaaaacuagagaaagaaacaucagcuuuuaagcuaauuaauugcuuaacaugcuuaggccugauuccauaguucauaacauuugcuuauaauuaaagauaacuauuaguuuggguuaagacuuaaagcuuugcugguaacaauauuaaauguuucucaguagauauuuaucauauugccuucuuaaaauagacauuggagcugcucugaguacaguaguauuuacaacuaaggaguccuagccaauuccagauuucucugcuuaacuuuagaaaaguagacaaugcuauaugaguauuucagcuuucuacaguuauaugugcccauaaauaagggacacauacuugcauagggcuugucagagcuuaauccucuacuccuucuauccugacuuuaccccucccuugaagcagccucuaacuucucacagagccuccuuuucccugacugacacauuuuugaucuuucagcugcaggaguucacuauuggcuucacauuauggaauauucacuguucuuuuugagucauccuguucuauuuccaccugaaugcuuucugucccucugccauguccucuggccccaucuugaguauuauuucauaguuaugcaccuaugauuaagugagcuucuugauucauguuuucuuuuaauugaaaaugcauacaauacauucugaucaugguucccccucucccauuccuccaagauucucccaccuccauaccacucagcuccuuacuuucuuugucucuucagaaaacaggcauaucaaacagaauaaaaaugaacagauucauuuucuuuuuaaugcagaaaaagcaacagaaacacugagguuuagacccuuauuucgaguaaggcaucugggauuguuuuguuuugauguauuccuauuaucucagucuucucuuggaggaauaugcauuaggugaccuguuuaguguucuggggagggccgucucaggaucuucaguccugcuaguuuucuaggggauuuuccuuucagaaccauucuagauaaucccuuugcuuugucuugguuuccuauuuucaagggacaugccuucccauuauuacaucuucaaguaacuuguagagaaaauaaguaugaacaguguaauuuuugagauuuguuuuuucaugucugacauuuucauugugucccccauuugaguaauaauguagcugaguuuagauauugcugcauugucuucaaguucaguguugcuguuuaaagucucaaacaguucuagugccuggccauuuaucuguaugcagaccucccuccccgcccacucccaccccccaccucccagcaaauccuuagcagauuuuguguguguuucugguuugucacauuguaguccuuggugugggccuguucuuacccauuguaacccuuuucaacucaaacacuuuggcuuuuuuugauauuagcuaauaaauuccuguucuuuguuuacucucugcacugccuggccaguauauuuucuaugauguggaucuccuagacuggcugucuauuuuucauagcuuagcuuccuguuuuuuuuuaguucuccuuuugguuuacuuucugggaaauauuuucaacuucaguuucuagcaguuuuucauuucuacuuuuuaugucuauuaauuuauuguuacugagaauucacuaggcaagcauucugccacugccauacauguagcaccaacccuugugcuuauuuaauuccuaugagauauuuaugauaugauagauaugcaaauauauauaaauauauauacauauuuauagauguauuuaaagagauucagagguggacuguguuuauaugaaauugacccuccugaauucauuuuuguuauguaguagaacacuaacaucaguggaaaccacuuuaacugcuugucuguagcccaugaagauaggaagaaauugugugcuuugaugccuucucuaauuugaauugaaaacaaaagguuuuuaaaagcucccacagaggcuugauauguuagcccaaggggagcucaaccuuuuaaaggagaagcggaugggagggguaacuaggaggggagcaguaagcgagauguaaagugaauuuaaaaagaagaauaacuguuuucuuuuuucuuuuuuaaaagagugacugggcugacauuuuuuaaauugccaggugcuaguuugaaguaauugccuuuuuuggccacaggucuugaguguugggucaaauggucucucguguaugaaguucuuaguuuuuauacagaauguuuaucuaccaguuuauuuuuuucaguguuacagacaacacugcagugauagcugucuguuugcaguacuggagauugagcccagggccucauguguaugccuggcagaccuucugccacugagcuacaaaccauuuucaucuuucacauuccucugagacaaaacaaacauauuaaagccuuuugauuaccaagugcuucuaguaagaauaaaucgauugcauuuccauguuaguacuaaggauuaaaaucaggguuucaugcugauauagcagacccuuugccuacugagucauuuccucugcaugucugcuugccuuuuuauuuccuuccuuucucccucccuccccccucccuuccauccauccauccaucuauugauccauccauccauuuuuccuuugcuucccuccuucuaguccaucccccucccucccccuccuucccuguuuuuuuucuucuugugguauuaggggucaaacacagggccuuauacauacuuaagcaaaugcuuuaccacugugcuacauuuucagcucuuguuuuguuguaaaaccucucccuacagcuuuugcuuccauaauuuuuguuuuugguugguguuuuguuguuuuguuuugcaauguuaagaauuaaacaugcagccccagccccuugucuaaguguaccccuccccuuccuagcuuguauuaaaaaccuuccagugguggugcacgccuuuaaucccagcacuugggaggcagaggcagguggauuucugaguuugaggccagccuggucuacagagugaguaccaagacaggcagggcugucagaaaaaaaaaagccuucuguccucugugucugaugauguguuccuguuuaagaacuaggcacuaaaauuugauguaacucuaaauucuuaaugggagucuuuauuucagaaaaucucgcuagucuaagaaaaaaaaaauucugaagaagugaaauugggaauuggggagucuucccagugaaucauuuauggugaggcugacaaacaagaagccccauccuuaccuccuuacagcuucuaaacaaaaaugaaucuuugucugaaagcuuggugcuauuuuuaacauguuuuuuuguuuguuuauuuguuugguugguuuuuugaguuuuuuuguuuuuguuuuguuugguuuuuguuuuguuuuguuuuuguuuuguuuuuguuuuguuuuucgagacaggguuucucuguauagcccuggcuguccuggaacucacuuuuuuuuauuauuacuagguauuuuccucguuuacauuuucaaugcuaucccaaagguccccaauacccacccccccacuccccuacccacccacucccacuuuuuggcccuggcauuccccuguacuggggcauauaaaguuugcaaguccaaugggccucucuuugcagugauggccaacuaggccaucuuuugauacauaugcagcuagagacaagagcuccgggguacugguuaguucauauuguuguggaacucacuuuuguagaccaggcuggccucgaacucagaaaucugcgugccucugccucccaagugcugggauuaaaggugugcaccaccaugcccggcuaauggagaacuuuuuaugcuaauaaagcuucuuuacccagugucauuaaauauugaaguaguguaggaaaaucaaauacauuucaaaaaguggucaucauuguuccacuuuucuccagucugccuaguuugcauuucuuuauaguuauauagauaaguuagaagugaacgugucaaggaaaucucaucuguggaaaccauuuucucauucacucguaaacauaauaggaaccauugggauaaucuaguccgguuacuuuguugagugcuccuugaaacagguugguuagcacaguuuuggaaauuuaauauuuauucauggucuuuauuaucauucacccagcauuucucacucaucuucuugcaugacauuauuuguuaccagggauacaguuauucacaguuuuuauaauccuauggucaaggccaagcuggaugggugccugugguguggugagagugcaggaaaggaacuugaauugcuuggagguguuggagaggaggaccccagagggacauugaacuaaucaucuaaagauuucucaucucucugcaacugugugauacucuacuucaguguguguuaacauggagagcauuuuggcuauucuaacaauaacuaaagccaugcacaugcauaaaaucuuugcauuucaauaaaaagaucuguugaaauucaaccuacguuaaguucucuaaagguuacaaagcaaucaacuaguuugaauacuuuguaaggcaacuuuucaguuuuuaucuagaaagucuccuuuaaaguucauuaucacuucucugccuaugauccacaucacugugucgucaggcucuaccagaaaaguuugaugacaaacaauuugaucaccucucuagcugaggccagagucugacggguaccuggugagugaguauuaggaagagcuucagguaaacagucuacuguggaaucagucacagagacaaauagaaccuaaggugcaggucagaugcuuuauaugaaaucagauauuuuuguuauuugaaauauuuuauaugugcuuaaaagccuugaauaugguuaaaagucuauaaagaauguaucagacugauagaagugacuuauaauagcauauauaguuuaauuauuuacuucuuguguacuuauuuauauuuagauuuuacuuacacugguuacaucucccuauuguuccuguuccaguuuugccauuggcccaguagcuucuucauguaaggguucuuaagaugaauaagcauuuagcuauaguuuuuauaagagcauuaauuaucugaaauuuauuauggaaagcaauuacuauaaaguuuuuaaaugaaaaugaaagcccaucguuccuucccuuuccuaccuccaacucucucuacauacccugcugucaaacuucauggccuccuucccuuuguuauuauuacauauagguauaaaugcaugcauuuaguguugcauguauguauaugauuucagagaugacaacuuggaaccagauacccaauuagagucucuacucugggguugacuaauucuccccauuucaggaaucauuaguugccuguaguucuuuguguaaggguggggccccaugagaagacuuucucuuccauuagagcuguguauuugguauucucacuguucagguccucuuuaagcagccguauuggugagauuucauggguguagcuuaccugccauuugaaggagacaagaccuuacagcaaauuuccuggucccuugccucuuagauucucccccuuuuauucugagauauuccaugagccuuagauggagcaauuguguuauagauguaucucucaugucugaguuguguuuuguaaucauauccaucuguugcaaagcaaagcugcuuugauuauggauaaaagcuacacuucucuggauaucaagagaaguauuuagaaugcaguugggaauuaugaugauuaaaguagcaguacuagacucaccucugagguccaugauuucacuacuucuguggggcuggcuagguuuccaguaaguacuagacagacuuuucuuccuguugagcaggccuuaaguccaaauggauagcuaucugucggcuacuaccacaauauaagugucacuauugugccuuuagggcuaucuucuuauacuaguaauaguugugauuaauaggcauaauggauggguaggacaguugguuguuuuuuuucccccuugacauuuuguauagcaucuccugguacuaagagagcuaguccucagggagaaagguuccagaucaugucuagcucagauccuucaaguccucugcuugaagugcaugguguguucagcaauguauacuuaauuucaacuucugggagauuacaaaaggcaguagcaauagccuauauuauuuugggagucucuuggacuccugaacaacucaagauggcauuuuucaucagcuuuuguuuaacagucaguggcucuuguggguaguauugucagcccaaguggcauaacuuuaugaguguguguguauacauauauguauauauaaaugauacugcacauuauauuuacauauaaugugcaguaucauuuauauuauacauuuuagguaaauaaaaaauaaugugauuccuuaugacuuuuuucaaacauccuuaguucuauuuuccuucuccucaugcuccuuguucuguauugaccucccccgccccaguuaagccucguugcccauuugucuucccccugccccugcauaucagcuguauccugcuauucccaucucuagcacacccuguacuuuugagccccuuuuucuuuccugauuucugugguuagcccagguuauauauucaaaccugaagauuuggagguaggaaccacaggugagagagaacaugugguauuggucuuucugggucugggcuaccucauucaguaaaauguuuccuaguuugguuuacuuagaaauucuuucaauuuucuuuacaacugaauagcauuccauaguauauauguaccacauuuucauaacccauucaucaguuguaggccuuuaaguuguuuccauuuccuaccuauugugaacagaagagcaaugcacauggauggcugagcaggugucuguguguggagaugagucuguugggcauuugccaaagaggaguguagcugcguuauuugguggaauuauuuuuagcuuuuuuuuaaaaagaauuuuccacacugauauccaaaugaacuacaucaguuugcagucucaccaacaguaaaugaagguucccuuuuccccacacucucuucuuaaauuaagucgauucagagcuagugaagugccuuuaucaggcuauuugaaauuucuuuaauaacuugucaacugauugcuuucugauuacuagguauuucacaucuauuuaaguaaaagguacuuuuuauuagucauacacuuuagauaaucugucuuuuuagcugauucccuauucuaaaggguaggaugaaagcuguuauaauacagcuuuuugaaucuuuccuggcaugcacuauauuuuucuuaacucuguguugauugcaucuaaggagcugguuaguuacuguguuaaaacucugcauuuccaacugcaccagagcacugcuaagaagaguggggacaaaguucccuuuguucaguuccuauugacugaguacauuggcgaggccauaacaguuucuuccuuagaggcuccagggauuccugcaaaacgccacggccuucuacuucugggcuaguauucauucucauugcaugucugcagguugccagucacaguggcuauguacagaucgacuggaagagaguugaaaaagauguaaacaaagcaaagagacagauaaagaagcgagcaaauaaagcagcaccugaaaucaacaauauaauugaagaaguaagacaaugagacucuuugccuucuguucuuugauaacaggucucacagaaaguaugauuggggauuacauuaucuuaaugauguuugagccaagcacgguagcucauaccuaccauucuagcacuuaggagacugaaucagggggauugcuaugaauuauagaccagccuguuagcuugagcuacaaaauaaaauuguguuuuaagaaagcaaagcagcccccccccccaaaaaaaaggaagaaagaaaggaagaaagaaaauaguugggaauguuauuuaucuggaauucaguaaauaagaaguucuuuugaauacauauauacauuuugauaaauacaucguuuaccaugugcaagaauacaauuuagaggcaccauauccauacaugcuucuguacaguuauuuccacuauccauuugcauaacuuaaaaauuuuauuaaguacuauuuccccaaauuucccuuccccuaaccucuauuugguuuugggacugucgauuaauuagagugugcauaaguagaauugugcauuuguccuucuguuguccuauuucauucaaaguaauauguaauguaaucuaguuaacauaauauauuaauaucuaauucaguguaauauuuguagcaucauuaugaguauuuuuauugacacuuugauuuuuaggcaacagacuuuaucaagcagaacauugugauauccagcggcuucgugggaggcuuuuugcuaggccuggcaucuuaaggacuugaaggcucuaugguaguggauccaacaaugagaggaagacuguggcagcaggguuaucucuuaauggcacaugcuaccagucuccaaaguaaggaacagccggcuggacgauugcaaaugaagcagcuuagcauuuugccgccugaagcuuaccaagcuaguaucuccuguaagacaaccuaugugcuguguacacaauaguauucuugagcaaccauggauuuugcaaauuuuuaaauuuaacauuuguuuagaaacuagccuaugauuaucaucacuggauauaguggagacagaaaaagcuguuacauguacuguccaaugaaauauuacccuaucuacuuuucaaaguuuuuugugcuuuacugucuagugcuaauaauuaaauauugucuuauagcuucaauguuauggcugauuuuuuuuaaagauguguuugcaauaaacugaagaauuguuuuaccccuuuguggaaggcaacaauagaauuauuaagauauuaaacucuucugauaugucaaucuuuaguuagguuuuucccccuucucuuucuuacuuugcuuauguguaauauuuacauuaaaggaggauuuuguaaugaaauacuacgcgacuaaaacacuuucccuuucucuaaugucugcaguuuuugaaacgucuccuuguacguucuaauuuuucaaguuuguuugcuuuaacagaacuaauuugggaguaugucauuaguuggucauugauaugcuuuauuaauuucaaaugcaucucauuuuuuauuucuaaaaauccuaauuauuuuuuugucucuucaccaaaagguacagauugcuuuaaaauacuuaauaguauaauaugaacuuauugucugaagaacugugauuuucuguguaguccuaaaauuauagcuuaaauauaauugcuuccuugauuauaugauguaagcacuagggcucucaggcauugcuagcguuccauuucuugaacauuaggccaguuuacuuguuucucugggccagccucacacuuguuccgagcaucucuuguccaagaacagcuuucaauauuguuauucuuguucauagaauucuuggcugucccuggggaaaacagcagaacaguauagguuagagucuucagacuggaaauauugcagcuauucagacuaucuuccugugauaggacacucccauuguauacucugugucuuguaaaugugucauuucauauuuuugauauugguuacaagcugugugcuuguacugucuugaaauucuuuaaauucaaauguacaauugaauuuuaguuucuuuuauucucauuagugccucauauagaaugcuaaauaaaacucaguuccuuaauaugaag

SEQ ID NO: 9410 - RNA, 4115 nt, Mus musculus
ucuugagacagggacuauauuuuucuaaaugcuuaaaugcuuuagguuaaguauuugguuguuuaaaauagguuaaauuuauucucuuguaacugguuuuauauugauggaacuuacaccauguguaauacugcuucaaauauacaugaaguaguccauaaacuuuuauaucguuuuaaaauauugauuuacccaugcaaguuuuauagguuggcaaauucagauuaaauuuucuccagguuuuuuuuuuuuuuuuuuuuuuuuuugguuuuucaagacuggguuucucuguauagcccuggcuguccuggaacucacuuuguagaccaggcuggccucgaacucagaaaucugccugccucugccuccggagugcugggauuaaaggcacgugccaccacacccgguggcucuccaguuucuauuguguuguuauaaccauaaaaaaaaaaucuagauuugguguaauuuuuuucauuuucgaauaaaugagagguauaccaaugcuguagauauauaccuaaacauaaaaugaauuaggauugcuugugguugggcuuauggggagggugaaaacuaggaggaagugauucuuaguguaauguaguaacaaacaauuuagaccacauaggugaaagcaagaaaagaucucaaauaucaaaauuauaaaauuuauuuuuuuguuugaugcuggagauugaaaggcccugaguaugcuaaacacacccugagucuuaauaagacuuugaauucuguauuacacauuuaguacuuuguuuaucuuauaauaucuaaucucucuguguuuguuuucaagacaggguuucuuuguguagccuaagcuggcuucagacucagagauccaucugccucugccucuugauugcugggauuaaaggugugagcacccaugcugaccauagcaucuaaucuauaaaaugucauuaagugguuucuuuuauacuuugugugugugugugugugcacaugcgcuuguguuugugucaugguaagccugugaaggucagaagacaacuugcaggaaucaguuuuggaaucuggcaaauauuuugagggacuaagguugguugccccaccauaaagugguagagauuagauuuguaugauguaacacaaaccaggcuccuauuuuuauaucacuuugccuucuacauuuuaaugcccuucuuuguagccuagcaugaccuucaaccuagcacucuaccaacugagcuaaaucagcccagguuuuuuuucauaguuauuauuauuauuauuauuauuauuauuauugacauacgguuucccuguguagcccuggcuguccuagaacucacucuguaguccaagcuggccuugaacucauagauccaccugccucugccucccaagugcuggcauuaaaggcaugugccaccacugcccugccauaguaauaauuauuauaaaacaaaauuuuuccauuuuuguaugucauaaauuuaaaauugcauuaauuuugacagugacugagaaaggcuccaugcuuauuucacauacauuugacagcuaaacuauguaaaugccaaaaaaauuacauagacauguaagacuuauuuuauauggacacugcauguuugauggaggauaaauccuuguaguuggccugguuuggccaggcaugauuguacgugucuauuaucccagaacugaggagucugaggcaggagaacacagaggccagccugggcuacagagcaauacccuguuucauaaaaccugugccccaauaaacuagaauuacuccacaucaaaaacaacagcuuugguuuagaggucacagagcuugcacaaggaucagaacccagcugugcuagcuagacuccaaccccucccuaucacuuuauuucuaaaacucuaaccuuauuauuaaagggcaggaaggcacucagacauggguugcuuauaucauucuuggaaagggacuaaaucaggaaccaguaacuuuggggacguggccaaauacugacagguuugauuucuguuugugcaaguguccaugugguaguggggccaaaaaucucccagguuuugaaggucaccauuugugacauuuaacaauucguauguuaauuuagcuauagaaaauauucagucucugguacucacucagucaaguaaaauagaacaccauagaacauguuuuguaaaaguguaauuaaacacgaaauauaauccauacaaaacuaguuuauucaucuaguuacuagucuccaggcaacaauuuaaagcucugucugucugcaaaauuaguugggacuuuuauagucucucauugaagaacacagcuaggauuuacugacucagcacuuauauauucugaaaucuaaauuuaaauauacccuauugauuacagguguaaacuuauauaaaacauauaaagcuugguuuauaaacggaucuuuucuucauauaguccauuuacuaauauuuucuaucccaaagacuggaggugugaugagauacaucacauuauaucugccuuuucaaaauagucgauggaaaguuuggucuaucuccugauuauacuaugggucaaacaccagacuuauuuguaccugagggacagaacaagcaaauguuacugcuaaggguuuccuauguaguggaagcagaaaaaggcuggcaggaagcuguguugaggauucuauuucucuaaggccaguucacauacagcuccuacucuuccauggaguacccacugagaugacagcaacagaacccaacauucugaaaucccccucgacaaauuucacuguuucuguuuuuuucuuuauaguauaacgaauuacugcuagggcguaggguauaugcaagcagcaggaauaucuggcccgaaagugcugccaacagacagaccuuuggcgguggggugcgggagccagcgcgccagacccccugcaggcgacugacucuucauuccucccugccuggggugagugggcgggggucgggagacguuuuccccuuccccuuuugaaaggguauggggcuucgcguggccuugucuagggcggcgcccaggcugcaggguaugaagccggcugcugcuccucuggcgcacuccucguggaggcuauuauuucuagcagugcgccuucuuccgagggcagaggucuggggccgaguguucccuccccgcgacucagcugguguccagcccugucgggaucgauauucccggagugcgcgagcgcuagcaggaccaccgaaaucacagucuuggcccacccuagggcuuccgggcagccagaggcuguccuaggcuuucucguuggcgcucgcuacaggcggugccggaccucgcccagacugagcacuccccucccccccccgaucccaccacggcucccgaagggacacagccuggaccccuccauucucugccuguguauuuaaguagcacaaccuaaccggcugcucccacugggugacaacccuacuccggacagacgugccuaucagccaaccaccgaccagaacuggcgagcaucccgcucucggaucuguggcggccucggugggcggggcuaaagcagcuagcaaguuaaguggagccacgacugacgcgagucaacaaaggucacgugaggcgaggggcugcucugguuggcugcgccgagcgggcugugaggggggggucacggcagcggcgugggguucgcugugugacacaauuacaacaacuuugugcuggugccggggaaguuugugucuccuacgaaucccccccagagcucccgcuccucgcgcgcuccggccauucccgccgacccugccuguggcugcccccuucccauccccgcgaugugacccuacagccgagccgucgccgcuccggacccagugguuccacagccucugcugccucugccuucaccucuaccgcguuaggauuuuucgcugccgccucucgcggcagaggaggaggcagaaauaaaguuggugugccggucuugugcggagauuggaggcguccuugcgggcuccggcccggagagggggggugucggcguuggaguugugaauucgcugcguuuccaugaaauccugcggagugucgcucgcuaccgccg

SEQ ID NO: 9411 - RNA, 117364 nt, Mus musculus
uggcugcgccgagcgggcugugaggggggggucacggcagcggcgugggguucgcugugugacacaauuacaacaacuuugugcuggugccggggaaguuugugucuccuacgaaucccccccagagcucccgcuccucgcgcgcuccggccauucccgccgacccugccuguggcugcccccuucccauccccgcgaugugacccuacagccgagccgucgccgcuccggacccagugguuccacagccucugcugccucugccuucaccucuaccgcguuaggauuuuucgcugccgccucucgcggcagaggaggaggcagaaauaaaguuggugugccggucuugugcggagauuggaggcguccuugcgggcuccggcccggagagggggggugucggcguuggaguugugaauucgcugcguuuccaugaaauccugcggagugucgcucgcuaccgccgccgccgccgccgccgccgccgcuuucggugaugaggaaaagaaaauggcggcgggaaaagcgagcggcgagagcgaggaggcgucccccagccugacagcggaggagagggaggcgcucggcggacuggacagguacggggagcgggcacucgcccgggcggcucgggacaggcuggcgccacucuccgaggaggccggagcgcggcuagccuguggcggccguggggcgggcaccucggcuuggcgcucucggcuccgcugacgcccgggccucgggcuuuggcacggacgggucggcgccgaugccggggcacuaacgagcggcgugugucuuucuccgcagccgccuuuucggguucgugagguuucaugaagauggcgccaggaugaaggcccugcugggcaagguaaggcaaaccgcgggccggagcgcggacgcggucucucgagccagaggcgcgcucgccuggggcaccggggccgggucaccacucauuguggccucgaaagacggccgaggggcuuccggaaaacuauuuccugcuacugcgcuccccuccacccccugauaccucgcuugcucucuugagagaucacuucucuuggagccagaggacagaggcaguggcgcuuuuggggccaagcucauguggggcuuccaaauugacuacgauuuuaccgcccuuggaggcuaggcggaugaucucugaggugccuagggagggucaugaguucguaaacagcuguagauuuccuuaaaucccccgcucguuaucuucccugguuauuaaggcucuuuaggcagucuguuccugaugccugcuuuagucaaacauuucgggauggcuucuugucucugcucccugaagggggaaguugcacguaguuuagguccguaaagaguuugcaugggguuauugacuuguaucaucaucggugugugcuuuaccugaaguuaggugauuuguuuacuuuuuggaucuuucugccaaagaucuaccacaguuguaugagugcguuuucuggagcuugguuuccugugagucugucaggagcaguuggggaggauucuggguguagucucuuguuuauuugugugcaaaguuguugguacugucauuuaguuaaguaauggcugcuucuguccgcccaagauggcgggacagggugggaggagaaagugagccgggggagguuugggggagggaggagagguaaacagggaaauaaauaguaucagagaagaauaggccucuccuuuggaguauguagcucaguaguuaauaaaaaugaucacagauuauuugcauguagaauuuuuguccccuucucuagcuuugaaauagcgugcauacgccugguaaaugcuuaucaaccuguagcacauuuaguuacccaugguaagcuauugaacaaaggcuggagucucagucugucuacuucaguuuauauuuccugaccaaagugugauuggaaugguaggaggagguuuuuuuguuagcugggacucucaaacuuggagugucuaugguagauguugcauucauuagaccuuuucuucuuugccggaaaucuuuagguuugauuugauacuuuguuagcucuauuguugcaauugggaaguuuaagaaaggcgacuaaagcuuaacggcuuuaaaaaaaguugauuauuuugcuccuuacuuuuugaauguauuuugguuuggcugccuuaauuguuuuuaucugugaucauaauuacguuuuuauuuuaaaguaucaaaauauaagaacuugugauugcagacaaugacuauaaggcaaaacagucauaaucuuuuucgguagguccauuuucuuugaaugguaaggaaauuugaauugaacuuugacagugacgguauuaauuuucuuucauuaaaauuagcgcuggaaaaauguucaguaacuagcucuggaauuauauaaauauaaauaguuguuagcccccucuuuucaagauuuuccucaaccuauuugaaguauuuuauguacaaagauuagauuaauguaaaguugucauuccaaagauguguguguguguguguguguguguacacacaccuguauauaguguuuaaauuuaagggccauuuuauuuuggaguaaacauugcuaguuuaaauugaguuaauagaguugcuuucagcgauaauucauuuggaaauuuaggcuaaauuuauuccuuuugguuacagugaugaagaaauaaguggaauguguuuuaagugcauguguaaagugcuaguucuuacuuucauaucuuagaaugcuuguuaucagaaucacacaugguuguccuuaacgugggauauuauaucauaaauaguaaaaccuacaguuaauaugaacugaguucacauuuuaaaaauugagcauuuucaaaauuuucuaaauguguguuauuuuauuuuucugguauuugaauacagucacauguuaagcaugaaaaaauaugugaagcuucauuuuguuugggggaagaauuaugacuuuauaaaucucaggugguauauugauuaaaaaaaaaucuucauugauucuggcuucuuagggucuagcuacuuagaucagggcucaacagcuuuaaugcuaaaacauuccauauuauguacuuuguacaccuacguggaucuugauuguguccuuauuagcaugaacauuucaguaaaauguguaauauaaauuuaugcuugauaaaauaacaccucacauuuucuauuugaauugaauucggacuagaaugaguguuaaauuauuaaguuuuauccauccucuaacuguccugagaaucaguauguuugaaugugagguuugggaaguagauuguuauguugcuuucagaauuauuuccuauguaacucuuuuuaauaaaaaguauuggcuuuucucuauagggugguggauuuguucaggcaguuuuacugaacacagaauagaacauuuucuagaauucuuuuuuuuuuuuuuuuuuuuuuugguuuuuugagacaggauuuuucuguauagcccuggcuguccuggaacucacuuuguagaccaggcuggccucgaacucagaaaucugccugccucugccucccaagugcuggguuuaaagccaugcuccaccacugccagucgucuuuaagguuuuuaagugcacauuuauaaacaagucuaacauuuuagaaaacuaaaaccauuccauagguauuuuuuauuuguccuuuaacaugugcagaugauuuuuuuuucuggacucugcauacuuuuguaaggcucgauuauguaagaguuauugaaaggguugcuuguagaauuaucauuugauauauaguauaguguuuugaauuucaagauaauaguaauacaguauuuuguaguaauaccuuaaauaaggcuguaaaggaacuaaagcuugcuuuagaauuuuuguaauauagcauggucuuuaacaguuuucucuuuaaugauaacccauaauuuauuauuauuauuauuacuacuacuauuacuuauuuuaugucuauggguguguugccugcauguauaucuguguaccacuuggguguugacugaggaggccagaagagcuucugaucugaucccuuagaacuggaguuacagccaguugugaauuguccuucgugggugcuuagaauugaaccugaauucucuagaagagcagccaguucucuuaaccaccgagccaucucuccaggacuaauagucauuauuuuuauuuccuaauuacauuggaauuacuaagaaauaauugagugaaaccuuuuuuuagcagaaauuaacuaugaugauuauuuaguacaaauuugaaaacuuuugggguauauaguuuuuaauuagguaaggauuugaguuaggaguauauagagagaagcaaaguaaaagaguguaaauaagauaaggacaucauuaggucauuuuuagagguggcuuguuuguguuacgauauuuggauuauucgugauguaugaaaaugaauguguacucuuuguaaggacuuaaagaagaucuccauuuucagugcuaaagaacuuuuaguguuuugguuggaaaaaguagcuauagaaauaggacuggcacgaugacucaucaagaaaaggcuuuuguugccaagccugaggacuugaguuuugaucccuuuaacaacuaacucucucucucucucucacacacacacacacacacacacacacacacagacacacaauacauaugccuuguguuugaaaauuagaucuagucacaauugcuuggagaaaguuuuaugcaguuacuauguuguuugcuaaaaaauuugauauguucccuguaacaaaauuauaguaagagauuacagaucauguucauaugucugucagagaauaaagcugaagcaauagguacuuuuuuuuguuuguuuguugugaauagggucuuacucuagucccagguggcugcuaguugaucuuucugcuucagcuucagagugagccaucaugcuguguaauuuuaaguuucugguuuucuuuucauggaauagguuuucugaagauucucuuacaaaaggcaacauugacucucuucuucacaugguuguuaaaaacugguucagagguaaauuucugugacuugaauagaaugaugggguuucauacuuaaguuuuauuaguuggcaggacguaggguuaauuuuuuucucacuuagaucaugcaacauuuaguuuuguuuauauauuaccaauauucugcauauuugaaaggauuucugcucgguuuugcuuugaaacucauuggugauacuuagaguucuuugaaauugauguuaaugauugauaauacugugcauuauuaauaucuuuaaaaugugguauccagagagcuaauuuaugguaaaaagcuacccacuacauuguccaagaauugaagugaugguugggcuguuuacagcauaccuguaauuauuugcagacuauuuaauuaauggcauuuauuuaaugaaugcauaguugacagucauuuauucauacugaaucuugguauauaauugcauaagcuuucuauauugguuuguaaguuaugacaguaauauuugaauucacaucaagcucagcuggucaguguaggaaauaggaaguguaggaagguaauguagguaucauuuugguuaaacuugaaagcuccuuaagugggauaggauuagcauaaggauaacuggccuucgaauaucaguggcagaagcaaagugucagguacucugaauauuugugauaaaggucaguuuaaaaaggauaggaauucuuucuuggagauauuauuucucaguuuagauagcaacaaguugccuuuuaauuuuguuuaggaaaauaaucuaaaaaucaaguuuuagcuuuuucagaucuuuaaagggugauuuauaccuugugaucuuuguaguaauacauacuuuucuauggguucuuaaaugaguuugccugccagcuuaaagauccuugacaguuuuagcagguuucucacagaauaguuuaauuacuauuuuggaaugcagaacauaacuuuguacuuuauagaguuccuuucugucguguacaaaaauuucuuagauuuauuuacuuuauggaugaguacuuugccugcauuuguguacuauguauguuccuggucuuauuagaggucagaauaggacauugaauccccugggacuggaguuacagaugguugugagcugccaugugggugcuggaaauugaacuuagguccuuuggaagaguaacacauacuuuugaucacugagccaacacuuaagcucuucucacuaugaaaaaaauuauugauuuuuuuuuuuuagguuuaaauuuuuauuuuaugugugugaguauauauguguacacagauguguuugaggagaucaggagacauugguugacauaugguugugagcuaucaugugggugcuaggaacugaacauggguucucuuuaagagcaacaaguauuauucaugauugaaccaucucuaguaccauauuuuuauuuuuaauuaugugcaugugugucuguauagguuugugcacaugagugcagugccccugaaagacacaagagggugucagaucuccuggaacuggaguuuagguaguugugaauugccugaugggggcauuggaaacuggacagguuucucuguaagagccauaugauagcucuuuuaaucacugagccauuuuuccaggucuuuucuuuauugcauuuuauuacaucuuuuuuuuuuguuuuguuuuguuuuuuucgagacaggcuuucucuguagcucuggcuguccuggaacucacuuuguagaccaggcuggccucaaacucagaaauccaccugccucugccucccaagugcugggauuaaaggcgugcucaccacgcccggccuauuuuauuacauuuuaguaguccaaauaguuggacuauuucugaacuuggugguggucuuuugguggagaaaugguagugaaugaaguauagacauaaggaggugugguauuuugcaguuuagguagcuuugugauagucacugaacuuaagucauuuuccauuuuccucauuagcauguuuuauuuauuuguuguuuuuagcauuuuauacaugcguauuguaaugacaucauuucccccugccucuucucuguucaacuuuucuuuucuucuuucucucucuauuuuauuuauuuauuuauuauuuauuuauuuauuuauuuauuuugguuuuuucgagacaggguuucucuguauagcccuggcuguccuggaacucacucuguagaccaggcuggccucgaacucagaaauccaccugccucugccucccaagugcugggauuaaaggcgcgcgccaccacgccuggcucuguucaacuuuucuuauguucuccuucccaccuuugaguuucauggccagucuuguuuucauguguauccuauuauuuucaggcaagucugcacaauuaguggcaucauuguguguaaugucuuuuuuaaaaaaaaaaacuuuuauuaaacaugauuucuuuuauuauuauuauuauuuuuuaaaugucagagagcauugugccucugcucccaccugucuuugccauaugaaaauugaggauaaauuguuuggaaaaugaguagaaaccagauaaguagcugaauuuauguggauuuguauuuugauauuguggugguauagaauuuuauguguuagaauauuauguaguacaugacagaaauaauuuuucuaagaacuugggucuuaguugcuugaguuuuguucagauaguuuguauacuuagggaaauuauguuuucaguauauagugguuaaaauaaauguuuuagaauuuugguuuucaaauaugauaugagcuaaaaaauuuuuuugcuucagugauuugugaaccauuuguuguauuguugggaggaucuguaucaguuuuggagacaaccaauuacuucuggcuuuuuuuuucucuauaguguaucuucagaagaaaacagucugagaauauaauacuuuaaauacaauaauaacaauauuuaguguuaugaucuuucaaauggugcuacaauuuuugaccucucgaacauuuauuauggauaguuuaaacuguguacaagacagaaauugaaugaacuauugaaucaggaaacauggcauaaguaguaguugguuuuuaugggaauguuauugaugugguggagcacuagguauuaaguacuaauuuauaaauagucaucuguugauuuucagguagaaauaugcuuugucaucuaccagaucugugauccuuaggcaagcaucuuuuggggacuauuuuucauuuguaaaauggagugguaguagauuuccuccaggcuuuaggguuuuguguuauagagggaaaauaguguuuucaugucauggaagguacucaguacaagauagauguuauauggaaagacaauuaaauuuaaacuaagaccuugauucaucuacgagauagaagagagguggagguagguuugaaagcucuugaaaagauuuuuaauuuuagaguuuuuguuuacuuuucccugcuucaaauauguuuucucuacauggaagcucugggauaggucuuaauccugguuccaacuuguauguauacuugacugucuaucugacguguguuuugaggacauaucuuuuaacuuuuuuuguaauugucacacgccacaaaccugucaucccagaaaccguggaauauucaucagcaccucuucuuuuaacaucuuaaguccugcaggguggugguggcacaccuuugaucccagcacucgggaggcagagaggcagguggauuucugaguuccaggccagccugguguacaaagugagugccaggacagccagggcuauacagagaaacccugucuugaaccaacgaaaacaaaaaaaacaaacaaagaacaaaacaagcaaacaaaaaacauauuaaguccuaacaauuaccagagcuugucacuucuauauuuuagaucucaaaucuaccuauacuuggcuucugcuaccaugcuauuuguagccacuauucugucuuugauauucagguuucuucaugcacuuuuuugaauacauauauuuggacauaguucaacacugaaaaguuacaaaaaagauauuaguuaaaaaaaaucuuuuucuaaguuaucucucaaaauauagguaacuguuucccaaggcagcugcuaaaagguuugcuacauaaucuuucauaauauuucaguacaaacacaagcauaauuguugagcauaauuauguuguacuuucuuccuguauauuugagaucauaguguauauguuuuguauugaauugucuuggguuuuagaguugucuagucuuucacauagugagaugcucaugggaggauugaguuggugauuuuuguuauuuugauuuuugagauucuuuuauguccuuuuauaugugauucugaauguagaaaugcuucagcauguacgguuccuaacugaaaauaucuucauauacuuucuuaagcuaacaauugcuuaacaugcgcuaugaauucucaauuggaauaacugcugacuuuugccuuuauauuuugauuuuauuggcauaacugaugaccaggugucaugaauauuaauuugauucauuucuuguggauguacaaaggagccauaguugaugcuacuuuacacuugacauucaucuucauauuuuauucuuuauuauagaaaagagaaaauaacuugucaaaaaaggcacaguucuuacuguguuacuuauuucacagaaagauaccuuuauuuucaucauaaauuagcaauagggcuagaagguugguauuuugcuuuuucaaacuuauuaaaccuuugaugguuaguauaguagcugcauauguuuuacauauggcuucagaaaaugucaggaucucugcuuaucuuagcgaaccuauuccuuaaaacauuuaauagacuuugguauauaauuuggauacuccuguuguuaaucccaccaguucagaauaggaccacuaccauaaucuuugagccaaauuugaagcacaccuuaauuaaauacuagccagcaggauggacucuggccagguccauuccuggguucuuagaaaauggcuaggaguaacaucuugcagaggcuuuuuuucacaaggcugcuuucccaucagguccaaucaagagcaaacauauauccuuaagcacauuuuguuuguuuguuuguuuguuuguuuuucgagauaggguuacucuguauagcccuggcuguccuggaacucacucuguagaccaggcuguccucgaacucagaaauccacccgccucugccucccgagugcugggauuaaaggcgugcgccaccacgcccggccuuaagcacauucugaagugaaguguaccccacccccugccaugcccacacccaaucugggacaaggauauaugcuaacauauuucuugccuacauacuuuucaccuacaugugaucaagcacauuugguguaguuggguaaaacaaucuuguuuaggggaaugaaaacauguggcuuguuauuucucauacaugauagccucuaacauuucaggaaguaucuguccuuggacaaggggcuuauagauuagaggcauuaacuuaaaacuuaacuuuggcucucucacuaugguacacuguuucauaagaacaguggguuugaaagcugaucucaauuuuaggauuuauugcauccuuuccuuauagggccccuaguuuucaucugcuagaagaaacaacaacaaaguguguguuguuuugaagacaugguauacccagauaguccaggcuggccuugaacuugcuguccuacugccucugccuuccaagggcugggauuaauaggacuuugccaugguagccagccaauuguaccaucuguuaacaggaagagcugggaauuaggaauuuccaaagugauuauaacaacauuauugcugacuuguucauuuauagaguugaugcacuucuuuaagauuuugacuuagaauuagugcacgauuaaauuugguucuagauuguaauuuucuuugaauuuuagcuucaaguuucugagacuagaaguugaauucccauaaugaaaccuagaguuguaugguguuguugaucuaguccuuaacuguuuaguuagucuuggauuauucgaaaauucauuuaauuuauuaacuuccucaaaauguuucuuuguauuuuagggccuaucugauauuuaauucuccauauuaaugaauucuguuuuguguacacacaugguucucuggacaauagaggagaacauugggaaauugguuuucuccugccuuguugaggcaagguuucucuuguuuuuccugcuaugcuauguguguguacuccaggcuaacuggccuaggagcuucugggcuagucuccugauuuucucacacuucacuuuaagaauguugggauuacagaugcaaccuuuaucuggcuuuuuauguggguucuggggacaaacuuaguuuauuaaguuugcaugucuauuaccuuucacuuguugagccaucuucuggaauggcccaaggccacaugauuucugagaugugaaugucacauuuaaauauauguaccugguuaauuugagacaaggucucauauggcccugguuauguggauuaggcuagcuuugaauuugaaacgauucugauucuccugucucugccucucaaaugcuaggauugcaggcauuuuccacuauucuguuuauucacuugcuuccuuucuuuucuuuccccuuuucugauuuaauuuuauuaaaugugugucugaauauggguauguauacaugaaugcagaugucugaggaggccagaagagggucccagaucucccaggaucuggaguuaaaggccaccugacaugggugcuggggaccaagcucugguucucuggaagguuuaguacacucuuaacuccugagccuucucuccagaguuccuuuccuuuccccuucccccucccucucgucuuucuuuauucuauguacaggcuguugggaacuugugucaugccgauuuucuugccccagcuguuauacugguauuaaaguuguaugccaccauacuuggcaacaucugucauauuauuuuuuaucuguauuuuuuuuugugugugaaauauuuauucgacuauuuuucccccuguucuuaguugaauuguuuccucuuuacucuggcuuugagucaaaaaaggugucuuggaaaugcuggagauaaaauguagagauugguauguacugggcaaauaugcuaucacuggcugagccaauacccuuggccugaggguucuuuauauauuuugauuguuaaaacuauuucugcugcacuauaagcuuuuacuuugaauguuuucguagguuuuuguuuguuuguuuuacagaguaggaguuaccgauuuucagcugggcauugguggcacauuccuuuaauuccagaggcaggcagaucaaggucagcuugguuuacaaaguaaauuucuggacuacacagagaaaccggccgucucuaacccccccccccccccagccuucccaacaccccugcaaaacaauaauaacaaaacuaacaaaauaccauuuuuccuaggcauacugaauuuuuaaaaauugcucaucaguugcaguguguauguacauggcauaaugugguuagagaacaacuggugggaauuggcuuucuccuuccauccuguggaaucuggacuagaaccucaggucuuguccuuagguuucccuauauaguccauugaccugcugaacuaucacuggcucuauuucaggaaucuuuaagaacauuuuuauauagguccugaagacuuuuuaagaaaugcuuuucauucuuuaaacuuuuacuugaguguauguugaaaccucaugcuauucuaccuacaccccauucccaaauaacaacccugaggcuuauuauugaauaacguguguaagccuuaugauagguuguuuguucccugacuagcuccuaacucaauuauccuauuuauauuauucuuugccuaccacauggcugguuaccucuccuuaguuucauacauguuugacuuucuccauaucuggauagcaaauuucgcucccucuaacucccaaaguuccaaacucuuaucuacuggaacucccaccuauuuccugccucaguagguaaagguccuuacuuaccaagccuaaugacccaaguuagaugcccaagguccacaugguugaaggaaagaaacaacucuuuaaacuugucuuaugaucuucauacauguaacccaaggcacacugugcacucucuaaaugcacuaaacauuauuaaaaaucuugauaugaauuuauacacuauaggcauugcuuuguugucuuucauuccccaugucagaggugcuuuuucauuuaauuauguuuccuuugacuuauucuuuauuuguuaaaguuaugccuaaguguuucacuuccuuugaaacaaguauaaauuaugauuguagaucuaaauugaaggucauaauuuacacuuguuccaacuguaaaacugugaugguagaucuaaaguuuuaaaaaaugauauauauguauguaaauauucauauauauuugugugucuguguguuugugugcaugcauguguguguguguguguguguguguguauauauauauauauauauauauauauauauaugccauaguguacguguggaggucaguggacaacuugggagggccagggauugaaaguuuuuuuuuuuuaaauuuuaguagcugagcaucaaaccuaugaccucaugcaugguagguaaaguaucaguaagccauaccccuuggccuugugauguauucaauuuuaaauuauuuguuuuguguuguaugucuuugugugccuacacaugcaggugcauguggaggacagcuugauguuuuaaaucaaucuuuaccucuuuuguuuuuuuuuuuugguggggggcagguucuuuuacugaaacaggcuuauggauuugucuagacugguuggccaguugugcuuguuuuuaugguaacuuugauaauacauuuauucuaaaaaucuuuauuauuauuaaagauccuugugugauauucuaagcagagacucauguuuccucuaaguauuaaaaaaguuuuauuuuuuuucuaaccuuuaugccucuugccucauugcaguggcuagcauuuucagcaaguacuguguuaagauuagagacuuacugaauacagagggagaacauccaguuacugguuauaaaauguaguagauacaaaaaaaagguuccuuaaaauuacacuuuguguaugggcacauguguuggaggucaggagcuuguggguguuguuucccuccuaugucccauguggauccugggguuccaacuaagguuguugucaggcuuggcuacaggcaacuuuucuuucugcugagccuguguuuguuuguuuguuuuaaucagcugguguuagauuuuuuuuuuaaaagugguugcaguuuauccaguugagaaaguuccuguguccacucuacucucucuuacccugcuuuuuagcuggucccuguggaugcuagauuugaaguuagaaauucagcucacugugggugccacuggcacaagggaacgauagaaaccacuuaugggccuacuacucuguuuuagugcugauggauaaggaaguucagcccccuacugggucccauugccacuauuguguccuuguucaguuuuguugauacugaauuggguuucaacuuaagcuccuugcuggugccugacuaccuaggacuuugagguuggggugcauaugaguaauaauaaagcuuuaaagucuccuaucuguuauaucagugguucucaaccuauguguaguggccgcuuuggagggcugaauuacgcauaucagauauuuauauugugauucauaacaauagcaaaauuaaagaguagcaaugaaaauguuaugguugggagucaccacuacaugaggagcuguauuagaggguugcaucauuaggaagauugagaaccgcugugcuagauggugguaguaguggccuaccuugcuucuauauccuacucacgguucuguaaauggguaaauggaagcaccaauuucuuuacaugauuuggauuaucucuucuuucugccuugcuacucacuagccuaggaauugagcaucccugccugucaugacuagaagaucagcuucuuaacuagcucacuuauaguaucuugauaaaggaauuggaguacucuuaucugugacauuaaagaucagugacuuguuguacccugccaauacuacccugcuagggguaccgugggcaagccugcuucugcugagcacuggguauaagucacuugccuauacugucuugguaagaaaaugaaaguaccaucugccucugguuugugguggguugugcaugacaagguuucuguaugucccuauucaaucaaauuuuggguagaggaaagagaaccaacuuuuuguuaagcugccuuuuucucaguacuucggauuuccuugcguuuuguuuuguuuuguuuuguuguuuuugguugaugguacugaauuagggacgugguuuugccaccugaagauaguuucugcaaauguaagacauuuggaauucuggggacucuugugagaguauauaaugcaaaagccccaagagggguguggaggcagcagcugcuugccucuuacagaccuucugauuaugaagaucaaaauugucucaaggaacucaacgccccuaaucaacaggaaguagucuaaugauauugacacccucuguccccuauagccuucuuucucucucuaguguugggggguuggaggaauaagggugaagaagggugguagaaauaggaacccauaaaguagccacaaguccaguuacauggguauuuugccaacauguauauauacuauucaccaugaaugugcuuggugcccaagaaggccagaagagggaacagggguuauaaaugguuguaagccccaaguggguuucugggaaugaaaccagauuccucuacaacaguagcuaguguuaaccaucucaccagcuuuuaaaguuuuuugcacacucccccaccccccgggcuuuauguguucguaguguguguuuuauugaaaguagucuuuucugauacaauauauucugauuacagauuuuccuucccuacuacucccaagucucuuccccuccccauauggauccauuccauuucuguuugccauacuaaaagaacagguuucuaagaaacaacaacaaaauguaacaaaauaaaauacaguaagauaaaacaaaacccaucacaucaaaguuguucaaggcaaaccaacagaaggaaaagagcccaaaagaagacacaagaaucagagacccacuuguuuacuggcucaagaguucuauagaaauacuaaacugaaagcuauaagauauaugcagagcaucuggggcaggcucaugcugggucugugcuugcugcuuuagccugugagaucacaagagcuuuacucauguuaauuaaagggccaugauuuguugguguccuccauccccucuguaauuuuuaaaaaauggguuguaacagggaagagcauaaaaaaguuuaauacugucugaaaacuuuacaacauaauacaaaauaaaguguuaaaacaauucacauucagaggccucagugaacucaagguagauuaaacuaaaauugcugccuauuaauauacauuaauaguaaaaacugucaaaagagagaaucuuuaaaagaauaacaacaaaauagaaauuccuuacauacaggauucuuaauacaaaacaaaacuugauuccuuuaucagacaccauggaggccagaacauggaggccaggaugacacuguugagaggaaaagauggcuagccaagaaguccauuaucuaugugcuuggauuuucagaacucauaucucaauuuccccuucuucacucucuuuacucuaguacucuaguuuugggccuguacugugauuuuuaucgacuugaaacuugugucauuaagcuucuaucucagaccauuuuguucucuuaucuuguagacuaagaacccacaaaaggaaacacuggcucucugauaacaguaucacuuuucaguccuuuagccccuuuuagauuuaucacuguaucucauauugucaguacugguauuuguuuuuuguuccucccuucuucagacauuugcaugcaaugccucuucccuacucagccucccuauuacucucucuguaauauguuuuuguguuaagucagcacuuagauuauggcuauauaaguaaguguggucaaaaugagauuuccuuuuuauuuauaaguuuuguuuuugaggcauaaauuaacuuuuuuuguuacugucaauuuucccuuuaauuuuguagccacuuccagguuccuagcuuuugguuuauuuguaagcaacgaugagaguacuuccuacucauuuuuuuuaaucuacuucugauuguugcucuauuugcccugaagcauuuuuaucuccuggagguggauuuguacauguuaugguuaagaauauaauacuauauccuggacuggagagguagcucuguauuuaagaguuuguauuacucuucuagaaguaccuggauuugguuaccaguuccuaccucaggugguuuacaacaaacagccuauaacuuuagcuccaggauucugaugccuuuggccucugcgaguaacccauccccccgccccccaacacacacauacacaugauaagaaguaaaauaaucuuaacaaaaagccauauccuuacuaaaaccuuaaaauuuuaucaguccucauuguuggaccuccacaagcucuuauccucauuuuauaaagauuuauuuuuauuuuuguauaugaauguuugccugcauggaucuauauguguaccauguguaugucuggugcuucugaagucugaagagagccuuggauuccuuggaacuggaguuacagauuguagugugcuguccuagaaacugaagcuauccucuguaaaauguucuaaauuccucugccagccuucucuuugucuuuuaaauaagucuuuuaaacaccuuuuaaugccauuguuuccucauuuguaaaacaggaugguugucacccauggauuugaaugccuauaaaaugcacuauguuuagcaguuagcaaguauuguaauacugguuaugauaagggacuugcuaaauuacaguaaauguuagaaugauaucuggucugggcaguugugugugucucagguaggauuuuguuaaaagagucaaggaaaaccauuauauaaggaaggagugggucuuaagagaauugauaccuggaggaauagguggaaaagaguagguaguuauuucuucugaugauuguggguucuauguauauuuucuuucuccuuucauaucuucccuggcccuaucaucagacuuagcugcuuagacugucaaagcugguuaagugauuuacuuguagaaaauaaguagaguuuaauguuuucucuguaauaacauuucuguuacuuguaucuaguauguuuucucuugugauuggauggucacugguguaagcaaagcuuaacaaacaaacccuggguauuuuugugagaguauauuaaaguaaggacaugcuauagaccaaacagucacccaacaccuuacauuaucuuguguuaauuaaaaauuauaaauuucauuuauuugugcacaugcccaugaaugugccauaggacaugugaaagaccagaaucuauuauggggucccaggaauugaacucaggcuucagacuugauggcaacugccuuuauccacuggcuggcuuuugcacuaauuuuucuuagcaguaaaucuaguuaaugaugucuauuugcucuacuaugcuuuauauuaucaaaaacauguauagcugccaagauuucccacaguauugacaucuauucaauauugacaccugugauuucuucuuagucgcugaggcugagucacuuuuuuuuugggggggggguuggcuuagagugagaauucuuuugagugguagugauaagauuuguauauuaaaaaguguuuguuuaccauuaccugucuuacauugcugcccauagauuuugguccuauuuauacuuaaauaaggaaaggacagaaaauguaguuuuggaaaauaauagacuguaucuuaaaaugauaugcuuuuuuuuuucuacacuaggcauugacacuucaguucugagaccuaaccuaauuuauugcuugcauccaucacucugcuauuauacagaauuaucugucuuuaauuuguauucucauugcuuugaaugauaagaaaugucuguuuucaccaaaauaugcuuuaauugugggagaaaaguaauguuaaucaguuuaauuuuuguuguccccaaaccuccaaaaaacuguauacuuagaguucacugugaacuaggcagcuaagauaagacauggccaacucaggauaaguucacaugauaaucuuuugauuuucuaaaugguaugaacaguguuagaagaucggcaucccaaagauaaccaaccaccauuccaacuguagagucuggacaaagcaaacuugauucuuaaucaagagugacaguuaggaaguggaggaagaaaggaaaagucacugcuccaagcuaccaaauuccuagaauugagcuuugggccuuuguguaaacaaagauuuuacugaaugaagaagauugcaagucuuucaagguggaguagacaaaauuauuuuacuugucuucaacacaaguuuauauuauuaauugcuauuucuuacaaaaguuauaugcauuuaguagaaccuguccauugaauuuagaucaucuccaggccuagcuguaagguguuuucuuaugauacuaggccacagcagugagcuacagguccuagucagccaugggacaacccaugcucaaagguguacugugcugccaagcuaagauuguggccgguaaaguuuaagaagugcuucucucuuuuuuaaaugacaaggcuuuucaguguuuucuguagucaucuggaacucuugugcuuaagugaucuacccaucucagcuuucaaaaguagcuaagacauauacuaccacauugguuccagugcauuuuuuuggaacuaaggaauuucagguuuaacauggauguauuuggaagagaaaauguauuagagcagugucuguauucuuguguggugaggaauauuugcaucuuuauuacuauacccucacaaauguuguauaugacaagguacucuuauguugaacaugggcauuaagugauaacugaagggaagaaaugagagauaaaguacuggugucuaauuacuuacuaguuuuuguuuuuaaaguuaauguguauggguguugugcuugcauguaugucguccaccacguugugugccugguucccagugccuaugaaggccaaaagagguaguugaguuuacugggacuagaguuagagccucuugugagaugccauauggguucuggguccucucugagaaaacugguccuuuuagcccaggcuuaccaaucuuuacuuucuuuuuaaguuaaaaaauuuaucuuuuagccgcucauuauguuaaaauaaagaauaacaaaguuauuauuuacuucuuguaguaagcugggcagauugccauguggaaggccaaaaaagguagaaaaagaauauuuacuuuuucuuuuuuugacuuuauuggauauuuuauuuacauuucaaauguuaucgaguauguauuucuuuuuuugguuuuuuucgagacaggguuucucuguauagcccuggcuguccuggaacucacuuuguagaccaggcuggccuugaacucagaaauccaccugccucugccuccggagugcugggauuaaaggcgugugccaccacaaccggagggaguauguacuucuuaauaggcauuauuuucuuuuuuucuccuuaauuccucuggauccuuaggguguggaauggugucuuucauauucaggguaggucuuuuuccuuuggaaaguccucacagacagauccaggugcaccacaugggucuccugggguggaaauucuaaauccugucauguugacaaugaaaauugaccaucacaaaaaggaaaaugaauuuuuuuucuucauaauauguuucuacuuuaccuaaauuuaaucuggugccaauuguacuucuauuuuggauucuuugcuggguugcuauuuuugugaggauaaugccugucuuguuuacucuugaaugcauacuuaacauagugcuagggucuacuacauaacagguaccccguauguaguuguuauauuauugguaacuuguauuggaaaagcauuuuauuucccaguuaaaguccuauacauaucgugaucauuuucaugauauucaaauuauguaagugucccugucuuccaucauacacauacuuugagggagcauguuuccuuuuuauauuuccucauuuuauccaaaugucuuuugucuguguaauaaauguacaacuuggauuaaauguuuuuaaaaauaauggcaagauuguuauuuuucugaagugaacuguguauauuauuuuguauuuucggccagaaaguaugaugguggugugggucaguuuuauucaucucauuccugaucaugugagauagguagagugcacaauauuuuauuucaugcaugaggaaacucacuauuaggauuuuaucgccauaauuaacaucucacaguuaucagauuauaaagcugggacuuguuacuagacuuaggaucacaguuuguacaugaacaggccagguucugucacccauacuuaucucaugaguaagccauucaaaagagccaaauaaauaaugaaaaauagaaaaagcuuuauuuaauguggccucuucuugggaagagggacacaagaccaagugggaucccucucaccuacagguccauccaucuucuagggcaguuguucuuagucuuccucauauugugacccuuuaauacaguuucucauguugcggugaccccccuccccccaaccacaaaauuaucuucauugcuacuuuauaauuguaaguuugcuacuguuaagaauuugaugugaauaucugguauacaugauaucuguuaugugaccccccaaaggagucucaacccauagguugagaaccacuguauaguuuaaauagaagucaugucuuguauaguuuaaauagaaggcaugaaauauacauaagcaaucaauaugaucaucaccuucuaaguucugguaccucauccaaguucuaaguuuuuuccccaacuuuccacucuggcugccuuuaaugggggaauucuaaauucuugagauccauuuuuuuuguuuugauuuuguuuuuguuuuuagacaggauuuccccauguagcccuggcuacccuggaacucucuauagaccaggcugaccuugaauucagagaucuaacugcuucuggcuucugagugcuggggugugccaccaccaccuggcuacaggacccuucaacacaggcuuguuuguagaggaauuuuaauccagcaacauggcugcucugacaagugaucauauccaaagaccuucuaggucuacaugauccaucuggaauguaaacacauccuggauuacaauauggucuggcuggaauacagaccugcccuuaguguguaccuuuauucccuaacaaugaugguaagguuaguuuguagaaggaagcagccauguuugaaagggaugucuaauugaauugcaaauuagucagagaaagauuugacagaauaagucagagauaggauacacccuacucacaaaacuacauauagcacaugaaagauaggguacuuaaaccaggaagaggggguauguguuuauggcaguugagguagaacaguguuacagagacagguuauagagagaacaaacuagacacaagugaaggcaaaaugagccagagaaggagccagaggauuaaagcauauugccaaaguuaguauuuggccaagcagagcaauuaagucagaagcugagaaaagcuggauucaaucagucagcuagaagcuucaggucuuggccuagggauacuuagaauagagaagaaaauacucugggcucaguucaaaccauggguauggcucucaucgcauccuuucagcuaggaaauaaaagugacguuugcauuuacacguauuaguacuucaaguuugauuuuuaauuggaguuuuaaaagcuuuauuuggugcuaguaagauagcuuaguggguaaaaguguuucaccuuuaauuucugaguuuccauucuccaccugguagaaggaaagaacugacacaaguuguccgcugacuccuucccaacacgaacaugcacacacacaaagucaauuaaaaaaaagguucuuaguguuaauuccauagaugugaggagaauagaccaccuacccaaaucauggcuaaacaaaccuuuucuuuuucuucucccucuccccuucuucuucucuuccuccuauuccuccuccuucucccuuucuccuuacccuuuuuuucuccuccucccccuccuucuccuccuucucuucuuguuccuccacccucugcuccucuuccucuuucuccucuuccucuacccucuccuccuucugcuugauaugggaaagauaaggauuuuuacaguucaauaguaggggguuuucagaugggggauuugggaggcaaauaggcaggguuauagaaguagaacacaagcauaacuguuuuaaacaauuaaggcaugguugcaaggugauaacaaccuucuaaaacaaaggcacaguugcuguuuccuggaacaagcaguacagaaccauuuguaguuuaaguuacaggugggcauaguguaauucuugagaaacaaagauuuaaucauaagcaggaaugaacuuaguuugucuuuaagaugguuuucaagaguaagauggaggcaggcugguuuagcaaaaggaacacuuuuuuuuuuuuuuuuaaguaaguguuguguuuguuuggacagaucacacaguuccacgggagagacuuauuguaggguaaaaaggacaaaagggggcgaagaaaaugaagaagugaagagaggggguggggucuggcuuuuauaugggcugugauguaacugcaugcacaacuggugcagguaaagguggggagauggaccagguaaacauuccaaucagucuccucuguggacagcggcuucucuguggacagcgacugguaguccuguaacaggaacugauuaauacuuugcuuagaaauuuuuuguauuuguuguugaaggaauguagaaacaagauuaaugaggcagggagcaaaugauaacgucaggaaaaugauuaggaaaggcaucacgaaagggaguauccacuucuauauauguuuuuuggaaaucuaguaggaauuggagguggaggccucagguucccugaaacucugcgugucugauuguaguuccuggauuuucuuacuaucccagauugguugacguagaaacagcaugugauaaaauaucuugacaaaagcaauuuaagaaaggaaggguuuguuuuugcucauuguuggagucuauuaugguggggaagugaaagcagcaggaacuugagucaguuguucauuuugcaucuagucaggaagagaaagcaguaaaugcuuaugcuuaggcucacauucuuccuuuuauacagccuaggaucucagcucagagaauggugccacccacauugggcaggucuugccaccccaguuagcuucauucccccaggcaugccuagauaucaaacugacaguugagagauuuaccagcacagucuuuggcuacauagucaguuugaggucagccugagcuccucuuuuucccucccuaaagagcauuuuuuuuuuuuuuaaucuaccuguuacuggauuaaugaaauaguuuuucuuguuaccuuauuuuagcugcccauguucugauuaauuauuucagaguuuuugcaucuucacuccacaugcuucacuucuucauaaagacaauugcaguucauuuuaauucuauauuggucucauaaagcguugguacuauaguuuguguuuaaguguuaauuaagaaauugugaguguugguaugugcauuugggugguccaaaggggauauuggguccccuggagcugcaguuagagcugguggugaucugggaguuggugcugggaacugggcuuuggucuucagcaauagcauuuauguuuuuaaccacugagcugucuuccuggcuaccuaguuaacuuuuaaggaauuucaguuaauguauaaguauaauauuuacauauuuacuauauuuccuuuguuucuuuauuguguagaucucaauuuccaucuuguauuaucuucugucugccugaaggacuuuuguuucuggugaaguuuucuuaguagguagugauuuuuuucugcuuuugugguaaaacuuuauuuuucuuucuuaaaagguuuuugcuugguauacaguuauugauuguuaugcccaaguugcagggacaccaaagaccaccgaggagccaauuccgaugcaaacauguagucuuuauuaagagcucgggagcaagguuucucaaagucccagcaagucagagugagaacaccaaguguaggggcgcaggguauuuauugugguuacaguaagcuuggggaauuuccauacgggucagcaaguuaauauuuuaaaaacugcauuucuggcauaaucuguaggaacugaacauaggggcaaaaccaccugaccaccaggaugucuaaguuaucuauucucugcaggauaucagguuaucucuugauccugcuauuguagccuagcuauugcugaggggugggagguguugucauaggauguuugcucuggugaaguuugugauuuuauuccugaaauugggguuuagccucuggucucacacaaaauggaguuuuugguuuuuuguuuuguuuuguuuuguuuuuuuguuuuaaauacagaguugguugggccuuacagacucuauggagguguuauuccagguuuagugcuuuacuguuuuuauaagugaaauuugcuuuucuucccaccuauaaaguaagaugucuuugucuagucuacuucugaggucauuucuaguguuugcuaggucuauuuuaucccaggguuauguuaugacuuguagguuuuuguuuuucagaauauauuuuuaauauuucuuaauugauaucuguuuuuccuuugucuauaacuuuucaucuaauuugaaauaucugcuuuugugucuucagaaaaauuuuccuuacaucuugcauucuaaucacaauggcuguguguguuguguaugugucaugcaugcaugugaguguaaaaguaugucuaucugcucucagaguuggauuucaggugucuuccaguauuccugucugugaggucacaaggucuuuuauugaacuggaagcuugacaauucugucaggaucuacuugucucuacuccucaauauuaggugcugcagucaugccuggcuuuuagauggauacugacugcucaucaugcuugugcuuuuauucaauuaacaaucucucuagccccuucuuaccauccccccacaccacuguucuauuuaaaagauguuuuuccuugcuguaucucauuuuguauucaugugcuuucaaguuuacugacuuuguucuuuaguaauuuucaguuaugucucaaagaaccaaaauggaacauguggucuuuccuuaacauguuuauguuuuacucuaguuuuucaaccuuauauuucauugauauuuauauaauuuugauuuucuguugacugugauuguaguuucuugcaugccuggucacuuaggauagugugaauuuucccuuuguagcuucuggauauguuuuuguuuuguacaaugucagacaaaacaaugcagcccuuagucuuauuucaauacauagggcaauauucuuuugaaaaugucuuugggaugcuacuuaauaggcccccguccccuaccucccauccccccuuacauacuuguagcaacuaccauuugucacuauuuaagucacaugcauuuuuuccccauuguguuucagauguuccuaaggccauucccuucccuaacccagcgcauacccauuguuaacucuuuuaguaguuuaaggucaaauauauacagauacccugaauacucuuguuuguuaucagucucauccuacuaucugcuuucuauacucagcucuuggccuauccacauuucuagcucccuuuucagccagguaaguuacauuuugacugcauuccucuauuuuuacuguuggaagcuucuagugugagugcauuccuuuacuguccuuaaguagccacuaaauuggcuuugcaucaguuuagauaaguuugcauuuucuaaaguucuaauuuaguggaaucauguaguauauauuaauuugucauguuucuuucucaucauaaccuucugacucauuuuguccuguguaucaauguguacucaccuuuauuucugagaaguucuugagcauaugaauauaucacaguuugcauacacauugucuuuuagcuuguggguuguuuuuauguuuaaagauucuaugaacauacuuugauagucuuuauaugggcauauaguugcuuuucuuuucuuugggugaauacuaaugaguagaauuaauagauuauauauaguaaacuggaaaaagccuuucaaggugggugcauuucuaccagcaguauaugagugcuccaguacuuccauauucuucugaaugauuggaauagauacucuuaauuuuaaacauuuuaauauaugcauaguagcaugccaucuuuaugcuguucacauuuuucaguucacauuucucuaaugauaacaaguguguuaucuuuucuuugguugguaccaguucacauauuugcucuauuuuacuugcaaaauacuguuuuguuuuuuguuuuuuguuuuucucuaaaaugggcucucaauuuguagcccugucuacauagaccuggcaggcaucaagcucacagagaucugccuuccuccaaauuggguuuucacauuauuuuguuuugagagcucuuuccauaguuuguauauaaaacuguaucagauugugauaaaacuguaucagauacauguuuugcaaagauuuucuucaguuugugaugcuucucuucauuuucgaacaauaguuucugaaaaguaggaaaaauguaguuuuuauaaaguuucauauaucacuuuguucuuccauacuguuaugauuuagucuuuuagcaguauuaauuucuguuuggacucccucucuccuucccuuuuuauguuaaaauuugugugugcuuacacacaugugcauaugagucaugcacaaccacccugugaaggucagaguacaaccugaaaaaaaaagagucaguuuuccucuuuaaguuuguguguccuggggauuaaacuuagccugucagacuugguggcaguaucuacaccacuaccugcagagacaucuugccagcucuauguucagguuucuguuuucauaaguuugaaauuucauuucuaagaucaaagcagauuagaaguacuuacaagugaaauagguaguagaguuuucuacauaaacucaaggcuuuacuguaugucuugggguuucuauugcuggcuaaaacacugaccuaaaacaguguggggagaaaagaguuuaagaagcuuauaaaacaucauccagggaaaucagagcagcaggaacucaagccaggaaccuggaggcaagaauugguucagaggcuaugcagaacugcugcuuacuggauugcugcucauggcuuguucagucugauuuuuuauaacaucuaagaccaccuacuugcacagugaccgggacacaucaguuaucaauaaagaaaauguccuauaggccauugugggauggggacaggguuuucucaauugaaguugcuuuuugauuuuuagcuugggucaaguuggcauaaaacuagccagcacaccauacgaacucuguuuaugcauuuaauaggaacucuggcauuuuauucauucaauaaaucuucaguuauuuucugaaaaugguucauuuuaauucaagagauacucugaaggaaugcagcuuuuacagaacaucuuauaucuuaaauuuuacucuuuuuugaauuauguaaaguggcuuucaacaguaugaaauuaagugaguuauuguuguaaaagaacauuauugucccacaaagaaacacaugaaaugaaaguaaccugguaaggcaguuucauuuuguagaagggugugccaugauucaagcugaguuagcaagaauaccaagcaggaaauucaauagguuuuuuuuuuuuuuuuauccuaaugcuggaauagcgugccuuuccuccuuagcugcccucacagccuuuuguuguuagcuagguuucccccccucuaacccagacuauuuuuuucuguguauccauaccuguccuagaacucccaucuguaaaccagacuggcuuugaacucagagaucugcccgcuucugcugggauuaagagugugcagcaccucucagccucuggaggagggcccuaaaacaaggaauuaauaauugcuucuguguuaguuaauguuuuauugcugugaagagaaaccaugaccacaacaauucuuacaaaggaaaacauuuaauuggggcuggcucauagugucagagauuuaguucauuaucaucauuguggaaagcauggcagcaugcaggcagacauggugauggagaaggagcugauccaaaggcagcugaaagagacuauuucacacugcauguagcuugaccccacagugacacgcuucuuucauuaaaguuaugccuacuccaacaaggcuacaccuccuaauagugucacauccuaugggccaagcauuuaaacacaugagucuauagaggccauuccuauuuaaaccaccagagcaucuauuccccuuaggaaggcuuaaggggaaccugccuccuuaaguauaauagguuggagcagacuguugccugcccagcuggaauuuaaguaauauuuccaguuguaugauggccagguguacggaggaaaggaagcuccugauuggugcuuggaaagagaugugagggagaaauaaagacaagaguuauuaccauugcaagugcuaugagaagccagaacugaggauaauuuuuaaauuucuaaguuaaaguccauaagaaucuacugauggacugacauuagcaucuguuuauuuuggcucuuuguuuugccuuuggcugccaaggcugaucucuagaguaaugaaccugugaacugcuuuuaugaauuuugguagcugucaggagugucuagaauaaguauuaggucacuuccagaugacuucuagauagggagagaauauaaauuuagccaucauuuaaguuuuagguuaaaguagugauggaggggucucucuuggcuguagguugguguucuagugagcuaguaucuaacuuauaucugggcaccauuuuaaaaaaaaaucaagaaacaaaauuagaaaugacucagugauuaagagcacuugcugcucuucuagaagacccagguuuacuuuacagcacucaaaugguagcucauaauuggcuggaacuucagucccaggggcagcaggcaugcaggcacccacacauauaaaauaauaauacuaaaauuagagcuggaauaagcaagcuuccaaaaccugcacuauuuuguuauguguccccuauugaaauuauaguugucucugccuaaugccuacauguaaaagguucccuuuguuuuuguuuuuuucuugucaugcuagguguauuuaaacccuugugccuauacaagcaguauugcuuuguacuucaggauuaccuugaacucauuuauguaguccaagcuaacuuugaaccucccauucucuuuacauuacucugucuugccauccugaguguugggauuuuaagugugaaccucuaugccuaacuuuugugcccauuguugugaguuaagcuucccucuagcccacuuauuuauuaauucacuuaucuuuauuuuacaccccccccccccccguuuugcacccacuuugugccuagugcuugcaaaugucagaagagggcaguagauuggacuagaaguugcggaugauuaugagccaccauguggguacugugaaccaaacccaggucuucuugaagaacagaaaucacucuuaagcacugaaccgucucugcagcuuaaacaggauuuccuuguauauauauuuuggaauuucaaauuaaauucagcuaacuaaaagaacaugagaaaaaagcuuucuuugaguaucuuugucuaccuucagguauuaaucuuuuuuuguuguuguugcuaaaacaaaguauucaauguugaguacuuaaaagaaaaguuuauugauauuaaaaggugucuacuguggugaagaucucaugguggauaaucgaguucuugcaguguuucuucuuuucuuccuuuuaccauuuuuuucccauaaagcuaaugguuacuuuauugagaucuucuucucguuuuuucuuucugcagagaagaucucuuuuucuaacuuuccuucacuuggcuugcuuguuuauuaccuguguggggcgugggcagggcaugcuugugccucagcucugugugcucagagaacaacuugggguaaccaucaguucuuaauuucaaccauguuggucccaaggguugaucuuagguugccagauugcucuguuuuuuugaggcuggccccaaagucuuagguagcggaguaugaauuuaaacuccuagucuuccucaggaguggugagaccauagacaugagcuauagcauauugugugugugucugugugugucuguguguguguaucaucugcuaguagaaucuaaagauuaagaaacauuaggcaaaguauccuaccaucugagcuauauccccauccucugucuauggcaucaucuugaauaccugguugguuaauaucaacaaggcaguaaguaucucagguggcucuuuguuugauuuugcuguuuguuuugguuugguuuugacacagcuucacccuguagucuagaccauucuggaauuuacaauauuccuuguccuaucuccuaaguguugggauuauaggugugagccaccaugcccugucugucccccuacuuaccuuuuaaaagaauucucagaaacugucaggcuacauugaaugaaacucuauuguaggaacaucauuaccaccuguuugacuuuuucucuacucucagcuauaguccaagaggacugaagucucugcuauguaguugauuccagccagagaaguaacacaaggguagaagcagagcccaucuuuucuucccauuuuauuaggcagcaguuuaucaggccacacuuugagguuuugcagccaugucuuuauguaaacaugggucuaaugaaauugaguucuaauuguaaaagaagagaugauaucugggauacuuaaaauuugaagcaauuuacaaaacaguguugauauaaauguguaaggugggaaagguauguucuuacauuugcaaaauaacuugaauauggcauuuaaaacgucuguugcuucuguauaaaacaauuaacuagcaugcugacgucaggagggggaaagaaauuugaggauauuuuuccuuuugaauuagugauguguaaaauagugaaggaaauuaaaaauaaaggcuugagauugugauggauaacuucuagaaaaaaugucauuaagaaucaauacuugaagauuaucaauuuaauuguauuuucucaaguuucaagaacaugugacuucccaaauaguuugaauucaguugacuuuuaccuguaaacuucauaaauacacucaguauuuuauaagcaguuaagcaaaggaaucauugaauaccuggaaagggauaaaauuugcuugauucaugaaguaggaaggauaucaucuuaagugaaagagaccuuuuaaaaaaaaaaaaaacaaacaaauauacaggauaguuuguuuacuuugaguuugcucugcagauucacaaugaauaaauuagaauaaaucagaaaauuaagagaaauucacucauauauguacuuguuuuguauauggauauaucuaaugcuuaguauuguauuuuauauauauuuugucauguuacacacacuagaaauaugauaaguaaauggaugauagugguaauaguggcagaaagauuuuuuuuucccugaucuguauaucuuuaacaaaucuuuuugcagaacuauguauauuuuaccucuuuggaggugaauggguaauggaauuuguggcaugagaaaaguugaagauaauacauaauuguaaaauaggcaaaacauuuuaaaauauagaaugggaguuggcuuaaauauucaauaggcaaugacuaauaguugggaucuugaaaggaaucguagcaguaacaaggcuuauuauuaguaguaguaguauauuuaacaacacuguuuaaaagaguaguuuuucuuucagguaugaauuaggcuguagaaaagagaaaccuuggugcauaaaguuguacccauguuguaauguuauguucauuagaauugggaaaugauagaagaaggauaaugacuaugagacaaauauuuaauguauagggaugaagaaauuuaaauuggugugacuaaagggaacuuaaagaggaaaaauuuugaguaugaggauaaccauuaaauuuuccuuuaugaauguccaaaugugaaaaaccugauaguuguuaaauaaaacauuuguaguccuuagcuuggagacuuaagaaagacccaaguuccuuuuugaaggggugggggacaguuucaagacagcuguuguucuauguaacagcccugcuuguucuggaacuugcuggccucaaacucacagagauacaccugccucugccucccaagugcuaggaauaaagucuuguaccaccaguuucucuuucauuuugugcuucuuucugauuuugauaaagcaagauaucuacauaaaauuuguaugauuaaagugacuguuagaaacuaacuuuaguuaagaauaccgauaaugaaauuggagaaugacaaaggacuaugagaaauaaauagguuauaaaagacaagaaaggaauauagaaggaaagaaaacuauaagaagcuaaauauugucuugcuuucauuuuuuaaugucuagaagccaguuaaguuccggucugaguagcuacuccuugaauaguagcuagcauuaaaccaaaaguuuuuaguugguugaauuuauuauaucauuugguccauaaaauaacaauuauuccacaaaaaucuuugaacugccaauauuccaguucuuuuuguaagaauguuuaauauuuguaucccuuaaaauaauauagaggauugucauuuuuuucuacaguaauagugugaacaccccucaaugaaaauuuaaaauuuaaacgcauucuuuuguguauauacaggauacuacaaauggaaaauuucuauaucuuucuauagacaaaguuaaaugcagguacacuaaaaauacaaaauuuucuccaggcuauguguacaaguuauaauggauucacuguuuaggguuggaaucuauuuucaagauguuucauuauguguauaugcaaauguauccaaauuaaaaacauuucagauugggaacacuauuugcccuaaacauuucuuuuauuucaccgagacaaaguuuuacuauguagcuggcccuuaaauuguagcaguucgccucagcuucuugaguauuggagccagcugugacucaaagcauuuuuuuauaaccuguaguaaguauuaaaacuguauugaaauuuuuucuugaaaaaagugauucuuuaaaacgacucuuagguaaauuuucacauuacagucuuuucucauauaauucuuaaaggguuuauacauagauucauagaaaccuaagaaaucuuuaaaaaugcaguguaucuuaccuaaagucucaaucaagugguuuaauauuuuuuuccccuacuuccuacccagcuuugagauuaccccuucccccuuuccccauugaguccaguuuguguugccaucuaguuuugggauugggaccugcucuggugugugggguauucuauagugggucacaucauuaaaacaaagcaaaacaucugacuuuccuucuuucugcagucaugaaaugcuaauagagccuuagcucgugguaggauuuccuaucuucugccuucuagucuaggauuuuguuuggcuggaguuuguacaggucuucuguuacagaaauuuuucuucauuccuuuccccucucuuaucuguuuguguguguacaugcuuguguaugaggguacuuaugugcaauucgggaggucauaggacagucugacuuucuuauauggauucuggagaucguaauucagguugucagacuuauguugcaagcacuuacugaucuaucucaggguccaguuuugagaucuuaaucauuuugucaggacucuuaaaauuaagguaagcgaaguuccucaagaucuguagcauauuacaacuggaauaugucaccaaacuuuuuuuuuuuucuucuuucuuucuuucuuucuuucuuucuuucuuucuuucuuucuuucuuucuuucuuucuuucuuucgagacaggguuucucuguguagcccuggcuguccuggaacucacuuuguagaccagccuguccucgaacucagaaaucugccuggcucucauuuguuuuuuuuuuuuuuuaagaguucaaaagaauuaauagcuuuuuuuuucuuuuccgagaaaggaaaugugagagcaaggguauauaaauauuuuggaaguguaagauagaauuaauguguuugacugaaguucauaacaaggaaaagacaaaagaauuuuuaaucugguauagauuuuggcuaaagugaaccauugaauauaaaugguaguuguucuuauuacagagauuguaugaauucucauauaauuuaauuaaguucuucaugauuguaggaaagauggauaauauuugauuuggaaauagguuugauuguaucagcagagauuacaguaauaguuuagacuuguaauuuauggagagaauugucauuuguuaaagugcuccuucuuuauuugauuugucaaauauuguuacaauuuuguaaugggaaagacauuuaugcuguaauuaguggaaucacugauaaauacuuaaagaaucuauuugucuugaagaaugauaugcugagauauaagaaaaaaauauugauuuccuggagagagagagagagagagagagagagagagagagaauguauguaugugugugaauaaucuuauggaggaaauguauuuuuaggauuguuacccaugucuuaaaaaaacauuuguguucuuuuuuuuccuaggcuguucgcugcuacgaaucucuaaucuuaaaagcugaagggaaaguggagucugauuucuuuugucaauuaggucacuucaaccucuuauuggaagauuauccaaaagguaaucuguuuucuuguugagucauauacauauuccuauauuauauuuacacacacacacacacagauuuuugugggccaguacaaaaccacaauacauacauacgcauuauguguauuauauaauauaauucuuguuacuggaaaggcaaguaauacaggagagaaacaaaugagcuugaaccuuaaauaaaacuaguuuauuuuuuuauauguuuuucaucaggaaaacuaaguuauaucucugaauguaggaguuaguccucugaaauuugccuuuuuaaagaaucuaaggugccaaauuagaccaaucacucguauacaaauuuaaaaagcugccugccccuccccaguacaaaaagaaaacuccacaguaaaggaaaacuguucuuacaagcgauaacauuuaaacuuaggguaacacuaaaucucucucucuaugcacuggauguauuuguuuucagcaaaugugagcagaguaccaaauggauaguaguggauuguuaguaauucacauugcuaucauauccugccaguuuuggguuuggccacacuuacguuuuccuaauggaagucuaguuuuagucugaaauguucauacuuugugaaauucccaguuuagcucugauauuuauauuugcagauuuauauaaacaucuccaaguuccugucuucuaguauguaaaagucacaaaaguaguagaugaucacuuagagauuuucggauuguuauguaaugcuagcuaguacugagcaaaauagcuucaguucgucaggauaacaggcauuaauaacaacccuuaacaucuuuuacauguauuuauuuacuuguuuggggggggcaugcaugugguauggaauggagagaacgacauuuaguaucaguuuuuuucuuccacuuggagguuaucagggauugaacucagguugucagaacaggugcuuuuuaccuacugaauuauuucuggcccaacuuacuguuguaacaucaguugaagcuggcaacuuauuuaaagcagacuaucauacuaaaaguauacagaauucuauggaaucuguuuuguuuuaauucuacacccucauguacugagaggggauguuaguuugacaacacaugaggggccuagacuuggaaugcccucauaggacucucugucauuuagugaccuuaguuaccacuaaaccguguaucuuuuaacuuuuauuuuuauuucuuauuuugaauguacuaguuaauuaguuaauuuguguguuugcacauaugugcaugcacauguuaugacaugggugugaagaucaaaggacaacuuguauaguuuuuuuuuuuuuuuuccaucuuccauguggguccuggagcaaaucuuaggccauuaaaccugucagcaaguauauuuccuuaccuccugagcuauuuugccagccccuaacuuuuaaaacuucauuguuugugaauuuagcuacauuuuaaauuuauaaaauguucaguuaggggcuagagagauagauggcucagcauuuaagaacauuuauugcuuuucagaggauggaagcuugagucccaguacccacauuagauggcucacaaccagguguaacuagcuucaguuccaggagaaucuaucuuuuagccucugagggcaccuguuuuccugugcacauaaauguaugcacgcacacgugcaugugugguugcucaugcuuuuagcugcaccacuugggaggcagaggcaggagaauugcuguaagagugaggcuaguguaguaucuuccagaccagacugggcuacagaguugagauuuuugucuuacaauacaaauaaguaaacaacaaauaaaaaguuggucuguagccgggugugguggugcacaccuuuaaucccagcacuugggaggcagaggcaggcggauuucugaguucgacgccagccuggucuacaaagugaguuccaggacagccagggcuauacagagaaacccugucucgaaaaaccaacaaaacaaaacaaaacagaaaaaaguuggucugugaagauaacaaagaaucaaggggcauuuggaaauuuccuuuuauguuuuggaaugugggauguaggcaaauaguaguuaguguccugacaauuuaucugguggaaguaauaguaaguaauaugggagaagaggauaucuaaagauuuaauuuacugaaaaaaguuuacuguaaauacccacuuaccauuagauuagauuaauuggcugucuaguagacagaauaauuuuuaacaggaagaagagaauggguauaucauauuucaaacuaauuacuucuauaugaguucuccuugagaguuugaggggcacuuucucccuauaaauaauuuucucuuuaaauacaagcuagggcuagagagauggcccagugguuaagagugacuguuauuacuguuauuauaugaguucuguacccaguacucaaaugguagcuaauagcagucuguuucagggcaucuaaugccuuuuuugaccuuuguggaguucuguuaauaaucagaaacuaguuauucccccccuccauucuuacaauuuuuuuuuuauaucucuaaaagaagagccaaauguuagguauaauacuucccucugcagcauacccacccacacucaaagcacuaccaccaauuauaaagacauuucuuuccucagguuuacucuuuucuuuguaacuggcacaaaaaaagaaaacuguuuaccucaguuaaauacuuauuuuuaggaaacauuauaaaacauauaaguuaaaaugaaccauacaguaaacauguaaaucucagaguacagugcuccaaguacccauuuguaggggacuuucugccuuugagaaugauucucaauuauauacauggauuuauuguuuucuuuuuaaaacauucuuugaacucaggauagccaugaguuuaauuucuuuaagaaauaacaacaacagacaacaacaacauaaccaccauuauacuugccaugguaaacuguagaaccuguuuuaugaacauguuugguugugauuuuacuguauuuguuuaguaaaugauaugcuaugguuauuuuacuguugauuaaaaguacacacauacacauucugccuuuuauuugguuauuuuauuguaggcauaauguuuuguuuuguaugcuaugucaacgguaccuauagauuauucaaaugcugauuucuuugcccuccuaucuuguuucaaucgagccacagcaauguaauggguagaccaagaaacucgugucucaaguuuauauaaacaguucuuaccauuuauucacugccuugacaacaauugcuagucacccaauggcugggcagaauagggaguaggguaggacaucugccaacaaaggaaagagaaagagagaggaagaaaaagaaaucaguggcaugauggaggaauuggagccaugaagaaugggucugaagaaccagaucaauaauaauaugcaauaucaugggauggggcugagagguagccagauuagcauaggagguaauaguaaaucauuuaacugcuaagcuauugagcugcaguuuuggauaaaucuauuucuucuguguggauauugggaaauagcauaagcuaaagacauauagccgccuuauuaauucauccuuuauauuuauauuaaggauaauucauuuaugcaugacaccccacauuggucgcuaauaugucuuaguaauuauuuaaccuuaguugcaaguuucuacccugccuuugaucauucaguucccagauaaaagacaaaaaaaaaaaaucuuuuauauuuauaauaagccuuuaaagcacuagagcugggcagauaucuacuuucuaagauauucugccuacuucucuguaaauaaccccuagauaucauuugccauauucaucuggguugcucuuaacuccagcuggccaucacucauggccauguuuucaugauucaccuacuccacagugacuucuuuuccuuucaccuucucucuuuucccccucuuguuccuccuuagaccccaagcccaggaaaugaaauuccgucuaccucucuucugcccaguuauaggcuauaggcaucuuuuuucaaccaauaguuuuaaauuauggagcaagguaugcauagcaucacuugaugcacaugaggauucucuuaucccugaggcaaccagaccuugagggccacuauuuagcauuacacuaguuagcaacagaccaaaccucaacauuuuuacuuuuaggaauuuauccuaaaaagaguaguagauaggaaauuguaguaaagcugaaacccauugauguacauuagauugcuauggaagggaguguagccuucauuuaguaaggaauuuaauuuagaauugcgaccuauggaaacuggagaaugaaacuaguauugcauugagggaaaaaugaagccauuauuauauagcuuuggccaauuauuaaaaagguugaaauuauuuaaaagguugccuuggaaggcaauuuuuaaaaaguacaauauaguuggauuguaauaaucauuccuaauguuaguaugagaaaguuaaaaccuuaaaauuaacugauucacauuucauguugagguggaaguuuuuccaaguguauaacuccauaaaaauuuuuaaccagugauagauuugucucuuuuuacuacuuccuucaaguaauugccuucuuucucuccuuacucccuccacccucuaaccccuuaucuauaauauuguggcaaaguagguuuggcauguuuuaauucuuagacagaaaugguuaggauggguuguauaccaagauuuuguacuuuguagaagucuucugucagucugagcaugcuaucuuugauuaaaugacaauacuccguugugaguaucuuauacuauaaacauaguauauaaauacaguguaagaacaaaagaucuauuuucuaauaauugcuaguaaguuuggcuagaaaaaaauaaguguuuugaugcacuuguuagagucauucugauacugauuugaaacauaaggauauugaaaugaaggguuuuuuuaaauauauauauauucucuauucuuagaaauaccuagugacaguaaacuaagaacuuuuuuuuaauagauaaagauugaggacugcuuguaggacccaggugguagguacuuguagccuuuauagggucucacugauuuaucugguuuaagaaacacaaaauuuauuaguaucuuaaaauaagaugccaauggagguaaauaaaauagaauaccuaauaaaguauaguuacuaagaaaguauguaauugaauagagagauguaaaaaauuucauuuuuaacuaccugcaauuuagaguaucaacucugacuuugaauuugauguuucauauuuauuuaguaauucauaacauuguuguauagaugccauguuucuacuaaacaucaauaacagcauguuucuuguaacugagugucauuuaauuuggaugguauuaggauuucuucaagaauuccuaauuuugaaagugaauuuuuaaacacugaaaacuuaacacaguuuaauuucuguauuuaaauuuuuaaaauuccaauuuaauguugguuagugaaauauuuauuggaaaagaaagacuaauaucaaaugaaaaaauuguuaagcuauguguuuugacuuacuucccccuaacuguucuaagaacuagacccaagcuuucuucauucuagauaaguauguaccauugagcuacaccccuuuacuuuaguacuauguuuaaaaauaaaguuuuuuuuuuuaaaaaaaaaaaaacuuaaaaacuuucuucuauaucgcauucuaguuuggaagcauuguauagaaagcucuagaagcaauuauuuuccauauuggauucaaauauuuagccgcauagacauaaaagaauaucuaaagaauauaucuacuguuuauugaauauuagaaaugacacuuaauuguuacacagguuaagaaguggaacaguacuggugcauccuagguuuccuccacuuuuuuuuccauggguguacucuaugucccgaaauuucaguguuuucuuaguuuucuuuuucauuuucuuagaaccacuauuaauuuuuuucucauaauauauugucuaauuuggaaaaauugagcaaaaugccaagucucaugacauauauuagaaguacaacauuuagaggcugaggcaagaggauuugcgaguuugaagcuugucucaaacaugagaauaaacacauuuagcuauauacaaaaaguaccuuuuauuuacaaucauaguaguagguucuuagcagauguaaaacuaaacaagaguuucugauucauggucuagcuucugguuacuuagcaguuuaugaguguaccccuccccucucuuuagguguaugggaguuugccuacacguaugucuauguaccacaugcauguuugaugccuagagaggccagaagaaggcaucugauccuuuugaacuguaguuacagacccacucucuauauggguuuuuggaauugaaccugugacuuuugaaagaauaaucugcucucacugaaccaucuccagacccuacaagaacccuuuuuaaggaagagaaugggguagggcauuugucaaucuugguaauacuaguacuccuaguuaggauguugggcaagauuuaacagccaaauucuagaaacucuggaauguaaggagcagguagaugauuuuaaaaaguaaaucagaacagaguaauuaacacuugucugugagggggugcugcauccuguccauuuuguaguauuauagaggugacacaaagaguuuaucagacuguacacaguuaauaaaaauaugguucuagaugagaaucuggucuagguuuauguggaucuucaggucucaaauugagaaagaaguuauaaauggcaguagaaacuaaggauaggccucuguccuuagacuguguauaguuguuauccugggauuucacuuuaccuuggauguuuuaaaauacucauuuuauuucugccuccugguuuuuaaugaauuauauucucuuuguugguauguauuaugcucuuagagaaucauuugccaguauuuucuucaggaaacacucuguuauuacuugauuucuuucuggccuccccaugacuccuaggccuugagaucuuuuucagaagaauccagacaagacacucgaguauaguauagaagauauaguuuauuauuuucaagggacgggagugggcagcagccaaagggaccauugagaaggaaaacauugucacugaauaaaagagaguccaauguccagaguccauugugccuccuacauuuagauaggguuuauuauuuuuaaaguuuuaggaauagccagacuucuugggguguuuucuuguccaggugaugaacagguacguuuauccguacucuuaagggagggcauacugcuauauauccuugugcuuuaccagaaagccucuuccuagauaguaaucucuacccaggucgagagaugaacacagaucuucuugugaccaguaaucaaaguccuguaguuucaguuucugauuuuacaagcucaugauuaugaggggaagggucucuccucauacccaacgcuggaaauuaauuuugguugcguuguugcauauaggaaagauacuuuuauucuccugagcuaagaauguggguaucuuaauauauuguuggaguuaacuuuucuuuagaaguuugaaaacguugcaucaucuugcuucuagacuaaacaucuguuguaggccuuuuuaguuuaguaacccuauagcuuucuuggaauuuucugaaauuuuaacucggauucuuaagaguagaagucaaagcucuuagaaccccaacaggcuaggcuaggucuuaauccauuaguuaccagagaugaauaaugaugaagaguggaaaggagaccuuuguagccauggugugaaaaacagguaaaggaguuuagugguuucauaggucugucuuucugacaugaagcuaagguugcacuagagggcaagaggaaacauaauuaagcaguccugguuaagguaugguucuuugucucagcucugguucuacaagguggugggauaaauuguuaauacauuguaauucccugaggaaaccaaucugcuaucuacaacaugauuaguuuagcaaggauguagccucaucuucauggauaauugcuuuaauugagagggggaauaucuuuccuggaaaguuuuggcuuuuuaaaucuaaggcaacuggagguuuuggaaaauaacuuguuugccuuuagcuuugacaggaaugagauaauguuagguuaaguagguugaagcagaauaugagacaaaguaaaggacaaaaugacagauauuuuagucuuuucaucuuauugauugcuugugaauugaagaguuggugcuuuagcaaaggcaaguuuuucaagugcccauugcagaauuauugguuaaauuuauccuuugcuacuggucuuucuuuuuggacuaguguuacuaauaugcuagcccuuuaguaaaugacuucugguuuguuuguuuguuuguuguucauuuuugagaggucucuuaaacuucauuauauccuauugcauuauucuguaauaguuuuccaaauuuuauuuuucuagagcauccuaucuguuuauauagaauucucuuccucccucauuaaagcaacauuuccuaucuuuaaagagucuuuccccuucuuuggaugaucuuuaucucauuuuuaucauuuauuuuucauuucuuuuaaaugucccccccccccacacacacacauuucuuguugcuuggauacuuucuuuagauagcugguaauucuuaacucuccauguuuuaagaauuguaaaguacaacuagaaccucugagcauguacaaauagcuuguuuagucugaccauggccugcuuuuguuggagaauuuaugcaucuguuuuugaucacauugccuaagaaacacugagaauuguuccuaccuuggugguaaucucauaaaaugauuuggauaagagucucucuucuucuaaaaauccagggugacucuagguuuagaacaaagcuuuucugggcuuuagaacagaaugugaaugaugacaguuacugugcuuuaguuauuucuuaucuuugugccuugaggagguugggcauggagaggguagguuugggagauggguuacauaucacaauuuuuuuagacagauuccuggaugugugcuuauagaguuaaaugggugauccaaaguaggaaagauagacaaaaugaaggcaaauauaucaagcuuuuauccugcuuucguuaucauauaaauucaagugagaaaucacugcaaaaaaaaaaaaaaucacagcaaaggcgagugcuuauaaauaccuacuauaguaaugcuucuuaagacuuuccuaaggugaaacauaauugugacuuauaauuauucuccuucuuuuagcauuaucugcauaccagagguacuacaguuuacagucugauuacuggaagguugguacacauuuucaugcuuauuucuuauuuguuuuuguuggcacauuuauuguugguuauaaaaaauaaagauuagagcucacuuuuuuuuaauguuacuucuacaagaaagagauuugaagacggaaaucaauaucauuuuguuauuuucuauuuaacuacuuuguauuuuauuaaaaagaauuagauuguugacauuuuauugaccagagaugaucugaucgcaugugaaauaauugaaaaaucaaacacagccaaacagcuuucagcuagcaagggcuuggguuaaugguuuguguggugcuggggauugaacccagggacuuauacuugguagacaagcaccucacaacuggguuacauuucaccccuuuguuuauguauuuguuucccggcuaagaauuuugaagucacuauauauucuugauauuuaucauuaguguagcucuggcugucauggaacuuauucuguagaccaggcuggccuugaauucagaggucuuugcugcucuugcuuccccagugcuaagugagauuaaagauguacaccaccgccaccuggcuuguauugucacuuuuacugauugauuccguuccuuugaaaaagcuuuuuaguuuuaugaaaaccuauuugccuuuucuggacuuuauuuuccugugcauuauuucugaagucauugccuauacuaaugacauuguuucuccugacuuuuauuuuuccuaguagcuucauaguuucaggucucaaauuuauuucuguuuaauuuugaguuaaguuuuuuuacaagguuggagauaauaguccaauuuuaaucccuugcauaguuuaccagaaucaauguguuaaugagguugcccuuucuucguuaauacucuugguucuucguaaguagucaguugcuucucaauugcauggauuuauucuuaggaucucuuacuuuuuucuguguacauugcuaauccuuaucuucugagcauaauuugaagucagcuagaccucaccuuuguuauuaacuuuccauauuauuuggaagggguggucuuuuauacuuccaugaguuuacauuuucuguuucuaucucauuguuauuuugaagacaugucaccuuggguaauuuggacauuugacauuauuauugcaguccacaaagaugaaacaucuuuccaucuucuggugucaucagauucuuucaucaauguuuuguaauuuucauugggaaugucuuuuauuuguauaguuaaauuucuucccagauauauuuuuuguagcuuaucaugaauauaagauucuuuucauuauaucccccauaccccuagucagucgguguguaccgguguggugugguguguggcauguaucauguagcuuacaaaugucugugcacauccaugcaggggccagaguaagaugucagaugccuuccuuauugcuccccaacacucuuguaauggaaugucucauugaacccggagcuuaccauuucagcuagccuagcuaguaaauaagcuccuaggagcugcuuguuucugcacacuagugcugcaguuacaagcauuuuuggauauaacuagcuuuuuacagggauacugggaauuugaacucaggucuucauaauuguacagcaaauacacuuacccacugagccaucucccuggucccucacucuuucuuaacaguuuuugucaucacuguuuuaaaauagcccugcuuuuuauauguugguauuuuugcauuacacuguguuguuuugaacauguuaguaauagccuuagaguacuaaaaugcauuaguguuucauuaaagcaaagauauuaaagcacuuccccuugaaguaauuuuauuaaaagcuagcccagauacaaauucucuacuucuuucucccucugucuuccagugucucuuuuuaucuguuauaugagucugaaucuguuugccuuaacauacucucuuguaugagauggggagggagagagauacugagauccgaacaaggggguuuugcucuguauuaagugaacagcauagaaagcaucacauggagaagaagacaugacggauacuuuacagaacuaacagggaaugaaauauuacuaauuacaauggucccagauaacaaacaauauuccuaugcugcuucuaacauuuuugguggauauuuguuuuauaagguugcauauuaaccuauuugcugcuuuuuaacaaaugacuaccacagcacacauaccuacacaugucucuuugggucaggagcaugaaacaauauaaaguuuaaaauugcagcuauuuguauuagcucauguuguucaaagggaaauccauggcaaguaagguugguuguuuacuaguucucuuauaguuuaaacagguggaauauagaguaagauagcugucuuaaguuacuucaagguauguuauuaacuggagacaaaguuccagugucuuagaauauaggauuuauuuucauaauaacaaguugccauauucuuuuuuuuuuaaacaaaccagccugucaguacugcaucucacuuguguguguucuuucuuucuuucuuuuuuucuuaaacauuuuauuuauuuuauguacaugaauacauuguugcugucuucagacacaccagaagagggcaucuguuuccauuacaggugguugugugccaccaugugguugcugggaauugaacucaggaccucuggaagagcagucagugcuuuaaaucguugagccaccuccccagcccaaguugccauguucuacaaucucacugaauucauuuaccaguucuaauauucuuaaaaagucuuuagguuauucugaacuuagaaccacaucauuuauaaacaagugcaguuuaacuucuucuccugcaaaucuuguuuugcuucuucacuuuaggaagcaauuccuaaggagucagugcuuuuuaguauaagcagcuuuuagugccaguuucauaguuugacaugaauuuauuuuucaguugcuucucagcauaaaaugcaauuguuuucaaagaugauuacuggcauauaaaaugcuugguuuugacugacagucagacucauuugacccuaaaauugucugggguugguguggcagcucagugguauagugcuuagcugguauuuaugaagccccaaguucaauccccaguacugccgaagaaaacaaaaaagacaaccaccaauaagagaacuuuacugucucaaacugcuuuugauuuagagcaugucugaugaaaaguuuuagagacuugaauuaauucauugccccagcauucuuuucuguuaccucacuuucucacuaccucacuugggaaacagggcuuuuuucauuaguccuacuuauugcuguaugcuucuaggauaaaggucuaauauuuuuccugucaaucaauccucauaucauaguaaauugaaaguauucuguacucuguggucuguaaaacuugcauugucuuaaaauucuaauguauucaagaccaucaugcccauuuaugauguccguuuguuuuguuuucuauagguuagugcuuguuauuagguagcaauucuuuuuucagcaugguucuguuuguuaccccacuuucucacccugugggaaacagaguugaggccuugccaaucaguuaaugguaggauggguucaggggaaaagcagaaauuuaugcugcauuugagaguuaguuugacgagcaugugaauaaauagaaauauaaguuuauauauuaucaacuaagaggugaugauguuuuaaagccuuaaucgaaaaauauagaaggcucuguuguacuuuauuuuuuacaucacguaaaacaaacaccuacccccaccucuguacauguauaacuugcuuuugugagauuuuuccuaggaagucuauuucuauccaucucagauugggggaaagagggcaacuacagacuaaagaaaacaauuccacccaaguccaccaugguuuaauuggaagacuuucaggagcuugagugugaggaguuacuucaggagcaugggcaucauagggcaacuguacuaccagaaaguagucuuucccuagcagugguuauuuuuuauguauuugugggacuuccugagccuugugaacuuucuacucuuuccacagaagaaugccaauggucccagucuugagaaggucuuaugcaaaugaucacauaucugcuggauaucaggaccacagugacuaugcuaugcuuggaggacaggguucuauaucaccuuuguuacuaauagugguauauuuguugcauucuguaaacuuaacauuuuauauaucauuuucaugccaagcuccuagaguauauauugggguucacucuguguaguacauuccauugccuuaggaaaauguguagcuaacuuaucucugccauuauguuagcacaugacgaauuuucauugccugaaaaauauuuucauccucuagucuguugauuuaucuuuccuucccucccuuagaaaccaaaguuauuauugguauauauauguguguguguguguguguauuuuuuuuacucccuauuuuuuuaugcuaauggacacaugaaucccugauaaccaucuugucuaaucaaaaugucuugccauuuucaagccuggagauucuguagaagugaaauaguacuguauguuuguuuaugucugugcuggaggaagaggggcgagaacugcugauuguugagauguuuucaauuuaaaaucauuuucauacaacucuagccugcacuuaaucucuucugcacucuguugacuuuugacucacaaaggaaaggaaacauuuacaaaaacaaaaggagaaacuaacuuuuuuuaguaacuguuacuauuacuuucucaucacaaauuuaaauuaaaaaguauaccuguauguaugguuuuaaacuaccauugcuguucauaugagagaaagcauguaacccuauccccaauacacacgcacacgugcacacacacaugcauacacaguuucucuguguaucccuggcugaccuagaacuugcucuguaguccuaaacucacagagauuugccugccucugcugggauuaaaggugugugccaccauuaucaggcugaaaacauggaacaauuguguuucugagcagaaauaauuuugcuuaauacaacgauuuccaguucuguccauuuucauguaaauaucaugacuucauuuuucuuuagagcugaauuaacuaacauugugcauaugaaccgcauuauccauucaucucuugaugggcagcuaggcugguuccaucucuuggcuacuaugaauaguacaggaauaaagauagaugugcaacuauauucaugggagcaguucucaaccuguggguugugacuccuuuggggguugaauagucuuucacaaagguugcuuaagaccaucagaaaacacauacugacaaaaugauucagaacuguagcaaaauuaguuauaaaguagcaacagauaauuuuaccuuugggcuucacucuaacauguagugcauuaaaggguugcagcauuaggaacugcucuaugauauguugacuuagaguccuuuggauauguauucagggauggauuuagugaaugucuagcaucugcuauauuggagggaauguaggaaguacauauguuuaauuaguucucuuucucuuuuuuaaauuuguuuuguuuuucuugagacaagguuuuacuguguguuaguccuucucucuggaaacuugcuguguagaccaggcuagccuugacauugacaguaauccucuugcuucugccuggcucacauuccucucugugucauuuuuguuuguuaaaguucaauaaguacacaaacagaaaaaugugagcuuugguggcugaucuagucaaacccuguaucugcuguguaguauuuauccaacuccuugagcauuugcuuaguuucucuaagccucagcucuuuuuuguuauaagugaaacugucugccucaugagguugucuuauaaaauauuaccauucugcacaaaacuuaaguucuuauuaaacagugcuaucaagauacauugugcuaaggucaaauuaagagguuagagauauugccucuaauuugauguagaucaaucagcaaagcuucacauggaagguaguaguauuuaaauggauuuuuauaguauauauuuaaauuguuucauaguguugcgagaaugggaaaauguuuaagagggaggaagggagggagagagagaauaaaguaaagaaauugggagaauguaagauguguucuagaaguagaaauguacuucaguaaaccucccccccccccccacacacacacacagaguuguuuguugugauucaaucuguauuuccuucuucagagaaaguaguuguuuuucaagucuugacuuuauaggugauauauuucaugacucaauuucucuuguguuuggaguaccuuuucugcuaugucauauauuacauuuuuuauuugagaguuggagaaauacauuuuaguucagucaguuuugcacaaucucaucaguauuguucagauucuuucagaggauggaauaggaaaugaaugauuuugauuaaaaaacaguucuaacuaaauuaaagaaaauuaaauaucaauuuucaaaauggauguugagaccuucuuaacucuucaauuuugugaaucccuuaguuacauauaauguucucacuuagaaaauugggguuaaugaggauauaaugaaaguaaauuaccacauuauuagauuuuacaaugugcuuaaauguuuuucaauguuuuuagaagucacauagaauucaaaagaaaguacaguaaaguccuagcaaaaauuuuauuauuaaaaaaucaugugcaaaacaucauagucaauguuugauaacuauuguggccuaugugcccugguucccuuauaccuagagcaagaugacuuggaggaauguucuacacuguugccagagauccccaacaagauugaguccuaguuccaacagcuacaaucagcuccauaaagcauccauuaauggccucccuucguauccugaccucuucacuuucuuacaaguguuuagcuagguuaacugaccacauaagcuacuaacuagcacugauaccuuuaguuaaguuuauacuacuuggaaaauacagcuuuuuaauuuuauguucaguaccacugaaggaaaagcuuaaaauucacaaaaaaaugcauaagaaaagucuacaaugaauuuuaccauuuaaaaaaagaauuaucugucaaaacaacacuuacugaauuauauuuaggggcuuagccauuagugaauauuccuuuuguaguuucaaaaacaaggacuacauuuauuauaacucauuuuaucuucaucuuaccuaccucuaaauagaaacuagccuuuagguuuuuguuguuguuugguuucuuuuaguuuuauggagauaugaacuuguuuuuauucaagauaaauucuugaauuagaagcauuacuccuucaucaguuucccauguacuagaugacauguaccaccacacuugaccauauugaauuuguaaaaaggacaaauuuagccaggugugguggcgcaugccuuuaaucccagcacucuggaggcagaggcaggaggauuucugaguucgacgccagccuggucuacagagugaguuccaggacagccagggcuacacagagaaacccugucuugagaaccccccccccccaaaaaaaaaaaagacaaauguuugagcacacauauuuauuauaucuugggaucuuggggaaugagaggugggagguacagaaagcauagguacaugugccaauaggagaaaauaagauggcauaaucacagcauuuucuuucuucaggaaaaaaaauauguuuaaguuugcugauugaauuccgcuaguuuuuuucuccccagaacauacuaaauagaaaccagaguauaucgccaaguugauugaauuccauaccaucugcuuacucauaacugucauuuugguguuuaaaaaauguauuuuaaauauauuguaagacaugauagggauuuuaagaauguaaaacauuguugaguacuuuauuuuacaucaacaacauacuauacacuucauauaaacacguuccuuaaaagucucucuuuccuuccuuuauagaaugcugccuuuuuauauggucuugguuuggucuacuuccauuacaaugcauuucagugguaaguuaacauggcauacagauaguuaacuuuaauugguccaauaaauagcuuguuuuaguuucuuuggcuuuuauuuacauuuuuuuguuugauuguauguguguguuaauauaaaauauguuauuguaaguaaaccuucaguuugcaaucaucuguugaguugauaagauucagaaguauugacccaucuuaaauuauuuagacuuuuuaaaaaaauuguuuaugauuuaagauuucuaguaaaagagaauuaaauagugacuaucuaucuaucuuagaauuucuccauuaauuauugaugacuggcuccuagguuauuugaacugaagaauaaguaugauuaaacuguguaguccuggcuagcccaaaauuuacuaagaagaucaugccaauaugaucaaggugaucuuccuguuucuaccuucacagugcuggcuucacaucaccauaccuuccuuuacaucaauccacccugaauuauauuugugucuuaguugguuuuuuaugcuguaauaagauaggaugaccaagucaauuuauagaagaguuuauuggagucuuaauaguuucagagagugagucuauuaucaucauaguuaagaaaggaguagcacgcaggcaggcacaguacuagagcaguugcuaagaacuuacauccugauccaccggugggaggcauacuuacaaggccucgcccaacccuccccaacaguccuaugaacuguugaccaaacauucaaaucuaugagccuauggaagucauucucauuugagccaccacaccauucuuucuuuaguauucauuauauauuugaaaccaaggauuuuuaagucuauuauauuuuaagaaggauccaauuuguggaauuaaaaauuguaaauguuuagaacuagagaaauagucuuagaggugauuuaugcuuuucuuuuuaauauuuuagguggagaaacaaggauguguuauauauauuuagcuugauauuauguaauuguugguguuagacgcaagguuaaucuccaagcauaccuuuuuuuuuuuuuucuguuguacugcguuuuaaaauuaguaggugcaacuaacuguucaaccguggcuugccuggaacucaccaagucugucugccugccucugcuccucugccucuguggagauuaaaggcauccagccuuucuuuccuguuuguuuguuacuguuuuuuuuuuuaauggcaaauuaucauguaaugauaucauguguaaugcagacuauguuuaaacucacagcagucuuccugccuuagcuucccaaguggugacaucacaggugcagaccaucacauagcauaggcagcagauuuugaguuuguauuuguaaggguucucuuuggcacauugguaaaucuuuaugaucgauuggaaauaauguaggaaagggaggaagcaaggaacucuacaguuuaagaguggguauuuguuucucagacuagccagguuucacauaacuacuuaugaccuuccuucuauauugaagguaagaacaaaauuaguacugaaguucaaaguuauuuaauaaauuugugaccauguuaaguuuguuuauuuuugauucuucauuuauguaugauuucuacauuauucauuuuaccucagaaaugaaacugagugauaaaaggauaauacaggauuuaacuuuaaauaaauguccuuuguuuuugcucuuggucaccacuauuucuucucucucucucucucucucucucucucucucccucccucccucccucccucccucccucccucucucucucucucucuuucucucuuucucucuuucucucuuucuuucuuucuuucuuucuuucuuucuuucuuucuuucuuucuuucuaugauuuuguagaaaucuguuuaaaggucaccauuauuuuaaagcauauuuagugauguguguuuuuagaauuagugcuauugaggaguuagguucauauaaccuuuuaaaagauagauuuauuuguuugucuguuuauuuauuuaauguaugugagugcacugucacuucucuucagacacaucagaauagagcaucagaucgcauugcaaaugguuuugaaccaccaugugguugcugagaauugaacuuaggaccucuggaagagcaaucagugaucuuaacuacugagccaucucuccagccauauaauuuuuuuuugaacuuaugauuaaauguagcaauucuuaaaccagaaauucuauauaaauaaucuggugauauaaaaaguuguuucuagacuaucaaaaaaauuagcaacaguacuagacacagcaauauguuccuuuaaaaguuuuuuuuccaguggagcauuauucuuugccuauuugaaaacugaaacuucuaagcauugcguugucaaaguauuuuauacaguuuuuaguagcuauucaucaugcuuuaaaauucugucaggauaaaauauuuauuagcgaugucuacucuauacuacagagaccauauucugcuuccauguauuuuugagagauaggaauguaguaagauaauaaccaaaauuuaaauguagucuuuagugguauuccuauccccccaacccccaguucuauuuuccugagauguggaaacugaagugucacgugaaaaaaaaaaaaacagcaaaaguuuagauagaaauacaaacuugguuaaauaaauguauuguauauuaggugaggaguuuugaucaauaaagagauuagacuguagaguucuuccuucucgacaaauaacccuaucuguuaccuuuaagugaugguaucgauugacaucugcuaauugguuauuuugcugaugcuaaugauuuagagagaaaagaaugaugcagacccgaauaaaucaaaacuuagaaaaaugaggacaauacaucauagauagaaaauaaaaugauuggauuauagauucaaccuuaucacuguauuuaauacuaaguaacaaauaguugacacugaauuugcauggugagguuugacuauaauaguggauuuagaaggaagcuaaaaaaugaagauauucuagaucaggagaauauaguuuaaagaagcagugaagucaagaauaccaauauuugcagacagaaauuuuugagguaagccacuucaccuuugagguaagcugaagaugaacaguaacagccaacugagaguauauuuguuaaauguaacaaagagauaugauuauuaaguuauuagugucauacaaacuaccuguuugaggaaguaaguguaagccaaaauacaaaaucuuuuaaggaauuuuuaucgguaaucuaguaaugaguuucugaaaguuguuucuauaacauuauagcaccaaagguuguguguguuugugugugugcgugugcgcaugcgugcaccugaggcugugcaugugugugcacauguguuugucuuucgcacuuuuagaccuuaaagaaugaauauacaccgagccuaauguguuuauaguauuucugaaucuaggcuaauugccuacucauagggaucauguuuaaaauaaagcuauguuuguacguauguaauguugugaaucaaguggaagagaugucuguacugaaggcucacaucacagauacuacauuuaggggaaaaaaaccuagaauuuuaauuuagacaagaaauacuuuugcaagugguuguuacugauaucauguaaucuuuuuuuuuuuccucauaaacuauuuguuuuaccuuuuuucuuugcuaacuucuuuucugcaauuccacuuuuguuucauaucugugccucagacuugccuggguuuuuaugggcacauaugaacauugcuuagcaguuuuucugacucauauuauaaggacauuaugaagcauuagucuugauuuuuauauuuuuuuagacugugucucuuguaucccagauuggccuugagcucacuggcuagguagcaagggcugaccuugaauuucuauuuauccugccccuacuuccucagugcugagauuagucaaccuucucaggcaccucuuguuuguucagugcccuuggggcuggaacccaaggcuucaccaaugcuggguaagcacucucuuaacuccccuacauacaucucuaguucuuguucauaauuuuugcuagcacaccuuaaaagguguagaucauaaauauguauugcagcaugcuauuguaaaacaauaaacauuaauacaaccaucacuugacugaagauguaaacauucgaacuacccuagaagcuucugaacauuuugcauacugcucuuuccgcagaauucucaguccuacuuucuaaccuugaugccucuacccacagauauacaaucuuccucucauugagcuugcauugauuuugaaacaguuuugaauaugaauuuuaucuuaucccuauuuuuuucuguuagcccuuucaccuuucucucguauuauacauuccucagacccacuuaaauaucaucuaacacauagaugccuauuucuuaaggaagaaagucaaguacugucauaagcaggaauauaggucugaugcugaaccuauguucuuccugccaaauaaacuaccugguagaagucuuuaauauuauaaauaagcacauauauaaguagucauuuuuagacuagccuaaguaugauccuucagaauaaaacuacuaaaacacaugaaguauuuuauggcauaauauuuugcauaaacaauuagcuuuuauuuuggaaaaucuaagauucaaaauacucaccguuaauguuuauaauacuaguguuagcucuuaaaaaucuuugcaaauaauauauauuauauuugauagagguuuuuaaacaauagaagguuuuaaaaacuaccuaauaugauuucaguauauuauuuuuuguuauuuuacuguguccugcuauuaaauuacaaauauuugcaacauuuuuauuuguaaacagggucucaguagcccaggcugaccccagucuccuuaucuuucuuccuuucuaccuuuugaguacuggauuuacagcugugaaucaccauacuuggguacuaagguuucaacuuagggcuucuugcaugcuaaguaagcacucuacuaucugacuacauccucaugccaguaccuuuauaacuuuaaacauucaaaacauuuggucauuguuuaauaugccuuuuaagcauuggcuacacuaacaugaucaaguuagaaacaauaacagcauaagaguccauucaguaaaagauuuucuucccugaguuuguucuacuugaaucaaacuuuuuucuuuuuuuaaaaauaaauaaauauccaaugagaguuugagggaaagagauggacagaccaaggaaacuuaacuaaaauaaacuuagaaauagauccacgugaaugucuggauuucuguaguuuccaaguaagaaugaucuuuuucuauauaaauaaugugguugcuggauauuacuuuagaaaugaaaacugacuccucacuaaugcaguauaaaagauagagugcaguggguugcacacgaaaacauggaaaaacaaauuacaaaguuuuaaaaagacuuauuuuauggcauagacuagaacauuugcauuuaauauauaaaaugcuuaaguguuccuuuccguuuuuaaguaacaauuauuuacauuauuauuucuuuuuuauaaaucugacauuuaaaaauagcauuacauaaaacgaguuuuacuguacuaccaagcagaaaugugugcauguguuaaaaaguuaagcuaucuuaugucuauauucuuucagggcuauuaaagcauuucaggaggugcuuuaugucgaucccagcuuuugucgagccaaggaaauucauuuacgacuugggcuuauguucaaagugaacacagacuaugagucuaguuuaaagguagguuguugaguuuuuucaagauacaauguccuauuucugugauuguuguugcuaaauauuagcgcauugagaaauguugaaacuuagauuggcacuuucaaaaaaaauuuauuuagaugaagaaacuauucaucaauuaugaacuugaagaaaaauuugguuucaaauacaaaguaguuuugaaagagaaagccaugugguaaccaauuacaccauuaaacuuuuauuuuaaguuuugcugaaaucugucaggaaaggauauuggagcaucugagaaauucucugaaaaagugauuggccaccauagagcuacuuaauguuguacgugugaccuggccaucaaacguuuuuuguuuuuguuuuuguuuuguuuuguuuuuauuuuuuuaaguguaugacuauauauauuuauccacuucaaccagcagggcaugucuugcauuuaaauaauaaaaacaguauuuacaaggcauuuggacuucugguuuguguauauaaauauuguaagugaaagauaguuuguuguuuguuaaauaucuuccuuuuuguggccauucaauauuucucccaauuuuucauuuuauacugaguugcuucuacugucguugccauuaguacuagaauuuuuguuaaaacugcacuucucugcaugacaaaaauaaagaaucugaaaagauuauaaguucuagggacacacuuauaguuuuaugaaguuagugacuauaauguuugcuaaguuuuguugcauacuauuaugauuccuaagauugugauaagggaagagaaugagauaaagaaugacuucacauugggcuauaauuugaaaugugaagcuuuguuuuuucuuacaauggguguuucuuuccaugaguguuucuaauuguucuagauuuuuaaaguagaaaauuaugcaaacacuguuuccucucgaaccauucaugacuuuauaaggaaacauucugaugagaguuagccaccuaagaacauuaagacaaauagauuguaaaaaauguagaccacaguagaugaugguaaguacaguagaggaauagauuccagcauaucuuaaguagcaugaagaauguaauauaauaccuggaauuuaaguuuuccccagcuuacuguuauuuuuaaaauaugcugugguaugccaacggcuaauuagauauguuaccuuauguauuuuaaaauuuccuccuggguagccaguuuucauuagcuaucaguuucuuuguuuuauuacacaaaauaaacuuacuugagcaguucacgauacuguuaaagcaucucucaaguuucaaaaggguugguagugguuuaacaaacuuuauuugguguauuuauuggggugguaauugugucccaaauuauagaauguagcuaugccugaauauuaguacaauaauaaccuuaguaacuguauggauaaaaaucucugcaagaaagcaacauuauuaagauuuccuuuugauuaggagguauaguauuuccaagcuaacugaaaauauuucugcugcccuuuauacucaaccaaaacauuccuguauagucaggguuaagguaaagguucuuaccaaaaaugcuccaauuaagggcagacuucuuuuuaggaagggcuuuuggucauuuguuuaaaaugauaaauaguauccgauauuuauuucauuucuauaaacaugggugauuuuaagagcucuugauauauuuuucuuuuucacaaugacaaaguuuuuaauuugauuaauuucccuugcacugauacucauuuuugaagccuucucuaagucauauauucauugucuauuauggaaauuuuuugaucucaacauuuucugucaaaaagcagcuauuuuauuauauuacuguaagugcauagcauucaguaaauggaguuagaaaucaagaaguacuucccccuuugacugccuccaguuuuuugacuaguauuuuaccucuggauaaauggagaauuucuauugcucuucuaucacaucaaacuuuuucauaguacaauauguucgaauagaugguuuuuaggcuacagugucagcaaguaauaucuugcauugaacccgacaacuugacucaguuccugaggacccacaugguaggagagaacagauuguugcagguugucuucugaccuccacacaugugugcacacacaaauacaaacaaauacaaaugaauuuaauuaaguacuuuauagaugauguugucuucaucuauagauuaguugaguaaauugauccgaaguuucauuaaagaugauuucuuuuuaguucuauguuguuguuguuguuguuguuuuaggggaggagagauauuuuuauagacauccugcaagaaaccagugaacugggcaguaacuagaacacugucuauguuggcuuuucuaaaagcugguauugaaguacaauauaagugacgggcuucauuuuacaucuuucauauagaaagacuuugcgaagcagugccuaauauacuacugucauuuguuagcauugcuuggggcuggagagaugacucagugguuaagacuacuggcugcucuuccagaaagaccuggguucaauucccagcaggcacauggcagcucagaacugucuguaacuccuguuccaggguaucccacacccucauacagacauacaugcaggcaaaauacuuacguacauuuaaaaauauauuagugcuuaauagguaaugauugauauccauucauucaggauaaugaaccugucuuccuguuacacuuuucagaaguauuuuaccuuuuauuccauuaguuugaaauagaccucauggcauucuuaauuguuuaucaaaggagaugucaucauuagaacaguuaaacucaaucuuugagcaaggcucaagccucuaaauauacuaugccuacauaauggagggaugaggaaaugaauaaaaagaauauuuuaguagugaggauacugugaauauuccuuguuacagauaagaucuuuaaaaauauuuuuguguuuguggaaguauagcauauauaugugcacaugugcuugcuugaacgcuaaaggagacuauccuucucuuaacacucuccacuaaccccuuugagguagguuuuuuuuccugauccuaggacucacagcuucucagcuaggcuggaaacuacuaagcugcagcaguucuccuucucugucccauucacagccugaguuauaggcauucacagaacaaacacccugcuuuuuuguuacauacaaauuccagucuucaugguugugcagcaaacauucauagcuccugaauuaucaguccugcuccagaucagaucuucucuaccuuauuuucuugacuucuuccugaagagcgguauagcuuauauaauacuuuuuacaugauaaaagcauuuauauaaaaauaauuuauuuucuuacauguuccuuuuaucuauaugugaaauauguuccagggacuccugguccguugcagucaguauuucauauuuuuaucaaaauacauucuuaagacagauuuguucuauuuugguacuaagaaaacagcucucauagcaagcaaauuuugguuuuaaaauuuggucuugccagauaccuuguaacuaauuuugugacuagcaaaauuacuaauuucugauucuuucuaugucuacugagccagaauaaucaugucuaccucacaaaauuguuaugcagguggguauuuauguguguauccauaucauuccggaucuuacagccauuuugcccagcuauacaggagugugagguauuaucuccuuauuguccuggcugaucuagaacuugcuaucuuccugucuuagucccgcugcugggauucaacaggaguaugugccugguccaguuuuaguucuuaguuuacuaugcuuuugguuuggguaugcuuuugguuuugguuugguuugguuuggauuugucuccucaccacucccccacuuuuuuuuuuuuuuuuuuuuuuuugagauaggaucugauauaaccuaggccaggcuugaacuuagcagaaguuaguccuuaacucuuccuuuuuuaaauuaaauuaaauuuuauguguauggaugguuuacaugcaugucuaucuguauacuacuuuuuccuggugccugaguaguguauaagagaucagauaccccugggccuagaguuauagaaguuugugagcuguuaugugugugcgcagggaaucgauccuagauucucugaaaccaguacuccuaaccacucagccaugucuuccaugucuugagccccuaguccagaauucuuguucuuucuaucuccauuuucuaaguccuaugauaugauauauguguguacuaccauaacuucauugguguuguaugugguuuuguuuugugugucuguuuuauuguuuuugccagucuacccauccucagaaauaugaaaucaaugaccauauuuuucaaucauacagcauuuuuuccccauuaaauuggccacuaaauaucuccuggguuuaguugguggugggcaacuuaauuaacuuaacuuucuuaauucauuuguaaacugauuuacuauuaucugaauguaacuucauuucagggugauaaagccuuuuguuugaucuuuucugcaucacauaauacccugccccaguuagaucuuauuggcauuuuaacucaguugaauguauuuagggugugauuuuauuauauuuuagugcuguuaaugauaauuacuauuaauaaauaguaauuucuauauguauauuuaaagcagugugcuauauggcugguucucuaaaaguacacugauucugacagucuguauacugccucacauuucuauaccgugcuguauuauuaaaauucuuucucacauuugaaauuaaaauaagaaccauguuuuucaauuagucaauaccggggcgucuguuuaauauaaugaggauaauggagaaauucuagugcguacauauuuaaauauuauuaaaccauaccaaguuaagaguuuauagauuuggagaaaggagaauugacuuagugcuuaagaacacuuccuauccuuccagaggacuugaauuuggguucuagaaucuaugaugagugauuugcaacugccuguaaguccauccuuuuucugucuagauccaacacccucuuuuauuuucaaugggcgcacacaaacgcacgcacgcacgcacgcauguacaccacacacacgcacacacuuaaaucuuacugcccaaagaacauugagguugaucauuagcaaucuaucuaauuuaucuauucugugccugugggucagaagaaaacuuguaguaguugguucugucuucuuaccauguggaucucagggauuuaaacuagguuauugguuuuuauccagugauccaucucacggacucauuuugaggauuuuuuuuuuuaaaagggacucccgcaacuuuuuuuuuaucagaauuuauggguuauugcuagugucuuuuuauaauugauauuugaagauaauaaugauuaaagguuaauaugaaaggaaugagauaagaauacaaaacacaguuaaaguaaaauagaucgaacucaaaugauacuuuuagaaaacaaaaaauaaaaacauggcacuuuaccagguauugguaugacuuaaaugauuagauagucaguggaagaagaggcuauaaaauguuaaaaugccuaauugcaauguggacuaaaaagaauuagaagauaaauuggguuuauuuguugucuaaaacuaccugaucucauuguuucucugaaugccucaguauaucauuuuuauccuauauuaaacaucauacuuuuaugcaaaauagcaguucacauucuuuucaccuuacugggaauuauucauuucugguugucugauuugauacguagcaaucuuugaaaaacagagucuugacauguaacucagguuagcuuugaucuuauuggccuagucccccugucucagugccaaaguuuugggacuacagguaugagucacaauaucugguucaaaauuugugaauuuuauucucaguuuuaaaugguuacauauuaacaccaaaaaaaaaaaauaaaugaagauaagauauucacuuccuaucuagagaucaccuuugaauuuauaaaauacuuaauuauuguagauucacagauuguuucauguagucaagcuacuaugaacucaagaaauacauuauaggaauuugaauauuauuuauuaaucuuauccauaguauuaaguuaaaauauucaugguuuuuauuaauacuuuaaccuuauauuuuuguuauuucuguugucuggagacaaugacaauuacuauuaacuuauuucauaccugauguguucucauucuuucuugaaguucauuucuuaccuuuucugacauuuugaaaauucugguuuuagagugguuugagagagauuaucucaugcauaugauuuaccuuuugaaaagguaauuggaaaguuccccauauccuccuuuauuuaaaaaauaguguuggaagcuuuaaaaguuaagacuuagugauuuggccuauagcaagguaauagggaagaaauucuucacuaaaggauucuacauaguauuuguaugucauagaauccauauuugcuaauucuuugaguugguuguaacaaauagagacaguaagaaaggccuguucauuauauuuuggaacuuuucauuuagugaauuucauacucuagugucuuuguuauugguagcaaugucacaaauucuaggaugaagucuauaaauaaaguuguguucauuaccaaauauuaagccuuaugagagacaucucaauacuuggguguguguguguguauuuaagcauauauuagaaacuaugagagcauuguucugguaggauuuuuuccuacuuuuacuugcauuguauauuucuuccuucuaaauaagaauuggcucuuuaugauaguguaagauuuuguuugacuuuuuauggcuaucagaaauaugaauuaugauuuuggaaauuggaaaccauuucuuuucuuuucuuccuuuucuuuuuccuuuuuuuuuuuuuuuuugguuuugguuuugguuuuucgagacagaguuucucuguguagcccuggguguccuggaacucacucuguagaccaggcguugaacucagaaauccaccugccucugccuccugagugcugggauuaaaggcgugagccaccacugcccggcuuggaaaccauuucuuaagguuggaaaccauuucuuaagguugaaaccuuaaaccugaaaacaguauaacccuguuuuucauuggauagaacaccgcuguuccuuuugauaugaugccauugcugacugcuuucuauauguucccccgcccccauuuguagaaggcaguaucuuuucuuucuuuguuccuuuuucuacuacuugucaauuuuuacuuuacccggugauagaucaauugauuuaugugucuguuuaauaauaguuaacuucacucuaccugucaaauuuuguuuuuacauuugagauuugucugaguucgaugauauguucuacauauagaaagcagaaaaaaaugucugaaauacuuuuguauuuaugaaauauguuuggaaacuuacuaauggcuuguguauguggcaauaaguaugcccuauacagaaguguuagagcaauuacaagucucuuaagucacaauuuucuuucuuagauguuuuaagagcacaacucaguucuaauuaaaaagugacuauuaguauuuacucaugacuuaaauuuguaguuauauuugguguuaaauugcaacuuuaugaagcagucaguauaucuaacuucaccuuuuaaaaguuauguuugaaaauaacauuuuacgggcuggugagauggcucagugguuaauagcacugacuguucuuccaaaggcccagaauucaauuuccagcaacuacgugguggcucacaacgauauguaaugagaucaacauccucuuuuggugugucugaauauagcuguagugcacucauacauaaaauaaauaaaucuuuuuuaaaaaagaaaauaaaaaaauuuacaguaaaaaauuauguguguaccagcuuuauuuugauauagcuacaauguauucacucugaaaguaauuugaaaaugagaaaauuuaaaacgcguuuuacuuguaauuauguggauauagauuuuaggcuuuuagaaguuauucaguuauaaacaguaauuauuucauaagaucuuucauuuucuagaugcauuguuugacuauauauguauguauauauauguauguauguguggguauauauaugaauguacauauauguguguguguguguguguguauauauauauauauauauauauauauauauauauauauauauauauauauauacacauacauacauauauaugaauuuuccucuacauuucucuucagaauuguaguuuuuaacuaauggaccauugauucgauugcuacuuuuaauauuuuugguaauuauauaaauguaauaaugauucaugccagguuucugugcagaaucuuggaugcagauaggugaucuuuguuucaguguuucagugagaccaguaaaacugaagacuauucucuuaaagcuugguuccuuuuaguucaguucuugcuuuucuuccccagagaggaaagggauguuuucuauuaaauaauuucuuuuugcaggcuagaugagacuuagaaauacaguacagucugaaagugugauugcuaugcuguucuuucugucuagaggaaagccugcuuugcugucauacuacuuacauaucuuaaaauagacuguuuucuauugcuuugguggcauaccaaagggauguuugaagauauacaaucuguugaguagacuauagaaaagugcagaaaaucuuugagguauuacauguugaagguuuuuuuuuuuuucuuucuuucuuucuuucuuucuuucuuucuuucuuucuuucuuucuuucuuucuuucuuucuuucuuccuuccuuccuuccuuccuuccuuccuuccuucccucccucccucccucccucccucccucccucccuucuuucuuucuuucuuuuccccugccacugugcccauaguguguauauguccugagggcauuagaggcuuucaaauaaauauuugucaaguggauuaagcauuuaagauuuuguguuuguaguucuauuauaguuuagucacuuagaaguuacugaaagccuuaaaauuuaagaaaucuacaaaugcagaggcuagcuugauuuuuguauauauguagcagagguuuguaauuguauguacaauaguuauuguauucuuaucaaguaguaauuuucaaacuuuccuuuucauauacuguuagauaacugauaguuuauuauuauuaguugaagguucaaauucaccaaguucaguuuuguugcuuacauguugaaauacaauacguguggacacuuugccccuucuuagaauaggaaacaaaacacccauggaaggaguuacagagacaaaauuuggaagugugaugaaaggauggaccaucuagugauugccauauccagagauccaucccaugaucagcuuccaaacgcugacaacauugcauacacuagcaagauuuuguugaaaggacccagauauagcugucucuugugagacuaugccagggccuagcaaacacagaaguggaugcucacagucagcuauuggauggaucacaggguccccaauggaggagcuagagaaaguacccaaggagcugaagggaucugcaauccuauagguggaacaacaauaugaacuaaccaguacccccuggagcucucuagcugcauauguaucagaagauggccuagucggccaucauugagaagagagaucccuuggucuuguaaacuuuauaugccccaguacaggggaaugcuagggccaagaagugggaguggguggguaggggagugggugagggagcgugugagugacuuuugggauagcauuggaaauguaaaugaaauaaauacccaauuaaaaaauagaaauacaauacuuaauacuuggugauaguguuucucuuaaugaaaguuauuaguucucuuagggcuuacaucuaaaaguugccaucaugaauaucaguuauuuuuauauaauuugcuuagaaauaagcuuacuaaaguugauuaaaaugguuuggauuaugauuguuuauuacuuucaaugcuaaaguuuuguggcagccuggaaaauuacauaguauauauuuaugggacacuuuuucagaacuguugaaagauuugauuauuuuguuuauuuagcuuaaauuuauaccaauucuauaaugcucauuuacuuuaaauuuuuuuguaugcucaauuuuauuuugcaaaacuuuggugugagauguuaccaaauguuuugcauuuuaaaacauuugcguuaaauguugauguuaacaugaauuuuuuuaugauugcuuguacuagggcaguauaauacuacuaaacuacuaagcuuaauuucuccugaggaauuaaacaaauuguauacauacauucuaaaaggacuaaugaguuuuauacuucaugaccauucucauaaugaaagcuuaagaaccacuuuacguuaaaaaguagcuggacaguucaguuggauuuugaauacuuaaaaucuaaagccuuuucauaacuaaaaagauacacaugauaauuugauaauauugagucuugaaauuuucuauucucaccugcuucaaguaaauaacccaacgauaugauauaauauauauauauauauauauaucaauugagagcauuaaauguacaaaauaauucucauucauugguuaguaaauucuauuuguggaacauagcuucaguauuuuguuagaucugacauaccugaaaaauauuuuaagguccuuucauacaacucuuaaguuuuuaaugcauugacuuucuuuccucuuauuugcagcauuuucaguuagcuuugguugacuguaaucccugcacuuuguccaaugcugaaaguaaguacuaaauaccuuuugauacguguguucagaucauuuuguuacaaaugauaacaacacuuaaaaucauauuaacaaauucuguguaguuuuucuuccacaguuauugaggcuaacuauggguugauauggcuacuuuacacauagaauuuaggagauuaaauauuaugacuagucugucuguagcagauauguauugaaguaggcuaaacaagguugauuuuuuuuuuaaauagcuuacuaauuguaaaugacuuagagggauugcaaauaacauucguuagucauuuaguagauaugcagagguuuaugugggagcucacugauugugcucugguguuaaaauuauugaaaauacuuugacuuuauuauaauaguuucauaugucaaauacaaaguuugaggugacauuuuccaguuaauuaaagaagaaugcuguugugaaguauguucugauucagugguuuuauuuucuuuuucuauauagauuucuuuuccuguccauuuaauauacucuaaaguaacaaauuugauaauugaagagugcuuuuuagaaauuaucaauuuuuuuaaaaaaauauuucuugaaaaaucaaauaaaagaaucugacuaacaugaaaauuucaguagauguugugugucaggaaguaaccauuuugcuauaaauuguuuggguauucuuuuccauuaguuuguucuauuuccuauucuuccuuccucuucccucuuccuuccuucuuaagggaaaaguugaaagagaacaguugaaaaauauuguuguauuaaccugaauacaaagguugaagcauaaaguguugcgcuaaaggguacagauucaguacccagcuacucugucauucuguccucugacuuagacagcaguauagaaaaauguuauugacaaguaguuuuguuguaugaaaugccuaaggaaaauuuuagauugauuagugaaaaguugcagaacuuuuaauaugacauggauuaacagcaugggcaaacugcaauuguagcucuaugguagagcauugugcucccccaaaagaagucuaagguaaagugagcuuugacaaccauuucuguaggaaaaauguuucuagcaguauuuaauaauuuuauaauuugagaaacaagaucauggugaugugagacguuuuguuauggaauacaguagucuccugguauuuguuuugcuaauucugaauaaacuuagucucauguccuuuuguggcaauauuaguuuaucucaaauguaauuugguggugaaauuuuuuuauuuauuuguuuugcucuauuuuaaagaggaccuuaaagaacuuaacuguaugguuuuuugucuuguuuuguuuaauauaaagggcaacauuggacuuaguaauucuuggaauaaugagauccuuuucauuaguccauaagauugccuagaagaaauuuauagaguagcaauagagcaucaaguaguuaauauuuuguuuugauuuuccaauuacgaucacacagcaguauagaaaaauguuauuggcaagaaguuuuaguauuuuagaaggcuccgugucuucuugcuauaauagucugucucucacauaacaaggaaauaguacaacuggaauacucuguaagaacugcacuguauuaggcagagaggaguagguaaaggcccuuaaauaucuucucuauaacuuaaaacuuuaauuauuguuuuuggguuuuuuauauucuaaagauauuuuaauuuuuacuuaugugauguuuaacauagcguaauauuuuugaauuaguauguuauuuuuaaauucauuauaugcuuccuuaccuugugugauguuguuacucugguguucagccugagagaauaagcaugaagaaucacccauagaaaggaauaaaaugguagccuuccaaaccuugucccaugcugucagagucaucauuucagaaaucuauacugauaacaagucucucuuaaaacuugaucauagcuuuggaccuugugguuuauuuuuuuaaacaaauguacacaggcuauauuuauguaauuuugagaggcucugagagugcuugaaaucaauuuauaaaaucgaaaucgaaguauggagaacauaaaacaccaaaaaaaauuuuuuuaaagagaaaagggaagggagagauggaggggaaagacagagggacagagacggaaagagauagagagacacacaccaguuuuuauucuugguuugcuuucauacaugggugauagaauaucaguaaggaggagcaauaauauccaaaauauucuuuuuauuaauauuaauauaauacauaauauaauacauaaacauaaaaauauaaaucuaauagcucuuguuuuaguauguuuucuguuagauauugacuuuaauacacauuugacuuaaccucaaguacauuuugaaauguaaaauuuuguaagauuucccuauuuacuuaauguugucauuuuaaacauuauaaaguauauacucauuugccauaucuuuuuacauuaauaauuaauaacacauuuuguuugauaacuaacagugacuaauaugguuuauuauccuauuuguucuuuagugugacuguauauuuuuuauuaaaagcaaguaaaaguucuucuauuacuuaaaucuauguaauauaagccaugccuauauucuguaauguuauucuugccuaauuuuucccaaaccuugcuguacuaucagugacuuguuuuuguuuucuaucauucuuuauaguucaguuucacauugcccacuuauaugaaacccaggugaguguuuuaauuuacccaagugaaaaagaaauauacaguauucacuuauaaucauggacuaaugaaauuaaauguaugcaggaaauuucauacaauuuuggcuauuguuacauacauauacucauuaaguuuagucagaauauuguucaaucaguuaauagacaagaaacuugauauauccagagaagaaucacuuauaacuugcuuauaaacuugauuugguauuucuaguaauugcauuuacuauuucuuuugugguggugaaugcuuuaaucucuuguagaugcuaauuauaauauguuguuuuuaaaugauuuuuuuaucagucaccguguguguguguguguguguguguguguguguguguguguguguguaucugcaugaguugguguacacauguuugcaggugcccuuggauuuaugggaaguugugauccuccugauaugguacagagaacagacccauaguccucuucaagaucaauaggcacuuagccaucucuccaaacuuuuauuuauuuugauuguuuugcauuuuuuuguuuguauuuguuucuuauuacuaaaccuuuaaugaaguuaucauuguuuucuacaugauuugaggcaaaagccaacuucguguuucuugauaugaugcaaacauuuccaagcaugucacuguuuuuauauuucucguuuuugaguuuauaauaacauuuucacagcguauugucuuucuacgauauaaaucugaauauauuaguuaaaauaguucccugucuucauuaccuuagguuacaaccagucaucuuaaacugacuuagcaaggucuuuguaagcacucucugaauuuucugcucagucuucuaguauucuaagcauuugaacauuuuucuccaaaauauacuaucuauauacaacaugguguauuuucuguuucugucuuuggucuucuugcuacuuugcagccccaaccauuuccaguauguguuagaugaucaacaauaucuuuuugguugaaggaauuagguugaguaugugagcccuuauccuacuuaacuauugcauauuuaauuuuuguagacuagauaagauuaaugucuuaggauuuaguugaguucaugagcagaaguucaguuaauaaguacugauaaucuuaaugugcaguugucuaaaaugaugaucccuccugauguauauauauaaaauaguuccuuaguuauuuccaaugcuacuuauuaauuucauuugaugcuuagaaugagucaauagauggauuagacauuaccuuuuauauuuaauuuguagaugucagauaauaagguacaugauuugccuguggcucauauaaccaguuuaguauuugucccuacacuuuuuuuuuaugauuuauuugauucagacaguuaaauaguaguaguaagaagaauaaaagccacugcaaccuauuguucuaugaaauguaauuuaaaggcaguguuugcaagcuuuccacuuuuugacuuugaagguguuuuaaaccuuauuacuuuugugauaauagcuuuuggucauguuaaaacuuugcagacaguacuaaauuuaccuaugggauuugaaaauacuguaaggauugaauacuauaauuauggccgucuuaaauuuaaauuuauagauguuauaaauauuuuguaaucuuucauauucuggaaagauuauguauauaacaggauuuuacuuuuuuaucugugauuuuuauuauaguuuuuggggguguuuuauauuauuaaguuucuugggcacuugcuaagcaggcagacuauacucuuggauggagaguacucugcuguuauuaauauuaaauaaaauugaggugauuuacauuauuaaaugaguuuagaugauuuuagcuauugggaguuggcaaauacuuaaaggucauauuuuaaugauacauuguuauaguggguguuaguacuaguauuacuuacaucggaaauuggaaccugucugguguuaaaaggaaacaucaguaauagaaucagcacuuucuuacuuuaaguuaguuuuuugguuuuuuaguguaucaaagcauaguaaauauuauauaauucuuaauauuggaaugauuuuuauauuuguuuucuuuuucucuaaauuucuuuuuaugcucuuuagaggaaguaucauucugcaaaagaagcuuaugagcaacuuuugcagacagaaaaccuuucugcacaaguaaaagcaacuauuuuacaacaauuagguauguaauaaaaugauaucuuauguguucuucuguauauuuuucauaguugguaaaaaauaaucugaacccucuucuaaguauuucccaucuuagucucuauauucuaauucuuguccuuuuaaauucugaaaauucuucuuaaccauugggugagaaagcaugagaauuccucgguacgagguucauuuguaauuuauguccagugaaauuaacuaauuugccuacagucaauuagugguuuaugaacuuccuuucacggcuucaucaguauuaaucacuaaaauauuugucuuaaaauuacucaaacucuagcacacuauagguuuuauaagcacacaauccuauuuaguguaugaagauaauguaaccauuuagguuuucugauuacuaucuugaaaagagagccaagaaacccuucaauauuuaauuuuguuacuuaauuauugaaucuucccccccuauauuuuguauuugauuucuuucuuuuguuuugguuuuggucugggaaaauuaguugucaguuuuaaacuaacauuguauauauguauuuuuauaauaguuguuuaauguaauuuugaaguuaaaguuccauuuauugugauugacuauauauaaauaaugauauuaccugcugucuuguuacuuguccuuugcuaugauaaaacaccacgaccaaggcaacuuauaaaaagaaggauuuguuuugggauuguggcucuagauggguaagaauauaucacaacauggcaggaggcaggcacuuggcaggaacaacugagagcacacaucuccaaacauaaagaggauccagaaaguagaagaggaacagcagacagacacagggagcuuuugaaaccucaaaacccacucaagagacauacuuccuccagugucacaaacugggaacuaaguauucuaaugccuccuucauaccaccauacuuucauauaaaccuuuguuuuuauauuuuaauuuugucuauuagaauuuuauuugaauugucuauauuuuuaagaauuacaagaguaucaaaaugccuuuagugaacuacaguguuugaguaaugugaauuuuuaucauuaaauuuaaacauauugcuaguauagugaaaaaguuuuugcguuuuaacuuggaaaaacacgugugaugcuuucaaaguuauuugccucucaacuaaugcaugcauauaaauguuuucccaugcauuuuuagcuucuuagaagaauauauguauauccuuccuaucuaccaaucuaauuacuaucuaucuaauaaacacacacauacacauacacacauauuuuuaagaaacagauuggaauauugugguuuuauuuuguuugguuccucagucaccugacuuuccacaguguuuuguuaaauuucagaauauaaaaguaaacucaugacuuuguguaauugugucugcuucauagcaaauugcuuucuauuucuggaccaguuccuauuagaggccauuucuuuagaucuugguuucaaaaaaacacacacaaaaaaacaaacaaacaaaaaaacaacuuauggggguagaggaccuguggcuaucagaaaggcacccacaccuuucauucuuguuuucucucggggauugaauuuauguauucagguuuguacaacaaacaguuuugacuggugagacacgucuucucccccaucccgcaccgccccccuccccagccaaucuuguucuuacuaguaauaggaggagaugggaaguguaguuugauuuagaauacaauauuucaugauguguuauuguucuuauuauuuuuugcuucauuaacuacuaaguuguuuuguuuuguuuuguuuuccaauuacgugguuguuuugcuugcauuuauguuggugugccaagagcauaucuagugcccuccaaggccagaagaguugccuuuaaucgcagcauucaggaggcaguagcagauagaucucugaguuuaaggccaucuuaguuuacaaaccaaacaauuuuaaauaguaguaagcauuagaucuccuggaauuagagauucagaagauuguaaaccaccaugugguacuggggauugaagguagauuuucucaaaaccaaacaaacucacagcccaguguucuuaacuaaugagccaccuccauauucauauucuuagaaaaguuuauuacuuuuaacauuugaauaggucuuaguucuauuuuucaaaguucaguauucuagucuauauuuuacauacagugugaauuauguuuaaggagaugggauugugucuguauguuaauugaacuaucauuacuuauuuauuccuugaaaauaaauacugaguuaauagaaugucuuggaaauucuuugcacuuauauuuuaugugaaacaguauguaugauguuucuaucuucuuuguauaagaacaugacugcuaauagccaauacagucuuguuauuuauaauuuugaucaauuauauguacauuuaaaguggauauguuugauuagugguagauuuuuggaguuaucuaguguuuguaaucuacuacguguuaaguaauuguuuuuaaacacuuuaauuucucugaaacauuguucaucuauuuaguauuacguuccuaugaaaaaacuuuauuauaagaauuaauaauucuaaaauaccaaaauguauauucucaaauauaucaauaauacauuaauaagaaugguuauuuuuauuaaauuuuugcuuuguguucuuaaaaauagaauucuuauauaauguuuauuaauguuuuaaagguuggaugcaucacacuguggaucuccugggagauaaggccaccaaggaaaguuaugcuauucaguaucuccagaaguccuuggaagcagauccaaauucuggccaguccugguauuuccuuggaaggugagacuuaaccagauaauuauauucuguuauuuauaguccuaauagcuacgagauuuaauuucaacaucaaauguuacuuuacguuuuuacuuugaacaguauuuuuuuuucuuaauagauuauaauaaagauuccugaaaggcaaaugauaaaaauaaauuuuaaguacagaaguuuucucauaaccuuaucuuaagagaacauuuucuaguuucaugaaccugaauugcuauuaguuucuuuaaaagauccuuuacuauuuuuugaaaaaagauacuacuuuuuucagugaauuacuuauauacucuaccucauguaauuccuagcauuugaauaauaguagaccucaagucacacuugaaaucuucuauuuuuuaagaaagugaguaaguuauuguugaacugucuggagagagacauugucagaauuuuguucaggaguuauuugauauacgcuauauauguauuugauaaauuguccuaauccauuuugccguucaccauauaguggaaaacucauuauacuaggcaccaaaagacucaaauuuaaguaagggcuuaguuagguuuuguagaauuguggaugacauacauacauacacacacacacacacacacacacacacacagaaacacacacacaaucacccuuuugaugcuucaauuuucuccucuacuuuuuccucauuuuuacuuugagaaggaaauuuuacaggguguuuugaucauauuuacccuucucucaacgccucaggaucccccucccccuuuuacuuacccagucauccccaauucugcugcuuuacacucuucacaaacacccuaccauuagugauuccugagcucugaaaagggaauguauagcauaaaugccccauuuaggacuggguauuuucauucucuuagacucuguacuuggaccacuugaggguaucuguuaaucaucaucuacuguaaauagaagcuucucuaaugacgguugagaggugagaugucuauaguuauaacaagcuauuaagaaucaguuuaaagccggccaguggugacgcgcaccuuuaaucccaaaacuugggaggcagaggcaggcagauuucugaguucgaggccagccuggucuacaaagugaguuccagggcaggcagggcuauacagagaaacccugucuuggaacgccccccccccaaaaaaaaaaaccccaaaaaacaaaaucaaagaaucaguuuaauacuauguccauuuagcaaaguaauaguaauagguucuuuccuaggacuauagccugucuagucacagguucuuggccacaauaguggugcuggguaugaguuccaugcuguagcuuaagucuauaauuagaaagugguugguuauucccaauauguucaugccacuguuacacaaaugggcauaucuuuacaggccaacuguuauucuagcuugcaacguucacagcuguguggaguugauaauugcuuuucuccuccaguagcauggcaucuucaaguuuauaguucaguaccagcuugguaucuccuauguuuuaugauuccagugugugcuaucuuuuauaaggggguugcacuaaauuaaugguucuugggagacaagggaaaguguuacagaaugcuacuggcaccucaugggaggaaacuagggauucugcuaaaaaagauauuuaaaaacaaaagagucuucaaauguacaggacagccagcccuuuauaacaauuacuugccugcaaaauagaugaucuguuguauacauuccugcuucaaagcuuauuuucuuaaauuucccuugaauucuaguuuuauaagauuaguuuauaaugaaucauaucuagaauuacuguuuuaaaaugcagugauuuuuuuuucagcuucauuaagcaguauuucauauuuuuuucuuucccucagugaacuaauuguguauucugaaccacugagauaucuuaaacuuuuucagguagacauuaaauuuuccugacuucucaaacaaggaauaauuaucacaaucuaacuuguuuuaugguugaagaugaucauuucagacaguaauuauucuucaucuaucauaguauucuagguguguuuuaaacuuuugaugcuuucucauagucacuaccauguaaugcucugcuuuuaucaugagaaaugcuuaugaauagaaaauacuuuaaaguuuguuuuccuaucuuuguccuuugcuuuuguuccaauuugaucuuauuuacugaccucuugucacaaauucuuuuucaguauaacaguuuuugcagguaguauuugaaacuugcuucucugcuuugucaguaaaauuaucugauucugucuuaucuaugauaguaaugccuuaggccuguuuucuacugcucucuaauggaugugcuguguucuuucagcuuuuuuucauauagauaaauuucaaagguagauuucuauagagcuauuuuaaauuuugauguuucucuaauagccuuaccucuuacucauauacuccaaaucagcuucauaaaaccauccucuuuuuuugaggagagggguccuaggcuaauauaucguaaccaaauacuuuacuacugcuguuaaguuauccuucuagcuucucccuucucccuuuauuuacucucagacgaucaugaagucugggcuacucuuuugguuuuugguucgcucccuuuuucuuuugcuuuuucugcuuccauuccuuucaucucagcuuugacucauuccaaaccagugaauauaaccauuuuuuucugugcauaacuuuacuuuuagucuguacuauacauuguuggcaggugaauauucuugugcuuuuaucacagccauucccauuguuauggaaacugauuucaaaguuuuguggugggggugggaucuuaaagucugugagugccgauguguaugauuauguugcacacgcauguacauauguauauauauauauuuaaaaaauacauuaggauuuguccauacuguucaaauauauuugcguauuuccccucauuuucuaugucaauaacacuuguaaaguauauaucagugaaauuucaaagaauaacuggggauaaaaauaguuucugaacaaauaaagauuuucagauuuuuuuguuuuuguugguuacucuaaaccaggaaucucccaaacauaagcaaauaauaagacaaauauaaguuuguuggaaagcuauccuuaccucaucuuuuuaccuuuuucuaauucugagugaauuguagucucuucuuaaacugucuauuagccauuugauauggcauugcgauauuuacaguaccuucaauccucaugucuauugaaaauucccuagguguguuagaguauacuuuuaauuuuaacacucaggacgcagggucagguagaccuuugaguucuaggccagccagggagggcuacaaagcaagacccugguuggggguacaaaagacaaaggaaaauaauuauauuuuaagcuccuucaagacaaaacuuaugguccuguuuucuuuuucuuuuagcacaaaacauauaauuucugucuuaguuauuucaaugauguuuguauuagguacauacucuuuaaaacauggcaggcauuaaaccugaaucucauaaaauaauacuauagucauaaaauaauacauacuauacuguuugugaugcucagagacaaaccauuacauuagcaucuuuauaaauuaaauaauguuugcccuuugcuguuauuuaagcaaagaaaauuuauuaggucuuacuuaaaaacauguaauuucggguuuuugaacgcuauauucugacuaugaaaaacuagaugucaaaauguaaaagcagagcauucaugggcuauguccaacucuuaguauuauaauaucauugugaaauggccuauacuuauuuuaauagacuuuaucaaugcaguauacuuuagcaccucuaagaaagauuauaguacaguuuugaauugcuaguuauuguguguauuguaauuuucuugcgcauaugcacacaugugccuaaauauauuaacauuuuuaaaaaacuugcuuugauacauaacccuuuuuaagcaaauguaauuuguuuugguauugauggaauuuucuuacccucccccuucccucucccucuuaggugcuauucaaguauugggaaaguucaggaugccuuuauaucuuacaggcaaucuauugauaaaucagaagcaagugcagauacaugguguucaauaggguaagacugucuaaaauuaaugauauuggugugcaaagaugacugcaucacauaaaauacauuguaaugaaaaucaugcuauaaaacuaaccaguuuuuagcucacuuauuuuucuuaauuucucuuuucagugugcucuaucaacagcaaaaucagccuauggaugcuuugcaagcuuauauuugugcuguacaauuggaccacggucaugcugcagccuggauggaucuaggcacucucuaugaauccugcaaccaaccucaggaugcuauuaaaugcuauuuaaaugcaacuagaagcaaaaauuguaguaauaccucuggacuugcagcacgaauuaaguauuuacagguaaaaauuuuaaauaccaauuuuuuuaaaagccacauauuucccuagaacacccaggcaggaauagguuggcuggaaaauuugucuaguuauaucuggaugucuauauauaauauguuucuauauuuuguaaauauaccauagguuguaguauuauuuuacuuuuuauuuuaagugagauaagcaaucuuguuuaaaaugcucuuuugcacauugaugcauauuaauuugccuaaguuuuuuucaguguacucucuacaugcuuaaguugucauagcauuuuaaggaaaagaacacaaacacugucuuucacuuuugcuugaaguuucacgagaagacagcuaaugagaacccuggaagcagcuuagcuauguuuugauucucacaaagguuuauauucugguuacccucuuuauacuuauuaucuuucuaaagccccaaauuuagaaucuauuuucuuuuaaaaacaauaagcuauagccuuuaggaagauuuaguggacuugcucuuacucaaguaggcuuguguuaaauuugcuuuuuacauaauuuuuccuaggcucaguuguguaaccuuccacaagguagucuacagaauaaaacuaaauuacuuccuaguauugaggaggcauggagccuaccaauccccgcagagcuuaccuccaggcagggugccaugaacacagcacagcaggugagaaguuggguuauguucugcaagugcccagcuuuaaggguucuuuucaaucuguaguagucaagcuuauuuuaaguaagcauagaaggcuuaauuaauaauagccuuuucauuuaagugcuaagggaaucuagaucaaaauaaaauucccucugauaugggaauaaauuuggggguaccaacuuagaaccuuugugcauuuucauguuuuugcaacauuucuuaaaauaaugcugcagugguuuauuuaauuuuuuuaaagaagauuuucaaaggaagguacacauuccuccauugaugaugacucagugauuuuugacuuucaauaauugcaauuagagauguccacaugauguugaaaaugaaaaguaugcagcuuguaacuuuuauaauuugaaggaaugaauuaagaauauauagcacccuauuuuugucuuccuucugugauucuuaggcauguaaaccucaucauccaaauacugaaccuguauuaggccucagucaaacaccaauuucacagcaguccuugccacuacacaugauuccuccuagccaaguagaugaccuguccaguccugccaagaggaaaagaacaucuaguccaacaaagguauauguccuagagaaauagaaaaucccagucaaaaaaagaaguuccaacugcccuguaauugugcaguuucaacauuucccguccuuuacuuuaaaucuguggacaucagaagaguaagguuugaguuuucccaucccgaacucuuagaaucauauuaaauaagguaggaauaaccuugcauucaucaaaucauuuuauccauuucccugccguuuagguaucagcacacuucaucaucacuuuugagcaacauuaaaauauauuuaauauggaaucuaguggacaguaugguauauaggcuagcaguuugggccauaguuuaggggugggcuuuuugggguggcuuauuaaagaaucaauauuuuuuaaauuaugaauauuaaguuuaauguauaucuaaauuuuuaaagaaaguaauaauaaacauuauauauaauuacuccaaaucucauagucauuuagacuucauuagucauuaauuaauguuaaguauuuugucuuaaacaaauauucuuuaauguuucuuuuuaucaauuuuccucagaauacuucugauaauuggagugguggcaaugcaccaccuccaguagaacaacaaacucauucaugguguuugacaccacagaaauuacagguauguaaauuauuuuuuaagaaguuuuaguuaaaguuaaauggaaggaaaccugguacaugaugcguguacauuauaaugaagauaauucagucucuuuuucccacuuguuucuacuuugauuuuggaacaaauuauacauguagaugcauaaaguaugaauauagauuauauaggauaaagccuucuuucagcuucugcucuuaauucacugaugucuccugacaguuuucuggcuuugcuugcuucuuaccugucuuagcagagcggugugguauauucacucaaguauuucacuuaaguaauuugacuuaaguauagucauucaugguccagaaauauuaaaugaaaaauuucagacaaaacaaaaccccauggugacuucuaaauuauaagguucugcuggcauaguggaaucccauucuaucucaccggagacaucaaucaucucauuguucaguguauucaggcuguuauaugcuaagugaugcuuaaucacuuaguagccuucucauugucaaaacaacuguuucaguaucaugauucauauauuaauaaugaccacaaaccacaaaaacaaugauucugacaauuguaguauaucaaacagaagccacacauugcuuccucuaagugaacauguaaaaaguucuuuuaaaaaugcacaaaauaucauauacuaaguuugcuaagaucuaugauaaggauuacucuuuuaccuuaaguuguaaauaaagagaauuuuauacuaguuuuacugucacaccuaauaccguacuggcuauggcuucuguauguagugguguuaggacuggaagggcauuaaauuguggguuuaguuuuucugugauuuuugaaauucacuaggggaucuuaaaaggugccuccuuuacauaagggggucuacuguaaacuuuuaauguuccuuuucaggucaauauauaaacagacuacuuguuauauuaaaaaaaucauauuucuuuauauagauauuuuauuaacuuaaacuugcuuaaguugaucacuaguuuuagacagugucuucagacuuuuccuguuucagacaaugcuuuuuggagcauauuuaucaugucuuuuaagcuuaaagagcuuucuaccuaaacaccaaaaauuacuguauuaguaaaacuucaugcucauuucucucaaagaucaccuuaaaauaaacuauguugagaugaaugcuuaguguucuuauucugguuucuuaaacuauaaaaagacuuagauugaauuagguuauuguugaucugcaguguuuaaccuuaauagugguuuugaguuuuucuaauuauucagauaaagauuuaacagauuuguuagcuucuuuuuagaucugucuuuaauuauauucucccuuucccccccucagcacuuggaacagcuccgagcaaacagaaauaauuuaaauccagcacagaaacuaaugcuggaacagcuggaaagucaguuugucuuaaugcagcaacaccaaguguguauaacauuuucccucuauaauuugauacaguuuuguguacuuuuauugacuguagcaucauuguagaauucacucauacucaugucuauuuauauuugguagaacuuugugaucuauacuuucuaaacuacuaggaguuuuuaagaaaagcauagcuauuuaauuuuaaacacuauuuuauuauuuaauuccaugguauuucauauauauuuuuuaguacuuaguaauucuacacuaaaccuagguaagguuuuauacucaucuuuaguuuagaggauuugucauauuacaaguuuucugguuuuauuuauuuuauuuguuggcggguggggcacuuaagguugaacacagggccuuauucaugcuacaggagccuacuaccaccaccacuaaucucuaauuucccauuccccucuucaccuccucccuaccuucacucccuccuucauacacauaagggaacucuaaguucccugaguugaucuuggaaauugagaaccuuuugucucagcuuccuaaguagcugggauggcaguccuucccuacuagacccaccuuagaauuaagaguuugagguuccuugaagaacuaugaauuccagaauuuuucauaaguuucagcugcuuuuuuuuucuuuuaguaauuaguaacuagauguuuccuuaacgugaaauuuauuucugcuuuucguagguagcuugccauauuaauaaauaguuucuuguguuugaaguuggcaucagaucagagauccaugauuauucaucuuuacaugcugauaugcugauucucuccucuguggacuacacacauugaauuuauaugcuuuucauuuguucccugcagaugagacaaacaggaguugcacagguacggccuacuggaauucuuaaugggccaacaguugacucaucacugccuacaaacucaguuucuggccagcagccacagcuuccucugaccagaaugccuagugucucucagccuggaguccacacugccuguccuaggcagacuuuggccaauggacccuuuucugcaggccauguucccuguagcacaucaagaacacugggaaguacagacacuguuuugauaggcaauaaucauguaacaggaaguggaaguaauggaaacgugccuuaccugcagcgaaacgcacccacucuaccucauaaccgcacaaaccugaccagcagcacagaggagccguggaaaaaccaacuaucuaacuccacucagguaacaagacuagcugcuuagguugacuucucacacaguaguucguguuuauuuuguuuauguaugguaaguguuugaacaauuguuuuuauaugaaucauauaguccuacaauguuguugcuguguuucaauucaguauacauguauauacuuucuguccuggauaauuuccgcagauagacaaucuggaagauuuaccaaugaagaaaacaaacaauauuuuuuaaaccccaagacgauuucuaacuuauacuggccccagaagcaaaaugccuaauuuuauaguaguaguagauaguggucaacaucugaguauagacagaaugagucgaagagaauaaaaugccaaaauggaguaugggagugaagaguuccauuuuaagcugucuugaaaagcuagaacaguaguuggggaaggucacaaaaggguggaagcagauugggaaaagaauucaaaauugagucacaauguccaauuugccaugcagggaauuaaagaacuaacaagacaagaguaaaggauuaaggugugagguauugggcauugaugagaacauaaaccauaucuugucuuucaagaaugauauaucaaaguuauauuaaauaaugcuguuagauccaugucuuaaaucagagaagaagcacugugaccauacaguuuuuauagaagaaagcauuucauugaguuuugcauaguuucagaggauguauuccauuaucaucauggcagggagcauggcagcacacuggcagacauggugcugaaaagaguucuaaggauucacaggcagcagaaagagggagacucuaggcuuggaguaagcuuugaaaccucacagcccacagcuccuaauucuuucaaacagugcuaugcauuuaaaucuccaaggcuacagaagccauucuuauucaaaccaccacaaucuaguaaggugaucuagaaauugaucacccaaggugauauuucuggcguucagaaaucaguggaugcaggcaaacucuacaccacaaccuaugguguacauuucucugcuugcccuccuucuuucuaguaguauggaccuaagggugguguuucuuuguugcaguuuuaaaggguaggagaaaaauaaauacugcauuacaccaaauguguagcgaaguccaaauauuugcuguuugacuguauacagggaugauuuggaaacuuuugaauagaauuaguuucacuggguuguuacaaguugaagcccaagaugaaaggauagauaaaacuggagguagcaaguauagacuguucccaugggucaucugcagucauguagguuguacagauaagggauaguauagcuaaaggagaaguagaguuuagaauuugguuuuguucguauuuuaaauuaaaaugagaaauaagcuaaugggaaacauucaguagaaagauugauaaaauagaggaaaaaauuguuauuugagaugauguguuuugggaauucaguaucuuuaaacauuauuuguuaagaugccuauuaagguucuaaaguauaauugacuguuauauaagugagagcauuuguuaugauugugaagaauaguucucuuauuuuucuucccuucuaaauccuagguuugcuuaacugcugauauuuucaaaaauacucaauccuauuuuagaaaucugauaacauuaaaacaaaaaaucuuagcucauccuaaccuggcauucaggaagcugaugcaggaagaauucaaguucaggguauccaugacuaugacauagccagauuuugucucagggaaacaaauacuuuacccuaccacaaugauuuugcaggacacagccuucuguaccugcuaaauggcaaggaacccuagucccucauggccacuaccuaggagccuuacaauauaguuauaaugaaguaagaaaauugucuaaaaauauuaaacuaauuucgggucaaauuuuucccucaugaggucgcuuuauaauacugcagcuggaaagccccuaauagucauguaauuuuuauucuuuaacuuacugccaaauuaaaucuuuuuucaaaaaagcuuucaacucagcuacaacaaguuuuaaacuaucaaauuaguucccaauuccaggguucaauauggcugagaaauucgcauucuuauucaauuauuuugucaguaaaacgaaaugaaaauugugauuccaggggggcaauuuucagguaaaaauuauucgucuuaguucuacuuauuuuuauuuuacuagauguauuaagugaccuuccucuggacuuaaaacuuuccuuaccuauaguauaguaucuauccuggcagauauuuuccuaaauguuuauacucaguugaugaaaaaaaaaugcagcuuuuuauaagucauuaguagagacuuaaaauguauauuucuguacacauauaaauaaaauaugggguuuacugagugaggaagcuuuuuaguagagucuuaaguauuuuagaaacuuugcucuagaggauaguuacuuuagugguaauugaauuagggaugaauauauuuacuuuuacauuuaaagauaaaauuaauuugcuuucuauauuaaucucuuaauagauuacagaugcauuauuugguuuaucauauccauagauuaauuauuaaugauauuauaugucuauccauauuugaguuuagaaaugaaaaucccuguuuuaaaacuuaauuuagaguucucugugcuuucuguaaacuaauguaugccauacuaauuagggaaauucuuuuagcuaacuaaaaguacuuuuuugacaaauuuggaaauugggucaaauuauaaagauacuuauuuuuuaguggcuuuuacauuuaauauuuaaaauuuugaguaugcucucaguuuaacauaagauuuaaaccauccuuuuuuucuuuuuaggggcuucacaaagguccgaguucacauuuggcagguccuaauggugaacgaccucuaucuuccacugggccuucccagcaucuccaggcagcuggcucugguauucagaaucagaauggacaucccacccugccuagcaauucaguaacacagggggcugcucucaaucaccucuccucucacacugcuaccucagguggacaacaaggcauuaccuuaaccaaagagagcaagccuucaggaaacacauugacggugccugaaacaagcaggcaaacuggagagacaccuaacagcacugccaguguugagggacuuccuaaucauguccaucaggugauggcagaugcuguuugcaguccuagccauggagauucuaagucaccagguuuacuaaguucagacaauccucagcucucugccuuguugaugggaaaagcuaauaacaauguggguccuggaaccugugacaaagucaauaacauccacccaacuguccauacaaagacugauaauucuguugccucuucaccaucuucagccauuuccacagcaacaccuucuccuaaguccacugaacagacaaccacaaacaguguuaccagccuuaacagcccucacagugggcugcacacaauuaauggagaaggaauggaagaaucucagagccccauuaaaacagaucugcuucuaguuagccacagaccuaguccucagaucauaccaucaaugucuguguccauauaucccagcucagcagaaguucugaaagcuugcagguuaguguggcaaaauuaaucacagagugaaguguuugacgauuugucugaucaagaucugggaaauaaaagauaguguaaucagucauccaaaguaaaaguuugaacagagcuugguaaugcuugaauguugugcuuguacuuacugaugauugugcaauaugucugaacgugcuguuacugcccucuacugguuacuacaguuguuggcuucagugugguugacugcucuggggaugaaaacgagacucaaucacauuuggcuaaaaaucaaggccuagaaaagccuauuugcuugauuuugaacaaagucuguuaaagguuagacuagggauagaccucagcaaucgcccagguaagucucuguuuacaauucauuugauucuagaagagcuuauaaagagauaggaaaaguaagggacaauggagaguuaaaacagacugcuagguuuuugugaaagaaaaagcauauuuguuuuaguuuuugaaggauaaacccucucaaacacuuagagggauaauaaguguucuguuuagaacaaaaacgucaucaucaaaggaucagucugauuagauugcaucaucuuucaguaauauuugaaggauagagauuaauggucuuuucauuguacauguuucgucuaauuuuuaaucauugguuuguauuugucauccccuauguauaaauaaaucauggauguaagcaguuaacaucacuuggaauagucacaaagaauucugcauaguuuucuagcauugaauuuuaaguuuaagcaguguuauacauuuuugaaggccuuuguuugguugcuggguuuaaucaacagaaaauaacuauucuauaaauaggaaauuuaagcauugggucaguuaaauuggcuauuuaauauaacaauuucauuuuaaaguuggaaacaguucacaucuaucaguucuaguaugucuuaucaucuagaaauauuaucuuuugcuauuuacauugcuuuauuagaacauguccucaaccuaccauuaauuguuuauaugaaauuaaacuuuauuuuauagaguuugcuacuuauuuggagcaugggauaggacuggcauagggagaagaauucauuuaaaauaaauuaaaauuaaucuuaauaucacuuuaauuguaguacugaaacuuuaauauacuaaaguuuaaccagaaauuaugucuguuuuuuauuauuuucuuuguugauccaaccuugcugggaucauuuuccucaauggccuguaacauggcaacagcugccauuaaucuuaacuauuuuuuuggauggggugaggcauaagcaggcucucuguagccuugaguucacuaugcagaccaagcugcccugccucuuaccucugccuccuuagugcugggauuaaaggugugcaucaccacaucuacccagucuuaaauuaaugugauuuuuuuuucauguuggcauuuaauauauaucuaaauuaaauuuuuuaaaacauacuguaagaucacuuaauuucuaaaauuuguuucuuuagaaaauuuuaauuuaggggacauuaaccucuuuuugucuuuaaguuacuaucauucauuucaacauugaaccccuuuaagugucuagguuaacagccauagcggacugagaugcaguuaccuugauacauuccacuauucuugucuucuaucugccugccucugccuuggcuaaucuggucuuuacucuccuuuccuaguuuugcuucuauucaguuaaagcaggggcucaauaccucauccagucuuuguagacucaagacauuugcuuuaaaaacaaaaugagaaaccgagaugucauaaaaauugcuuacuggagguagauucuagagcuauauuaugucccaaaaguuauaagcaauguggaaaggcuuuuuuuguuguuguuguuaauaaaauuuugugcuauggaguggcuaguuacuauauuucuuaaugucuuaugaaagauacucuuccaucucauuuuugaggacauuuggacauucacuugaguacauccucauaguuuuauguuaaacuuacaaaggucauuuugcuucauuauagacacuuaaauagcuaaacgcaccaaaacuuuuaucagucucuggaguggacuugggcuguuuaaaccaaucuaggcauuaucuuaaugaagaggcaggaaaucacuuguguaaguuggagacaaaucuucugaagcuuagagcaaaagggucuugagauuacaaguagugggguguuugguugauacuagcuuaugccagaacucaggugaaaguaacccagguacaguuuaggggcuuuuuaacaaaagauuuuuuuuuuaaagguccuuuuacucagaacacuuucuuuucauuucuguacuaaauaugguuacuucagaaugggaaaaagaacgauuuaagaugacauaguuucuaaauucucucuguaaccaucuuauuccauaacuuuucuuccuuuucucucuacuuugggcuauuuugauaaaguuuuauuaucuggccugugguauucuaaaacuguucagaaaauagcauauguacccugcaucugucugcagcauuaagauugauaaguaaauguuuauagucucuuaaauagaugauuauaugugucaguuauuucagagaaauuucugucuguuucggacuugauuuuugcaagcagauuuuuaagacacaguaaaaaacugcuaauaugacuauuugcaauuuuucuugguugagcuaauguaccaaccuugaauggaaaagauucugauaauugaaaggaaauuagaauucauacuuguucuucagauaaagaaaucauaaacaaaauagggaauuuuuuuuuauguucaacauauugugcuuuuaguuuucuucaguggaagauccaggaaucaaaauaaguauuugcaggaagaauuuuguuguucugcuagauucaaaauucacggaguuaugaaacugucuauuauaacuuaauucagaauuguuuucugccuucuauguaaauauaauacugauuuuucuuuucuuuccuguuauuuuuaaaggaaucuagguaaaaacggccugucuaauaguagcauucuguuggauaaauguccgccuccaagaccaccauccucaccauacccucccuugccaaaggacaaguugaauccaccuacaccuaguauuuaugugagucugaauuagcuagaaaucauccaaguuaguguuuucuucuauaugucuuuuguaaaaaucuuuuaggacaauauauuacagauacuggcagcaaugugacaauuuggcaacaaaaagauauauucaaagauauuuugugauauuuugcaaguaccuuuuuaauuguugguuauauuacaaauuuauuguuguuuugucuuguuuuuguugugcuggagacugaaccuaguacuuugcacauucugggcauguguuuuauaacauugcuacuauucccauaguuccucuguauaagguauauuagaauaggugaaaauauuuucacugccuuaauuuuuagcauuguaggucagaauggggucccaugucuggcauccggcccuccacagggccagagccacucauggaggcagacacaggaccccacgccaaggccucuaccagguaggugggugguaagcugugagaagccgcaggaucccacuuucagggguggggaaggcacauucugaggucccaguagaacugcugggagcugcuggcucaggggucugggcuugcacagaggcugagauuggcagguucuuacucuugggcacugcagacgccucugaaugccgcagaagagcugagaacagauugugggccugcaugcgggcucuggcccugggccaaagggaaaggggcaggagggaugcucuggcugguuaccacaaggacauaaagaguccuuaggcgggcaccuuggauugaugggagcugugucugggagugcagggaggccuguggcaggagguuagacgcacagcucuccagaagaccaccugcuccauugcuccagcaaugaugagaagagacaggccaugguuuuaagguguuuauuguagaaaggcagagagagggagauaguacggaaguagagcccggcuauggcuagauggggaagagauggaaagcaagagggcaagagugagagaggcaggaccaagagaguaagagaaacaagagaauaagaaagagaugagggggcaaauagccccuuuuguugugggcugggccuacguggauuugccagguaacuguggggaggagcauaccuggauguugccaaguaacugugggaauguagucuagacagaauaccagaagccuggggcauugccuacauggcugauggauacacaccucuggggggcugggggccuguggcugugggaggcuguagcugcaacaggcaccaggggcucagggggcauggcugaacaccugccaucccucaucggcggaagucacuaucuaccggucaccgggauucaaggccugugcucgacccggaaccagguugucugugcacagcucacagagcaguauuaaacaaaagcuacuuggaacuauuuaacauuuuuguuuuuaaguaaacugaguuuuaaaucuaucaauuuuaugggccuuaauauucacucuguuuuguacacaugcuaaaagaaauaccuucaauggcagaaaagaaaaaaggauguuuuaagaauguggucuuuggagcuggagagauggcuaagcaguuaagagcauuuguugcucuugcagaagauccagauucaguuaccugugcucacaugaccauccauaacuccaguugcccuugucuggccuccauggguaccaggcacaugcaugguauacaugcauauaggcaaaacacucauuuacauaaaauaauuuuuuaagcuagcaugucuauaaaagaaagaauaugauuguagauggauacauguuacaaauaucuuuauaagguuuuuuuuuuuagcauauuuaaaacuaucaguuuuaucucauagaaauuuaggcaucuggucugaagaauugaauaaaagcaauucuuuuuuuuuuuauuuguuuuguuuuguuuggggguucgggguugguuuuguucgagacaggguuucucgguguagcccuggcuguccuggaacucacguuguagaccaggcuggccuugaacucagaaauccaucugccucugccucugccucccaaguacugggauuaaaggcgugugccaccaccgcccggcaauaaaagcaauucuuaauuguguuuuucacaaauaaauccugauaccacuuuauuaacuuauuccaagaaaaaaauuagauauguauaaacuuaugguaauauacuucggauggucuuacaacuaugaaaaugaaucuugucuuugagaaauuuugauuucuucacucaauuuuuaagcaugugacaaaagucuccaucucaacucuuugugaauauauaguuaagaaguauuaaacauacucuuguuauacaacuuauuaugaaaacuuauauacuuugccagagugucuacccauugaauaucuuuuccccaucugcuuaagucauaauucuguuuucaugaauuucacuacuuuauauauggaaucaaauuuccuuaugacuagcguauuucauuuaucauguccucaagguucauccauguuacagcauuugacaggauaaccagucaguuaauuuggugguauuagacucugcauuuugcacauauuaaugaaaauauucuaccaucaagcugucuuuucccucacuaacucuucauuuguugcuuauuuuuccccugcuagggguaaaaccuagggucuuuugcuugcuagucaaguauucugccauugagcuauauacuccauucuuuagcuaucuucuaaucuugccugauacuguagauauuuacguaccuacaggaauaauguugcaucaagaacauauguuaucauuuagaauuuuuuaagauuuauuuuucuuauuuucaauuacaaauauggaauuagauacaugugagaguagguggacccuggagccggaguuauggguaguugugagccacaggacuaggaaucaaaaucugauccuuccucuacaagaacaguaagugcuuauauccacugaaccauagcuccaggccaauaugaucuuauuuuuggucaagaggacucacucugucacucuagcuagccugaaauucagagaggcccacuucugccuccagaguacugugauuacagugacugccaccauuuccagcuucuauaucacguuuucuaacuuuuaaaauuuugugguuuuuuucaauauggguaguauuggaaauaaaacuuaagagcccccugacuguucagauaaacauucuaccauggacuuagaacccagcccauauuuggugaucuuacucucuguggaggccauugaggccaagcaaacucuaccacugagcuguucuuucuacucaguaauccucacuuuggucuugaaguuuaaauguaauuucagcuaccuaauuuguucaacauauaguacacaaaaauguauugguugcuacuuagucacaguuaaaaucaaaguguaaaaauacuagaaaauagaaaaauaugaaugcaugaaauaaaguagcuauauaggaaauaaauauaaggcauaauauuuaaguuaaaaagcuguauuuuccuaagauauaaccauauauuuuaacuuuacaguuggaaaauaaacgugaugcuuucuuuccuccauuacaucaauuuuguacaaacccaaacaacccuguuacaguaauacguggccuugcuggagcucuuaaauuagguaugcuuuuaaguaaaaagaaaaauguuuucuauauaugcugucuuuuaaccuuuuaaagcaccaguaaagaagucugguacacccccccacccucccaccccuccuccaaucaccacucacacauccacuuauuuucuuuuuaauauggauggggaauuuugauuauuuuuacuuugaguccaugauuugaaucuauaauggucauaguguuaguugcuggcaauuuaggauuaguuuuuuuauuuagccuuuauuuuuaucuaaugacugauguugaacagcuaugagaauuuugaauauaaaguguaaguacucaucaaguacuguacuauagccccauuaguauuugcuagcaccuacaaaaauuaaguaugugaaaguuuaaccauuggacucgacucauucucuauuugaauaucaugagcauuaggacaaaguaagccuucaaaguauauaaaugaccugguugguuuuuaggagaaauggauauagugccauaaaaugcuucgucuuugaaagaaaaggcagaaguggggugcauuuuuguuuuguuuuuacugacuuguuuuuuuuuuuuauuuauggcuuacuuauaaagacuugggacuuuucucuacuaaaacuuugguggaagcuaacaaugaacauaugguagaagugaggacacaguuguuacaaccagcagaugaaaauugggacccuacuggaaccaagaaaaucuggcacugugaaaguaauagaucucauacuacaauugcuaaauaugcucaguaccaggccuccucauuccaagaaucauugagaguaaguauuuacuuccuagagauuauuuuuagacauuuaaaaauuauuucauuuuguagcuuugaaagaagacauuacuuuuguaaauaucagauuauauuacauuaaauaccuuguaagugcuuuaaacaaaccuaugaguugauucaguaaauaauuuguagagagggaauuacuaucuaggaaaauguuuccuagguuaucugagguauuuaugauuaaagcaagguuucuucaguacuauugacauuuuggguugaaaaauucuuuguuguggggcuauuuagcagcauccaugucuucucuaaagcauuuuagaccuggcaaauauuuccuggaaaacaaaguuguccccucuugaaucacugauuuggagccuauaucugucuugaguuugcuuuaugcuuauucuuauaugcuugcauuuucuuuucuucugccaguuuaauauuaccagguaggcaacccuuugaggaaguauuaguguucuuccuuccagucauauaaaaaaaaagugcugaggaagagguagaaacaagauauaauaaacauuagacauuauuauauaauuucaacacauauauuuauauuuuaaaauaugaauuuugagacuaaucaaaauuacuaaaacaucccucuagaucuuacaucauugaaacauuacuaaaaucauguaguaguauaacaagaacuuugugaguucuuccacaaaaugaauauaaaacauccauagaaguuagcucuuugaaauacugcuuugugcuaaauuguuuguucacauauccuaccaggaaauuuaauuuccuaugugacugaaagucuugaguuugucguucauuacauuugcuuaucuguuuuuaaauauuuaaaauguuccacugagcucacauuuuuagucaagacaucauuuauacaugaacuuacaaauuuggcuuacuauauuauaguuucuauuucuuugacaaaagcacugugaccuaaaucaacuuggagaggaaaggguuuauuuggcuuacauuuccguagcacaccgcaggaaaccaaacagcgcaggaaccugagacaggagcugauggggagguauggagagguacuguguauuagcuuacuucucguggcaacccaauuucuuuagagcccaggaccaacagcaugggugaaauagcacuaacaauggaccaggccuuccuccaucaaucacuaaugaagaaaguguccuacagccagauauuguggaggcauuuucucaauugagguucccuccuuucagauaacucuggcuuguguuaaauugacauaaacuacucagcacaguuuuccauugucccuuucuacuccuacaaaaaauauucaucuaguaaaaucucuccuacaaguugcauuguguuacauugaauuacaucaguuuuucucuucuugcaaauagaaguacuaugaaucuguagugacauaaaggaaagauuaaccaguuguguggaauucuaagugaaaaugcccuuuucugauuuuuaggaagaaaaugagaaaagaagucaccauaaagaccacucagacagugaaucuacaucaucagauaaguaaguaauuuuucauuuccaccuaaugguucucuuuaaaagaugugcuucuaauuuuccucuuuuuuuuaaguucugggaaaagaagaaaaggacccuuuaaaaccauuaaguuugggaccaacauugaccugucugaugacaaaaaguaaguccuugugauaguuaugugagcugacgaacagaaauguccuugcuuugucugagaauuguuuacaauuuuuuccauuuuguuucuuagcauuauccuaaauugacaugaggucaaacuaaauaauuuuacuagguuuuacagcuaaacuauuuuuuuauaguaauacuguuacaugcuuuuuuuuuaaaaaaaaaaaagacaauuauuuuaugacaguuuuuuuuuucauuuauuuauguucuaggccuauaauuuuuuaauacuguuuuacauuggaaguuaauuuauauauuccauuauuucuuucaugaaaguaaaauguggauuuucugauugaguaaauucauaaccuccacaaauauuuauaucaggguuuuacucuuauuucuuuauagguggaaguuacagcuacaugagcugacuaaacuuccugccuucgugagaguuguaucugcaggaaaucuuuuaagccacguuggucauacuauacugggcaugaacacaguucaacuauacaugaaaguuccaggaagcagaacaccagguaaauuuuaugaauuaguaucucauaaaagaugaagcuuuuuucaucuuuccauguaaagcaagagacuaaacaucuuucuacuuaaaauuaauagaacuaaaaggauugaucuuguaagauuugaugcuuuuaucaggucuuaggucagaauuucuuuuuauauccuucaaaucuaauuuuaaugauuucuucugaaaaauuuuagaguacccucuagcccaacaacuguuguucuugcauacuucugagaaugguagggauacaauguuucauaacaguuuuaaaaaaaaaaaaaaaucaugccaggagugguggcgcaugucuuuaaucccagcacuugggaggcagaggcaguggauuucugaguuugaggccagccuggucuacaaagugaguuccaggacagccagggcuauacagagaaacccugucuugaaaaacaaacaaacaaaaaacaaucauaauuuauguacuuauuuuauuguggccuagugugugucuaauauauaacacuugaaaaacauuuuuccaucucuuccauucuauuugguuuuaaaaagaaacugugguuacagucaguccucuaguuaaguuguaacugacaguuucaaaagcacuuuauauaaaguaauuacuaaacucaucccugacuugaccaccaacuagacagcuaagguuuugcaagucauaugcuuucuugguauuguuuccuucaugucaaacgauuucauuuucugcuuucaaguuuucaucaaucaauaauauacuguccuugggguccauggguugacaugaaauuuuagaauaaucuuugaaauauuuaguaaucucuauaauccuaacaucaaugaauuaggacaguuacugauaaggaacaaguaucugucacauguuucaacuucaaauguuuaaguacacauuacuuaaaaccagaaugcuuucuuucuuuguuccuuaaugaauuuguuuaagaaucauuacaaaauagaauauuuugauuucgacuaauauugaccauuguuuucuuuucuggcaggcuagauuauuuuccuuuguagaauauauaauuaaucuuuggaaauuaagaucugagacugaguauuacuaagacaacaagcaacacacacacacacacacacacacacacacacacaaauucuggcaaaaauuguccagagaaccauguucuacuuucugcuccaucauuagacauguuuauuguauguguccauauaugcuuacacuaaccuguguauaugugcgauggcacauauguaaaagucagaauauaaauuuccagagucaguuucuauccuuuuaccacguguaucuguggagguuugaccacugguuguucagcuugauugauaccaagcauuuuuaucugcucaguucucauucaccuuggacucccaugcuccuuucuccuguuaguaaaguuuuauuugguggugguggggggugggcauuagaagguucugaaaaugcaccaaguaacugcacuagaaaucuuaacaucuuguuaucuucuucaagucauuuuuaauaaaaguuuaaaaauauaauauauagauuucauacaugagagaaaacauacuuguucuuuuagccuguucacuucauguagcaacauaaucuccaacuuuauacauuucccuaugaagguuguaauuucaauuuuuuuaugugcuguuauuucuauuguaauucaaauauauuaauuacauaaaauuuaaaaaauacaucuuuccaguauugaugcuuuccucugagagagauuucuucauuuagucuuugcuuauuuuucucaauaauauugacuaaaauaaugggcauaugcauuaaauuuuuuaauguauauuauaauuucauaucuuauaaaaaccagaaucccauuugagaauucauaacauuauuaaaagcaaauauaacugagaaaaaauuuuauccaauaauuuuauauuuagccaacagugaguuaauaaguaauuaacauuaguuguauauuuaugagauagugucaucuucauaacaauuucaaaagauauuuuucauauacuauauuauccuuagcuauuuucucuuauuuuauuuuauuuuaaaauauguauauuucaaauguccccuuucuugguuuccccucugcaaaccuccuagccaguucccccuuacccugcuucugugaggguguucucccaacccacccauccacuccugcaucaccgcccuagcauuccucuacauuggggcaucaagccuucacaggaccaagggcuuccccucccauugaugccagauacggccccuucaauccuuccucugacuccuccauugaguucccugugcuuagucugaugguuggcugugaguauccacaucuguauuggucaggaucuggcagagccucucaggagacagcuguaucaggcucccaucagcaagcacuucuuggcauuagccauagugucuggguuuggugucuguaugugggauggauucccagguggaacagucucuggauggccuuuccuucagucuccguuccacucuuuguuucuguauuuccuuuagacaggagcaauucuguauuaaaauuuuggagaugggugguggguugcccuauuccucaaccagggggugaagggaaagcuugucuaaccucuggauauggucuugacagguucucccuccccuuugugggauauuucagcuaaugucaucccugugggcucuugcuuuccuagcauccuggacuuucugguugcuacccccaguuccccaucccucauugguacacaccucuguugaauuuccugaccaucuguacaucuccauguccucccauaucugguucuucccccucuuuuaccccucccucucuugucuuccucucaagucccucccccccucuaauucccuugauuauuuuguucccccaaguagaacugaagcauccacucuuagguguuauaagaaauguauauguuuucaucaauacaauauaaaaaguaucauuuugcauguguuuguauuaaaugguuguguuaaacaguuguauuuguuauagguuucuuuacaucaagcauauauauuuuaaacuccaagguuguccuaaggcuguauuuacccuuaaagauuuuuauauagauaauacagucauggaaucucugauuauaauuagaacucacuuuuauuuagaguccauacuauggggcaauuuccaaauaucuacuuauaauaacuauugaauaucauuauauauuuugccccaagauaaaugaaacaauaagcuucuguucuuucaugaauucucaguuagaauaauacaaauaugauucaauuccuuagaaagaaauuugacuguauuccaucuagaacaaaccagggaugaggggcacuacaccagaaaugcagauuuuaagucacuaacuagaauucuaggaaaggcaagauguaaaguauuauacucuaagcuuuaagucaccuuucuuuuggucaagcauuuacuucauuguaguaaaccuguuaugaucuccuugaauucugauaaaguugaucuucauaugaggggaggauccccuauuuugccuuuucuuucccucuugauaauagcuguuuuauuuuauauuauucuguaaggauuuauuuuauuaauuuuaauuguauggguauguaugugcucaugagugcagguacccauggagcccaggggugccaaaaccccuuagagcuaccuauuguaguuuuugagaucaaacacaaguacuuuauaagagcagcauagacucuucaccucugagccaucucuccagcccaaguaguuauuuuaaaaacaaggcuuuaagccgagcuuugguggugcacgcauuucccagcacuuggaaggcagaggcaagcggauuucugaguuugaggccagccuuguccacaaagugaguuccaggacauccagggcuauacagagaaacccuguuucggaaaaaaaccaaaaaccaaacaacaaccaacaacaaacaaaaacccaggcuuuauucacaaugaaaaaaaaagguaaugacauuuauaacaaauauaucuuauugggcaccauccuaauuauuauuucauucaucuucaaaauagcacuuuuauacaaauguuaauauuuguucuuauauauaaggagagugugcuuaaaaugcuuuaauaacuugcuuggguugaugcuguaucuuagccaagcagccuaucaaagccuaaacuuuauuuuggcuuccauguuaguccuuaauaaguuaggaguaguucaccaaacacaaucaugaaaccagacucaacacaaaaggcaaaagaacugaaucuuuaacauauucuauuaacauuuuaaagguuucauguuuaaggacacauuuucuauagaauuaauuauauguugauuucuuuuuucaccuuuaggucaucaagaaaauaacaacuucuguucaguuaauauaaauauuggcccaggugacugugaaugguuuguuguuccugaaggcuacugggguguuuugaaugacuucugugaaaaguagguucccauacuaaauuuucuuuaaauauaauuacuaggaaacaguaucuacaaaggacagcuuacuaaacuggauacccuaauguggauacauagucagcuuuugguuacaauuuaguggaaaucuuauguuaaauugaauuauuccaaaccuauaauuuuauguuacuagaaaacuuauaguaaagguauccugaaacuguucuaugaaauauacuaauagacguaaauuuagaaaauucuaguuauuuuuuucauuuuuuuuaaauauacauucaaauacuuauuuagaaggcauguauucuaagaaaauuucuaaaaauauuuuagaaaguggaagaaauucuguaauugaacaugcuuauuguuaggaauaacuaaaacuugaauauaauaaucuuugccauaucaugguauaaauuuuucuuaaaagugacaauuuuucuucuaaaggcuuuuuauaaaauuuaauuaacuccuucagauuuuguuuugcuaaucaaagaaagugcaugcugaaucuuuuuuuuucgauucuagaaauagccuuccuuuauuuggguuaugucucaugguaaagaguacuucggauuuuuaaauuuugauuuaaauuaaaugucucuagauagaacuguguucuuuuuuucuauaaaguacucaauuguauaagcuccugauauuuucauuuacuaauaaaauuagaaaauuaugaauuaagaauuaaaagcauaaauuagcaugugauauuuguccccaucucaguuaaauguaggaggagggaaguuacugcaaauguguauauaugaaauuugaagacaaacuauagacauuuuuuauacuaacauguaauuucuuaguuugcuuuaaaaauccuugcuguaaauauuuggguaauuaugacacauaucauaauugaaaaaaaauuaaggacccaaaaugucuuuucauguaaguaagagaaauaaucaccuuauaauucuucacuaacauuuguuuaauucaauucaaggaaaccagauucagaauuuuacagauucaaauguauugaugaaguaacuuccucuacuuuauaccauaauuuguagacuauuaguucuauugauuaauuaagguugcugccuguuuacuuuuaugaugguagcacaagguugaaauagugcuaggauaugugcuaauaaccauuuuuguuuuauagagagcuuuauuugcauacccuuaucacaaacaucuagccaguccuauccccuuggcacuuagagugucauuagcaauguguucuagaguuucagagaguugccuagcaguuuacaaaguuuuuauuuguuuguuuagagagauaagagaacaaacaugaaaacacaggauuaagggugcguagggccucuuuucuccuuuuaccauguagggcccagggaucuaaguuccucaggcuugguggcagauacuuuuaccaaccuagccaucuugccagcccugaauuaaauagcagguauuuguuacuagcugagcugucuugccagccccgauugauugauugauugaugauugauuuggaagaaaaagggaaaaagagagauacugaaguucuauuuuaggucaaagguuuuucccauauaaucuuggauaauagaugguuugcagauuguaugguuucugucacaauuguguuauaacaaaaaacagucauugaucauauguaaauaaaugguaaugucuaucuucuaauaacauuuguugauaaaaacugucagcagggucauaguuuuguguuacgacuuaauauguacuuugucauauacuuuaccccaaguuauaaaguaaagguuacuucuuagauuuuaagcaaauacuuccacuauauaaguucuucuuuccccaaaauaugaaauuugaagugguuauuaaaguguauaaauuucuuuuauaggaaaaguuacuauauaauuuuuccaacauauauuaugaauaaccaguaaaauauuaaaguaaauuaguaauaggaucuauagaauguuuccaaagugguggucauagugguggucauggcuauuaugcaugauauauacaaguugguuuucaagugcauaguuuuaauuagcugaucuucaaaaccauuuagaaguugacaacuuauuccccuuuuccugacucaaagcagcaggagagacucuuucuuguguggguuuucugguacauaguguccuuguuuaugaauuuaagugaauuuaucuucauccucugucauuuagugauuucaagguacugcaagaauagaaggguuugguguuuaaaaguagggagggaccuuagugaaaugaaauuagaauaaaaguaugugcuauuuuaaaaguagcuacagauuccccuuggauuguagagaaaggaauuucagcugucuuuagauauauuccuguacuuaacuuuaauuucacucuuuacauacauguagcaguuuuuguuaacaguuaaguuuuauuaaaaugaauuaucauuaaaaaaaacuuuuauauauauauauauauauauauaaagaauuuauuagaguccuugacugauuuguucuguucuucuuauuucagaaauaauuugaauuucuuaauggguucuugguggcccaaccuugaagaucuauaugaagcaaauguuccaguguauagguuuauucagcgaccuggagaucuggucuggauaaaugcuggcacuguucauuggguucaagcuauuggcuggugcaacaauauugcuuggaauguugguccacuuacagguauuuuaaaagaauauacuuggaaaaggauuuaaccuaaaguaaauaaauaaguaaaugucuuuuuuuaaaauaaggaaugucuccuuuuuaguauaaaaguuaaauguuagcuaacuauugaaaguccaaagcccuagauccuuaacaaaugaaagacuuaaaaguuuauauaguuuuuuauacguggaaaauguacuuguaauuacuuuuuagaguccucaauuuuguuuuauaaagggaacucuuaagggagaagaauaaauaauuacaaaugcauucuuauagguuuuucuucuauauuaaguuguauguaaaacaguuugugccuacccuuagguaguaugccuuaaaguuaagaauuuggcauuuguagccaggaagaccugaauuugaaccaggacuuagcuuuauaagcuugggcaaguuacuuaauuuuucuaguccuugauuuuuuucaucuagugaugauaguaaaaccaguaaggaaauuuuaagaauuaaaugagauaauggauaaaaguuaguuauacacauaggaagcacucucuauaugauuacuacugaugcuauuaccauaauuaucacaaaacaaaaauuuuuguaagcagggugguaguggcacaugccuuuaaucucaacauuugagagguagaagcagguagaucuguaaguucaaggccagccugguuuacagagugaguuccaguacagccaagucuacacagagaaacccuguuucaaaaaauaauaauaaaaauaacaauuaauacauacauacauauauguguguuuguguguguguguguauauauauauauauauaguuuuagugacuugagauuuucaugagguaauaauguuuaucuucacaucuuuucaugguuuugguuugugauuuguuuuucuccucagccugucaguauaaguuagcaguggaacguuaugaauggaacaaguugcaaaauguaaagucaauaguacccaugguucaucuuuccuggaauauggcacgaaauaucaagguuucagauccaaagcuuuuugaaaugauuaaguaaguacuuucuaaaauuguacuaaacucuuaaggggcaggaugacuguuaagcacuccccccuccccuuagaauuauguuacauuauauagaauuacauuaaaacaagaugauccagaagucuagcaaaauaugagauucugcuuguuacaacuacuuuucccuuccaaauagcccacuauuguuuuaaaaagaauaaagguauaaauuauucuauggcagaagauugacuuuuuaguauuuccccauucuucucugaauuauuucauuucucaguaggacuguaugggacacaaggagagaagacagcagaagccaaaggcauggucuuaaauuuugcugugauaaaaguuuuuaguugcuaguuuauuugguacucuaaauauauacauguauauccuuacucucugacaacuguuuuagguuugacauauaaccauagccuaaagcauuaguuuuguuuuguuuuuuuuuuuuaauaaauuaaacauacaaaauuuuaaaaacaaaauucagugaauuucuuggaauaugaucuuuaaagaaagccugcaauacuaaaguugacauuguuaucuauuuaguaagcuuauaguuagguuguguuauguauguauuaauuaagucauaccucccaaggauuaauauuuauggguaaguugaagauaaauauacuauuaucuugaauuuuaauuguuugacaaucaagaacaauugaacaccuacugcauauggcagugacauagcaaauagaauaauagauaagacuuuugcugucaagaugauacucaguugauaaacccuuucuuucaaauugcuuaaaagaguaaucuaggucagccacucaguucuaauggaaaaccugagcgcuaagauuuacaggagaguaagaauuuagcagugccaaguaaugagaaccaacuaggaaaaucagcacaaauuuuaagaauuacaaaaggcauaaauuacaacaaaaguugagucguguuacuauaaauggauuauacuaugucaucuuaaguuagaaugaagaaauaccugucucuucugcaaucaguaaaccagguuuuuguaucuuguaguuaaugaauuuauaaauuuuucugugcucguggaaguaaaaaaagcaaguacagagaugaugauguuaauaaguguuuagguagugugacuagagaugaugugccuuucugccuauguagaaucauaaguauucauaucuaguauuucaaccccugacuuuaaggguggggaagaugacucuuggagagguuaauugauuuggccggauaagaacccacauuaguaacucaaacaaggagaguuuuauauauuaagaauauuauauauauauauauccagauaccaauuucaacuauaaaugacuugacauugucauccuuggagcuguugaucauuuguucuuuuuuuuuuuuuuuuuuuuaaauucaugaguauacagcagcugucuuaagacacaccagaagagggcaucagguccuauuacagaugguugugagccaccaugcaguugcugggaauugaauucagggucuccagaaaagcagucagugcucuuaaccacugagccaucucucuaguccuuguucuauuuuuuuuaaaucugauaauaucuaaaaauuugacaaaugaacugagcaugguagcucacaccuauuuaucucagcaguugguagucugagaugggauugauuaauugccacaguuugaguccauuuucaaauuuucaaauauauagugaauuauacaccaucuuuagcagauuccaaaaauaaucugggaguggagagcagaagacauacaacaaaagaaaaauggauguuagaagcaaaucucuuggcauuauuucuaauugguauaucucuuaggugaaaaauauguaguauuuggcugcuaguaaugaguaauuuucuccuauauuagguauugucuucugagaacgcugaagcaaugucagacauugagggaagcucuaauugcugcaggaaaagagaucauauggcacgggcggacaaaagaagaaccagcucauuauuguaguauuugugagguaagucauuuuugcccacaauuguuuauaaaaaguuuuguuuuuuagucuuuuuuuuuguagugcauuuuacuuugauuagcauuauauauaguuuuaauauuuucucaucagauauuaauguuuaaugguguuauaucuccuuaguuguuuaccuuaacaguauccacuauagagucguuuggcuguuugaucauuaaccaacaaggaaaguuaggagauuguagguuaggaacaaucuagauguacacagaugccaauaaacuggguugaguuugguauagccuagugggcuuugguguccaguucucugguggaguucacauuugacgugucagucuucugcuguggcuaaggcuugcaagggaaacgacaacaaaguuauaccuggucugagaaacuugaaaucuauuuuacagucaacuaauaaguaauguacauugggauuauaaugaauaugaagguggccuuaguacaaaaaugcagagaggaauaauugauguaguuuaguuuuccuuucuguuauuggcaguaagaacuuaggaaaacaacagcaaauccauagcuuuaucccuuucuugaaggaugagugugguuucagaagguuauauacaaacuauagugagaauacagguugacugucagaaauaccaugaguagagaaauugaauaccuuuagaagaaagguuagcuagucccauguggcuauaauacugacaguuacagauucuucucauaaaaucuaggugacauguagcuuuugauguaucaugaagcugucaaauaaugugauguuuauuccaaagucauugaauccaccagaaacauuugagaagucaacaaagacaguaucuguuucagacagaaaaacggaaagaauagagaaaauaagauacaucauagcuaauuccuauaauagauaauuccuuugccacauaugcuagacuaaaaauauggcaauggauuguuaaaaugguauagaaauuuuaaaguaaaguauuucucagccuuccuaaugcugugaggacuaauaaggaauaugguuccucauguuguggugaccuccaaccuuaaaauuauuuucauuacuauuucauaacuguaauuuugcuaguuauaaauuguaauguauaucuguguuuucugauggucuuaggcagcccuugugaaaggguuauucaacucccaaaggggucacaacccacagguugaaaaacacugaucuauaagauaaaaaccauuagguaacuuauuaaaagguagaauugagggacaaguugaagaauacugacagauuuucuagcuccauucuuuaggcucaugucauugcccauuaaggauaaugagaaauaugguaaacucuggaaucuugaauuggcucauucucauugauaauuuccuaucuuugaagaaguuuaaggauaaauuacagaugggggcauugaugaucuauuccaaacuuugaacuuugcuaauucuguuguugacuuuaauuuuaaauuauuuacuucauuuagcauuuuagugguguauaagguagucagaggaaauuaaugaggaaguaaaugugucuuauaccuugaaaaaauaucugaggaugagucguacacaagguuauuuuaagacagauauauuauuucuaauguuucaaaaacucuuacuuuuaacaugaagcuuauaacaaauacuuacuguuacuugccaguuucuucaucuauaaaauaaucaguauauucauucauuucacagguguauuuugaaguuuuaguaagcacuagguacuaugacaugcucuggcagugcaaauaugaacacagucuuuguauucaaagaguucagucuauacgguugccugugauggauucugucaaggaaacaugcaaagaaaauagugaucacuugacaaauuguauacuaauguuuugauuuaaaagaaaaauaaacugguauuuaguaaaauuuuuaauuaaguucuauuagaauugucaugguuauaccauuaauuucuuucauucaccuaaauaugauugcucucaugucuugagguuuggugcaguauaaacauuuucagucucagucucacacuccugcuugcucccccacccccaucuuuuaacuguacaguuuuuuuuuaaaguagaagacuauaacauagaagcaguacaauaaacauuaucauaucuguugaccccauuuuucauuuguguaaaacagguggagguuuuugaucugcuuuuugucacuaaugagaguaauucucgaaaaaccuacauaguacauugccaagauugugcacgaaaaacaagugggaaucuggaaaauuuuguggugcuagaacaguacaaaauggaggaucugaugcaagucuaugaccaauuuacauuaguaagugaaaucaacaugugaguacauuagaucaguugggaggcaguaguguuugcucugcuaccugauaaauaggagguaaugaaauauguagauuuucuuuuugcuuaucaagauacuucaugagaguauauuuauauuucuuuuaccaccuucuccaaguacuuauuccuauaaaauugacauaucacuuuugccuugcuucuuggagagaccagccuaaaaauaaugguuaaaacuguaugauuuacaaugcuaucaugauuuucauauuguuucaucuuggcuggugaaauguuugcuuaaauagugucuacaaaauaaagcagugugagugugcuuugaaauauacuucugcuuuuagggcuaauugaauuuguuuaaaauuguguacuggcagauguuuuaaucucgugggaguauuugaggaguguuuaacuuccuugcaugugguauaaccuuaugaauuuuaaguguacucacaaaucacaaaguuuuucauuguaagcagcagauacaggaagcauuucacucaaaacagaucugacuagaacuacagacauaauuuaugaauuuuuuuuucuuccaauacuuuccacauacauguaaucaaaaccuagcuuuugaaguuuagcuccugguauuuucauuuggaugguguucaagauugcuucaagaaaaaaagaaaaucaccuggaauuuauccccccccccaaaaaaaaaguauuaccagccuuagauuacugaaggcagucacuaguaauauuguaaauaauuugauaaauugauuuuguaaagcccugucaaugaaagcaauauauaaaaagugguaaacuaaauaauauucuaaaagauuuaggaggcauaguaaaacauacaaaagauucuuacaaaagguggccaggugggagaucuuaagggaaauuguacuguuucguuguguaacaaggcuguugaacuuuaacagagaauaauuuccgccaguuucauaaagcaacauauauauuugcagcugugaaucaaggagcacaacuaacaaaugagcauaccaaaauagucugccuugcuuuuauuuccaggcuccuccauuaccauccgccucaucuugauauuguuccauggacauuaaacaugagaccuuuucugcuauucagaaaguaacccaguucugcaccacugcuauuuguagcuaucucguaaggcugcuggcugaaaacugugucuaugcaaccuuccaaguguggagugucaaccaacuggacgggagaguacugcuccuaugccaggacucucguaaagcuaauuagcugaacuucagagaaaaaaaaaagaauaauaauuaccacguuuuguauauaucugacaaaacuggcaacaucauaaagacuacugacuugaagacaaccucuuuuauauuucucgauuucugggcuaaugaauuuguuuucaccuaucuuuucccuuucagaauuuuauucgggggggaaaauaacuagccuagcuggucauuucuuuguaagguaguuagcaauauuuagucuuucuuuggucaccuuuuuuuuuuuaaugugaaaaguuaaguaagaaacuuuuuuuacugcuuuuaugaauuucugucuuguuuugaaacuaugaucguuauaauuuugguucccaaauaaaacauuuaaaaaaaauaauuaacagcaacgucacaaagauaauggauugcacauagacuaagaaauaaacuucagaauugugauuuuuuuuguuucuaaucuugauguaaauuuacacuauuuauaaauacauauuuauugccugaaaauauuugugaauggaaugcuguuauuuuuuccagauuuaccugccauugaaauuuuaaggaguucuguaauuucaaacacuacuccuauuacauuuucuauguguaaauaaaacugcuuagccuuguacagaaacuuuuauuaaaauuguuuaauguuuaaagaguuuucuauuguuugaguuuuaaaaagaauuuauguacagugcccaauuuuuguucacuuuucaaaucugauuauauauauuuuauauauacuuaugucuguauauauaauauauauagaaaucuagauauauguauaaagauuuagaauuugaauuuuucuuguuuuaaguuucacaucuaugguagauuuuugaggugucuacuguaaaguauugcucacaaaaaguaugauuauuuuuaaagaaauauauaugguauguaucuucaagaccuaaaaugucagacugguuuauuguuaaauugcaacuacugcaauuacagacaaaaaaaaucugccaaauguaguauaauagaaaacauagugauugaacuuaaaacuuuaaagggaguuuuaauacaggcuuuucaaauccuau

SEQ ID NO: 9412 - RNA, 404 nt, Mus musculus
ugcgcggugccguucuuccugucccagccaccauuggagagcagcagccauggcucugugcuaccccauggcccugggccucaacaagggccacaaggugacgaaaaacgucagcaagcugagacacagccggcgaugcgggcaccucaucaaacacaccaaucgugcgggacaugauccgggagguguguggcuucgcacccuacgagcagugagccauggaguugcucaaaguguccaaggacaagcgcgcacucaaguucaucaagaagaguguggacacgcacauccgcgccaagagaaagugggaggagcugagcaacgugcuggcagccaugaggaaggcggcggccaagaaggauuaaugaacccucccccaauaaaagaugguuccuacaaaaaau

SEQ ID NO: 9413 - RNA, 978 nt, Mus musculus
cccgggcacggguccauacggcguuguucuugauucccaucguaacuuaaagggaaauuuacacaauguccagagcccuugacguccugaagaugaaggagaagaauguccucaaauuccuugcugcaggaacccacuuagguggcaccaacccugacauucagauggagcaguacaucuacaaaaggaaaagugacaguaucuacaucauaaaucugaagaggaccugggagaagcuguugcucgcagccugagcuauuguugccauugagaacccugcugacaucagcguccucuccuccaggaacacuggccagcgagcugugcugaaguuugcugcugccacaggagcuacuucaauugcuggccacuucacaccugggaccuucacuaaccagauccaagcagccuucagggcgccacagcuuccagugguaaccaauuccagggcugaccagcagccacucacagaggccucuuaugucaaccugcccaccauugcucuguguaacacagauucuccccugcgcuauguggacauugccaucccaugcaacaacaagggagcucacucagugggucugaugugguggaugcuggccagggaaguauucugcaugcgagguacuaucucccgugagcaccccugggaggucaugcccgaucuuuacuucuacagagacccagaggagauugagaaggaggagcaggcugcugcugagaaggcugugaccaaggaggaauuccagggugaauggacuguaccagcuccugaguucacugcugcucagccugagguggccgacuggucugagggugugcagguucccucugugcccauccagcaguuccccacagaagacuggagugcacagccagccagugagguuggucagcagcucccacagcacaggccacugagugaguugaagccaccacugagugguccugagcugcugugcagacaccugagcaaag

SEQ ID NO: 9414 - RNA, 978 nt, Mus musculus
cuuugcucaggugucugcacagcagcucaggaccacucagugguggcuucaacucacucaguggccugugcugugggagcugcugaccaaccucacuggcuggcugugcacuccagucuucuguggggaacugcuggaugggcacagagggaaccugcacacccucagaccagucggccaccucaggcugagcagcagugaacucaggagcugguacaguccauucacccuggaauuccuccuuggucacagccuucucagcagcagccugcuccuccuucucaaucuccucugggucucuguagaaguaaagaucgggcaugaccucccaggggugcucacgggagauaguaccucgcaugcagaauacuucccuggccagcauccaccacaucagacccacugagugagcucccuuguuguugcaugggauggcaauguccacauagcgcaggggagaaucuguguuacacagagcaauggugggcagguugacauaagaggccucugugaguggcugcuggucagcccuggaauugguuaccacuggaagcuguggcgcccugaaggcugcuuggaucugguuagugaaggucccaggugugaaguggccagcaauugaaguagcuccuguggcagcagcaaacuucagcacagcucgcuggccaguguuccuggaggagaggacgcugaugucagcaggguucucaauggcaacaauagcucaggcugcgagcaacagcuucucccagguccucuucagauuuaugauguagauacugucacuuuuccuuuuguagauguacugcuccaucugaaugucaggguuggugccaccuaaguggguuccugcagcaaggaauuugaggacauucuucuccuucaucuucaggacgucaagggcucuggacauuguguaaauuucccuuuaaguuacgaugggaaucaagaacaacgccguauggacccgugcccggg

SEQ ID NO: 9415 - RNA, 41175 nt, Mus musculus
cagagcagcuugcgaggcauugauuggcucagaggcugcugcccgcuuauugguugccauaggucgucacggagaccuaggggguugggcggagaaggguguugggccuggcgggagugcugaggguuccuggcggcggggcugcuccccugggcgguguccggggagcuguuggccgagucacccuggcuucccgccacccucugaaaggugucugagcgagugggguccacuaccaagacccuuaggccgcaccaugggcugcugcuucacuaagaggaggaagagugaaaaggcugagggagaggaggagcagcccaagcuguacagcugggaccagcgggagaaggugauguuuuggggaucccuugcuuugggcccuccucggcugcccuuugcagcagaugaaagcgggcaguuuggcggguggcccacaacuggcuuucacuggcgcgcacaggcagcugaagucgcacgacuuugggggcgggaugugaagggcccaaaggaggcauagaguuaguggucagccuaacuagacucccagggccucucuguaggcucugcaccccgacuccggauucuagaaaggacuccagggagggaaagagccaggaaggugcugaaucuccaaucagcucauuucaccagcguuggccaaagggguuugguccaguggucgaauuacacacgcaagacugguucucaucuuuucugcgguuuguauucccaagcuguuacucuuuugucugcucuccucugaaaaucgcuuuuggugccucuugguguuacucaguuauuaaauggacuguuucaugucuaccuuuauucucgucuuccauuuaucagaaaagaauaaugaaaauugaggcagucuuggaguguauuguguaaggugaaaguacccaacacaaaccaggaaguaguuuauuauugcagcuuuauaugaacgaaaaugccauauauauauauauguacacacacacauacacacacacauauauacauauguguguguguauauauauauauauauauauauauauauauauauauauauauauauauauauauauauauauauauauauauauauauauaucucaaaagguuugaaaaagucuccuaaucuugcacaaaacacacuuacuuaggcauacauuucacaaugguuccucuuucuacaaaguucuucuuuucuucuuaguguaguugcuuuguaaaacacuuaauagacaucaauuauuauaguuucucaaacaaaauaagaacgcuuguucuuuuaaaugggugucaugaacaguuaacuauugcuuaaugcaacaacuuugaccagaaguacuaaagucuuguuuuguuauaaccagucauccugcauccuuguuugguaugacaaaucauccugcaucauuucaaauccccagcagaauuuaggcauucauauaaaugacauuuucaaaauguuggcuuuuaacaaauggaagcugaauucucaggcucagcuuuuugccuuugacucugaaaccuuucuuaggccauguggccuuuuguuccucuuauauagcaguauuuugucauguaggaaaguguuguauuuucugucuuauaugaagauuguacccaucaaaaucauuugguaggaggauuuugaaguauucauuuucaacagccuugggauuucuaauaaugcuguuuaaauuuuuucuccccagcgcuggguauugagccaugcuaggcaagcauucuaccacugaguggcaucccuagcuaaacaaugcucuuuaaacuugaacuuccugcugcagagagaguuuuuguuugucuuauuuuguuuagaagugucaggcuaaaaguaaaagugugcuuuucuuuucaguagucuugguuggcugugguucacuguuccauaauaauugucuuucugcuaacuucuacuuacaaaguucugauuaauuggggucuucuggucuugcuauuauguuauuuuugcaacaggaucuuuuuuguuauauuuugagacaaggucucauguaacucugcauagcccugaguaucuaucugauuccccugccuccaucucuugauugcuugaauuguaagcaugcaucaccaacuuaugcuagagacaauguuuugauauguacuucuggcuagccuguuaaacgguauguagcuuaggcuggccuuggauuucaggcaaucuaccugccugagcauacugaguacugagauuaugggcugggcuaccacacccugauaguugggaucuuucauaugaauguguuuugugaucucuuuuucuugugcucuuuaucuaaguuaaaguacugaaaaauagcuuaguggauacuaauaucuaagugucgccucucccaccaugugugcugcauuaaacuuucugguguaaauaggaacauuaaauuuuuuucauuuauaguuuuaaaauguuuuuauucaauaaagaggucagccuugaaaccagauucauacaaacagcaaaaacagacucaguagguuguauuuaugcauacuuaaacauacauagauauguauguguaauaauaauaaaggaacccuuuuugagagcauugcuagguacuauaguuguagagauguaagagcuguuauuggaaauguacaauaagccuauauauauauaaaauagcuagauauauaauuauauucuauauaauacauaguauacauaagaugccauaauauauuauuauuauauauauuauauagauauaauaaaaguuaaaaccuuuuuuguggugcugggaauagaacacagaauguuaggcaggcauucuaccacugaucuauaccccuagcccuccaaugguacuuuuacugacccuggucuugcuaucucuugaaacuuuuguguguguguguguguuuuucauuacaaggaauugaguguaaauacacagcuuaccgaaauaacugagauacauuguaucuguagcaacagaaaugguuugucucagguuuucauaauaucauggagucuaggucugugcuguuuaaaguuagagcaagcaauuagucaaccuguaagagauuuuguuuuuuguuuuuuuuuaaugaguugacuguaaucuccuuaccauuggaaaagugguguuuaaaguuuccuuagguuguauaaucagaguugauggguaccccauggguuuuggguuuuguguuggguaauugggucagccuuaagggacugaagcaaggagaaauugucucaauuagaaagaauguuugaggacuaaguggugucauggcaacuuacauauuacagucaacaguggaaggaauucauuuuccauugcugcugacuuugaaaaagaaaaaaaaaaaacuacccugaaaugagaaauaguuuggauucuaagaucucuguuuaaaucauuuagaaagaaaugccuuuucuuauuauuuauaugcuguauuuuaauaguuaagcaaauuauucaauguauauguauucaaacaccaaggaagagccaaacuuauuauucuugcccuccgagaucuuccuugcccuuuggagugaaaacgggaaauacugaggcaaaauggggugaagaugaguggcacacaaagggaguuuucaguuccacuuauucaugcuaauauuccucaauaacggaaagaagaauaguuucucuggcugggcaaaguggugcaagccuauagugcuagcaacuuuggaggcuuggugcuucugaguacagggccagccuccugaguuucaggcugcccugugugaguauggucauugugagacugagaucuugacuccuuaaaaagaaaaaaaaagaauuaguuucccaaaugauggcuuagguaugaaaauugugauuugaguaugaagaacacacuuguaucugcuacauuugucucaugauuauucgaaauagugcuuauuaaagccaaagucucagaucagaaauucaacugucuguuguucaacuuuggguaaaccagccaauuugugcauaucaagcuucuuaguuauaaaguuggcuaguccuaaagaguucugcacaauuuagcgaggcaaagacuugcccugaagaagagacauuagauaguaauugucaucuccagagacacuucaagcacaacuuauaggagaauuuaauuccaagaauuguucaucaauagaaaggaugacuuuaugggaaacugaugucuguguggaaccuucagagguuagauaggugaccugcuaaaaagaaguaucuguaguagauaggaagcucgaugcuauuuucaucaucaucuaaguaugugagauaauuuaguugccguuugacaugaacuaaaccauccuaaaacuuaauaccuuaaaacacuggcaaauacugcuuuuguuuaggacucugcccuuuguguacaguuaagcaggguugacucuauaugguaucaacuguggcaacuugaguagggguuccaggaucgccuucaggguggcuuaaccccaaaggugacugucagguugauacaggcaugcaguugggagcucaacuagggcugaaggccaagcacucuccauguguauucugaacuucaggauccaaggaccucugauuuuauugagucuaauugaucuuuucucccaaauaacgauuucuaauuuugauauuuuauuacaaauauauuuaaguuuuuuauuuuacaguuauguguguauguaugugaaaaucugguaugaguuuguacacaugagagcaaugccuauagagagcagaaacagguaucagauccuguggagcuggagucucauacaguuaugagccaucugacaugagugcugagaacucagguucucugcaagaacacuaugugcucuuacuggcugagccaucucucuaacccuucauuagauauauuuuauuagaugucuuuagagaaaacauuuaauguauaccuuaaagcuuaaguaagcauaucugcuacaagcuacucuuuaaaaauacuuuuuauuuuuacaaacuggauuuccauuaaugugaauagauuccauuaguauaucucaggauaucauuacugaaguuaacuccagaaauuaaauuuaaugaaaauuugcuugcugccuaguaaagaauuaagauguucacugcuguuuucuguuagggaaauaauacuuaaauaguacuguugauccaacuccugcuaaugcagcaaguuugaggccagugugggcuauagguaauacauagagauauaaacuauguacauuucaucaaggcucauauguuaaaauacuuuagacuauaaccuaucuaugcuuguaauuuuagacauuuuaagaacuaguaacguuuacaaaauuauucuaagcuagaaauuaguuauuaaguuuugacuugaagaacuuuuaggaauuucugagaaaauauaguaacauauauccuauauuucucccuugaauagugauugacaauccaaguaauuuuauacuguaaagcgaauuauagaaucuuuagcuacaggauuaauuuauccucauaagccaguaaaaauggaaugucuaggaaaaacuaagaagauagauuacacugaaucccgcaguauuagaagcuguuaugaguauuagucaaaauuuuuugaaggccuaaauccuccaugauuauauuugaaguuagagccacuaaagaaagaaaaaagcuuacauaauguucauaaguguagaguucuaaucccacaggauuggugacuucauaagauuuacuagaaaguaagcccagucaagucccucaaccccacaaaaagugcugguaaagauagagaugaagggcuucuuaguugaagccagcuaggccaggccgccguaacaaaaugccacauucuggauggcuuacacagcaaguuuagguuucagaguucuagagcccaagacucagaagaucaagaugcuagcacauucuagcaucucugucuagugggccugucuucuuggcuuuagauagcugucuuuuugcuguauccuuucaagacuuuuccucucuguauucaccggcgccagcacucuuucccacaucuuacaaggccaguaaucccguuaugaaggccucucauuacuucccaaaggcuucaccuccaaauaucaccauauugaaggcuagagcuucaaaggagaaauuuggggagacugguuggagauacagcucagugguggaguacuuaccuagcauacacgaggcccaggguucaaucucuaguagcauuaaaaaugggggggagacacgaauauuaaguccacagcacacucaaaccuauuaaaauaacagcucagugauuuagcaauagauuuuaugccgacauuugcaacaagaaaucuuaacuccuaguagugugugugugugugugugugucuguguuaauuuguuugaguguagacccacacaugccuugcuccucuugcccauucagcuuuguagaaaucagccaaauccugguggucuuuucccuuuaccuauucaccuuugcucuaacuaccuccgcugugauuaauguaucagugccaaaaagacacguggaaacaugaucagagaauacuuuuuuccuccuaaaauuuaaugcagaauggacuuaagccacccuuugauguucuuucucacuuuaaggccuggaaguagaccaagcucccauugccugccccguaacuauguucccacguccugguacuggcuuucacagaggaaagcagccucagucucccuuuacauaaagggaggaaagaccuacaguaguuaucagaagcagugccucugccugcuauaguucuuuuauuucccuagccagaaauugaucaacuugacgugugacuuaacugaaugucccugagugccaguuuguucccauuuuuuuucaguguugggaauugaacuguggccuuccauauacuagacaagugaagugcucuuacugggcuagcuccuaagccuuacucuuuuguucuugaucagcaucagacucucaguucauuggagauggaguggagagugggauguggggaagauucaaguucucuucaaaacagugugugauuggguuggagagagagcuccacauuaagaguacuggguguucuucugaggacccgaguuugauuccuagcacauggugacucacaacuauccauagcucuaguuccaaggagaucugauacacucuucuagccuccaugggcacauauaugcaggcaaaacacucauacaccuaacaaaaaagguacuugauuaucagauuuaguuacuauucauauaauaccuguauaacccacauuauaggaguuauauucugggguaaccaagauucauugacuaaaauggcuauauaguuaccuauauucuguuuuuuagcgguuuauugauuuuguaaauuuuauguguaugcaugugcacagugugcaugcaaguacccacagaagagggcaucggaagucuuggaacuggaguuacaggcauuugugaggugucugaugugggugcuggaacuaaacccagguuguuugcaagagcaguaagugcuccugacgacuaagcaucucucagcaccuuauacucugcuuuaaaccuguuuauaaucauauccuuguuuucauucauucuauuguauuguuucuuaaucauucuugacaguuugucuauuaaaacuuguuuugaccuuguuguucuuuauuauauuuaauguuuaaauuauuaauuacaucugugauuuuaacuucucuuauguauuauuuuagcauuuaauugcaauacaguuaacauuccauggcaguucuagaucguguuuguaaaguaucuacuauuuuuaaauuucugagccuuuuuuuuuuucaggguagucucaaaauuugagacuauucuaaaucagccuucuaagugcuaauuuuauaggugugugucaccgcaccuagcuuuaauuuuuaagagaaaauuuagauguguuuauuuuauguaugcauguguuuugcuugcauguaugucuguauaccacaugcauucuugguaccuaaggagggcaauggauuccuuggaacuggaguuauagacagcagugagugacauauggaugcugagaaucaaaccuguguccucugcaggagcaacaagcacccuuaacuacugagcuaucucuccaaucccccaauuuuauucaguguguguuuauggacaaguaauuuuacuuuuugcauuuuacaucuuguuuagauguguaaugcaagcuuacuuguuguggauucagguuuucuucauuucuaguuuuaucuguuguugguuuuuuguuuuuguuuuuuguauuuugguguuuuguuuuguuuuguauauucauggugcuuuuggaagccagagaacauucucaagugucauuccuuaggcaucacacacacacacacacacacucacacacacacacacacacacacacacacucacacacacacacacacacacacucacacacacacacacucacacacacacacacacacacucacacacacacacacacucacacacacacucacacacacacacacucacacacacacacucacacacacacacacgcucucacacacacacacacacacucacacacacacacacucacacacacucacacacacacacacacacacacacacacacacacacacacacacacacacacuuacagucuuuugagacaagcaaguguccugggauucuccacauauacuaggcagugggccagugagcuauaaggcucugccugucauugacucugcagugcuguuguggugauaaguguauuccaccacauccaacuuuuuauauaacugcuggugacugaacucgggucccuauguuagaacuaucuuuuuaagagaauuuuuuucugagacuuuuguuucgguuuuguuuguuugauguagggucuugcuauuuaacaaaggcuggaccugagcuggagauuuuccugcaacagccuguauauuugaugugccugugcuuugccaacuaugccaucuccccaauucuguauuuuuagauuuuaauuuguuuuuuuguuguuguuuguuuuuaccuauaaguaauuaggagaaguaguguuagaaaguauuccuuagauuuuauuuaauauuuuaguuuauuucauuuggaagugcgaggaauagaaccaagggccaaggcaagugcuauacaaucgagcaauacuuuagcuucuuagauauguuugccuuuuguuuguuuggcuguugauuuugguagggucucauuguauagccuaagcuggcuucaaauugacaaucuuccugcuuuauuuagcacaccuguuaauuccauuuccucaacauuucucaaauuuaucccauccuucucguuccuucuaacuacuucagcccauucuggcuaagccccucagacucacacuccagauuuccauauuccuuuuaaacuauuuuauuuuuguguauauauguaagcccgcaggagaggccauuagauccccuggagcuggaguuacagauagucgugagccaucuaaugugggugcuagaacgaaacucaaaucuggaagagcagcaagugguuuuuuuguuuguuuguuuuuguuuuuguuuuuuuguuuuuugagacaggguuucucuguauagcccuggcuguccuggaacucacuuuguagaccaggcuggccucgaacucagaaaucugccugccucugccuccugaguacugggauuaaaggugugugccaccaugcccggcuugcagcaaagaacuaucuuuccaaccccccauauucuuauuaauuguucugaaauguaaauuuaacauauuuaaauuguucuguggcuucuguuguucauagauagcuuccaaacuuuauaccaggaccucugccuuauuaguuaguuucacuccaguauuucuggaaauacuaggccccuuugcauuuucuuccugaugacugaaaaauuuuaccuuguucaaucuguuaucuuugucugguacugucuuucuuucccggucuuuccaauaaacuccaacuuuuuucauucucacuuuguaccuuggguuguccucuauguuucccaucucuggauuucuaaaauauucccagcagcucuuaccacauggucagguuguuuaaaugguuuauuuagguaucuguuacuucccuuuuagugccuaaaauacugucugguucauuuuggguauccaaguguugguugacugacuaaagauccagaaagguagggugacuuucaagaucaugauacucauaggugacaaaaauuacgcuagaaaaaaagaccucucguugucuuaugcuauagaccagugcucauccuaggacauuauguaaaacuagauaaauauaauauuguguaugauagaagucacuuuaagcuaguuuaucaaugauuaacaugcuuauauguuacuuuguauauaggcaaauauauguccuguagcuauaaaaaccuguuuguaauacauaguuuugcauguuaauguuuauauucauaagcaguuaaauaguuccaaucaauuuauaauacacuuucagagcuguuuuuaaacugccagacuugccuuuuuacucucucucucucucucucucucucucucucucucucucucucucucuguguguguguguguguguuggagauauaugcugaugaucagacuaagagccucaggcaugcuaaaugcacuccaucauugaguuuucuaacuauauuuugauuagcacaguuaaaauuuuuaaaaaaugugacauucuagauacuauuauuuaagagauuaugugaggcauaguuuauaauaucuaauaggguggcaaauuuugaaaaguuacauuggaugaauagcucagucgaugugugauuaaaauuuguagaugugaguacuaacauaucaaggcuuuugugucuuuagauucuuccauugucugugguguaugaaaaucucaggauuuagaaacucaaaaccaagugucauuuucuaguaggguaaagaauuauauucaauuuaagauauuuuuaagaaauagaggguuuuuucuuuuuuauugguuauuuuauuuauuuucauuucaaauguucuccccuuucccaguuuccccuccacaaaccccuauccccucccggucccccugccucccccacuggcccaaauagaaguuuuaaaauugaagcacaaggaaaagcaaaucaccagaaagcugaaauaguauguaucuauauuuuuaauguuuaauuuucaguuacagggauggauccaaggccauguacaugcuaaacauacauuuuaauacugagcuuuauucuagccugaauuaguauguccugauuaggauagauacaaaggauauaagcuuuaauuuccuaggauuguuuuugugcaguuguaucugaaacagacucuuguucuguagcccuugccuaccuuguaaucuuccugccucagauucccaagugcagggauugcagguguguaacccaugccuggcuuacauaucuacuuccauuagaauauucuugaccuuguccuucauauuaauuugugguuauaccgauucuaaauaggcugaaagacuguugauauuagcagugaccauaugucaccucaguuaacucacaggaagacccaaaucauagugucacacgggcuucccuuuaagguugcauacccaagaaugaaauuugauagcagaaagaguggaugcauuuccuaggguguaguuauauauuagccauggcuagaaacuuuagauuacuuaaaauugguaaguucaccccucuuguaacuucagagcuauuaucauacuuagaaaaugaaaaaauaaaaacccuuaagguuaucuaacaggcuuuuuguguaugugugacugacuauucccaguuggcucaaaaaagcauacuuaaaguugaaaugguuaaaacaggggcuggagagauggcucagugguuaagagcaccuacuucucuuccgaagguccugaguucaaaucccagcaaccacaugguggcucacaaccauccguaaugagaucugacgcccucuucugaugcgucugaagacagcuacaguguacuuauauauaauaauaaauaaucuuaaaaaaaaagaaagaaagaaaugguugaaacaggauccaagaaauacacauagcacuuagugaaugugcccuugaacuuugguuucuuucccgauuuccuccaucguucuuuucauuuacugaaaacaaacaaacaaaaagcuuccuauuucaaugagacugaggaacuuagguuuuagcauuaacaacuaacuguacuggcaucccauagguacuuacuuaguuuuggugaauaauguuaacaauacucaaaguuacauauuuuguuucugcagguugauccaaaagauuacauguuuaguggacugaaggaugaaacaguaggucgcuuaccuggaaaaguggcaggacaacaauuugucauucaagacugugagaacuguaacaucuauauuuuugaccacucagcuacuauuaccauugaugacugcacuaacuguguaauuuuuuugggaccagugaaaggcagugucuuuuuccgaaauuguagagauugcaagugcacauuggcuugccagcaauuucgugugagagacuguagaaaguuggaagucuuuuugugcugugcuacucaacccauuauugaaucuuccacaaacaucaaguuuggcuguuuucaaugguacuacccugaauuagcagcccaauucaaagaugcaggccucaguaucuucaauaacauuuggagucauguucaugauuuuacaccugugucaggagagcucaacuggagccuucuuccagaaaaugccgugguucaagacuauguuccuaucccaaugacugaagaauucaaagcugugcgaauuuccacagaagccaauagaagcauuguuccugugucccggggucagagacagaaguacagugaugaaucaugucuugugguauuauuugccgaugauuauacaacugcaaaugccaggaaacuaauugaugagguaaggagaaagagaggagaaauagacauagcuaggacuaugcuacuuuggagacuuucuagguuuucuuguauucaaauuuauuauuagaaauacuggcagcccuccuugccaguauuucuacauaccuugccuccacaggcuugccuuagaagcagaccacuugggccucaaaauccuuucuaagaaaacuuuucauccuagcucaaaucaguaagcauucauuagcaccaauuauaugugggucaugcuguuaccauauuucauucauuauaugaugcauguuuauuuuccacaucuuugcuuacauacuuuguaauuaguugcaacucagaaauaauugaucauagcugaugcuggaaaugaaggcauagagauacaauucuuugccucaagaacugucacuucaucauaaacaauuucuacgcacacucacaacaguacugcauggccuuuucuaaugacuuacugaggaaauuucuuuggaguuuuaauugguuguaaaugacacuuaagaauacauuuagagucugcugugacaguguguaucacagucccauccacacugggcuccuuauuagcucuugccccauugucauugauaggcugggaugggugaauaauaugaauaagguugggauuggaaugucaaaagcucuaacacuuaugagcaguggcuuucagugacuucauucaguaaagaagaguuaaugcacagcagcuuccccuugaaaaauauuggaguggggagcaguuaaggcuucaggagcaggaguuccuuuuuugguagguguaccagucagaagauacauuggccaggcagugguggcgcacgccuuuagucccagcacucgggaggcagaggcaggcggauuucugaguucgaggccagccuggucuacagagugaguuccaggacagccagggcuacacagagaaacccugucucgaaaacaacaagaacaacaacaacaacaaaaaaaaaaaacccaacaacaacaaaaucaagcuuuccgaaguggauaaguaaguuucuuucugaagggauuguuguaaaguugaaaaaggaaugauuuuucuugacaaaaaguaaaaaugcguaucucuauaguuacagaucuauaaugcagugaauccaugucugaacucuacaaaguauauuugaggcagagguuuuaaaacuauagaaccuaaacguauaauuuuaagacuuugauacuuuauucauuauugcuuuuuuuuaaauucagggucucucuguaucuauauauauggcuauaccuagccugaaacuuacuuauguagaccagucuguaucuucaaccucccauaauccuuuugccucugugucccaauggcuuaagccauuucugucuggcuucaguuguugauguuuucuuuuguuaugccaguaugauaagaagcaugcuauggguuuuguaaaauguagaaaaauaugcuuguagccuuugcacugucuagucacaauguuaauucaauaucugagaaguaaauaucuucacucuguuguguggcaaauuucuuuuguaugaugaauuuuuacuacauauaauuuucaaaagauuaaucauugaaguuaaacuucuuugguagauaaccaggaguggauauacagauauauuaacaugcuuaaagaaaaaaaaagccaucaacccagucuuuauuuaugagucaugaaugcucugaacuuuuugaccuuugguaucugaugugugacaugauagacuuugcaagaauauggcuuagaugagugauguucuuuaaaaauccuucuagaaugcaaaauaaaaauccuacacuaauaauaguagucuacacuuaaauaguauuagauauguauguaguuuuacugugucaggcacuguuaaaaauuauugacaugaaguaauacacuauuuaaaacaaccuuaugaaccauagacaggguaaguaacuuggcaaaggucacuuagcuagcugguaaacaguggaacuaugauucauccauucaggcugauaguguuccuguguauuaacccuaaaacaaagcugaugugcugccccugugcugaaagaaagcugauagaugggagguguaggaaugcgacucaggaggcuucuaaacuagaggugcuuugguuagaacugucuaguucagaaaggacauuauuaagaagugaaugauuaaaacaugaaguaguuuagaggucagcaguguuccuguaaaugacgccucacuuacacucuguaaggaagcccuauggacuaauugguucacacacaaaagaaaagggaagagggcgcaagagagaaaccgaaaaggaaacauauggagaguauuaaagcacgcugaauaguaaaagaccuacacguuuuuuauuguaaaacuuuuuuuaaagggacaucguuauagauuuaaacuguggggagguuccuuccaccuacccaccuaaaaaguuuguagugugugcuggaaagcguguucuucauuuaaaaugauaauuuuggaauagguuaaagaugacucccacaggcaaugcacuuggcagucccaugguuggccaaccucccuguucacagaauucauagguuaauucccguguuuaauugggaagggcaaaaaugcaugugggucccagaguuuuccauuugauguugacuuuuuugguuccaugguuguuauuuucuuuuguuguuuuccacacaagugaauauaaauguucuuuguauguagcauaauacuagcaagugagcaaugcgacuugaauguguuggcucacacaugauugaauuuucaaugaguguacuccaugcauccucaaaaccauucaugaguacacaaggcaugaggagcccaacuaaacgcacugcuaucacaacucaguccauggugcuaggaaaggaaagaccuacguaugaagaugagagauuauauauuaguuuaaauaauacuugacuuagcaaagaaacuaguuaguucugagaugaaaaaaauuaaguuugucucagcacagcuauguuaggauagcguagacuuggagauucaauuuccaacucugguuugcugaggaauaucauaaaauugcauuuuuuauuguuuuacaaacucaacacguaguugucugagcuagggaguaugacacuugagaaggcaggacauucuacaaaagcugguuaaaacagaaagcacgcugcaugcagaguuaagggaaguuaccaagacuugaguuucucaccgccaaaaguacuuguuugcuuugauaugaaucacauuuauguacaggauaaaauagguaagcaagguuugaauuauuuaaguauauuuuauaauugaauuugguuaguuaccaugauuuuuauguaaaggugucucuaaaugucuucagugaaaauauuaaaauagauacagcuucauaguaaauauuaugagccguuaccacugacuuuauagaacagguuggaaaauauucacaaucaaaucaguacaaacuugaaaaauacauaguuaacugauuuuuuuuaauaaagaauucuuuuggguuuuuugagacaggguuucuggagcucacuuuuauagaccagccuggccuugaacucgagagauccacuugccucuaccuccugagugcuuggauuaaaggcauguuccacaaucacuuggccuaaaaugauuugaucuaccaucagauuaauuugaauuaaaguagcuauaugaccuugcacagguuucuuaaccaugagaggcucuauauauaugcgcaugcauaaaguucagaaaacuucauguacauaguaaaugccucuuuaaguguagucuugcauucuugcacuauugcuauacaaauugauaggauggcuuuuaagcuuaacauuagguauuuuuuccacuuuauuauaacaucuuuauuauauuuaauaaauuauauugauuguaaugaacuaugguauuuuucauugaguaucugcuguaucauuaaauuaaguuucuauacauguaaauguaauagagaaagugcaccagagucugaauuagccagaaccaaagcaaaacucagaaugcuguguugcauuauauacagaaaaaugcugaaauaacaaaacuuuguuuucauaccagaaguucauuuuaaagucuaaaugaaauuuuauucuccacagaugguugguaaaggcuucucccuagugcagacaaaggaaaugucaaugaaaacugaagacgcccaaaggguuuuccaggaaaaggcaucagauuuuuuacuucuucuaaacaaagguauuuucuguaauuauuuuccugacuggccaucuuaacauuuucuuuuccuucuguauuaccuucucuuccucuuuuguuuuuucucaaugccuaaaaaacccuguauaacucacuuucuuccuguucuguguuuaguacuuaaacuagucacauuucuacauuauuuuaguuuuauuuuauuacuguuguaccuuuguauuguuguaaagcacuugauaaagaugugcuuuggccauacugaaaaggaaguaagaaauacaaagucaauauuuucuguuuucauauaauuaacuucucaugaaaaaguagaauguuuuaguaagugaaugccaccaguaaauuucagcuguuaaagaaauguauaggggcuggagagauggcucaguggguaagagcacugacugcucuucugaagagacccagcaaccacgugguggcucacaaccaucuguaacaagauuugugcccucuucuggaaugucugaagacagcuacaguguacuuacauauaauaaauaaauaaaucuuaaaaaaaagagaaauguacauaggagaggaguuggacuguauaccuugccgacgggcugcuguuugccuauauuuucuugguuuuuuuuuacaugcuaauuaccaguggcagguuccuguauuuaaaauugacaguuacaguuuuguuacacaaccccacccccgcccccgcccccgcccagcaaccccaggugccauaguuccaugacuugccagucugaaguagugucuaugugaucaaggucuagcuuugcuucaguagcuuugcuucuacugcacuuuucugacaugcagaagugaaguuucggcugauagauguuccaaguuucaaaccauccauuuuaacuuuuuaaguuucuuugucuuauucauaaaaggaaagaagcaacucuucaccacucugcaucuccaauggcuuuggaaaauauauaaucucuuccguuaagauucauaacgccauccuugagaugaaauuuccauuuauacuucuguguaucuuauaaguacuggcauacaacaacauuuucugugucaaagaguucugcccuuccucaucacuuacaacaucuucacucuugaggggcucuucuuccaccugcccaucaucaacuccaucuuucucuuccuccuccucaucaucacagucuucaucuccaucuuccucaggagauguaugcccuguuccaucaacuugcagcacaacagagcuugcuguugggcaggcugggccuguggcugcugcuguccagcugcaggcaucugugcuugugcugcugugggugcugccaugguuguaggaaugaccugaggcuuauuuccuauaaauaagauuugcuguggcuggaugaugacgccugucuguagugacaucccuccaggaagugggguaggaccugcuggauaacaggcacuuguacuccaccaggcugcauuugugguauagcuuguagaacaaaugacugcucaggcugaaagauacacugggcaccauuggcugcucugaccaccugaagcagcuggccugaaguuguuagucucuguugaacaggaguuacgccggcagcacucguaauacuugauggauuccuauguuguaucaauuuaggaacaguaacuuguggugcuauagcuugcugugaugcaggaauaagaaccugcugggucugugcuugcugaugcugugcuggcugauggugguggagaugcgaugcugaugcugaugcugggcucgcugauggugguggugaugcugcugcugaacuugcaacaaaagcugcucuucuuccaaugaaauccauccacugcccuagacuacauuacuuuauucucucacaaaguuuuuaguuccaucaggaccuguuccuccacuccaucacccagaaaaaaaugucucguacgucauuaauaacaucuucaaucacagaucuauacaauuuaggcacaguauuuguguuugccgaguuugcaauuuccacacacaacacaaacaagggggagcaagauauaaagaaaaaaaagaaagaaaaagaaaaggaaaaaaacugagacccaagucaccugcaagaguggggcaaaaauuucucaauaaaaccuauccagaaggaguaagaggcaggagaccaggagggagggggacacuccucccacagcucaaaccuugagaauugcaagccaucuccaagauggacuuuuauauuucuuaaggguguauugacucaggaggccaaaguauuaucuauuggaaguaggaacauuguuugcucaaggcuccaaguugauaugaauagcaauaugcaaugcuaauuagguaaacccuacagacagggcacaucugcauguguguuuauguauaaauaaauuaaaaugaacucuaaaauuauauaugaaaaaaccauuggaggacuguugggauaauuuuaaucaguaaugcuguguguaauugggcuauuaaguguuagcauauccuuuuacgguuauuauaguaguggaaagauuuacuccaaucuagugcuugaaucuaccucagaauauauuuugacauaggacauuuaaaugaaaucuugaaaaugaaccuugaaacucucgucaacuuucagaaauggaauugagcgauaagucuaauggauccuaaagugugaggauuaguauugaagucaguaaucugaaucaaggauuauagauuuguacacuauuagcaaagaaguauuguagaauuacuucgaccucaacaguaucugccuuuaaauaauauguuucauaugggaauaguaaaaugcuaccaaaguagaacaaaaauuagugagcagguguuauaagaauuucaggaaauaaacaucauacaaaccagucuuuaaaggagagauacuuacaggagguacucaaaacacugauguagucauaucaagucaaaagagccagcuugaaggagucugcauuggcaaaauuuggggacaauuugaccaggaaaagaauaaugggaguugggaguauacuuggugguaagacugcuugccuaguauguuugaggacuuggauucaauuucgaauaauaaauaaaccccacaaaagcguaaugaagguaaugcaacaucagaaagaaaugcaccuguggaagaggcgaggcuugagugaagugguacucugugugcuugggaggaagaggaagagggauuugugaguucaaggccaucgucagccaugguucagggccagguuugggggaggggagcauuaggauuacaggcuaccucuuaccuucugccuccugccucucuugucuuugcuuguucucuucuuuuucaaaucuggagacagggauuuuuuuuuuuuaacaucaaugugaugagugaaccaagauaggaaagaaaguaaguuaaaugacaccauaaggaaacaaugaaccaaguccaaaauacaagacauccuguacgauaacaagcuagguuucuucagaugaggaagucuuuuggauuaaaauaaugcaaaaagauguaauagugaaugcaacgagagagccuugauuggcuaugggaaugauauggaacagacuagguagaucuuaaaccaggaguuugaaaugauaguuauuucauuuucuuagguaugaaaucauauugcgguuagguaggcuaugaauguggaguaucauugugucagcaaaagaaaaacaaagcauggguguguaggggcccgaaaaaugacucagugaguaaaagcacuugccaccaagcuugaugacuugaguucagcuccugggucccucccacauggaagaaggagagaacugacuuccauaagcgugccuugccaugagcaccuacacacacccacaucuacauaaauaaauaaauaaacacauaaauguaaaauaauaaaaaucucuguggccaaaauuugacucuuaguaacuauaguuaaagauaagauggauuuuuuuuuuuuuuuuuuuuuuuuuuugagacaggguuucucuguguagcccuggcuguccuggaacucacuccgcagaccaggcuggccuugaauaauaagaugaauauguaugcuguucuuuccauguuuuuagaaugugugauuuuuuuuuuucaaaauaagaauuggaaggguuggaguaauggcucaaugguuaagagaaguggcuauucuuccagaggacccacguucuaguuucacgugguguuugacaauuggcuauaauuucaguucccgccauucugaugcacucuucuggguuccucagacccugcaugauccacaggcauacaugcaggcaaaacacccauacauacaaauaauaaauaaaaccuuuuuuuaaaaaaguauccauuuuauucucaaaacccuuaaaauuuuugagaaaaauccaagcugcccaguagugacuucauauggaccagcaagcagacucagugcuaauauuccaaaagguuggacugggcccucuuuuaaagugaccaauagucauucucaggcaggauuucucaacuuuggcaucauugacaucuugagucagguaauucuuuguccuggauaggacuggccugugugugauaaaaugcugaacagaacucuggcuccuguccacuagauacuaauuucuucaguuguagcaacaacaacaaaauauuuuuaggcauugccuaauguccuuuaaggagcagaauugcugucaguugaaagccauuuuuuaaaaugguaggcuuagucuugaaauuuuacuuuuauuuuaauuuauggcugaaucuaaacuagucuuuaauuccaauuaucuaguuuuaguuaauaaauauuacuauuugacuauuaauaagagaaucuguuguccauucuaagacuuccaaaccugacuaauccucaaaacuaucuaggauguuuuuaaaaauauaaauuuccaacuagugucucaaaaggagugauucagaagucuuucugauguguccuuggaaucaacauuuuugguaguuucucagacugucgggcaucuuguuuaccuuuuuguuuuagagguuucuuuuauugaacacacacaguagauuagcauuaguaaagggccgucagacagcauggugcuuuugcaggccacugcaggcuuugugguuuagucuaaaugagauaagcuaguagacauuuguaugcuuuuuauuuuuaauaaaguuuuagaauaauuuuaaauuuacagaaaauuugcaaagacaauauucuguauacccuuuacccgagucucuaaauguuaacauagccaaugcaaauuugucaaaaccaagaaauucaccuugguaaaauguuaacucauucuuuuuccuuucaccagauuuuugacuaugcaaguuucaguuccagaauucaguuccagaucucacacuggcuuuaguugcuguguuuccuucaucuccccaacucugucacaguugucaaccuucucuuguuuuucauaauccgaaacuuugaaacacuuccaguuaguuugaagacuaucauucuguuggggauuacuggcuguuuucucggguuagacaggguuauagguuuuguagaagaggcagaguagcccucuuuacaucacagccucagcucggcaugagaugcuaucugcucugauuauuuaucuugugugggggagagcagagcacauuugugcugcaggaugaauguagaagccagagaauaacuugugggagucgaauaucuucuaccaugugcgucccagggaucaaacucaaguuuucaggaaacuuuuacucucacguucccaucagucuauuuacauuuuguuugauaacuuuaacuuuuuucagcuuuauugauuauaauuaccagauauuacauuuuaaggcauauaauguaguggucugacauauguauauaugucauguauuauaaaugauuaccacaaacuguuaaguuguauaauuaccuuuaaauuuuuauguaaaaaucuuuuauuguauguauguauguauguauguauauuuguguguaugcauauggguacauugccauagcacaguauagaggucagaggucagaggcaacucugugaagucauuuuuccauuuuuaucuuuacuggguucuggguacuaacucagguuuccagguuugugcagcaaaccuuacccacugagccaucgugauggcccuuuugugggaagaugacaccuuuaaagugucaucauaacaauuuuccaguauacaauauaguauuacuagcuaugucaccacugcuguacaucaaaucuuaagaacugaucuuuauguaugugucucggagugguugugcuggggauugaacaccaugcauucuaggcaggagacagcucaagcuauacaugcagccccaacuuccuaaccauauaacuauaagucuacaugguguaaccaccaccuugcaguugccuguaggcccugggauucccaccauguuaucuuauucaaauuuucaagacuccacauauaacugaaauuauacaguguuuuuaucuauuuaacuuauacugcccuguggcucacccaugucaauccagaucgcaaaaauuuuuaauggcaaaauaggugugugugugugugugugugugugugugugugugugugugagagagagagagagagagagggagagagagagagagagagagacauuuuuuugagacaaggucuuacuguguaaccucagaugaccugaaauucacagaaucugccugccuguaggaugcaaagccaccaagagugagcccacugcacuuuuuuuaaaaagauuucuuuauuauuauaucuaaguacacuguagcugucuucagacaccuagaagagggcaucagaucucauuauguaugguugugagccaccaugugguugcugggauuugaacucaggacccuuggaagagcagucagugcucuuaaccgcugagccaucucuccagcccgccauugcacuuuuuuauccacucaaauguauaccuagaagcuggauuucuggauuauaugguaguucuacuuucaaauuuuuaaguauuuucauaaugacuauaacaauuuacauucccacuagcaguacacaaggguucuucuugcuccacauccuuagcaacauauuucucuuugugguaauaacccaccuaucauguaugagaaguuccuaucucauuguagguuugauugacauuuucuugauuaacaacauuugguacuuuuucauguguugcuucuuauugauaguuaaaaagaagugcuuugcauuucaauuuccuuucaauuccauuagguuucuguucucauauuuauuauuuccuuacuuuaacauuagauaugauuuauucuuucucuaguuucuuaaaguuugaguauaaauuacagauaugggcuggagagauggcucagcggguaagagcaccagcugcucuuccagagguccugaguucaauucccagcaaccacaugguggcucacaaccaucuguaauggaucugaugcccucuacuggugugugugaaggcagcuacauuguacucauauacauaaaauaaauaaguaaagaaaaaggaaaaaaaagaagaaaauaaaucacagauauuaguuuguuuugacauugaaaaacuuacagcuaacagcuugcuugagugaagacacuuagguacaaugcacacaauguuugggggccauaccaacaccaaaauccauaagaaucuccaaaaugugaaaaaugaggcacaauugagacagaauaaaggaugcuugcuuauauacaagggauaaaacaagaaggcugagccucacucagcugggaucaugcacagcaagcagauuugggaacagcugcaacagcagagcagguagaggagucgcauacacuuaaaggacuuggaggagcuugcagaagaacuuuaacaaguagacaaaugagcuacuguauguguauuuaauacugauuuucuuccuacuguauauguauuuaauacuuuagcuguauccugaaaauuucaacacauuuuguuuucauauucauucaguucaagauuuagcaaaauaccugcuuuagaaaaugaaauuuuaugugaguauggucauaagcauucuuuuguguauucugcugcuuuugugcuacaaccaaagagcuguuuacuggcagguaauguauaguccucaaggccuaaaauauuuuuuaucugauccuuuauagagaaaagaacuugacauuuaauuuagugaaaagucauugugaagccaguauaguaacacauucuugaggaucaugagguucagagcaguuuggguuauaugugaguucaagaucagauugggcuauuuauuugaauuaugucucaaaaaaaaaggaagaggaggaggagagagggaaagaagguggaagaagagcaggagaaggagaggaagaggaagaaggaggagaaagaaaaaggaggagaaagagaaaacggagaaggagaaggaggaggaggaggagcaggaggagcaggaggagcaggaggaggaggaggaggagaaggaggaggaggagcaggaggaggaggaggaggagaaggaaggacgacuugggggcugaagaguugguuuagucauuaguaucacuuguggaggcugaagagauaguucagucacuagggucacuugcuacucuucccgagaacccaaguucaauuuccaguacccauguuggguggcucaagcuccaggcuacccucugcugaucuccaugggcacuugcacucaaguacauauacccccaacaaaggcaaacguacuguuuucuacaguaaguuaaaucuguuuuaugacgcaggcuacagucuauuuuguuuagauuuuaugcuuauuugauaauacuguaaauucucuuugcuugguaggauguuauagaaauaacuacuaugucaacuuaguugauaauaacaugcaaggaagucaucucucuccuuucugccuauuuauuucauacauuaaugagagaaauguuaaagucuacaagugucauaaggauuugugacauuucuuuuuucuaaucuuugaggcuuaacuguauauuuugaaagucuguuaauugcauaugcaauuaggauuguuacaucuuggagaaucuuuauuauauaauaguacccuuuaucuccaauuaucuucuuugcucuaaaauuuauuuuaucuaaaauuaauaagguuacuuauuuguuuuauauauauaauguauauaauauauuucuuaucaaguauauauaauuaaguaaaauuuuuuuagagcauguaguuguuuucugcuuuucaguccaguccgacagucuuuaacuguugucucuagaacauucauaucaaaguagauuacugauaaaauuggacuaaagucaucuugcuaguuuuuuucuauuauauuuuuguuaccucuauaaauguaauugagcauuuuuauaauuccauuuaaccuucuauugacuuguugauuguacauguuuuucuaaaacuuuguuucacagaaguaaauuacaauuuagauaauuugcagccaacuucacuuauagucuaagaaacugcaagcauauuuuuagaucucccuucccaucuucuguccuuuaucauuucuuuuauguuuauuaugaugcacuguaauaaugauugguaauguuauugcuuugaauucucaugcauuuuuacagcaguauaaaauaggaaaaauggagaucauauuuaacuggagguuuuagaacagaggaauggcaugguccuuuuaaaaugcaauuauuaaaagcaagaggcuggggauuacauuagcgauaaagcaguucucgccggagcuuggaagucucucuguggaggucugagggaagagcucgugccagguagaugccgugccaucgucaugggcaagggugaccccagcaagcugcaaggcaaaauguccucauacgccuucuuugugcagagcacaagaagcaucccgacucgucagucaauuucaccgaguucuccaagaaaugcuccgagaaauggaagaccaugucugcaaaggaaaaguccaaguuugaagauuuggccaagagugacaaagcucguuaugacagggagaugaagaacuauguuccucccaaaggugauaagaaaggaaagaaaaaagauccaaaugcuccaaagagaccaccauuugccuucuuccuguuuugcucugaaaauugcccaaagaucaaaauugaacacccuggccugucuauuggagauccugugaagaaacugggugcgaugugguuugagcaaucugccaaagagaaacaaccgugugagcagaaagcagcuaaacuaaaggagaaguacgaacaggaaauugcugcauacugugccaagagcaaaagcgaagcaggaaagaaggauccugagggcuggagagauggcucagcgguuaagagcaccgacugcucuuccgaagguccugaguucaaaucccagcaaccacaugguggcucacaaccauccguaaugagaucugacgccuucuucuggagugucugaagacagcuaugaugaauauaauaaauaagucuuuuaaaaaaaaaaaaaagaaggauccugguaggccaacagacucaaagaagaagaaugaaccagaagaugaggaagaagaggagaaggaagagaggagaaggaagaggaggaugaagaauaaguggcugucugaaaguguggaguauaugugcucaggcaauuauuuugcuaagaaugugaaauucaagugcagcacaacauuagcuucaguuauuuuuauagcaauggaaaacuugugcacauguuuggaaacuguuaaaccauggugguagauauaguaccuuguuacauuauugucuauuuuuuuguugcuguuuuucuuuuguuguuauuuuuccuuuugaaaaggaaaaaaaaccuacuauuuagcacuggcuggccugaacuugguggaccaagcuggcagcaacugacagagacugucucuaccaucaaaccuagcugaaauaucuuauugaguuuaaagcacugaaauuauccaagggcaauagaauguauuaaaaggauaugaggcaugacgaaaucagaaggaauaauuacagcuuauuaaaacgcacugacuauauaaaaguccuugaguucauaaugguauuuagacaaaaaggaauccaacucacugggcauuacugaggauugcuaggguaccacuucaguccucugaaaacugaugcuuacuuuuccucuuuuuuaucucguaugagcacauuucaagucaaccaaacagugcugauguacaagguguucucuuaacaucugcuaacaaauguagaggugauaagauaaccagaaagugaucauuuugcaucuccuguuaaaauaauugguucaggcaaaacgccuauggucuugacauccuauucauuucauucacauugaaaaggucacugccaccugaaucugcugaugacucuuagcaugauaagaaacgcuagucaaacacugugggcauuuguauuuaaagcaaaaaagagguacugccaccuaugaaguauucuugucaaaaaaaauaaaccuaaauguaaacaagguuuucauuuaacuucuacaagaaacauagcagaacaauuuaaucccauaaacacuacagggcaccugaccaaacuacauaaagaggggaguggggggggggcugggggacuuugggauagcauuugaaauguaaaugaagaaaauaccuaauuaaaaaauaaauuuuaaaaaggcucuuaaaaaauuaacugaagcaaacaacuuaagaggaagguuuuauuuugacuugcaagcuuuggagcuuucagucugugacugauugaccuuguuccuuugggcuuucccacaguacaccaugauaggaacacaucaggaaaaagcccauucgcccuguacuuuaaacaaaaggaagaagagaugaggcuccacgaugcucuuugugacuagccccuaacgauauggaaaucucucacucugcgccuucucuucagcguuuguuucuacgacuuuucaguacuuugggcugguuacuaagcuuuuagcacauggacuaaaauccaaacuauuauacuaacucauagacaauauagaacuuaguaaauuuuuuucuuuuacaauacuuuucuucugaaaguuuucguuucuuacuauauuguuuuaacacagugguuuuauaaauagcagcaacuuuuacuaugaguaagauuaaugaaacuuuaaaauucccuucuaucuuuuuguacuuaggccguauuccacugaggguauacagacaaaacacugccuucuaagcuugcuuagacuaggucucuguauggccauaucacuaacuugauagauucauuuauuuuaguuugcuuuuaaguuuuagaaccuuuuuuuccacauuuacauuuggcuuugagaugcugacacacuuuccaauuucaaguuauauaaaauaguacauugagagaauuuucaccugcauccaugcuacuacuuugauccucuucuuucuuucaauagguaaacauuugggggguggggcuuuugauauuuaucuuuuuacauuuuucugaacaggcuugaggcuuagaauagguucgcuagcauaagaacuucuuccuuaaaagcuaccuuuagaauuauuaccccaugcaagguuucauucaauacccucuucuuuuuuaaaaagauuuauuuauuuauuuauuuauuuauuuauuuauuuuauguacaguguugucucccuuugugauuucuuccuggauuguuuuguuuuguuugauuguguuuaucuguauucuuuaagggauuuuuguguuuccucuuuaaaguuuucuaccuguuuuccuguguucuccuguauuucuuuaagggaguuauuuauguccuucuuaaauuccucuaucaccaccaugagaugugauuuugauaucagaaucuugccuuucugguguguugggguaaccaggguucucacugugaugggagaacuggguucugaugaugccacguagucuugguuucuguugcuuauguucuugugcuuaccucucaauaucugguuaucucugguguuagcuggucuugcugucucugacuuuggcuugucccuccugcaagccugugugucaguacuccugggagacaguucucucugggaggaauuuggguauggagagaugugguacagggucaggucuggggugcagacagaaaccagaaggauccuguccccagcugauccuugguuccuguguccugauggcucugugagugucccucuugggccaggaauuugaagagaagugguggucuuaccugggcucacagguguguagguacuccagggaaaucagcucucuccuggugguauuucuguauuuagcuuuguagcgcuccuggacuccugucccaggccgccccucuguuccuguguccugaggguucugaguggguuccucugagcagcagugagugaugguccucccugcacucacaguccugucugugcuccugggaggcucacuccaucccggcacuauuuggguacggagcccuguggcagaggaucucccugauacucucuucuuaucacucaccuuuuugccaagaaugagaaaauguuagcaguuaucuuuucuuuuacuugguaccuaucauaaucuacagauacuguggugcuuggagcucauagucuagcuuguucucuaggucugaggguacaguugacagcuguauuguuuaccuuuccuauauguuuacuguauuaaauuauaacccuccaguuauuuuagcaucaaauuuaacgauauccuucucauuguugugcuuugugcaggacacacaacgacauuaaaguuagcauuucauaucacuuuaguauuucauacuuaguacucuauuauuguuuuauguuuguuuaaucaguuuauaucuguuuucaaaacacauuuguaaacccguggaggucagaauuucuccaucaucauaggagaugaaaggcugaucuguuaggaauaugaugauuuuuuuuuuaugagacaggguuucucuguguagcucuggcuguccuggaacucacucuguagaccaggcuggccucgaacucagaaauccgccugccucugccucccgagugcugggauuaaaggcgugcgccaccacgcccggcuauaggaauauggugaucacugaauaaacauuaauuaaaguucacauuuucuuggucuaacuagucuuggccaugcuugccaaaaaaaaaaaaaaaucuguguuaguccaggucuaccaaagguagaauuucuaccccuaaauauaagucauagggguuuuaaaaguauucaaauuaauggaugggaaaggagggacaaaucuuuccauucagaggauuaaaaucuuugcuuuuagaauguagcuuuaagacacacuugggaaauuuuuuucaaggagguauugcuuuggugccuagccuuaauuccccuuugguuuaguuccauaguuuguggccuagagcuuggcugguaaguaagggaacuggaaggaaggccagcugccuggcaagacuuguuuauguugacuuggauuguuuuuuaucuuguuugguauuuuucccacuauuuuuuguacugcuaaaugaguggagauucuuugguauuguuuguuuuguuuuaaaaaggagaauaagccaggcgugguggcgcacaccuuuaaucccaacacuugggaggcagaggcagguggauuucugaguucgaggccagccuggucuacagagugaguuccaggacagccagggcuauacagagaaacccugucucgaaaaaaaaccaaaaaagaagaagaagaggaggaggaggaggaggaggaggaggaggaggaggaggagaaaccagacaauucccaauucuaaugaccucuucuggccucuacaagucaccugcccucuacaugcucauacacacacacacacauacacacacacacuuuuaaaaaugugacacuaguccuauauauaggagcuguucaucauaggaugagacucaguguuuuaugguaaagauaggggaaaaaaaaacccugaaguaugugcccuucuauuuaucuccuuuccuacgugauaaagauacucgguauuucuuaggaagaauccauucaugaaugcugggcauagugcauaccuauaauucuagugcucaggaggcagaagcacgagaaugaggaaaaguucaagggcagucuggucuacagagugcauuccaggcuacccuggcuaaauagugagacugggucaaaaauauaaaauaaaaggaauacaaggauuacuuuuacaauauauuuguauuucugcuaugaaaacacuucuugggguuccuuucagguccugugauugccuuggaauuuaauggagaugacgcuguacaagaaugucaccuuauuguaaaugggauguucaacgggacaaagguauaagaucuuacugacuauaucucaauccagcuuuccauuuuaucuccuuucccuuauaaucaaacaguacuuguauuuaugguauaucccuuaacaucaccaucacaaccaucuguaacuccagcuccagaggauccaacacccucuuuuaaccucugaggaaacugggcaugugugugguauacauacuacauacauucaggcaaaacauucauacacauacaaaauaacucuaaaaacuuaaaaagaaaacccaagccugugacuuuguucugagaagagguagccuuugacaguuaagggcuacagaacuaauuuuuguuuauuuuguauuuggaauagauguuuguaucagaaaagaaggagaccgcaucuggagauguugauagcuucuauaacuuugcugagauccagauggggauaugaagcggauugugguauuaagccccuuccauccuuuauauacagacaguuugauaauauccuuacauauguuagucauuuagcaauuaguaauuuuuacuaaugcuauaauuguuaaaagcuauuuuuaaauaacucuuugaauaccauauuauuuacuugaguaucuaaaauaauucauuuaaauugaguaguuuuaaucauaaacuauuuaacuugcuucaguaagcuugcaguuuuauuucuuuucauacaauagucuuauuaggaaauaaucaugauuuuauuccuaauuaaaaguucuuucauaucucugguaauuuaaacuuuccaacuuaccuuagugcucuaugauaauucauuuaagaauauauuuuguuucuuauuuucucuuuuaauuuagaggcauuuguuacuaggugaaauuaaauaaaccuaugcacuuuaaaaaaauacauacauagccaguuaaauaaucauuuccuucuugcauuauaugacuaaugagauuuuguacauggaguugacauacuauuuuguaaauugggagauuuuuuuaaaauggguauuugaaagcugaauguggucauggcauauguagucccaggcuacuugggaugccuaaguggaagaaucacuugaguucaggaguucaagaacagcuuuggcaaguaagaaaaggcuaagauaaccagcuuugcaaauacuucuaacugauccuggcauugcugguuuaaggacuacuuccaaguaguacagcugauuucuaagcacaacugccagaugauucuccuguuuucuaauaagaaaaaguuagauacaacauaaaacuauagaacaccaaugaccaagcagggcgugguggcacacgccuuuaaugccagcacuggggaggcagaggcaggcugauuucugaguuugaggccagccuggucuacagagugaguuccaggacagccagggcuauacagagaaacccugucucgaaaaacaaaacaaaacaaaagaacaccaaugagcaacagauuugacagaggugaucagugucugugacuagcuauugugacuagcaagagaccuagagcaaaucuuauaaguaaggaaucuuuuaaguaaggaacacuuagguaugaugauaaucuagacagguuauucaaaaucuccauccauuuuuuuuuuuugcucaugucaacuaguguuaaaguaugauaaaaguuuugguuacuugaaaucauuauuucucaauucuauuugauaauaguaacuuccaggaggaggaaugggaauuguucagaaauacacauugauggauccagucuaaaggugcacagauucaguuuucaagggaaacugaaauaggguguauuguuaucuaaacuaaucaguucugaaagugcugauagggcgauuuuaucauauuuggcagggagcaagaacagcuuucauaggcucauuuauaggacucaaaauggaaacuuuuauuuuuauaaaacugagauugaaaauggccacuuguaaaaauuccuuccaugguuguuaccaaaaguguauuuuccuguuuaaagugguuuuggaaacuuucaggccaacuuauaacuaucauguugaauuguaaauguguagaaauaaugcuuuuuuauuuugaauuaauaauauugaguaccuacacugugccuagccuaccaucagcauuucaacauuucuuuuauuauaagagcaucauguucuacagagucaauaugaucucauaaggugcaaauaaaaacugcuggcagggcagguauaauaauuucuaucauaguuuacaaauggucuuugcaaauagugaucagaggcauuaacguuucccugagcuaagcuaaauuaaaugcauucuuuucugccuugauuauauuacuaauuuucuuuacccacauuugaaauaaucucaauacuugcuauuucaaaacuaaaaugcaauguuauaggggguauacauugaguuuuuaaucguaucaauaaugguguguaaaaacucaagaauauuauauaaaggagacauuaauuuaagauuuucccaccaaauuuaguauguuaaccaaaaccuaaaacuuuauauccauuuagaugggaacuuuuuacaaguacuuuuauguuguuucugcaagucuagacuucaauaguaaucaugauauacuaacuauauuuuauuucugaauaguuuuuuaaauucaugaaaaauuaauagccaugaaaacugauuuuauugucauauuuguuuaagcaucuuauuaguuuacuucucuugcauuaauaguacugcuauauuuugggucuguauauuuauauguggcauuuauaaaauuaucuaguguuuuaaaaauacuuugaaauaaauauuaaaauuaaaaugguucaaugcuacuuuuuugaagaguacucuauauuuacucauacuuguaccaaaauuugauaaaauuuuuauuuucuuuuggguguuuuguuauacaacuuuuaauuuuaaaaacaaaauaaaguggucuaaucucuguuuuauacuaaugagaaaugaacuguuaaacugcguguguauguauuugauguauauaugugcauguguauauacacaagguacucuaaagaaaugaaaaggaagaaacauauuuugauauaaggaauuuacaucauguuuucuuugcuaaaauaagucacauuuuguuaugggugaauauuugcuaagauuaggcaucuuuccuuccauauuuuaaaaauaugcuggguauagcauauacaauuguaauucuaguacucaggaauucaaggccagccuagguuauauauugaauuccaggccagucugggcuauauagcaagagccugccucaaaaaauaaagaagugugauaaauuuucauucaggcuuauaaaaguagaugguauuuuuuauugucaaguuuaccagucuuuguccuccuuuccuaucucacaaaacaaauacugaaagugcaaauugguuuguuuguaaaaagauaacauuauguuuauuucuacuuauaaagguucaacaaguacauuaagaacauuuggagcauugagaacaagcagaaaugauaacacaauaauaaaauugcuuccuguuggauauuucuugaugucuauacuuuguuuuucucauaaaagauauauuuaagcuuucuuuauaaacaggaaagugauuuugaugcacauuaaaauuuaagaugugccgggcgugguggcgcacgccuuucaucccagcacuugggaggcagaggcaggcggauuucugaguucgaggccagccuggucuacagagugaguuccaggacagccagggcuacacagagaaacccugucucgaaaaaaaaaaaaauuaagaugcucauucuauacuguuagcucuacaagcucuagaaucguggugccuucaaacccauucaagacaacauuuugucuuuuaaaggcucaguccuaaauaggacauuuguaucacucucaucccucccaagcucggggauccuuuuuagaagaggagguugggaagauccaggguuguggauaacaucaaggaaacuauuuuccggauccaaacaggcaguugcacagaugacugaguacuuacagugacugugacagcaagcacaagucuugugcaugcuccagccagacaaaaauuccugcauggagcagggagggugggcacaaaaucccaccaugacuuaagaagcuauugguauuugauuguuucugggagagggagaaucagguuucuugaaugaugugacccugguagguugaccauaggcaggccauacccacaaaacuagcuagaaagacaaacuggauuugaugaaaggaaaaaaaaaacaaaauuauaucagaaggaaggggaagauagagaggguaguuauggaaggaguuagggguaaaggauaaauauguucaaaauaugucacaugaaauucccaaagaauaaauuuguuugcaaaauaaaugcaggaagugugauccauugggauuggguuuuguggcuugauuucugcacuguaucuuaaauacuguacuacuuccaaaacagcaaaggauccuuaaaacauacuuuuuaaaaaguuuaacgcuaaaaaagccagccuucacgucacugguagucauguaguaguguagcuucaaucugaagagucucucaaaggucccuguguuagguuuagcagguaaaggaacuugcuguauaagacugguaauauaaauuugaacccacauaaagguagaagagucuauuacaugggcuggagagauggcucccuaguuaagacacuggcugcucuuccagagguccauuccuaacaaccacaugguagcucacaaccaucuguaaugggauccuaugcccucuucuggugugucugaagacagcgacaguguauguauauacauaaaauaaauaaaucuuuuuuuuuaaaaagaauugauuacacauaguuggccucuaaccuugacauguaugcccugucacaauaaugaaaaauuuaaaagguccauguuugggacaucuguauuauauuuuucccccaagacucaggaagcauugcagaagaggggcagaaagauuguaguaagaggggcuggugagauggcucaguggguaagagcacccgacugcucuuccaaagguccagaguucaaaucccagcaaccacaugguggcucacaaccauccguaacgagaucugacgcccucuucuggugugucugaagacagcuacaguguacuuacauauaauaaauaaauaaaucuuuaaaaaaaaaaaaagauuguaguaagagccagggaagacugcaaugaaauagugucuccugaguauaauagggccccugcacuccuaaagucagcagcuauaguugccugccuagcauuugcacaagaucaagccaauuaacccuccaacacuguaauugccugccugguuccucucuacaagaucaagccagucaacauucuaacauggauauggaucuacucguagguguugaaagggugauguggugggauccugggagaaguugggggauagauauguucuaaauauauuguauucauauaugaaauuacauaagaauauagucaggcaauggugucacacacccuuaaucccagcacucuggagucaaaggcagacagauuucugaguucaagaccacccugcucuacaaugugagcuccaggacagccacagagaaauccuaucucaagaaaaaagaauauacauauauauguguguguguguauauauauauauauauauauauauauauauauauauauauauauauauauauguaguuuuaaaguccauguauuaaaggaauggucacuagccugugguacugccagaagguggugauuuuaggaaauagagucuagugaaggugacugcuggcaggcauauuugaaccaggacccuccccacucucuuuaugcuucccagauaccaugaagugaacaccuuugcuaucuauguccaacucugugacacuauaccuugccagaggccugaaauggaccagcugacugaaaacaaguacugaaauaaaccuuuccuccuuaaaaguugguuuuccucagguauuuagaacagcuuaugcagauuuauagacuuaugcagacuuaugcuaucuuaauagugaaggccuuuuuguuacgugaaguaauuccuuuacucuugacuuguuuucuuucuugguauauagagaauauuagagaauagaaaugucauuauauuucaucccuuuuuguauaugacacuaugacuuuuagugguaagauguucagaaacugauuucauacuuucuuggugaaggcuuauucucaucuauaaauagugaacauaauugguauagcccucagaauucucacccuggcucugauccuccugucaccugccuucacuucuucgguuuacccuuauccacuucuaauuagacacugagaaaauaacuuaaauuguaugacaucuaauuaacugaugcuuguguccauugaaaacgacaaguaauuuauaaaaguuaaguaucauugugcugaacaaaguggaugcgaugcuuuuuaaaguaguuuagugguaagggccauacaucucacacaauuagguaacuuaguaagaaaaaaacaaguauaaguggcagguaggacuugagugcuguuuuccugcagugugcugcacuuccaauuguaaaauucagguugguuuuauaggcucauuaauagacucuuuuauauuguucuuagaaacagacaauaaauaauuuaagaauaauuuuaggugcuggggauggaacccaggaccuugcuagguaagugcuccauaccauccuuacauuuucucucauuggagucucaguuuuagggcugugaagaggcuaacaaucccgauuuuucauuuuggauaggaaagaaaacugagugucagaaaguuuggauggccugucaagcucaaaccauagucacugaacugcaauguaagccucuuugcuguccccuugugguuacuaggggaacaagacucacuuacuuaugugaagccuuuuccaacaacacacacacacacacacacacacacacacacacacauacgcacacacacugaaguuuaguugggaaaaggaaagauuaacaaguagacugugcauaagaagguaauggugacuccaacaaaaucccguauacgcaagguuggaacuaucaugaugaaccccauucuuacaugaacuacuaaaagaggaagcaaaguuaugugcaggaagaaagaguggauaaaggugaugagggcagaaguaugaaagacaaaaauggaacccucaaaaaaugagaaugagauuugauaccucuuacaguccugaucuuuaaacuuuguaaaugaauuaucgaauucaaaauaaaauuugaauguuaaaaaauguugguaagcaaaagauaaaaagaaacagcaaguggaaaugcuucuuuaaagacagggucuuuauuuuuuauuuuugaaauggagcucagggaaggcaaggauucgugcucagagacagcugcaagaaaugaccuuuggcuccaaaccaaagacuggcccuggggcucagagaggacgauucuugcuuagugaccaguggaacaauggaguucaggaagaacuagauuaaaggauaagaagugagcggugaacagcgagauauccagucaguuaacacaacuuuuauuguugcuucuuuauaccucacaagaaugauuccugcuucugcccaugcugcuauacuuaacaagggugcuuuuaaucuugucaaaaagucccuacauauuucuuuauucacaccuucucuguuucacuguguaccccuccauuuuuuuaaaauuuuaaaaucauuuuaaguuuuuuaaugaauggguguuuugccugcauguauguauguguauuuucaugcuuggugccugcacaggucagaagagagcauuggauccccugaacugugguuacaaaugguuguaagcuaccauauggacauuaggaacuggaagagcaacaaguacucuuaaccacugagccaucucuccagguaccuucccauuauucuuuaaaaugccucccuagauuaaguccuuacaugauuacugucuuuuucacuaaguacuuugauagacucauuuuucagcuuuaggacuuugccucuuugucuagauccucuagauuuccuuuauccuucuccacgucaucugucaucaugguagaagauucagucauguccacgugggucagugcuugucuacuuucaauacuuuugagcaaggcuggaagaccaugaguucaaggcuacugugggcuauauaaugagacccuaucuccaaauaaacacaugaacaauaaaagagucuaacuccuuuacuuu

SEQ ID NO: 9416 - RNA, 2376 nt, Mus musculus
cauuuauacuucuguguaucuuauaaguacuggcauacaacaacauuuucugugucaaagaguucugcccuuccucaucacuuacaacaucuucacucuugaggggcucuucuuccaccugcccaucaucaacuccaucuuucucuuccuccuccucaucaucacagucuucaucuccaucuuccucaggagauguaugcccuguuccaucaacuugcagcacaacagagcuugcuguugggcaggcugggccuguggcugcugcuguccagcugcaggcaucugugcuugugcugcugugggugcugccaugguuguaggaaugaccugaggcuuauuuccuauaaauaagauuugcuguggcuggaugaugacgccugucuguagugacaucccuccaggaagugggguaggaccugcuggauaacaggcacuuguacuccaccaggcugcauuugugguauagcuuguagaacaaaugacugcucaggcugaaagauacacugggcaccauuggcugcucugaccaccugaagcagcuggccugaaguuguuagucucuguugaacaggaguuacgccggcagcacucguaauacuugauggauuccuauguuguaucaauuuaggaacaguaacuuguggugcuauagcuugcugugaugcaggaauaagaaccugcugggucugugcuugcugaugcugugcuggcugauggugguggagaugcgaugcugaugcugaugcugggcucgcugauggugguggugaugcugcugcugaacuugcaacaaaagcugcucuucuuccaaugaaauccauccacugcccuagacuacauuacuuuauucucucacaaaguuuuuaguuccaucaggaccuguuccuccacuccaucacccagaaaaaaaugucucguacgucauuaauaacaucuucaaucacagaucuauacaauuuaggcacaguauuuguguuugccgaguuugcaauuuccacacacaacacaaacaagggggagcaagauauaaagaaaaaaaagaaagaaaaagaaaaggaaaaaaacugagacccaagucaccugcaagaguggggcaaaaauuucucaauaaaaccuauccagaaggaguaagaggcaggagaccaggagggagggggacacuccucccacagcucaaaccuugagaauugcaagccaucuccaagauggacuuuuauauuucuuaaggguguauugacucaggaggccaaaguauuaucuauuggaaguaggaacauuguuugcucaaggcuccaaguugauaugaauagcaauaugcaaugcuaauuagguaaacccuacagacagggcacaucugcauguguguuuauguauaaauaaauuaaaaugaacucuaaaauuauauaugaaaaaaccauuggaggacuguugggauaauuuuaaucaguaaugcuguguguaauugggcuauuaaguguuagcauauccuuuuacgguuauuauaguaguggaaagauuuacuccaaucuagugcuugaaucuaccucagaauauauuuugacauaggacauuuaaaugaaaucuugaaaaugaaccuugaaacucucgucaacuuucagaaauggaauugagcgauaagucuaauggauccuaaagugugaggauuaguauugaagucaguaaucugaaucaaggauuauagauuuguacacuauuagcaaagaaguauuguagaauuacuucgaccucaacaguaucugccuuuaaauaauauguuucauaugggaauaguaaaaugcuaccaaaguagaacaaaaauuagugagcagguguuauaagaauuucaggaaauaaacaucauacaaaccagucuuuaaaggagagauacuuacaggagguacucaaaacacugauguagucauaucaagucaaaagagccagcuugaaggagucugcauuggcaaaauuuggggacaauuugaccaggaaaagaauaaugggaguugggaguauacuuggugguaagacugcuugccuaguauguuugaggacuuggauucaauuucgaauaauaaauaaaccccacaaaagcguaaugaagguaaugcaacaucagaaagaaaugcaccuguggaagaggcgaggcuugagugaagugguacucugugugcuugggaggaagaggaagagggauuugugaguucaaggccaucgucagccaugguucagggccagguuugggggaggggagcauuaggauuacaggcuaccucuuaccuucugccuccugccucucuugucuuugcuuguucucuucuuuuucaaaucuggagacagggauuuuuuuuuuuuaacaucaaugugaugagugaacca

SEQ ID NO: 9417 - RNA, 2376 nt, Mus musculus
ugguucacucaucacauugauguuaaaaaaaaaaaaucccugucuccagauuugaaaaagaagagaacaagcaaagacaagagaggcaggaggcagaagguaagagguagccuguaauccuaaugcuccccucccccaaaccuggcccugaaccauggcugacgauggccuugaacucacaaaucccucuuccucuuccucccaagcacacagaguaccacuucacucaagccucgccucuuccacaggugcauuucuuucugauguugcauuaccuucauuacgcuuuugugggguuuauuuauuauucgaaauugaauccaaguccucaaacauacuaggcaagcagucuuaccaccaaguauacucccaacucccauuauucuuuuccuggucaaauuguccccaaauuuugccaaugcagacuccuucaagcuggcucuuuugacuugauaugacuacaucaguguuuugaguaccuccuguaaguaucucuccuuuaaagacugguuuguaugauguuuauuuccugaaauucuuauaacaccugcucacuaauuuuuguucuacuuugguagcauuuuacuauucccauaugaaacauauuauuuaaaggcagauacuguugaggucgaaguaauucuacaauacuucuuugcuaauaguguacaaaucuauaauccuugauucagauuacugacuucaauacuaauccucacacuuuaggauccauuagacuuaucgcucaauuccauuucugaaaguugacgagaguuucaagguucauuuucaagauuucauuuaaauguccuaugucaaaauauauucugagguagauucaagcacuagauuggaguaaaucuuuccacuacuauaauaaccguaaaaggauaugcuaacacuuaauagcccaauuacacacagcauuacugauuaaaauuaucccaacaguccuccaaugguuuuuucauauauaauuuuagaguucauuuuaauuuauuuauacauaaacacacaugcagaugugcccugucuguaggguuuaccuaauuagcauugcauauugcuauucauaucaacuuggagccuugagcaaacaauguuccuacuuccaauagauaauacuuuggccuccugagucaauacacccuuaagaaauauaaaaguccaucuuggagauggcuugcaauucucaagguuugagcugugggaggagugucccccucccuccuggucuccugccucuuacuccuucuggauagguuuuauugagaaauuuuugccccacucuugcaggugacuugggucucaguuuuuuuccuuuucuuuuucuuucuuuuuuuucuuuauaucuugcucccccuuguuuguguuguguguggaaauugcaaacucggcaaacacaaauacugugccuaaauuguauagaucugugauugaagauguuauuaaugacguacgagacauuuuuuucugggugauggaguggaggaacagguccugauggaacuaaaaacuuugugagagaauaaaguaauguagucuagggcaguggauggauuucauuggaagaagagcagcuuuuguugcaaguucagcagcagcaucaccaccaccaucagcgagcccagcaucagcaucagcaucgcaucuccaccaccaucagccagcacagcaucagcaagcacagacccagcagguucuuauuccugcaucacagcaagcuauagcaccacaaguuacuguuccuaaauugauacaacauaggaauccaucaaguauuacgagugcugccggcguaacuccuguucaacagagacuaacaacuucaggccagcugcuucagguggucagagcagccaauggugcccaguguaucuuucagccugagcagucauuuguucuacaagcuauaccacaaaugcagccugguggaguacaagugccuguuauccagcagguccuaccccacuuccuggagggaugucacuacagacaggcgucaucauccagccacagcaaaucuuauuuauaggaaauaagccucaggucauuccuacaaccauggcagcacccacagcagcacaagcacagaugccugcagcuggacagcagcagccacaggcccagccugcccaacagcaagcucuguugugcugcaaguugauggaacagggcauacaucuccugaggaagauggagaugaagacugugaugaugaggaggaggaagagaaagauggaguugaugaugggcagguggaagaagagccccucaagagugaagauguuguaagugaugaggaagggcagaacucuuugacacagaaaauguuguuguaugccaguacuuauaagauacacagaaguauaaaug

SEQ ID NO: 9418 - RNA, 2298 nt, Mus musculus
gcucuuuagaagcuugcuguccuuugaaguugaaagacaacuagaagcuccaccucuuucccuacagggccaucuagaugucaccgcuuucuucuuacgaagaaaaugaacagaccucucaaaaacaacucucucccagacuaacagaaaugauaacguugauucgguagcgacacggcgugggaggcaaaauagaguccgcaccucgccgaacucguaaacaaacuuaggccggggaucuauuuagcaagguaagggcggagcgacaaaaaucgcgcugggaucaaccgcagcugcgcacauuguauuuccgucucccuccccccccccgccccccaggacuccgcaguacaagcugucauggcggcccgacuguuaagcuuguauggucgcugccugucagcagcgggggcgaugagagggcucccggcugcucgcguucgcugggaguccuccagggcuguaaucgccccauccgguguggagaaaaagcggcaacgagaaccgaccaugcaguggcaggaggacccagaacccgaggacgaaaacgucuacgcgaaggugagagggaggggggaaaacgggacgcuguaggggccaaucuggaccagggaaaccagugucaaagcggacauucuccggcccgagauuugagcaguggacaaaaucuucgaauauucagaaauuuugccuagcuuguuuuucucuuucguugccuuauuugcagucagaaaucacacugaaagagggcagcacccaaagcauguuagaaacuuuauaauuaggguaauacuaaacucuaagguaacacgugcauaaugccaggcugugcuagacacuuuguaucuauuuacucaucucaauucuaaaguagcgugauuuugaaguaggcacuauaacuguuacugaaguaggcacuguaacuguuacagugacauagaugaggauacuaaaacacaaguugcuagcccaagaucacagcuugaguaggucauggagcugauuauuugcauucaggacugaauuccugugcuuuauggagagcagagauucuggagucagacaucuuggguugaaaauuauucacuuguaugaccuuggacaaguaauuuaaucucuuggugccucgguuucuuuguaaagugagaaaaguacuaggaaagcuaagaaaaacacaccugcuucauaugagucagaauggucacugcagcucuuaccacuuacuucagaaguacuccaaauuagaagguguuuauuauugccauuuccacucuacugaggauauugugagguuuguguuuuugaaaaggccuaguauauucaacauuaacaucugauugaagaucuuaaauuauuauaggguccuauagaauaaguggacccauaggaaauugccaauauccaaacauuuuuuuaaucuuuauaaauagcacuuuccaaggaugaaacuuaacagacagggugagcacucccaaacaaguacgugaggccaauuauucauuuggaaagaaagucaaaaucuuggauggggagauggugaugaauucaguggugauuagauuuggaagaagagcuuucuaggccucgagagcagcaaaugucacagcccuguggugggaaggaauuucacguauccuaaaaguagagaaaggauuuuaaucagggauaagagauugguuagagauuggagggcggauuagagaccaggucaugcaaggccaggauauaacuuuauggagcagcaagaagcccuaauugaccucuccuucuccucagaacccugacuuucaugguuaugauagugacccugugguggacgucuggaauaugcgagcugucuucuucuuugguuuuuccaucguccuggucuuugggaccaccuucguggcuuaugugccugauuacagguauagggguuuucuaagaaaguugagugggaaggggcagaggcaaagguagagguuggaggagucucuggccagaauucuuacccuguacuggugggggauagggugcuaaaguugggaacuucugucuaguaagguucccucacaucauaacccacuuguugcuuuuaggaugcaagagugggcccgccgggaagcugagagacuugugaaauaccgagaagucaauggccuucccaucauggaauccaacuacuucgaucccagcaagauccaguuaccagaagaugacugauggcuuaccgagcagggccuaagaagcauuacucauccgcugcuuguuauuuaccugguuccucagaacaccuuauuaaaggaauugaaaguauga

SEQ ID NO: 9419 - RNA, 1759 nt, Mus musculus
gugguggugcacgccuuuaauuccaucaccugggaggcagaggcacacagcucugaguuugagccuggucuacagaaugaguuccaggacagccagggcuauacagaggaaauauauauuucaaaacaacaaaaccaaaacaacaacaacaacaacaacaaaaagaagcaagagggaaggguauugguuacaagggacaacucaagaaaaacugacauugggaaagugugcaggaggacugggagguaagagugcugugccguuuugacucccucuaguaaaguguagguauuuucauagccucaucaagaauguuuuuuuuuuuucuggagcccuaagaaucuuuaauauaucaaucuagaacuuuuccucccugccucuuuccuucucccaauguaguuuuuguccuccuaugauguucaggcuagccucauacuuuugggcucaauuaagucucuggguccaacuuuccuucaucccccuccccaguggcuggaacuacaggucuaugccaccauguuugacuaaagcuuuaaaauaguauccuagggguggcaguguaccucagugguaagaacacuuacauagcaugagcucaaccuuaaacaccauagacacaaaauaauggauugcugagaaugagagggauucagaaaguugugaugugugcauuucuuccugccuccaaggugucaaacccuguucucaccaguggcaacagaguaagcagcaagacagacaaaagucccuuacaucauggugucuuuguuacaaugcaagcaacaaauaauagaacaaacauggaaaaguaagacuucaugugacuggaugaauuguggaaggcagcacaauggaacacagggaugauggcaggggaggccugagaauuuuacaugaagcagccuggguagaccucacugcuagaaugcucagaugauguuuccuucagucuuugguguuccuagccuugaugcuuuugauuauaggccuuuuuguagcucacccagucuuuuuuggaaaacagaggucuaauauaccauaaagaugguaccuaucgggcuggugagauggcucagcgguuaagagcacugacugcucuuccagagguccugaguucaaaucccagccaccacaugguggcucacaaccaccuguaaugagaucugaagacagcuacaguguacuuacauauaauaaauaaauaaaaucuuaagaaaaaaaaagaugguaccugucagguuucuauccuguaaaguuacuauuuuuccuuggcacuuuuaaguacauuuaggggaauggagagauggcucuguaguuaagagcacugguugcucugaaagaacugaggcuuagcuccuaaaaccuuuauggaggcucacauuuaggguccuauauucaugagcuugugcacagauccaaccaugacagaaaauauucaggggagggcugacaguaucaaagguggcacuggguuguccccagcaccaguaaauaaaugaauaaaaaaaaacugggggagaaauuacaucugacuucuuuuccuucuucauucccugauuaauauuguuuagcaacuuacagaacauauguauuauaucagauacuacaaaucagguucuauacaaauacucuaccauuuuaaaaaaagauuucuuuuauguaugugaguacacugucacucucuucaaacacacuagaagagggcaucagaucacauuacaggugguugugagcaccaagugguugcugggaacugaac

SEQ ID NO: 9420 - RNA, 24880 nt, Mus musculus
auuuuugucccugaaacccgggccagaggcgcagaaguagagagaaaugccccucuauucaggcgucuaugguauaccccagacccggcccucuaaggcccccgcgcuuccgagcuccgcgcaaacucugguucuuuuugcacgaucgaggugguuugcucuuccguugcccuguggcuucggcuugucuccagaaggaaggcgaggcuuccgcccagcacugggggugagcgggagcacauuucccccaagccucuggacagcauuuggaagagggugcuucccuaauuccaacuucagggaucccuaaugggcauguuuggagguuguggggcccggguggcauucagugggugucuacuuuugaggagacacuuaggaagcggugcuuggggauucggguggcauuuaggagucuguuuuaugagguaauucucugacgcagauuuauaccccuuggaagcagggcuuaggggggacuugggggaggcucggggucuguguaugaguacucuguuggagggcagaauuuuuggacucuccaagaggagagaaguuugaaguuacuuaagucaaggcgggaguuggggucuugggaccggaccgagugacagugugaauguucgacaccaacguggcacugugacgguuucaguggccuuugugaccucugaugggguugcggcugguuuacccggggcugugaaacccggacacuucaggggcccagacccugggagaggagccucucaaccgaggccaggaagacugucugccaggcucuucugugcagacauagggcuaccgggccacugagcgguccuuggcuacugcuuuagugggacuauggugcggaccuucuuucguaccugguccacuagaagagaauugcucucuagggggcggaucagcgugcggaaggggcguguugacgggguaucccgaagucugagucucaaacuaguuucuugauaacccauacaauaaucugugaaggugaguagcgcccgguggguuuaaaaaaaaaaaaaaaggcuuuucuaagggugcuaugcauaauuuaugaggggcguggucuuuacaguuucuucuucgggauccgcaguuagcuuucccucacagguuccagcauuuaaaccuggcaucuaucagagaagaugccgcagguauuguucuugccuugucucaguaauucuagauuacugacucgagacucuggauucaagacccaucuuugacaagucuuuuugggaguccgaaaaguggguaugcaggauaauaauaauuuacacccauuuaguuacuuuuauuaauccauuuuaucuucacaacuuuucaaaaguagauuucauccuacuucauagauaaagaaucugagauacagggcagguaaguaauuuguccuaaagcugaacagugaauggcugaacuaggauucaaauuugaucuguuggguuucagaguuggauaacguuccccgccuccaagccaauuuaauggagccauuacuggugcgcgcccucuccucuccucuccucuccucuccucuccucuccucuccucuccucuccucuccucuuucucucucuuucuuucuuucuucuuggauguauuaaagaacauucuuagcagugaugaucuuucuccucuccucuccucuccucuccucuccucuccucuccucuccucuccucuccucuccucuccucuccucuccucuccucuccucuccucuccucuccccuccccuccccuccccucuccccuccccuccccuccccuccccuccccucucuccucuccucuccucuccucuccucuccccucuccucuccucuccccuccccucuccucuccccuccccuccccuccccucuccccuccccuccccucuccuccccuccccuccccucuccccuccccuccccuccccuccccuccccucuccccuccccuccccucuccuccccucuccccuccccuccccucucccccuccccuccccuccccucuccccuccccuccccuccccucuccccuccccucuccccuccccuccccuccccucuccccuccccuccccucucccccuccccuccccuccccuccccucuccccuccccuccccucuccccugcccuccccucucccccuccccuccccucucccccuccccuccccucuccccuccccuccccucucccccuccccuccccucuccccuccccuccccucuccccuccccucuccccuccccuccccucucccccuccccuccccucuccccuccccuccccucuccccuccccuccccuccccucuccccuccccuccccuccccuccccucaacccccagucugucgcuguuuccugaggcuugcugaaagaauuagggaccugccugccucaggcaguacuguuugaaauuaaaaggaguaguuggugggacgcuuagugcuuagugaggcaggaggauuuugaauaguuugaaaccagcauggucucaaaccucucuuucucucucuuccucuucuuucccucucccucuucucuccuuccuuucuucccugucugugugucuacuucugucucuuuuucccgggucuguuuucccccagacuugccagguauuagugauccuucugugucagccugccaaguacuguggaauuauaggagcugugcuagcacaccccccaaaaaccccaucuuuuaagaaaauaguguugcuacugcucagauuaauuauaugauacaaugugccaggcacuauucuagacccuuucuacauauuuacucagucacaagguaaguucuuauucuuaauccucauuuucugaucugggaacauucaaguccucaaauguaaguaauuuuguauuaaugcaaauaugucuacauauugccuuuaguuacacauauuugaaaauuguaacaguuuuguggcagcacugcucuaagacccguucuguacucauucucauaacacauuucaucaguggauuuuuuuugagguggggauugguaugguuuguuuguuuguuuguuuuuuaugauacuaugaauugaauccaggguguuggggaagugcuuuauccauagucuacaucuccagcuaaguuggauuaguuucauuacuaucguugccuaucaaaggcaucuagugaguuuguauuuagcaguauuuaucuuaaacaagauacgccccuaaguggucauggaugacgagcaaagacugcucacuugggcuucgcacgguuauccaguauggugagugccuugacuauuaucucauaauucccacuugcuaggcagggccacuuugggugggggcugcccaucaaaccucaugaauaauucgugaacuguaugggauugguacuuuuuaaaaagguuuauuuauuuauuuuauguaugugaguacacuguagcuguacagaugguugugagccuucaugugguuguugggaauugaauuuuuaggauuccugcucgcucuggucaacuccgcuugcuccagcccaaauauuuauuuauuauaucuaaguacgguguagcuggcuucagacacaccagaagagggcgucagaucucauuacagugagccaccaugugguugcugggauuugaacucaggaccuucggaagagcagucaguguucuuacccgcugagucaucuccccagcccaguacauuuuuuugagacaggguuuccuguuaaccaggcuugccucagacuaaugaaccuccugcuucuaccuuccuagugcagagauuaaaggcaugcagcaccaugcacauaagcgcagcuugggcgcaaucuuucuuuugguguucccaccccaccacccuaagacaagguuucuauguguagcucugauuguccuggaacuccuucuacagacaggccucaaacucagacccuccugcuucugcccacugagugcugggauuaaaaguguacaccaccacaccugguggacacaaccuuucuugaccucucuguuuucaaguugagcugcugcugcugcugcugcugcugcugcugcugcugcugcugcugcugcuccaacagcuucauucaguauuuaggagucagaggagugcugccugcaguagcccuguuucuugcuuacuggguauuagauggagcaauaaggcaggccugccucuuuuguuccaucucacugagucucgugcauuauucaugaauacgauauagcuuuggucuccuugauucccagcuacugcaagaucauucauuauucaugaacauggggugugguuguaaugcuuuaacaucuacuuucugguugccuaguccuaguaaacccauaaccuugcuucgugauucacgaucgggaagaauggccuugagguccuuccuugauuucuuugacagcuuagaugcaguaauucuuuauucauauuucauagccucuugcucuaccuguuuuucuaguuacugccuccagagccacuugguggagcuguucuccuucuaauuaaagaagucccaaacugggcagggaaaauacaugauucaugagugggcgcgguccucuugcauccggguuucuggggguggggcucaggguuuuguuccggccuugggcucugccgccgccaucuugugucggcugcuggggugaaggaggguggcagggaagaccacaaccaccgcggucggggaaggagaaggcgacagugauccuagcuggcccaggcggcaggaggaggaggagaaagaggaggguggcggccgagcuugacuucggcuccuugaggaguuggcggcggcacgacccggggaaccggcauugguaauagcuuuucucugcaccuggcucgaagcgcaagggcucugggagguaugggagggucccugcuggcucucugccagcccaaugucugagugcacugccguguccuggguauuaagagucacuaggcaagcgggugugggggugugcaaauccuggggugggguggaucacgucugucugggaccaccccuauucccuugagcuucgaaaucugaccuugacgucagaccccuaucucagcuucuggagacuucuggcucagcacuauuaccagguaucuugauccgauccugagccaugcauuuccuaucagaacuccccacagucuccauaaaggcaccggaauucggugucgcugcucaugaaagccguccauacuugugugcuauuugaagaccugccccaaaaucucccuugagacucuuccuagcccuucaguauuugcucucauggcuuaagaggggccaggcuugaggaaagguccgcguggccuucauuuccgaaugaagagccuugucuagcauuuucauccagucuccccuccccccaggauacuaucuguccuuagagcugccaucuggauuaaacccggugaaaagcucucugccuagccuuuccgugggaaauccauuccuacauuugagaucucccaauaccacuuugacauagcauccuccaucguggacaccuggcauucuuauucuuuuaagcaccugccuuuagagacucucccugcuuuuagggacgccccccuuuuucacguucucauuguucuugaagcauuguugucuucuccaucagccaucguaaccccaguauauuuccuuuagucucucaugggacuagacgccagggaggaccuguuuggacacaguucuccauuagugaucucuugccgccaucuacucuuucagacucuugauuuguagccccaucugcccgauggucucauucuagacccaauuuuugccuucaaaggcagaccagcauucuagcuucucuuuuuauagauuccuuaaucuaacaacaggccucagaaucugcccucgucuuuuuuaaagguuucuaguaccaucaucauucagagagucucagcauuugcuuuugacuucccugaaccucuaucacugucagauaccuuuuuccccaacaggcucauuuaucuuccacaggaguagaaaaccucaucuauuuacuguggagucacaaaauugacuagaggaaccuaauuccauuugaagaucuaggcaguauuugcuugguaauauauuaucaugauuacagaguuuuacuguguggcuuuggcugucucaaacucuuagaggccagccugccucugccucacuagugcugggaucaaagguauacaccaccaugcuuaauuuuuaguaauccuuuuaaggcuuaaauuaucugaaauucaucuuccuuucucuacccugucagcagcugugguaccuguuuagaucuacgcaagaccuuuguugcuccauuagaaaucccucuccaagagucugcucucagagaccucuccuugccucuucgcacuuaauaucacagcuucuuggcacuauagugucaguaucaaagaccuuuuucugugcauucccauuauuuuuagugaaggguuucuaucacuagaaucgaagacugucagucccagcaucucccugcaguaguuucagggucuacauucccccaccucuuucuagagacccagauuuaagucugucuuaauaccucuguccaaggccgggcgagguggcacacaccuuuaaucccagcacucgggaggcagaggcaggcggauuucugaguuccaggccagccugaucuacagagugaguuccaggacaaccagggcuacacagaggaacccugucucaaaaaaccaaaaaauaaaaaaaaaaacaauaccucuguccaauacccccaccauuuauaaggccugcuaaggucucauuugggugucuuuuauuaucuccuucacagcuccuugagcucagugacuuccucugaugccuuucucauacuccucaagacuucuccuuuaaaaccucccagaaaccuuggcgagccuuagcauccuccucuguacaauaucuuuucuaccucaaucagcuggcucugcuuccuaauccuaccccagguuccccugcucagccuuucucugcuuugggaauagaguauucucaggcuucagucaucaguuuggagacccgggguaaguuuaaaaugcuuucauuucagcuuagccaaguaaguuuuggaaaauauauccuacacuugaucuuaagcacugggaaauauauucuaauagagaaggccgagcacauggugagggagaaaggaucuccauuggcuuugcuuuuuuguauuuuguuuuuauggauuuauuuuuggaugggaguaagggaaucuuuaguucuuguccuagagucucugccccacauucuuccugcuugccuugauaaaggggcuuuccaaaaccuggcaauugaaaucuccuguuuaaauauuuuuugaaauagucucacuguacaguucaggcugaccucaaacuuaagaguccuccugccucugcuuccuuuuuuuuuuuuuaagauuuauuuauuuaggaagcagaggcagguggauuucugaguucaaggccagccuggucuacaaagugaguuccaggacagccagggcuauacagagaaacccuguuucgaaaaacaaacaaaaaaaaauuuauucauuuauuuuauguaugugaguacacuguaacugcauagaugguagugagccgccuucuuuuuuauuuauucauuuaucuacuuauuuauuuauuauauguaaguacacuguagcugucuucagacacuccagaagagagcaucagauuguuacagaugguugugagccaccaugugguugcugggauuugaacucaggaccuuugcaagagcagucggugcucuuaaucacugagccaucucaccccaguuaugagccuucaugugguuguugggaauugaauuuuuaggacuucuacuugugguccugcuugcuccggucaacucuguucgcucagucccugcuucucugguccaaagauuuauuuauuauuauaaauaaguacacuguagcuaaccagaugcaccagaagacgugucagaucucauuacagguaguugugccaccaugugguugcugggauuugaacucacuaccucuagaagagcagucagugcucuuaaaggcugagccaucuugccagccccugccucugcuuccuaaguguugcgguugugggccuguacugccacaccuggcuucaaaguccacuuuugaacagugaccccaaaccugccaacuuagacccuugcugccagcacugggugaggguagagagguaaaggucugauaaagagcucucuggcucuggaucuugucugauguagggaguggagaaagaauaugccuggaacaaauggcaagggaaaggagauaacuuaagaaauggaggccccugugagugccuugggaggagccucuguccucauguccuugaguuuugaccacagauagccucuuuagccucaucaugaggucaguucauuuucucccagcuuuuggagcaaaugaagaaauaggaucuccaugccaagucacugccaauaagugcaaaauaggaauuacuuuugacucucuccuagguuaucaauucucuuccuacccaaguuggaucuaaguauucccagcaacugcacuggcaaaauuugacccugggcaggcuccuacuuccccucuucucccuugcauuaucuccuaucucugaguagucugggcuggacccaaagccaaauucugacacuacucaccuaagaaaaccauacaaacuagacaaaugccaugagccaggagaagugagagaaguucuccaagcuuucacuuucuauuuaugguaagagaaugggcuuauguaguucacagggcauuaagacaaagcccuuuacucuugugacaaaugggguagauaguagagagcucuugucauuguguucauauuagaaugugacagugccaagauggaaucuuagguauguugguggucuuaagggucagaagaggcuucauuguaagagcaguugugugaacagaaaacucaggguauauccaaagugcuuugaagagccacugggccuacaaagugauuguagguccuaucuuuuauuuauuucugacuccaccaccauuagaguucacuuccaguagcaggcuguauuguuaucuuccccaccucugggaucuaguaugucacuugaucauaugagcucagguuuucucauuuguucaacagggaucuuaagcccugccuugcagggucaagacaauugagagcaugaaauuugcuaacucugagaaguagcuuggacuucagugucauuggaucuggucugaucccaguucaaccacucugagugggaacuuuguucaaaucaccaaacaucccugaaguuuuuccuuccaugugagcugggguaaauaaguaguucgauucccauagggcugcccugaggauagacagcgacaagacuaguaaagcguuuaauguggccucugacacagaacuccuaguaaauauucauuuaucauaacugcuaaccuguugaagggccuucacaugaagagacuuuagaaguguguauuuucucucuuacgcagccuguuuuauuggcccagguuguuuucuauuccuaaaacugggagaaagguuugggcuuuguaaagcucugcccugagcccuccuggaccuguggucuguaucuuuucucaucacagcaacccauagagcuauaucaccaccuauuuuugcaaagugagggagcagcucuacaugcuaccuaucagggacaagauuggaaaccugaguauuuccugaguacacaucuguccuccagucuucucaaaauggucgucuuccuuuuacuccauagcauuggcgccuuucccuuaugcugggcuagggaaagacaggaugacuuagcagucagcuguguggauaugcaggccaaaccaccuugguucaacucuugagucugacaauggugugauccuggacaggccacgucaucuguccgugcuaguuucuuuccuaauguagacuugcugauccuugaucaaaucuucucccacuauuacuauuaauaaguagaaaaguaguuuaaggcuaaucaaggcuacauggugagacccuguauuuaaaagaaacaaauaaaccagaaaaauaucaccauguauccuaggcuuaccucuggccugucuuucuccccagauguccagcucgccgcuguccaagaaacgucgcguguccgggccugauccaaagccggguucuaacugcuccccugcacagucugcgcuguccgaaguguccucagugccaaccaacgugaguaucuucccuggagacuggcaaguauggugguaggaaagggagucuuucguauuacucuccauuugcccacaccccacucaugcauguuguucugaacccauucuugcucucugucucuagggaauggcgaagaacggcagugaagcagacauagacgagagccuuuacucccggcagcuguaaguagggcaggaguuugccuaaggugggaaggggcacugaaagaacuggauggggugggcuggaccgugaccuggaguccccucuaauuugacagguacguuuugggccaugaggcaaugaaaaugcuccagacauccagcguccuugucucaggcuugcggggcuuggguguagaaauugcuaagaacaucauccuugguggggucaaggcugucacccuacaugaccaaggaacuacccagugggcugaucucuccucccagguaucucuucccaacauccucaccccccaaccccccaucccccaccgcccgcugagauaccuguuucucugugccacagccuuauccuccugcccaccugucucuuacaguuuuaccuucgggaggaggacauugguaaaaaucgagcggagguaucccagccccgacuugcugaacucaacagcuauguaccugucacugccuacacugggccucuugucgaggacuuccuuaguagcuuccagguacuuggugauugcucagcuuccugcuugauuuucacagaaagaacucauguguuguauuuuugauacuauucacuauuuaauguguugucuuuggcaucaagcauuaugcgugagagcagagaagaugcagacaggaugagaccuugggccuaugcagacaggaugagaccuugggccugccuuuggggaaaagauggagacaguguccugcuaugagugucuagcucuucuaguauaacuuuaggcaggucacuuagauccuggccuuauaacucuuuccauuuucagaauaggaauggcagcaguaccgacuuuucaugggguuccuaugaggauuaagcauggagaauagcagcuuggacacaggaaagauggcacaggcacuuacuaguuaaaaagccuaggcugugagagcugaaagucugccucgggggacuuucaagguaccaagguccccaagggccaagguacuguagcaacaaucagacagaguaguaggagcucauccuggugggcagagauggguuuuccuggagaagguagagagggcaguuucaaaaauugugguggagugggcaccauuuugagaacuacuaacaguaguaguguaagagugagcucagacuuuggcuugaaaccauuucacucugccugucucgcacagggcauggcacaguuguaggcaauuagcaaacaggugagucagcuguucugcaguuugugcccauucuaccuuccccaacauacucuaagcuuuugguguguuucccucucacugaaucugaucuccagaaggucuuuaagagaggccuggaggaccagagggguaacugcuaucaggacugccugugccucuucccaccagucucugcuauuagucuuuuaucuucccuuccuccuaguuccggccucuugaccuggggucuguuucuccacagguggugguccucaccaacagcccccuggaagcccagcugcgagugggggaguucugucauagccgugguaucaagcuagugguggcagauacaagaggccuguuugggugagugccacuccugcaugccuuuucccacaaccuuuccuaggccaagauccucaucccucuucuacaacccacguuucauauugugugugcucaccucuccucgugugacauuagugcugcuguguccucucugugaugugccaaguuugcucagcacacacaccuugaaagaugccuugggccuugugugggccucaggcaucagucuucuugccacucucucucuacaggcaacuuuucugugauuuuggagaggaaaugguccucacagauuccaauggggagcagccacucagugcuaugguuucaauggucaccaagguaaggaaaucagccccagggcucuucgcagacagauagguaaugccagcccucucuguacucuuguacuuagacuugcuucugagguucacuccuuuuuaaccaggacaaccccggugugguuaccugccuugaugaggcccgacauggcuuugagacuggugacuucgucucauucucagaaguacagggcaugauccaacucaauggaugucagcccauggagaucaaagugcugggugagcuggggccauggaaguaucauaggggaacugguuaggagauuugaaagagaagagucccuggguucagagugaugggagcuauauccugagugccugaagucgaucaaagaaucuaguaagacccaccagagccagugaacauggggaagaagggccaacuguucgauuguuaauaggagcaugggccccuaggaucugaguuguauuuugaauggggcaucaugucucaacugauuuggggaaaagcagccuaucaguauaggccugggaccagggacaugagagucucaugauaucugaacuagcucugaagcaggggggagauaguuucugauccccagugagaacuguaguugaaaggguaucuggugucuacauugagucaggcauaugguuuuuuuuuccuuugucucuugaguuuuguaaacuuuaaggagggcauauaagacugacagccucccuaucuacuacucuagguccuuauaccuuuaguaucugugacacuuccaacuucucugacuacauccguggaggcaucgucagucaggucaaaguaccgaaaaagauuaguuuugugaguauugggggcaguaguucguggugggugguucuagaacagugcuucucagccuuccuaaugcugugagccuuuauuuaauacaguuccuuguauugugguaaccccaaccauaaaauugguuucguugcuacuguuaugaaauguagucuaaguauuuugccagaggggugugaccuauacaguuccaaauucucuguucauuucuucccuuuugugcugcuuuccugcagaaauccuugccagcaucacugguagagccugacuuugugaugacugacuuugccaaguauucucgcccugcccaacugcacauuggcuuccaagcucugcaccaauucugugcucugcacaaccaaccaccucgaccacgaaaugagguauguaguugagccagcagucaguaaggauagaaauacuuggugcuaaagggccacccauaccugugcuugucaaccguccauccuuugacaguagccugauuaauccuugcuuguuuccuuugcccuaccaggaagaugcaacagagcuggugggccuggcucaggcuguaaacgcucgguccccaccuucaguaaaacagaacagcuuggaugaagaccuuauucggaagcuagcuuauguugcugcuggggaccuggcacccauaaaugcuuucauugggggccuugcugcccaggaagucaugaaggucagugggguuucaucuugcuucuauuacuugcuauccaaaugugugagggccugaguaauaccggccacuugcucuuuccuuguccuucacuaggccugcucuggaaaguuuaugcccaucaugcagugguuguacuuugaugcucuugaaugucucccagaggacaaagaggcucugacagaggagaagugccucccaguaugugaaugggcuggagggaaggcaauauuggggguguuucucggggagcuugucucugauccuccucacuucauguuccucagcgucagaaccguuacgaugggcagguagcuguauuugggucagacuuucaggagaagcugagcaagcaaaaguacuuccuggugaguggucucauuggacaccuaguguguucaccucccuuggucucugcccaccccuucugggguucucuucugcauaauaaaggaaagagucuuaucucuuuaaccuguuaccucuuggucucaucuucagauuauaaaaggucauuucuuacagcccugggacuuggacauguauguggcaguagacuuuauuggucuaucauauugccuccagcaggcaugagaaacuguggguggcuuuguauccgcuuguaucacccugacuugccuuugugucucuccuuggcuguuucuuaggugggugcaggggccauuggcugugaauugcucaagaacuuugccaugauugggcuggguuguggagaggguggagaggucguggucacagacauggacaccauugagaaaucaaaucugaaccgacaguuucucuuccggcccugggaugucacggugagauggaugggaauaggggaauagaucaucucauuuuccugucuuuuuccuauccacgguauuucaauuagagauauacuuaucuuuccuuugacccuuuucauuccccuguuucugucauuuauucagcaaacauuaaauaguccuaccuugaaucaguuauuuucuucucuuuucuuuucuuucuuuuucucuuuuucuuucucucucucucccucccucccucccgcucccucucgcccucccuccuucccuccuucccucccuuccuuucuuccuuucucucuuucuuuuuuaguacucgggcuugaaucuaaagcuaacuguauguagccucccugcaugcuagacagguaguuacaaagacuaccacugagcugcccuuucauuuccuuuuucuguugacuuuuuuuuuaaauaaagauuuguuuacuuauuuauuuuauuuuuuaauguauaugaguacacuguagcuguacugaugguugugagccaucgugugguugcugggaauuugaguucaggaccucugcuugcugaacucagcaccagaagagggcgugcaucagaucucauuaugggugguugugagccaacaugugguugcugggauuugaacucaggaccuucggaagagcagucaagucagugcucuuaacugcugagccaucucuccagccccccuauugacuuuuuuauaaagaaaagauuuauuuauugcuagguguguuguggcacaucuucuucccccauuaauuaauuaauuuauuuacuuuacaucccaaucacacuccccuccgccccacauacgcagcagcagugcagcuuggucuucauguaggccccucaacaacuguggcacaucuuuaaucccagcacucauauauauauauauauauauauaugaaugagagacugcguguauauaugucuacugugugugugccuagucccugaagacacuggacgaguauguuggauccucuagaauuguaauuuugggguuauaaguggauugugagccaucagauguauugagaaccaaaacuuaguccucuggaagaacaacaaucuagcccuuaucacugaugcuuugagacaauugucuugaggguuuucagaaauauucccgaacucacugacugccuaggaggacuagugaaugguuuauugcaaaaaaagaacaccgcacaaucaacaagggaagaacgaagucaguagcaaacgucuucuuaauaguuaugucccagcaggguuauggaagguggauuuccccaguaacaaauauaacaguacucuuaaaagguuucuagccagggaagccguaucagaauuccugaaucuagagggaaagaaggugcuuaacauaaacuauucuguucacacaaacaguucaggcacacugagccauuaucuuuaggugggguggugauggggacuuuuccuaaaaucuaaauuccuagacgccagccaaaggacacuuuuagaaauaggccuucugaaggaugacauuguaguaaagccaggugacucuucaguuugaaacugaggucccuuaugaggccuauaagaccaguaucauuguuaccugucugguauuccuauuccuuaaguuauucacugaauaguaacuuuagcaguuacuguugaaaauacuugagugauaauaaagaguaaaaugaggcaggacacuguucauaccuucucagugcuggagaggcagguaaaucucugaguucaaggacagggugggccacaaagugaguuccaggacagccaggucuacaccggaaacccugucucaaaaaauaaaaacuaaauaaagguucuagcagaggaagguaaauaauaaagaauggguauauuauugauaaaauauagauauagcuaggcccacccauguacuaaggaggcagaggcaggcagaguuugaggccaaucuggucuacauaguaauuuccaugacagagcuacauagaaccugucucaaaacaacgaagaaacaacauugauaaaauauaaaaguaagcuacagaaucuguguuggcacuuaguaaaggagaaaggagcaaaguugugcuugcgagggggggcgguuagguuacuuugucgauuucauuaugauccuuauggaaggucucauuuccacucagagguccuggaaucaguucacuucacccuaaguggcgauaagagccagggaaagguucuaagcauaggagggacgugaccugacuuugcuuucauaacacuuacgcuuauuuauuguugaaccaucugguuauguuuggggaaaucuauucuaacuuaaaaugcugcucuuuaaaagaacaguagguaucacaucaacaaaaacccagguggcuggcuaguccauugucuacaauacauacuugucuucugcuuucuuuuccaucucauugccaccaucuuuuccaucucagcccuggccauguggcauuaucuuagaauauucugcuaagccagggagccuccugaacucaaggccugauucuucuagcaucagaugaguguucagggggacagcucucuaugauguugagugaauacacccauguucuacucucaacugcaucuccugauuucacagaaguuaaagucugacacggccgcugcagcugugcgccagaugaauccuuacauccaggugacaagccaccagaaccguguagguccugacacugagcgcaucuaugaugaugauuucuuccaaaauuuggaugguguggccaaugcucuggacaacauagaugcccguaaguuuugaaggcugguaaagaaggcaggggcaaaagagucggcgccuggguuuuccuguucuuucccaguaugcuuuuucuugucucaaggcuaucacauccuuguccccaccccaucauacaggcauguacauggaucgccgauguguguacuaucggaagccacugcuagagucuggcacacugggcacaaagggcaacgugcaggugguaauccccuuccugacagaauccuacagcucuagccaggauccaccagagaaauccauccccauuuguacccugaaaaacuuucccaaugccaucgaacacacucuucaggugaguggugcccaggggaaagggaagggcaggcuguguuuaccagucccuuggcuuccuggcauuuacaggccuaagcauaaaauauguuuucuucuagcaccuuucuuuucaccuggcaguuuagcauuucugaaaagacuuaucuagucuuccuucuugugauuccuccuugugagguuuuuuuuuccccaauauguagacaggcacaaaugucuugguugacuaguaguugagaggcuaagucaagaggauugcugugaggucaaggccauuuggacuacaaaacaagaccuuaaucugagaaaacaaagaaaagaauggugaauguugaacuauuccuuaccgaaguuuaacaguguuuugccauguuuucuuagauugauaugcuagguaugguggcaugcaccuuuaaucucaguacugaaguggcagaggcagguggauuuuuggcaucuacuuauuagaugugaguaaaaccauacauaacaacuuagagacagcucagcaguuaagagcaaugacugcucuuccagaagaccugagauuccaagcacccacgugaccauuuacauuugacagugguguuacguccagcuucaggggaucugaugcccugcauggguacuacaugcaugugacaugugaugcacuaacauacaugcagaacacccaaacacauaauuuuuuuuuauuucucuguguagcccuggauguccuggaacucacucuguagaccaggcuggccucgaacucagaaauccgccugccucugccucccaagggcugggauuaaaagugugcgccaccaccgcccaaccacauaauuuuuaaauuggggcugaagagauggcucggugguuaagagcacuugcuauucuuacagaugacccagguucauuuucuaacaccuaugaggcagaucacaacugucuauaauugcaguuccaagggauccaauaccuuuuuuuuuucucgccucugugggcaccuacacacacagugugcauauacaagucuuuuuuuuuuuuuuaauuaaccuauaccacacuuuuauggcuucacacuugcuguguagcugagguugaccuugaacugauccuucugccuccauuucccaaguacugggaagugccaccaugcaugucuucaaagcacgauuuucaugcuaaacaaaauaguucuuucccucucuucuaguucuuugucucuagcacaugauauuuagguuuccugcucuauugugcaacauguguuuaaugcuacuaugauaaugauauucuauauaugauacacguguggaacggugcugcauaucaugaagcugcaaugucaggacguuauacaucuacgugauaagcaccuaggccacaaggauagcuguagugcuaucagaagaauucuaagugcagugcuggaguccaacauauucaggauggauaguaggaagagaggggugagaaaagaccgauccuaccuaucacacaccccuucugacccuucuguuccaaaguggcugugucaauuuugugggcccacuagucucacuggggcauguguaaccuugaacuuauuugucccauaaucuucucucucauugggcugcuuaacugguaccauuuuaaguauacauaggggagaggauagagccagugucuuauuuccucagaaguuccuagagacuuagauaggaauuacuauuggauuggaucuauuuuuguuugauugcuuguuuguauuuugguacuaaagaccaagccuaggguuuaggcaaaaacuucucuaccauuuuguuguuguuguuguugagucagggaugcaauuguauccagcauugaacuugcagcaaucccguuuuuaagauguaaaauacucuuagcugauacacauuuuuuuuaucaaggcauaguacacauguacaggucuuaauacauuuuucugcacacguacauugggauaguuguuucccaggucaaguucaugagggagugggaaaggucgggagcuucugcuuuccuaaguagcuggguauuuccuacuugcauuaucuauaaggacuuucacaagccuacggaagcuuauuuuguccacuauuucauaaaauccauuuacucugccugcagugggcccgggaugaauuugaaggccuuuucaagcagccagcagaaaauguuaaucaguaccucacgugaguaacuuccacaucuuacccuucugcuugccaccaaagacauucagcugucauccucaaugcuaggugcacacuuuucaaaggacacuaaauguuuaguucucaugcuguugggggaucaagaugaggagcuuucuguggagaaagugggauugcccuggagccuaguucaguggccacucucucucucucucucucucucucucucucucucucucucucuauauauauauauauauauauauauauauauauauauauauauauacauauacauauauauauacacucuugccucuuggcccccucuacucccuaacagagacuccaaauuuguggagcggacauugcggcuggcugguacccagccauuggaggugcuggaggcugugcagcgcagccugguguugcagcgaccacagacuuggggagacugugugaccugggccugccaccacuggcacacccaguacuguaacaacauccggcaacugcugcacaacuuuccuccugaccagguaacauacuugucuggcaacauggguuuccuugcaaccaguuugcugcagacucuuaaguagcuucucccaguuaacuaguccagaugugaggcaaaagaugucagaaaauugaccuuuuuguuuuguccuucauuucuugaagcaagagaacuugcuguuccuuuucacugugcuguagacugugucuaaccugugcuguagacugugucuaaccugauuuuuucaggguuguagugaaccuugaggccaagauccucgacuugagagcaagggagucagcauuuauucaaaucccaguuuucucuaaacuugggcaagucauuucucuguaccuuucuuuagcuugaaggaggaacaguuagauauguuucacagggccuucugugaggauucauugguauuuauuaauacuaaguacauaccuggcgauccagucuagacuagcaaguaaagcaaguguuaguuuucucagcuaggaccuugcaguguaggucuuagaugacugauuccagcccucuuugggacccagccaaggguagugaguuggggugcaucuagaauugucagagaucuuacuccugaaacauucuuauuuuguuuuagcucaccagcucaggggccccuuucuggucuggacccaaacgcuguccacacccacuuacuuuugauguuaacaauguaagucuucuuacuggguuuuccuggggucaaauacagagaagauggacaggugggaaggaggugguggcuuuccauccaagggaagacguguuaacccuaccaugcaugcccugccuuccucuagacauugcaucuggauuaugugauggcugcugccaaccuuuuugcccagaccuauggguugacuggaucccaagaccgagcugcuguggccucacuccugcagucaguacaagucccagaguucacccccaagucuggugucaagauucauguuucugaccaggaguugcagagugccaaugccucuguuggugaggguguuuggccauuuggucagaagucacugccccuaucugucccuagcuucauuagucuucuacuaauagcuccaugaccucaccuuccuuugcaccucccucccccugaaaugaaggcaaucuguugggggguucagucccuucccucccucucucccucuucuuuaccaggaaaacagacuuuguuauucuugcuuggugcauauuugccuugguuuuauuauuuucucugcuuuuccacaaucuauucaucuaggggcaaugaucuccagcagggguuuccuccucugauucuugcucacuuugucucauuccacguuucccaugucuucccauccauacaucucucccacccugauucucuguauauguguuuacucuaauguuguccaucauaauuuagucccccugccuuuccuuuuggauaucugaaaugugucaagagcucuguaaccccccuuguauuggccuccucucuuccccauccccaucuuuuuuucugaaauaccugccuuuucauguuccucucugcauauuuccuuuagucuuuucuuccaccuccuccacagguuuccucuuaacuuccuuauggcacguucccgcuuuucccuaucucguccucaucuugucucguuucauaucuucucuaucuccucuugggauccuuccuguauauucaugcuuauauacuucccuauauccccaccaugucuucugugucucagauaauaccuccccaagacugacugacaccccauccaucugaucacucuacuuccucuuaagguuucugcuccuagugucucucuagaucuugauagccuuuauuccugccuuuuucagguuugcucucuguucugcucugccuuucccccuuugacccuugauucuaggauaucucuccaaaaucuuaucugacuaacccuuugucguacccuaagguuuucuaccccacuguuugcaucuaaagggcuguguuuuucuuuuuguacagaugacagccgucuugaggagcucaaagccacauugcccagcccagacaaguuacccggauuuaagauguaccccauugauuuugagaaggugcuuggcaggggcccuggaugggacaguuggggugagcuaagcacagacgggguuguaaggaauggggaucuaggacuauggagccagucuaagccuuuacagugaucagaucauggacugccacauagcuuuccuucugaucugggacagaccagcagguaauuagcauuggaggauaguuauaucccaagaguccagaaaauuuucucaucugaucuacuacucuuauucaggaugaugacagcaauuuccacauggauuucauuguggcugcauccaaucuucgggccgaaaacuaugauauuuccccugcagaccgacacaaggucaggagacuugaagccugauguucuauccacucucgggcuugaguuucuuauaucccauccuguucuguagaccuucagucucuuauaaaugauaacauuuuccuuggucuauuucucagagcaagcugauugcagggaagaucaucccagccauugccacaaccacagcugcugugguuggccuugugugucuggagcucuacaagguaguucaagggcaccaacagcucgauuccuacaaaaaugguuuccugaacuuggcccugcccuucuuuggguuuucugaaccucuugcugcaccucgucaccagguaggugcccacaugcaagauagaccuauaauaaaguguaucucaauagaacuugcuuugguuugcauuagaccuggucacuaggucagaguuccaaucaaaauaugccugcaucuuuuuuugcaagaguacuaaggaaauaaaagacaguagaucagagugauugagaagauaguggguagaagaugagaaugggguuuuccuuguggcauacgaccugucauuguaaagguucaguguuuacucagugacaugggagccaugagaaggcuuugaacaaaaaagguuaugaucuaacuuaacugggucugaaugcaucagggcagggaaggcagggagggcagggacuucuggaauggaccacauccuauucucuuucuuauugcaguacuauaaucaagaguggacauugugggaucgcuuugaaguacaagggcugcagccuaauggugaggagaugacccucaagcaguuccuugauuacuuuaagguaaggccugucucccucuccccuuaccuggaggacaagauggauaaauuacuuuuuggcccuccugccaucuaacacugcugauucccucuccugccuuccagacagagcacaaauuggagaucaccaugcugucccagggcguguccaugcucuauucuuucuucaugccagcugcuaagcucaaggaacgauuggaucagccgugaguaggcuauugccaggcaggcugggaagggcccuguguuggguggggagccucagcuuuugaagcuuucacuccuacccaucaccucccccgcccucaccuaccuccccuuccucuugcuuugccuccuuggcccucuucccuuacccucaccccuuucccuaggaugacagagauugugagccgagugucaaagagaaagcugggccgccaugugcgggcacuggugcuugagcugugcugcaacgaugaaagcggcgaggacgucgaggucccuuauguccgauauaccauucgcugaucuccgugcauuccccuaagccccaguccucccuccucagauccuuuccaauccugguuuccauuuggccucaggcagugguccauguagccaagccuggccuucccuauuacccagcaaccucaagacccucucaccgcugcuuuguaccuuguuuggaaccuaaaucccaauaaaaggauaauuacccagauguagccauccuggcugucuccaaggaaggaagaaguaugucuagaguucucugguucaaauaaguaccccaaugggcuacuccagcuauaagcuuucugggcagagaaaacugggaauugauaucuuuuauauacucugcauaacagacaugagguaccagugaaguuaugcagaccaguaccugggucaauaugauuuaagugacuugaacuggguucaaacucugucuucuccaugaucacuacuagcugccuccauccacuaugaagaauacacuuaacagugaucaggugggggcuggagagacggcucagcucuuaagagcacugacugcucuuccagggguccugaguucaauucccagcaaccacaugguggcucacaaccaucuguaauggugggucugaagggagugacaguauacacacauacaaucagucaaucaaucaauaaaaacagugaucaggcugca

SEQ ID NO: 9421 - RNA, 24880 nt, Mus musculus
ugcagccugaucacuguuuuuauugauugauugacugauuguauguguguauacugucacucccuucagacccaccauuacagaugguugugagccaccaugugguugcugggaauugaacucaggaccccuggaagagcagucagugcucuuaagagcugagccgucucuccagcccccaccugaucacuguuaaguguauucuucauaguggauggaggcagcuaguagugaucauggagaagacagaguuugaacccaguucaagucacuuaaaucauauugacccagguacuggucugcauaacuucacugguaccucaugucuguuaugcagaguauauaaaagauaucaauucccaguuuucucugcccagaaagcuuauagcuggaguagcccauugggguacuuauuugaaccagagaacucuagacauacuucuuccuuccuuggagacagccaggauggcuacaucuggguaauuauccuuuuauugggauuuagguuccaaacaagguacaaagcagcggugagagggucuugagguugcuggguaauagggaaggccaggcuuggcuacauggaccacugccugaggccaaauggaaaccaggauuggaaaggaucugaggagggaggacuggggcuuaggggaaugcacggagaucagcgaaugguauaucggacauaagggaccucgacguccucgccgcuuucaucguugcagcacagcucaagcaccagugcccgcacauggcggcccagcuuucucuuugacacucggcucacaaucucugucauccuagggaaaggggugaggguaagggaagagggccaaggaggcaaagcaagaggaaggggagguaggugagggcgggggaggugauggguaggagugaaagcuucaaaagcugaggcuccccacccaacacagggcccuucccagccugccuggcaauagccuacucacggcugauccaaucguuccuugagcuuagcagcuggcaugaagaaagaauagagcauggacacgcccugggacagcauggugaucuccaauuugugcucugucuggaaggcaggagagggaaucagcaguguuagauggcaggagggccaaaaaguaauuuauccaucuuguccuccagguaaggggagagggagacaggccuuaccuuaaaguaaucaaggaacugcuugagggucaucuccucaccauuaggcugcagcccuuguacuucaaagcgaucccacaauguccacucuugauuauaguacugcaauaagaaagagaauaggaugugguccauuccagaagucccugcccucccugccuucccugcccugaugcauucagacccaguuaaguuagaucauaaccuuuuuuguucaaagccuucucauggcucccaugucacugaguaaacacugaaccuuuacaaugacaggucguaugccacaaggaaaaccccauucucaucuucuacccacuaucuucucaaucacucugaucuacugucuuuuauuuccuuaguacucuugcaaaaaaagaugcaggcauauuuugauuggaacucugaccuagugaccaggucuaaugcaaaccaaagcaaguucuauugagauacacuuuauuauaggucuaucuugcaugugggcaccuaccuggugacgaggugcagcaagagguucagaaaacccaaagaagggcagggccaaguucaggaaaccauuuuuguaggaaucgagcuguuggugcccuugaacuaccuuguagagcuccagacacacaaggccaaccacagcagcugugguuguggcaauggcugggaugaucuucccugcaaucagcuugcucugagaaauagaccaaggaaaauguuaucauuuauaagagacugaaggucuacagaacaggaugggauauaagaaacucaagcccgagaguggauagaacaucaggcuucaagucuccugaccuugugucggucugcaggggaaauaucauaguuuucggcccgaagauuggaugcagccacaaugaaauccauguggaaauugcugucaucauccugaauaagaguaguagaucagaugagaaaauuuucuggacucuugggauauaacuauccuccaaugcuaauuaccugcuggucugucccagaucagaaggaaagcuauguggcaguccaugaucugaucacuguaaaggcuuagacuggcuccauaguccuagauccccauuccuuacaaccccgucugugcuuagcucaccccaacugucccauccagggccccugccaagcaccuucucaaaaucaaugggguacaucuuaaauccggguaacuugucugggcugggcaauguggcuuugagcuccucaagacggcugucaucuguacaaaaagaaaaacacagcccuuuagaugcaaacagugggguagaaaaccuuaggguacgacaaaggguuagucagauaagauuuuggagagauauccuagaaucaagggucaaagggggaaaggcagagcagaacagagagcaaaccugaaaaaggcaggaauaaaggcuaucaagaucuagagagacacuaggagcagaaaccuuaagaggaaguagagugaucagauggauggggugucagucagucuuggggagguauuaucugagacacagaagacaugguggggauauagggaaguauauaagcaugaauauacaggaaggaucccaagaggagauagagaagauaugaaacgagacaagaugaggacgagauagggaaaagcgggaacgugccauaaggaaguuaagaggaaaccuguggaggagguggaagaaaagacuaaaggaaauaugcagagaggaacaugaaaaggcagguauuucagaaaaaaagauggggauggggaagagaggaggccaauacaagggggguuacagagcucuugacacauuucagauauccaaaaggaaaggcagggggacuaaauuaugauggacaacauuagaguaaacacauauacagagaaucagggugggagagauguauggaugggaagacaugggaaacguggaaugagacaaagugagcaagaaucagaggaggaaaccccugcuggagaucauugccccuagaugaauagauuguggaaaagcagagaaaauaauaaaaccaaggcaaauaugcaccaagcaagaauaacaaagucuguuuuccugguaaagaagagggagagagggagggaagggacugaaccccccaacagauugccuucauuucagggggagggaggugcaaaggaaggugaggucauggagcuauuaguagaagacuaaugaagcuagggacagauaggggcagugacuucugaccaaauggccaaacacccucaccaacagaggcauuggcacucugcaacuccuggucagaaacaugaaucuugacaccagacuugggggugaacucugggacuuguacugacugcaggagugaggccacagcagcucggucuugggauccagucaacccauaggucugggcaaaaagguuggcagcagccaucacauaauccagaugcaaugucuagaggaaggcagggcaugcaugguaggguuaacacgucuucccuuggauggaaagccaccaccuccuucccaccuguccaucuucucuguauuugaccccaggaaaacccaguaagaagacuuacauuguuaacaucaaaaguaaguggguguggacagcguuuggguccagaccagaaaggggccccugagcuggugagcuaaaacaaaauaagaauguuucaggaguaagaucucugacaauucuagaugcaccccaacucacuacccuuggcugggucccaaagagggcuggaaucagucaucuaagaccuacacugcaagguccuagcugagaaaacuaacacuugcuuuacuugcuagucuagacuggaucgccagguauguacuuaguauuaauaaauaccaaugaauccucacagaaggcccugugaaacauaucuaacuguuccuccuucaagcuaaagaaagguacagagaaaugacuugcccaaguuuagagaaaacugggauuugaauaaaugcugacucccuugcucucaagucgaggaucuuggccucaagguucacuacaacccugaaaaaaucagguuagacacagucuacagcacagguuagacacagucuacagcacagugaaaaggaacagcaaguucucuugcuucaagaaaugaaggacaaaacaaaaaggucaauuuucugacaucuuuugccucacaucuggacuaguuaacugggagaagcuacuuaagagucugcagcaaacugguugcaaggaaacccauguugccagacaaguauguuaccuggucaggaggaaaguugugcagcaguugccggauguuguuacaguacugggugugccagugguggcaggcccaggucacacagucuccccaagucuguggucgcugcaacaccaggcugcgcugcacagccuccagcaccuccaauggcuggguaccagccagccgcaauguccgcuccacaaauuuggagucucuguuagggaguagagggggccaagaggcaagaguguauauauauauguauauguauauauauauauauauauauauauauauauauauauauauauauagagagagagagagagagagagagagagagagagagagagagaguggccacugaacuaggcuccagggcaaucccacuuucuccacagaaagcuccucaucuugaucccccaacagcaugagaacuaaacauuuaguguccuuugaaaagugugcaccuagcauugaggaugacagcugaaugucuuugguggcaagcagaaggguaagauguggaaguuacucacgugagguacugauuaacauuuucugcuggcugcuugaaaaggccuucaaauucaucccgggcccacugcaggcagaguaaauggauuuuaugaaauaguggacaaaauaagcuuccguaggcuugugaaaguccuuauagauaaugcaaguaggaaauacccagcuacuuaggaaagcagaagcucccgaccuuucccacucccucaugaacuugaccugggaaacaacuaucccaauguacgugugcagaaaaauguauuaagaccuguacauguguacuaugccuugauaaaaaaaauguguaucagcuaagaguauuuuacaucuuaaaaacgggauugcugcaaguucaaugcuggauacaauugcaucccugacucaacaacaacaacaacaaaaugguagagaaguuuuugccuaaacccuaggcuuggucuuuaguaccaaaauacaaacaagcaaucaaacaaaaauagauccaauccaauaguaauuccuaucuaagucucuaggaacuucugaggaaauaagacacuggcucuauccucuccccuauguauacuuaaaaugguaccaguuaagcagcccaaugagagagaagauuaugggacaaauaaguucaagguuacacaugccccagugagacuagugggcccacaaaauugacacagccacuuuggaacagaagggucagaaggggugugugauagguaggaucggucuuuucucaccccucucuuccuacuauccauccugaauauguuggacuccagcacugcacuuagaauucuucugauagcacuacagcuauccuuguggccuaggugcuuaucacguagauguauaacguccugacauugcagcuucaugauaugcagcaccguuccacacguguaucauauauagaauaucauuaucauaguagcauuaaacacauguugcacaauagagcaggaaaccuaaauaucaugugcuagagacaaagaacuagaagagagggaaagaacuauuuuguuuagcaugaaaaucgugcuuugaagacaugcaugguggcacuucccaguacuugggaaauggaggcagaaggaucaguucaaggucaaccucagcuacacagcaagugugaagccauaaaagugugguauagguuaauuaaaaaaaaaaaaaagacuuguauaugcacacuguguguguaggugcccacagaggcgagaaaaaaaaaagguauuggaucccuuggaacugcaauuauagacaguugugaucugccucauagguguuagaaaaugaaccugggucaucuguaagaauagcaagugcucuuaaccaccgagccaucucuucagccccaauuuaaaaauuaugugguugggcggugguggcgcacacuuuuaaucccagcccuugggaggcagaggcaggcggauuucugaguucgaggccagccuggucuacagagugaguuccaggacauccagggcuacacagagaaauaaaaaaaaauuauguguuuggguguucugcauguauguuagugcaucacaugucacaugcauguaguacccaugcagggcaucagauccccugaagcuggacguaacaccacugucaaauguaaauggucacgugggugcuuggaaucucaggucuucuggaagagcagucauugcucuuaacugcugagcugucucuaaguuguuauguaugguuuuacucacaucuaauaaguagaugccaaaaauccaccugccucugccacuucaguacugagauuaaaggugcaugccaccauaccuagcauaucaaucuaagaaaacauggcaaaacacuguuaaacuucgguaaggaauaguucaacauucaccauucuuuucuuuguuuucucagauuaaggucuuguuuuguaguccaaauggccuugaccucacagcaauccucuugacuuagccucucaacuacuagucaaccaagacauuugugccugucuacauauuggggaaaaaaaaaccucacaaggaggaaucacaagaaggaagacuagauaagucuuuucagaaaugcuaaacugccaggugaaaagaaaggugcuagaagaaaacauauuuuaugcuuaggccuguaaaugccaggaagccaagggacugguaaacacagccugcccuucccuuuccccugggcaccacucaccugaagaguguguucgauggcauugggaaaguuuuucaggguacaaauggggauggauuucucugguggauccuggcuagagcuguaggauucugucaggaaggggauuaccaccugcacguugcccuuugugcccagugugccagacucuagcaguggcuuccgauaguacacacaucggcgauccauguacaugccuguaugaugggguggggacaaggaugugauagccuugagacaagaaaaagcauacugggaaagaacaggaaaacccaggcgccgacucuuuugccccugccuucuuuaccagccuucaaaacuuacgggcaucuauguuguccagagcauuggccacaccauccaaauuuuggaagaaaucaucaucauagaugcgcucagugucaggaccuacacgguucugguggcuugucaccuggauguaaggauucaucuggcgcacagcugcagcggccgugucagacuuuaacuucugugaaaucaggagaugcaguugagaguagaacauggguguauucacucaacaucauagagagcugucccccugaacacucaucugaugcuagaagaaucaggccuugaguucaggaggcucccuggcuuagcagaauauucuaagauaaugccacauggccagggcugagauggaaaagaugguggcaaugagauggaaaagaaagcagaagacaaguauguauuguagacaauggacuagccagccaccuggguuuuuguugaugugauaccuacuguucuuuuaaagagcagcauuuuaaguuagaauagauuuccccaaacauaaccagaugguucaacaauaaauaagcguaaguguuaugaaagcaaagucaggucacgucccuccuaugcuuagaaccuuucccuggcucuuaucgccacuuagggugaagugaacugauuccaggaccucugaguggaaaugagaccuuccauaaggaucauaaugaaaucgacaaaguaaccuaaccgcccccccucgcaagcacaacuuugcuccuuucuccuuuacuaagugccaacacagauucuguagcuuacuuuuauauuuuaucaauguuguuucuucguuguuuugagacagguucuauguagcucugucauggaaauuacuauguagaccagauuggccucaaacucugccugccucugccuccuuaguacaugggugggccuagcuauaucuauauuuuaucaauaauauacccauucuuuauuauuuaccuuccucugcuagaaccuuuauuuaguuuuuauuuuuugagacaggguuuccgguguagaccuggcuguccuggaacucacuuuguggcccacccuguccuugaacucagagauuuaccugccucuccagcacugagaagguaugaacaguguccugccucauuuuacucuuuauuaucacucaaguauuuucaacaguaacugcuaaaguuacuauucagugaauaacuuaaggaauaggaauaccagacagguaacaaugauacuggucuuauaggccucauaagggaccucaguuucaaacugaagagucaccuggcuuuacuacaaugucauccuucagaaggccuauuucuaaaaguguccuuuggcuggcgucuaggaauuuagauuuuaggaaaaguccccaucaccaccccaccuaaagauaauggcucagugugccugaacuguuugugugaacagaauaguuuauguuaagcaccuucuuucccucuagauucaggaauucugauacggcuucccuggcuagaaaccuuuuaagaguacuguuauauuuguuacuggggaaauccaccuuccauaacccugcugggacauaacuauuaagaagacguuugcuacugacuucguucuucccuuguugauugugcgguguucuuuuuuugcaauaaaccauucacuaguccuccuaggcagucagugaguucgggaauauuucugaaaacccucaagacaauugucucaaagcaucagugauaagggcuagauuguuguucuuccagaggacuaaguuuugguucucaauacaucugauggcucacaauccacuuauaaccccaaaauuacaauucuagaggauccaacauacucguccagugucuucagggacuaggcacacacacaguagacauauauacacgcagucucucauucauauauauauauauauauauauaugagugcugggauuaaagaugugccacaguuguugaggggccuacaugaagaccaagcugcacugcugcugcguauguggggcggaggggagugugauugggauguaaaguaaauaaauuaauuaauuaaugggggaagaagaugugccacaacacaccuagcaauaaauaaaucuuuucuuuauaaaaaagucaauaggggggcuggagagauggcucagcaguuaagagcacugacuugacugcucuuccgaagguccugaguucaaaucccagcaaccacauguuggcucacaaccacccauaaugagaucugaugcacgcccucuucuggugcugaguucagcaagcagagguccugaacucaaauucccagcaaccacacgauggcucacaaccaucaguacagcuacaguguacucauauacauuaaaaaauaaaauaaauaaguaaacaaaucuuuauuuaaaaaaaaagucaacagaaaaaggaaaugaaagggcagcucagugguagucuuuguaacuaccugucuagcaugcagggaggcuacauacaguuagcuuuagauucaagcccgaguacuaaaaaagaaagagagaaaggaagaaaggaagggagggaaggagggaaggagggagggcgagagggagcgggagggagggagggagagagagagaaagaaaaagagaaaaagaaagaaaagaaaagagaagaaaauaacugauucaagguaggacuauuuaauguuugcugaauaaaugacagaaacaggggaaugaaaagggucaaaggaaagauaaguauaucucuaauugaaauaccguggauaggaaaaagacaggaaaaugagaugaucuauuccccuauucccauccaucucaccgugacaucccagggccggaagagaaacugucgguucagauuugauuucucaaugguguccaugucugugaccacgaccucuccacccucuccacaacccagcccaaucauggcaaaguucuugagcaauucacagccaauggccccugcacccaccuaagaaacagccaaggagagacacaaaggcaagucagggugauacaagcggauacaaagccacccacaguuucucaugccugcuggaggcaauaugauagaccaauaaagucuacugccacauacauguccaagucccagggcuguaagaaaugaccuuuuauaaucugaagaugagaccaagagguaacagguuaaagagauaagacucuuuccuuuauuaugcagaagagaaccccagaaggggugggcagagaccaagggaggugaacacacuagguguccaaugagaccacucaccaggaaguacuuuugcuugcucagcuucuccugaaagucugacccaaauacagcuaccugcccaucguaacgguucugacgcugaggaacaugaagugaggaggaucagagacaagcuccccgagaaacacccccaauauugccuucccuccagcccauucacauacugggaggcacuucuccucugucagagccucuuuguccucugggagacauucaagagcaucaaaguacaaccacugcaugaugggcauaaacuuuccagagcaggccuagugaaggacaaggaaagagcaaguggccgguauuacucaggcccucacacauuuggauagcaaguaauagaagcaagaugaaaccccacugaccuucaugacuuccugggcagcaaggcccccaaugaaagcauuuaugggugccagguccccagcagcaacauaagcuagcuuccgaauaaggucuucauccaagcuguucuguuuuacugaagguggggaccgagcguuuacagccugagccaggcccaccagcucuguugcaucuuccugguagggcaaaggaaacaagcaaggauuaaucaggcuacugucaaaggauggacgguugacaagcacagguauggguggcccuuuagcaccaaguauuucuauccuuacugacugcuggcucaacuacauaccucauuucguggucgaggugguugguugugcagagcacagaauuggugcagagcuuggaagccaaugugcaguugggcagggcgagaauacuuggcaaagucagucaucacaaagucaggcucuaccagugaugcuggcaaggauuucugcaggaaagcagcacaaaagggaagaaaugaacagagaauuuggaacuguauaggucacaccccucuggcaaaauacuuagacuacauuucauaacaguagcaacgaaaccaauuuuaugguugggguuaccacaauacaaggaacuguauuaaauaaaggcucacagcauuaggaaggcugagaagcacuguucuagaaccacccaccacgaacuacugcccccaauacucacaaaacuaaucuuuuucgguacuuugaccugacugacgaugccuccacggauguagucagagaaguuggaagugucacagauacuaaagguauaaggaccuagaguaguagauagggaggcugucagucuuauaugcccuccuuaaaguuuacaaaacucaagagacaaaggaaaaaaaaaccauaugccugacucaauguagacaccagauacccuuucaacuacaguucucacuggggaucagaaacuaucuccccccugcuucagagcuaguucagauaucaugagacucucaugucccuggucccaggccuauacugauaggcugcuuuuccccaaaucaguugagacaugaugccccauucaaaauacaacucagauccuaggggcccaugcuccuauuaacaaucgaacaguuggcccuucuuccccauguucacuggcucuggugggucuuacuagauucuuugaucgacuucaggcacucaggauauagcucccaucacucugaacccagggacucuucucuuucaaaucuccuaaccaguuccccuaugauacuuccauggccccagcucacccagcacuuugaucuccaugggcugacauccauugaguuggaucaugcccuguacuucugagaaugagacgaagucaccagucucaaagccaugucgggccucaucaaggcagguaaccacaccgggguuguccugguuaaaaaggagugaaccucagaagcaagucuaaguacaagaguacagagagggcuggcauuaccuaucugucugcgaagagcccuggggcugauuuccuuaccuuggugaccauugaaaccauagcacugaguggcugcuccccauuggaaucugugaggaccauuuccucuccaaaaucacagaaaaguugccuguagagagagaguggcaagaagacugaugccugaggcccacacaaggcccaaggcaucuuucaaggugugugugcugagcaaacuuggcacaucacagagaggacacagcagcacuaaugucacacgaggagaggugagcacacacaauaugaaacguggguuguagaagagggaugaggaucuuggccuaggaaagguugugggaaaaggcaugcaggaguggcacucacccaaacaggccucuuguaucugccaccacuagcuugauaccacggcuaugacagaacucccccacucgcagcugggcuuccagggggcuguuggugaggaccaccaccuguggagaaacagaccccaggucaagaggccggaacuaggaggaagggaagauaaaagacuaauagcagagacuggugggaagaggcacaggcaguccugauagcaguuaccccucugguccuccaggccucucuuaaagaccuucuggagaucagauucagugagagggaaacacaccaaaagcuuagaguauguuggggaagguagaaugggcacaaacugcagaacagcugacucaccuguuugcuaauugccuacaacugugccaugcccugugcgagacaggcagagugaaaugguuucaagccaaagucugagcucacucuuacacuacuacuguuaguaguucucaaaauggugcccacuccaccacaauuuuugaaacugcccucucuaccuucuccaggaaaacccaucucugcccaccaggaugagcuccuacuacucugucugauuguugcuacaguaccuuggcccuuggggaccuugguaccuugaaagucccccgaggcagacuuucagcucucacagccuaggcuuuuuaacuaguaagugccugugccaucuuuccuguguccaagcugcuauucuccaugcuuaauccucauaggaaccccaugaaaagucgguacugcugccauuccuauucugaaaauggaaagaguuauaaggccaggaucuaagugaccugccuaaaguuauacuagaagagcuagacacucauagcaggacacugucuccaucuuuuccccaaaggcaggcccaaggucucauccugucugcauaggcccaaggucucauccugucugcaucuucucugcucucacgcauaaugcuugaugccaaagacaacacauuaaauagugaauaguaucaaaaauacaacacaugaguucuuucugugaaaaucaagcaggaagcugagcaaucaccaaguaccuggaagcuacuaaggaaguccucgacaagaggcccaguguaggcagugacagguacauagcuguugaguucagcaagucggggcugggauaccuccgcucgauuuuuaccaauguccuccucccgaagguaaaacuguaagagacaggugggcaggaggauaaggcuguggcacagagaaacagguaucucagcgggcggugggggaugggggguuggggggugaggauguugggaagagauaccugggaggagagaucagcccacuggguaguuccuuggucauguagggugacagccuugaccccaccaaggaugauguucuuagcaauuucuacacccaagccccgcaagccugagacaaggacgcuggaugucuggagcauuuucauugccucauggcccaaaacguaccugucaaauuagaggggacuccaggucacgguccagcccaccccauccaguucuuucagugccccuucccaccuuaggcaaacuccugcccuacuuacagcugccgggaguaaaggcucucgucuaugucugcuucacugccguucuucgccauucccuagagacagagagcaagaauggguucagaacaacaugcaugaguggggugugggcaaauggagaguaauacgaaagacucccuuuccuaccaccauacuugccagucuccagggaagauacucacguugguuggcacugaggacacuucggacagcgcagacugugcaggggagcaguuagaacccggcuuuggaucaggcccggacacgcgacguuucuuggacagcggcgagcuggacaucuggggagaaagacaggccagagguaagccuaggauacauggugauauuuuucugguuuauuuguuucuuuuaaauacagggucucaccauguagccuugauuagccuuaaacuacuuuucuacuuauuaauaguaauagugggagaagauuugaucaaggaucagcaagucuacauuaggaaagaaacuagcacggacagaugacguggccuguccaggaucacaccauugucagacucaagaguugaaccaaggugguuuggccugcauauccacacagcugacugcuaagucauccugucuuucccuagcccagcauaagggaaaggcgccaaugcuauggaguaaaaggaagacgaccauuuugagaagacuggaggacagauguguacucaggaaauacucagguuuccaaucuugucccugauagguagcauguagagcugcucccucacuuugcaaaaauagguggugauauagcucuauggguugcugugaugagaaaagauacagaccacagguccaggagggcucagggcagagcuuuacaaagcccaaaccuuucucccaguuuuaggaauagaaaacaaccugggccaauaaaacaggcugcguaagagagaaaauacacacuucuaaagucucuucaugugaaggcccuucaacagguuagcaguuaugauaaaugaauauuuacuaggaguucugugucagaggccacauuaaacgcuuuacuagucuugucgcugucuauccucagggcagcccuaugggaaucgaacuacuuauuuaccccagcucacauggaaggaaaaacuucagggauguuuggugauuugaacaaaguucccacucagagugguugaacugggaucagaccagauccaaugacacugaaguccaagcuacuucucagaguuagcaaauuucaugcucucaauugucuugacccugcaaggcagggcuuaagaucccuguugaacaaaugagaaaaccugagcucauaugaucaagugacauacuagaucccagagguggggaagauaacaauacagccugcuacuggaagugaacucuaauggugguggagucagaaauaaauaaaagauaggaccuacaaucacuuuguaggcccaguggcucuucaaagcacuuuggauauacccugaguuuucuguucacacaacugcucuuacaaugaagccucuucugacccuuaagaccaccaacauaccuaagauuccaucuuggcacugucacauucuaauaugaacacaaugacaagagcucucuacuaucuaccccauuugucacaagaguaaagggcuuugucuuaaugcccugugaacuacauaagcccauucucuuaccauaaauagaaagugaaagcuuggagaacuucucucacuucuccuggcucauggcauuugucuaguuuguaugguuuucuuaggugaguagugucagaauuuggcuuuggguccagcccagacuacucagagauaggagauaaugcaagggagaagaggggaaguaggagccugcccagggucaaauuuugccagugcaguugcugggaauacuuagauccaacuuggguaggaagagaauugauaaccuaggagagagucaaaaguaauuccuauuuugcacuuauuggcagugacuuggcauggagauccuauuucuucauuugcuccaaaagcugggagaaaaugaacugaccucaugaugaggcuaaagaggcuaucuguggucaaaacucaaggacaugaggacagaggcuccucccaaggcacucacaggggccuccauuucuuaaguuaucuccuuucccuugccauuuguuccaggcauauucuuucuccacucccuacaucagacaagauccagagccagagagcucuuuaucagaccuuuaccucucuacccucacccagugcuggcagcaagggucuaaguuggcagguuuggggucacuguucaaaaguggacuuugaagccagguguggcaguacaggcccacaaccgcaacacuuaggaagcagaggcaggggcuggcaagauggcucagccuuuaagagcacugacugcucuucuagagguagugaguucaaaucccagcaaccacaugguggcacaacuaccuguaaugagaucugacacgucuucuggugcaucugguuagcuacaguguacuuauuuauaauaauaaauaaaucuuuggaccagagaagcagggacugagcgaacagaguugaccggagcaagcaggaccacaaguagaaguccuaaaaauucaauucccaacaaccacaugaaggcucauaacuggggugagauggcucagugauuaagagcaccgacugcucuugcaaagguccugaguucaaaucccagcaaccacaugguggcucacaaccaucuguaacaaucugaugcucucuucuggagugucugaagacagcuacaguguacuuacauauaauaaauaaauaaguagauaaaugaauaaauaaaaaagaaggcggcucacuaccaucuaugcaguuacaguguacucacauacauaaaauaaaugaauaaauuuuuuuuuguuuguuuuucgaaacaggguuucucuguauagcccuggcuguccuggaacucacuuuguagaccaggcuggccuugaacucagaaauccaccugccucugcuuccuaaauaaauaaaucuuaaaaaaaaaaaaaggaagcagaggcaggaggacucuuaaguuugaggucagccugaacuguacagugagacuauuucaaaaaauauuuaaacaggagauuucaauugccagguuuuggaaagccccuuuaucaaggcaagcaggaagaauguggggcagagacucuaggacaagaacuaaagauucccuuacucccauccaaaaauaaauccauaaaaacaaaauacaaaaaagcaaagccaauggagauccuuucucccucaccaugugcucggccuucucuauuagaauauauuucccagugcuuaagaucaaguguaggauauauuuuccaaaacuuacuuggcuaagcugaaaugaaagcauuuuaaacuuaccccgggucuccaaacugaugacugaagccugagaauacucuauucccaaagcagagaaaggcugagcaggggaaccugggguaggauuaggaagcagagccagcugauugagguagaaaagauauuguacagaggaggaugcuaaggcucgccaagguuucugggagguuuuaaaggagaagucuugaggaguaugagaaaggcaucagaggaagucacugagcucaaggagcugugaaggagauaauaaaagacacccaaaugagaccuuagcaggccuuauaaaugguggggguauuggacagagguauuguuuuuuuuuuuauuuuuugguuuuuugagacaggguuccucuguguagcccugguuguccuggaacucacucuguagaucaggcuggccuggaacucagaaauccgccugccucugccucccgagugcugggauuaaaggugugugccaccucgcccggccuuggacagagguauuaagacagacuuaaaucugggucucuagaaagaggugggggaauguagacccugaaacuacugcagggagaugcugggacugacagucuucgauucuagugauagaaacccuucacuaaaaauaaugggaaugcacagaaaaaggucuuugauacugacacuauagugccaagaagcugugauauuaagugcgaagaggcaaggagaggucucugagagcagacucuuggagagggauuucuaauggagcaacaaaggucuugcguagaucuaaacagguaccacagcugcugacaggguagagaaaggaagaugaauuucagauaauuuaagccuuaaaaggauuacuaaaaauuaagcauggugguguauaccuuugaucccagcacuagugaggcagaggcaggcuggccucuaagaguuugagacagccaaagccacacaguaaaacucuguaaucaugauaauauauuaccaagcaaauacugccuagaucuucaaauggaauuagguuccucuagucaauuuugugacuccacaguaaauagaugagguuuucuacuccuguggaagauaaaugagccuguuggggaaaaagguaucugacagugauagagguucagggaagucaaaagcaaaugcugagacucucugaaugaugaugguacuagaaaccuuuaaaaaagacgagggcagauucugaggccuguuguuagauuaaggaaucuauaaaaagagaagcuagaaugcuggucugccuuugaaggcaaaaauugggucuagaaugagaccaucgggcagauggggcuacaaaucaagagucugaaagaguagauggcggcaagagaucacuaauggagaacuguguccaaacagguccucccuggcgucuagucccaugagagacuaaaggaaauauacugggguuacgauggcugauggagaagacaacaaugcuucaagaacaaugagaacgugaaaaaggggggcgucccuaaaagcagggagagucucuaaaggcaggugcuuaaaagaauaagaaugccagguguccacgauggaggaugcuaugucaaagugguauugggagaucucaaauguaggaauggauuucccacggaaaggcuaggcagagagcuuuucaccggguuuaauccagauggcagcucuaaggacagauaguauccuggggggaggggagacuggaugaaaaugcuagacaaggcucuucauucggaaaugaaggccacgcggaccuuuccucaagccuggccccucuuaagccaugagagcaaauacugaagggcuaggaagagucucaagggagauuuuggggcaggucuucaaauagcacacaaguauggacggcuuucaugagcagcgacaccgaauuccggugccuuuauggagacuguggggaguucugauaggaaaugcauggcucaggaucggaucaagauaccugguaauagugcugagccagaagucuccagaagcugagauaggggucugacgucaaggucagauuucgaagcucaagggaauagggguggucccagacagacgugauccaccccaccccaggauuugcacacccccacacccgcuugccuagugacucuuaauacccaggacacggcagugcacucagacauugggcuggcagagagccagcagggacccucccauaccucccagagcccuugcgcuucgagccaggugcagagaaaagcuauuaccaaugccgguuccccgggucgugccgccgccaacuccucaaggagccgaagucaagcucggccgccacccuccucuuucuccuccuccuccugccgccugggccagcuaggaucacugucgccuucuccuuccccgaccgcggugguuguggucuucccugccacccuccuucaccccagcagccgacacaagauggcggcggcagagcccaaggccggaacaaaacccugagccccacccccagaaacccggaugcaagaggaccgcgcccacucaugaaucauguauuuucccugcccaguuugggacuucuuuaauuagaaggagaacagcuccaccaaguggcucuggaggcaguaacuagaaaaacagguagagcaagaggcuaugaaauaugaauaaagaauuacugcaucuaagcugucaaagaaaucaaggaaggaccucaaggccauucuucccgaucgugaaucacgaagcaagguuauggguuuacuaggacuaggcaaccagaaaguagauguuaaagcauuacaaccacaccccauguucaugaauaaugaaugaucuugcaguagcugggaaucaaggagaccaaagcuauaucguauucaugaauaaugcacgagacucagugagauggaacaaaagaggcaggccugccuuauugcuccaucuaauacccaguaagcaagaaacagggcuacugcaggcagcacuccucugacuccuaaauacugaaugaagcuguuggagcagcagcagcagcagcagcagcagcagcagcagcagcagcagcagcagcucaacuugaaaacagagaggucaagaaagguuguguccaccagguguggugguguacacuuuuaaucccagcacucagugggcagaagcaggagggucugaguuugaggccugucuguagaaggaguuccaggacaaucagagcuacacauagaaaccuugucuuagggugguggggugggaacaccaaaagaaagauugcgcccaagcugcgcuuaugugcauggugcugcaugccuuuaaucucugcacuaggaagguagaagcaggagguucauuagucugaggcaagccugguuaacaggaaacccugucucaaaaaaauguacugggcuggggagaugacucagcggguaagaacacugacugcucuuccgaagguccugaguucaaaucccagcaaccacaugguggcucacuguaaugagaucugacgcccucuucuggugugucugaagccagcuacaccguacuuagauauaauaaauaaauauuugggcuggagcaagcggaguugaccagagcgagcaggaauccuaaaaauucaauucccaacaaccacaugaaggcucacaaccaucuguacagcuacaguguacucacauacauaaaauaaauaaauaaaccuuuuuaaaaaguaccaaucccauacaguucacgaauuauucaugagguuugaugggcagcccccacccaaaguggcccugccuagcaagugggaauuaugagauaauagucaaggcacucaccauacuggauaaccgugcgaagcccaagugagcagucuuugcucgucauccaugaccacuuaggggcguaucuuguuuaagauaaauacugcuaaauacaaacucacuagaugccuuugauaggcaacgauaguaaugaaacuaauccaacuuagcuggagauguagacuauggauaaagcacuuccccaacacccuggauucaauucauaguaucauaaaaaacaaacaaacaaacaaaccauaccaauccccaccucaaaaaaaauccacugaugaaauguguuaugagaaugaguacagaacgggucuuagagcagugcugccacaaaacuguuacaauuuucaaauauguguaacuaaaggcaauauguagacauauuugcauuaauacaaaauuacuuacauuugaggacuugaauguucccagaucagaaaaugaggauuaagaauaagaacuuaccuugugacugaguaaauauguagaaagggucuagaauagugccuggcacauuguaucauauaauuaaucugagcaguagcaacacuauuuucuuaaaagaugggguuuuuggggggugugcuagcacagcuccuauaauuccacaguacuuggcaggcugacacagaaggaucacuaauaccuggcaagucugggggaaaacagacccgggaaaaagagacagaaguagacacacagacagggaagaaaggaaggagagaagagggagagggaaagaagaggaagagagagaaagagagguuugagaccaugcugguuucaaacuauucaaaauccuccugccucacuaagcacuaagcgucccaccaacuacuccuuuuaauuucaaacaguacugccugaggcaggcaggucccuaauucuuucagcaagccucaggaaacagcgacagacuggggguugaggggaggggaggggaggggaggggagaggggaggggaggggaggggagaggggaggggaggggagaggggaggggagggggagaggggaggggaggggagaggggaggggagaggggaggggaggggagaggggaggggagggggagaggggaggggaggggagaggggaggggagggggagaggggaggggagggggagaggggagggcaggggagaggggaggggaggggagaggggaggggaggggaggggagggggagaggggaggggaggggagaggggaggggaggggaggggagaggggaggggagaggggaggggaggggaggggagaggggaggggaggggagggggagaggggaggggaggggagaggggaggagaggggaggggaggggagaggggaggggaggggaggggaggggaggggagaggggaggggaggggaggagaggggaggggaggggagaggggaggggaggggaggggagaggagaggggaggggagaggagaggagaggggagaggagaggagaggagaggagaggagagaggggaggggaggggaggggaggggaggggagaggggaggggaggggaggggagaggagaggagaggagaggagaggagaggagaggagaggagaggagaggagaggagaggagaggagaggagaggagaggagaggagaggagaggagaaagaucaucacugcuaagaauguucuuuaauacauccaagaagaaagaaagaaagagagagaaagaggagaggagaggagaggagaggagaggagaggagaggagaggagaggagaggagagggcgcgcaccaguaauggcuccauuaaauuggcuuggaggcggggaacguuauccaacucugaaacccaacagaucaaauuugaauccuaguucagccauucacuguucagcuuuaggacaaauuacuuaccugcccuguaucucagauucuuuaucuaugaaguaggaugaaaucuacuuuugaaaaguugugaagauaaaauggauuaauaaaaguaacuaaauggguguaaauuauuauuauccugcauacccacuuuucggacucccaaaaagacuugucaaagaugggucuugaauccagagucucgagucaguaaucuagaauuacugagacaaggcaagaacaauaccugcggcaucuucucugauagaugccagguuuaaaugcuggaaccugugagggaaagcuaacugcggaucccgaagaagaaacuguaaagaccacgccccucauaaauuaugcauagcacccuuagaaaagccuuuuuuuuuuuuuuuaaacccaccgggcgcuacucaccuucacagauuauuguauggguuaucaagaaacuaguuugagacucagacuucgggauaccccgucaacacgccccuuccgcacgcugauccgcccccuagagagcaauucucuucuaguggaccagguacgaaagaagguccgcaccauagucccacuaaagcaguagccaaggaccgcucaguggcccgguagcccuaugucugcacagaagagccuggcagacagucuuccuggccucgguugagaggcuccucucccagggucugggccccugaaguguccggguuucacagccccggguaaaccagccgcaaccccaucagaggucacaaaggccacugaaaccgucacagugccacguuggugucgaacauucacacugucacucgguccggucccaagaccccaacucccgccuugacuuaaguaacuucaaacuucucuccucuuggagaguccaaaaauucugcccuccaacagaguacucauacacagaccccgagccucccccaaguccccccuaagcccugcuuccaagggguauaaaucugcgucagagaauuaccucauaaaacagacuccuaaaugccacccgaauccccaagcaccgcuuccuaagugucuccucaaaaguagacacccacugaaugccacccgggccccacaaccuccaaacaugcccauuagggaucccugaaguuggaauuagggaagcacccucuuccaaaugcuguccagaggcuugggggaaaugugcucccgcucacccccagugcugggcggaagccucgccuuccuucuggagacaagccgaagccacagggcaacggaagagcaaaccaccucgaucgugcaaaaagaaccagaguuugcgcggagcucggaagcgcgggggccuuagagggccgggucugggguauaccauagacgccugaauagaggggcauuucucucuacuucugcgccucuggcccggguuucagggacaaaaau

SEQ ID NO: 9422 - RNA, 11929 nt, Mus musculus
cuuugaacuuuagacuuuuuuuuaauauuucauacagcaauuauggugcauucaggaacccaauccccccaaaccccacuaggagggcacccucccuugcccucccaccccgcuuaagggucccaaggcuuaagguggaggaaggggagcaaaccauacauccaggagacuguccuuggccugccuuacccuccuagggacuggaguguuacaauugggcacaagcucgcacaugucccccugcuugugcacauauuauauauggcuccucacuaagcuggucaauuccuggcagagccccuacucaacagcaccgaguaggacaggacaggagggcuaggcagagcugggcuggggaagacccugagaaggaaagaggcccuggcuacgggacuaaaggagggaaaaaguagcccccaccauguccaucucccagucucugguaguucucaggucccccuauagcuggggacacuagguaggggaggaaggugaguggcugaggcaugcuuucccauagccaaucccaggguauagugauggucaggaucugaauagggucugggucccuaccucucaaaggcugggagugggacuucauugcacaaaauacuguaggagggccauacucagggaguagcgcccaaccagucuguauacagagauauugcauuaaaaagugagaaccucauuuaaaauaauaaaaaaacaauaaaagaaacuaacaaaaaagaaggcccauacaacagaggcaagugggacagguggcaagcaggcagaggaugcucagacccaaggcaucacucacuaccuucuagucaaagucaauuaagagccuggccugggcuagcuccaaaucccuggcuggccaugggguagugguccugggagagagugugauuuagaggggaaggccuagccuuaguguggaaaccuggcauggccauucuguucaccagcaacuaccaagacagagacagacacaucaagcaaaguaguggugagagcuuuguuagcacccagcagacaggccaaugguuggguugacaggccaggccagugguuugguguuugggcagguggcaggggacaaguuggcaggggaguguggcucaggcagguaagcaggcaacaagcagggaggauugcagaugggggcugcccuguaagggguguggcaucccuccagccgcugccugcuggggccuuggucugucuguggcuuaaaacuuggcuuagaacucgguauccaccacacggaaagcuggccugccugcaggggaaagcagagugaauggcugugagugggcaagcaggaagguggauagagcaagagaagagggccacacuuaccugagucaggcauagaaguggaccgaauguuggccuccuuuuguagcuguaccuccuuuagugcaaauauggaaguagcuauaaauaaagagguauauaagugggggaugaccuguggguacaaccccacauggcacaaguugcuucuucuuuugagaagcuugacuuucuucugucacacugccuauaaguaaggaagaugggacauggaauacugcuggacuacuaguagcacaagacaaaaaaguacuaaguuuaucaaguaugauauaugaugcuaauauaaauacuacucacaaauccauacaauagguggugguuugggguuuaauuauuaauucuguggguugauaugaaaggugagcucaauuuuucaguguaaugaaccuuuuuuuuuuuuuuaaagauauggucucuauaacccuggcucuccugaacucacuauguagucuuugcuggccuugauuucacagaagugggccuaccucugucuuccaauaauuccaauuggcacaugccaauaauuugaaaguucuuagguaucugagacagaaggauugucacaaguuccaggcuagccuaggcaacauagcacaccacagguguagugacauacaccuaucaaucccagcacuugggaggugguggcaggaucagaaguucaacaucauccuaaacuacauagaaagcccaagccgggcgugguggugcgugccuuuaaucccagcacuugggaggcagaggcaggcagauuucugaguucaaggccagccuggucuacagagugaguuccaggacagccagggcuacacagagaaacccugucuuggggugggggggaagcucaagguuuaccuguuucacaggaauauuugucucaagaagccauaccaccacaagccaggacuaccuaacacaagucuaccucaaaagaauccuccaaacaaaccccaaaucccccaaauccaaugcuccccgcuauuucuuauuccaggaaagggccuggaaugcugaggacaguauauauaaggaagcuauaggggaacuuucaccauucauuuugaacgguaugaaaguuauacggguguucagcuugcaaaaccugugguguacacuuuuucggcuauuguaucuauauguacuauaugaaaauuuucauaaaaaguaaaaggaauccaagaugaaaacaaaauucuuuccuaauaaauacaacugacacauguacaugacgauguucccucagguauggcacaaaccagcacccuauguuccaguggcucuguucacaaugucccaacuuaagcccauucccacucacugucaggaaguuuguggauccgcucccccaagcugagaaagaauggauguuuccuggcauccucagcagagauccgauugcgacccucaaacugaguuaggcagaagacagugcaucaguauccugguaucucaacacauagguuucuuuaccuaccuuccucagagccugcccuuggggaaguucccauuuuccuauaccuggaaccccaucccuguuaagguuggccucugaagaugcucuuaccugcagcagcuuggugaggaggucagcuccaucgcuaucaagucuaacacaaagguaagggaugugcuuuauacugaguucagacacacuggcccccaaugcccaucuacccuacccaccagccucaccggggugcauggcucagaagggccucggcucgguacuugggguaguuguauguucuaaacuccucauuggacaggauaccuggccaugucuccucaguugggguuccuaguaaggaauacaaguuaccccgcacaucucaggucuucccugcauaucccuacagcuccuuaggaacacacuuucuccucacccaaaaugcggaagaugaagugcagcuguucuuccacuguggagccugggaagaggggccggccgguggccaucucauagaagaugcagccuacaccccugggaaggaaagguaccauaaauauaagggggaguuggcuggaaaagccacccccuuccauacuuccaccucuccucaccacaugucaauuuggguagaguagucuguggacccaaguaggaugucagggggccgguaccacagugucaccacuucguuggaguauguuuuaguaggaauugacuuggcacgagccaggccugagaggcaaaaaaaaaaagggggggcagcuggaaugaggagguugugggcaaagccuagaauagaguauaacuggggauaagaaugccugccauagucaauuucuggagaggcugaaggggaaggagacugggcggucauagggaauuggguuagagaauaaugcugaggagucaaugggaagaagggagaggcuggugguaccaaaaucugccaguuugagcucuccccucucguugaugaguagguucuggggcuugaggucucgguguagcaccuucugccuguggcaguaggccaggccacggagcaacuggaacaggaacagcuagagacccaggaauggcaggcagaagucaaaagauauccacuaucaaauucccuggcagcaggcaggcaauguucccucccaaacagacacugagcccaaugucuuaucacauaaaagaugauaggcucccaaaacccuccaauggcucccagcaaaaacaucauacaagaagaagcuguuucugggagaacugugcagugagugggugaauggggggcccccuccugccuuuugcuuucugucccacacccacuuucacauugugcauguugaugacauuuccacagucauccagguacugcuucagguccuuguccugaggacaaaagagguagugcaggaacaagucacauacuuuggcucuuggccauuuccccacuucccuggguccaacugcuauccaaucuuaccaaguauucaaagacaagugugagggacuucucuguguggauaaugucauguagugugacgauguuggcaugcuugagguccuuaagcagggauacuguagaaagcacagaaaagaacagaagagugagagccccauucuuagacuaaggaccagauagauaugagcuuaaggguuuccuucuuuccaugugcaguuuaggguaaugccucacagcaccuagcucucauuuacccuauacuaagaauuagguguguagaaaagaagguuuagacaagaguauuaagcaagagcacgggacuacagcuccaacuucaugugacacuauauuuucauaaucugcuuuugcuuucugggaaggggccuuguucuaaaccuaaguaacaugaacugaaauuuguacucauuuucuguguaauucaaaucuacuuccugugauuucugaacaccuuaaggagugcuugaagaaugaaagcaaacaccauaauuuaccuuccuuaauccacucagcuuccuaauuaccuugcuuauuaccuggguauguagacaguaggcauucucaugaaggugaggagaggucagaaaaaccccagucucuguccucacucaucauagagaguagaaguauguggcaugcagucaagaaagucuagggugggccaggcagugguggcacacgccuuuaaucccagcacuugggaggcagaggcagaggcaggcagaugucugaguuuaaggccagccuggucuacagagugaguuccaggacagccagagcuacaaagagaaacccugucuccaaacaaacaaacaaacaaauaaacaaacaaacaaaguaagucuaggguggggucuguaccuucccggauagcaguacagggugccccuucuucguguuccagucugaucuccuuaagugcuacaagguugucugugagcuugcuuuugccuuuguagacaguggcauagguacccuggaguacaacagcagagaugcugugagguugcauggaauucauacugucccccaucuuuaccacaguccuuuuaacuaucuuaccucacccagcuugucuagcuugauguaggucuccaguuuuccaaagccaaucucagacuguggggcaaaggagguauguugaagcaggguugcagaggggaaccgggaaagugggauagguaggauacaggacaaaagaagauacuuaccaaacugacucggcggaggcgccggcuaagaggcuuaucaaagauggggcuauugagggucagcuucucaagguagcccucaggcagccguaugucagcugguagugacaggcguuuguugauguccuagcagccaagaugaaggaaagauggaucauaagcuccaccuccccaaacauaaccccauuuuccaacucuuccaacacugggacagagaucaagcaccucaguggagaucuugcguggggggugguugcgcaugcgcacucucacuggagacugcaccucaucugaggauguggcugaagccuggucacucuccccaucagaucccaucuucauguccucgugcacaaucucugggguggggagagggaaaggccaggccuuuggagucaagaacacucucuuucccccaauauaauauauuucuucaucguauccauuuguguacauggccccuagagcagacugggaaacccagguagaccuaggacagauauggagggaauguggucaccuaguggaguacuccaacagagaugagcugagaugguagcuaccucugggucagaaggcuagggguggcaggcauugccaagagcccuaagaaggcagauucagugagacugagagccaccaauagaguguaggaaaaaggcagagucuuggggcagcugaauggucaagguagucuuccccauccugaggacugaauauagucaagaaguacagacgguguguguuggaaauggaucacagggaaggagggaaaaugaaaacaagagucuaaggaaaaugacaagagucugagaggcagaaucugggagcugggacagagaaagaaugaucaaaguagacccaccuggugcagagcugagugggccccgaacagagcgaagcuccccaggggcaauacgggugggagcuucuccaaggucacugccaccaccgccaccacucucauccaggccuaucugcucagggacaccauuggucuuaucuaugccucggcccccucggagugucauugacagcugccguuugaucuucuucauccgauccauggcgaccugaacagggacaugaauagaaauagggaccacauuggugccugcuugaucaucagggaugccguaaagaccccaacaacccagagagggaugccaacaugaacaugucagugaccaaucacuacauauccuucgucauuguuggccuaccccuaaguagccuaccuggguacuaagacuugaguggcuagcugaggguaagggcccacucauuaaguuguuggucucuaggguaauagucucacugugggagcacaggacuccacagcaacuauccucagguguagcagcagugacagccgcagccacaguugggacaagggguucagucagagcugaagaacuagugacaagguccugggugugcccauagaauggcauguuccgcugacaccagccccacauugcccccaacugccaggcagaaugcucccuguggcccacagggacccucuuaccucccucagcaaccacugucauggugacuaaugggucaucccacuuuucuauccagaugaggggagagcuguccaggcugaaccauuggauagaguuagcaggggggugaggaggguaucucaguacaccagcuauccucagagcugcuagacagguuuuauaggguugagacccacaggguccaaacccagguuuuuacaaaacuagaucauauuccuuuucuccuagagaaaacaccacaucuuccuuaucaucccaaauaaauauuauaguccucauguggcccaugugucuuuuuuaaaaaaauauuuauuucauguaugugauacacuguagcuaucuucagacacacgagaagagggcaucagaucccauuauaaaugguugugagcuacuauaugguugccgggaauuaacucaggaccuguggaagagcagucagugcucuuaaacgcugagccaucucuccagcuccaugcccauguaucuuauauaccccacuugccccuauuaccccuguagccucaccacacccaacaguuucuaccuuaggaucuguacacagguugcuucccagauuggaaaauaucuuaccccauccucuccaguccauuguucaaauaucaccuuuuccaugaggcuucuaugaguaacccuauuuaaagacucagccaucuugagcuccuucaccuuucuaaugugucccucagaucuuacaaccgccccagaaauaaaaauaacaccaucuacuuauugguuucuuuccuuuuuuacugucugucuucucaccaccacaacuagaaaauuugcuuuaccaggguagauuucuguauguuuaggccacuguucuauccugagaaccuggaauaauggcugauaucaaaaaguacauacagaaguagccgagcaaggggcugagagccuaggaccaacuuuuauugagguuaagucccagacacagacuacuauaaagaagacacuuagggaugcuagaaucgacaaccagaugaccuaaaugggcuguuggugggaauggggccaccaaaagguuuaggucggcauucuucugcuuccuccugggcucugggccagcaaggagggggaaagaccuagcucaggagccaucuguacucacagcagggccugagguggcccagggcccaaguauagcuagaauugagguugaagauaaggcuggggaugaauuaaaaagaaaugggucacuuguuaccuugaaacaaaaugcuuaccccagcagcucccacucccacuucugcccacuucuucacuagaagggaaggcagagccagcuuagcagaagaaaucucagauagauaagaguaagauccacccacagagaauacagggcaauccugaccuuggcgacaaacacuagaucuaggccuagaaaguggccaguucccaaggaccaacauuucagggaggacagacuccuaaaaauauauacacuuaaacauuuaugagcaacaaaacuuaaauaccauaauuucaguuuucugagcuucuaaacuucagaacaagugaaggagcaagaaucaggagauaggauguuaacguagcauuuguccuucuuggcauuccucagacauacucaccaguucucaggcuacucucauaccaaggacacggacggacgauaacuccaacugcugagcacacaguugcauuaccaccauacuuacacaugcuccauucuguccugaccucuaaaagcacacacuagauccccaagaaggcccucaauauuuauuaacuccuacuaacauucacaacgucuaacucccuucagcacucaaaaccuugcccucaacuguauuggcauauauuugccccuuuuaaguaacuccuaccaccuucacguugagucccuuccuagccuagaugcuuguuagccucucucuagcacuguccuucccaauaauaguguccccuauggauucugauccuccuuaacaugcauucagggugcucuacugcugacccaaauuagcauucucuggacuuucacacgucucugaauccucaguacauugugauucuuauacaaucccugaccaguuugguucacacuuaggucccuucacaguuaugggucucuugaugugcaugcagggaucuaaacccagguccucuggaagagcagcacaugcucuuaacagcugaaccaucucucuagcccuuaccuucagaguuaugaccacuguuaauauacauucuuuuuuuguuuguuuguauguuuuguuuuguuuuucgagacaggguuucucuguguagcccuggcuguccuggaacucacucuguagaccaggcuggccucaaacucagaaauccgccugccucugccucccgagugcugggauuaaaggcgugugccaccacgcccagcuguuaacauacauucuuguacuuccagugcacaguuccuucccucagcacaagauuaaucuucauuguaucuugacccugacaguccuaacucuaucagcacaccuugaacccuuccuuagcccuauucuccagggagaaaugcacuauucuguaucagacugacucucauuagugaaugcagcuccuccauuugacccugaccccuaauaacauacaucucaguucaugacuccaauucacuuuggcacaccaguaccuacuccuauucccugcuucaaccaaccacuccuaccaccauuucucugguucacaauugauuuccuucauagcucuguuccuuucauuauccacuagauucuccaccccucacccccaaaaaaacucuacuucugaagcacuccucaaaucagcacacuucaguggcccauggagagaaaaaaggcguuuugauguacaucagcauauuuuacuuugugcucuuccccuaauagcgugcauacauuuaagugucuguaucuaucuaaccccacagcagcagccuuuacaacagugguucucaaccuucccaaugcugugacccuuuacuacaguuccucauguuguggugucccccaaccauaaaguucuuuuuguugcuacuucauaacuguacuuuugcugugaugaauuaucauguaaaugucugauaugcaggauauuugacauucgaccucuaaguugagaaccagugcucuagaacuucauauauaguauugcccccacgcuuucuggaagccuuuauggacauccacucacaccucaucuugacccuuagugugcaaagcucuuuauacuuccuuuacugacaaucucccguacacauguacgcacacaccuaaaacccaguaguacaggccuuuccccauccucucccauuacacacacucucagguccuucaaaagcucugccuucacuggcauauacugaucucacccuaccuuuauuacaucuacauacccucaucuccaggacccuccauuaccuccucuaugagcacacccuggacccagagaagcugccacccucaacuccguggauaaacacaguauuaacacuauccugacccucaucaccacacacucggaacuaugcgucuaucagcacaccuucugguaguaccucuaccacccuuucuccauuuacacugggccucucuguagcuccaacuuccacuagaauguuuuggaacugucuuuacuucaaacccuguuauaccccaucacgucccucaugguccugcaaccccuuuccauaagcacacugggccugaagucguaaggcuuuuuauuacauguuccuagcccuuuagcaacuccgagaaucucacuguaucaauccauucccauaacgcuaguccuuuaaucacccuucucccacuuagcauccacagcacuucccauccucagcucccaggacaggggcccagggcggggccaaggucagggaggccccaaaugaccccccagugcauucugggaaacucgagggggagggggcaccugacagacaagcugcccagaaccccuuggucuuguuccagcacugccuaggguccggcuggcucucuaggaagagcagcccccacccuaaguaucgaggacacgcucaccggagggggcgcgcgaguaaccucagagccgcggggccggcgcgguggcgccuggggcggcggcccgggaugaggccgcgcgaccuccuuuuccuccaguucgccgcaggcgcccgucccaguagucuucggccauggcugcugggcccgggccgccgccggcugaggaggaagaggcggcggcggcggcggcggcugaggcggcggcggcgucccgcucagccggccaugagcuuggccacugcgggcgaugcccccgugcucgcaagcgcccgcuggaauccggguguucacggcggcucgugacucacagcagacagcuagcggagacgcagcauaucccagagccccccagccagcggcccaacagccgcgcgcgccgcgcuccgcgcaugcgcacgcacacgcuggggguggggugugaagcaggaaggaggagacucaccucggacugcguguaccaaaagagccuucugcagcgggagggggugcggccauugcgugcccagcagggaauguggcguuggcccuggaacggcgccagggggauuuagagagggguuaauaguuuugaucuugcuagaaauuuacuagcaucgaggugagcagcagccaguagccaggcgugccagucaccaccuucuuucccuacagucucauuugguacauccccauggugguaaacgggacuuuugcaaggagaaaaagaacaggugagcgaagcaguuccaguccuuuguggugccucgggaggcaagaauuuaaaggcuggaaaugacuuucuaggagagguggccuggauuaccaccuuagcuaggacaaucuagccccgcccugccacccacccucuacca

SEQ ID NO: 9423 - RNA, 62721 nt, Mus musculus
ucaccgcccuugcauuucccuacgcuggaucauggagccuccaaaggaccaaggggcugcccucccacagaagccagauaagguaaucuuucuucugcuaccuaugcagcuggagcccugggucccuccauguuuacucuuugguuagugguuuagucccugggagcuuuggggagagggggugguugguugauaauuguucuuucugugggguuguaaaccccuucagcucuuucaguccuucccuuaauuccuccguugggguccccgugcgcaguccgauggcuggcugcgugcauccgcaucuguauugguuaggcucuggcacagccucucagggccaaguaaaaaucucaucucagugcuuaacuagaccuaaaucuguuaaacuuaggccccuacacugcuuggagggaggggucuuugcaucucuggacucacugggcacaugcucagugccagcaagcaagcaaucguucgccaauaguaacagugcacguacucucuaucugugugagggugcuagucggaggagaggcgggcucuccgagguucuucggugauuuucgucagcuaggaagguggcuggccccuagggagaaucuaccagaaccgccaucuuggaaggaugcgcauucgugcuccugguuaccccaucuuccuuaauaggguuucucaggggcaggagauggcagacagcauggugucugcgucgcucugcuccagccucugggcuuaugucaccucauagagcagacaggcuaggagcuugacucaagucucagggcucagaggcccuaaaucccccccccaucccccccccccucccgcgagcagcuuggguuuuaccagaugcagccacgccucugcacccgcagcuccugcuuaagcccacagagcccaccugggggcaccaucgucaagagcucugacacuggggucacgaauaaggagggguuuuaugccggacaggacuagcaucugggcagucaccgaacuuguguaguugccgggugggggguucggggggagcagaggaaaagaggaggaggggucauaguuucggacuuaggucaggaugcuaaagucccuggcaguggguguuucacuauuguaggcgauuccauacugaugaccaaggaucuguggaggaagucauggggcguggguggcagcuggggugaggcuaccuaagcuuuuuggguuuccguucacuguuccuaagcaguaagguuaagguuaacguuuucuaaagauccacuuuuuaaaaaaagguauuacuguaaacuguuuuguuuuuccccaagagucugauuucaagugcuaauuuguaaucuucugcccaucccuuuugaacucugaauuauuuagcagcuuaaugcaaaacuugcuaaacguuuccaagauuucaaagggcaagagaauuagugcuuucugcacgguagagaaugaacaggguuuuauucuagaagcaaaagaaaagcaguuaagugcagauguguucacuggucuuugguugcagaggugaaaaugacagcuauuccugauuuggccuacuucaguuuauggagucccuguucucagaauuaaugucccaaagaaagaauguagagggaguaucagagauguuaccguuccugccgggcgugguggugcacaccuuuaaucccagcaauagggaggcagaggcaggcagauuucugaguucgaggccacucuguucuacaaagugaguuucaggacagccauggcuauacagagaaacccugucucgaaaaaccaaaaaaccaaaaacaagacaaaccaaaaacaaacagaaaaacccuaaauucaaacaucacaaaauuaauuaauuaauuaauuuguuuguuuguuuuucaagacaggguuucucuguguagcccuggauguccuggaacucacuuuguagaccaagcuggccucgaacucagaaauccaccugcuucugccucccaagugcugggauuaaaggcgugugccaccaccgcccagccacaaaauuuauuuauguuuacuuauuaacuaugaguuacagauaaauuucuuuuuauuucuacuaagacaggguuucucuguguagccuuggcuguccuggaacuugcucuguagaccagguuagcuuccaacucagacauacaucugccucugucuccuggguacugggauuaaaggcuugcaccaccuggcuccagauaaauauuuuucauuguugcuaaguuauguuuuccuuguaccagucaacuuuugcuuuagauacuuugaaguuuauuauuaaaugcauggaccacagaggugagaggaccaaaucagccagagcuacaacauagugagaacuugucucaaccccuacaaccaccuuaacucagcauagguuucaaccuccuuuuuaucacugaacaagagagaaacaagagagacagagaaaaggauuauuagcuggagacuuacaggcauugcuuggguuucagagguguggaagaaacagugaaauuuguuuuuuuuuuccuuuucaaaaauaugaaacacuucaugaauuuguguaucauccuuucgcaagggccaugcuaaucuucucuaucguuccaauuuuaguauaugugcugcugaaguaagcaugugaaauuuguugaucgggaugcuguaauccaaggucaugauacaccuguaggccuugaaaauaucuuagcuuauguuuggcaccauaaacauaggagagaaacaagagguaagggaaauuugaggugcacuaauuuugcacugccagucucccguacauauucacuuaaugaccaacauaucuacuagaaaaguugagcagaaaacaucugguccaaagauuaaguugcaaacgacacagacacacuaugcaagcagagaugcaagguaguauuagaaaaauaaaaaauagucuugccucuuuuacuagaacccacuaacauggccacaugugcuucuuucucaacaaaacggugaaggugaccaugaucaucaucuagaaguacuacuacuauacaugcuugguuaaggacuuccauaccaagaagugaguacggaaggucaaccccacuaugcacagcaagaaaaguucccaacaagcuaguaggcuauguuccacaucugcaguggauuuuugagaggaagcucuaucuaucaaguugcagaaggagagguaauuaaguuccugaugucucagcccuggauugggagaccauugagacagaucuuaacaccaaggaaacaccgaaguuucuggacuuuagcagucuccaacaugcaugucacucaaccaacaguuggaaugaauuugaauaccaugcagagccauuugaaucuuuuuggcuguucuguaaaccucgggacaacuuuuuaaaaagaaaaauggucuuaaauucauuucaguguuuaauuuaaaccuuuaaucuaauuggaauuuagucuggugcacagugugacauguaaggucaaguuguuuuugcugcaacaaauaaaaacaauacaggcuuagguacaguggaguccagccuggucuacagagugaguucuaggacagccagcgcuacacagagaaacccugucucgaaaaaccaccccccccccccaaaaaaaagacuuugacuggaaagaaaaguuauaaauacagaaccaauuagaaucacaauagcuuuuuaaaaaaugauuuauuuauuuguuuuauguaugugaguauacaguauguuccugucuucagacacacuagaagagggcaucagaugcuauuacagaugacugugaaccaccaugugguugcugggaauugagugcaggaagaggagucagugcucuuaaccacugagccaucucuccaucccauaauaguuuuauuuuguugugguuugcaggagcauucauuuugaaacgugacagcauggcuggaaacuucugagaguguacagaaaauaaauuuacugguggaacuugccuuuauuccagaagucggaggcacagcagacagaucucuugugaauuuaaggucagcuuguucuauaaagggaguuccaggagagucaagacuauuauacagagaaaccuugucugggaaaacaaaaaugacaaauuuucaagaacaaaacuccuuugaaauugcauauauuucagagggauuaauuuccugucaaaauucacgauucauuuuacuuuuuuauguaguugcuucuuacauauuugauuuaucucugauugcuuccaucuuuuuuuuuugguuguuguuguuuguuuuuguuuguuuguuuguuuggcuggcugguugguuuuucgagacaggguuucucuguguaucccuggcuguccuggaacucacucuguagaccaggcuggcuucgaacucagaaauccgccugccucugccccccaagugcugggauuaaagguaugcacuaccacugccuggcagucagugcucuugguuuuuuguuuguuuguuuguuuggcuggcugguugguuuuucgagacaggguuucucuguguagcccuggcuguccuggaacucacucuguagaccaggcuggccucaaacucagaaauccaccugccuuugccucccaagugcugggauuaaaggcaugcgccaccacucccugcgcagucagugcucuuaaccacugagccaucucuccagccugcaugccuccaacuuacuuccuuuuuuuugagccagagucucaguauguagcucuggauggccugaaacucacuauguagagcaggcuggccucaaacucauagagauccaucuuccucugccagugcugaaaguaaggugcgcaacaccauaccuguuuucuuccuuccuuucauaaagccuuuucuguucgguuuugagaugcuugcagauuucuaagaugccauugaacuaauacaguaacaaaagcaauaagccuggccaaggcaggaagaccucugaggacagcauggccuacaacggggagcucuaggacagacagggcuacguagagagacccugucucaaaagaauagaaaauaaaaauaaacaauggcguuggagagauggcucgguaguuaagagcacuuacuacucuuucguuuaguuaccugaacacacauuguggcucauagccacccaucaaucuugcuccaaggcauuugcugacaccaucuucugcuguccaagagcaccuggaacacgugugguacacauacaucuguacaggcaaaauacucauacacauaaauaaaaauaaaucuuaaaaaauauuaucaauuaucacauaagagaauaugaucuauaguugauaugauugaacaauuaggaaacuaaacaaacaaacaaacaaacaaaaaaaaacuacacaaagaaguagccaaaauugauaggcaguuuuagaaaaaaaaauuuuggggggguuauuucgagacauugaugugaaugugucagaucaccuggaacuggaguuaccaauaguugugagcugccaugugagugcugagaauugaacccgaguccucugaaagagcagccaauacucucaaacaugacuuuuucuaccauauuccucucucaaauuggccucaauauccauguaucuacaguuuguuuuaggcaaucuagaauuuuaaagucauguuucucaacagaguucuagccucuaccuguuuaaaagauguaguuuagauguuuuucacaauaacacucuucuccugguguauaacuguauuaguuuccuauuguaacuaacacaucacucccaaaacuggucacauaaaagagaaauuugaccagugaguguguuugugcacaccuuuaaucucagcacucaggaggcagaggaagacauggaucucugugaguucagggccagccuggucuacauugaaaauuccaggcuaaccaggguuacauugugugauccugccuaaaaaauuauucagaaauuuaagguuggggauguaacacuugccuagcauguaggaggccacucagccaaucccuagcaugcagaaacaaacacaaaaaaagaaauuaacguugucauagcuagagucuauaaauccaaaaucaauaccaaucagccaagauuagaacauugacugggccagugucccuccaggagccuuaagggaaucuauucuuguuuugucuaacuucugguggcuguuggcuguccuuggccuaugagcacauaaccauaaucuuugucucuguagucacauuucuccucuuccauuugugccaccuaguucugucccuuuccggugauuuguauuuaggacccagcuggauaauucagcauaauuucuccaucucaaaaugcuucauacagucacaauggaaaaaccuuuuuuuugugugugugucauaugaggacaauugaccuagggauuaagacaugaucucuauugggggcuguauuaccucagugagaaaagaauguguauuucaacaugggggaacagagccaagaaaagucagaaauuagccgggcgugguggcucacaccuuuaaucccagcauucaggaggcagaggcagguggauuucugaguucaaggccagcuuggucuacaaagugaguuccaggacagccaaggcuauacagagaaacccagucucgaaaaaaccaaaaaaaaaaaaaaaaagaaaccucagaaauuaaguugcauuuuuuuagcacuaugcaaaaacaacagaagagggagcucugacacuugaaaaucuacucugaaccccaccuucuucagaaaguucaggaacauuaauauaaagaagggcaaaagaaauguacagggcauaucccacacaguuguaagaaugggagaguaaggcaguagaugccauuauuagagacagugaaggcaugccagagauacuagcucagaacagagcaaaaucguagccacaaaugacacaaagcaaauaaacacaauaugugguugauagcuuaagagaaacaggaggcagcacuugguaggcugagguagggggauugcauguucaaguccagucuguucuacaaagugaguucaauguuauccuguggaauauaauaaaacucaaaaagagaacuagaaagguaacaggaaaaguauguuuauuuuuuauuugguguuuuuagacauggucuuuuuuaagauugauuuauuuuauuuuauguauaugaguacacuguagcuguacagaugguugugagccuucaugugguuguugggaauugaauuuaguaccugcucacucacuccugcucacucacuccugcuugcuccagcccaaagcuuuauuuauuauuauaaauaaguauucuguagcugucuucagaugcaccaaaagagggugucagaucucauuaugggugguugugagccaccaugugguugcugggauuugaacucagggccuucggaagaacagucuuacccacugagcuuucucgacagccuccucuagacauggucuuacuacagccugggcuguccuagaacucaccuuguagaacagaguggccucaaacuuggagaucugccugcuucugucucccuagugcugggauuaaagaugugcaccaucacugcccugcucagugggugagaguauuggcugcucuuucagaggacucggguucaauucucagcacucacauggcagcucacaacuauugguaacuccaguuccaggugaucugacacauucacaccaaugcacauaaaauuaaaaacaaacaaaaaaaacagucauagaguuggaaauguaguucagugguaaagugcuuaccuuguaugagugaggcccuggguucuaacacacacacacacucacaguagccaggagccaagccagagugguaguucagaacacagaaagcagaggcagaguucaaggcuacauggguuugagaucaacauagacuacauaauauuaauaaucaggaauauuaaaauagccauuguaacuccauuccacaaguucaaaggagauuuugaaagaccaaauuuaaaaaaaaaaugcaaugaguuggaucauauuaacagcacguucaauuuuacagaugcaaaacuuaggggauuugaacauaguaguagaaacuguucaaacuggagugcagaagguaaaagaacagaaacugaacagaguuucaagcugugugauaaauucaagucuguguuguggggauggagagugucuuaggguuuuacugcugugagcagacaccaugaccaaaacaacaacguuuaaauggggcuggcuuacagguucagagguucaguccauuaucaucauggugggaacauggcagcauccaggcaggcauggugcaggaagagcugaguguucuacaucuucaucugaagacugcuagcaaaauacuggcuuccaggcagcuaggaugagggucuuaaagcccacacccacagugacaguuccuucaacagggccauaccuacuccaacaagcucauaccucugaauagugccacucuaugaggcuacaggggcucaaaauuucacaaugucucuucuacauuaagggagaaagacccuagugccccucccaaaagaguuugcagugagcuagacaauaaaaauguguuuguagcugcucucauugcagucauugguggaguauguguaaacauuucugaagguggacuuuggaagaaucagagauauuuaaggagggaaggcagggugugggcaaugcacaccuuuggcuccagcacucuggaggcagagcagggaggucucuguggguuuuaaaccaggguugucuacauagaaaguuccaugccagcaaaaguugcacgcaggggcuggaggcagggaguccccugagauuguuacagacagcaggaauggauccagaugagguaagaaugaaacuugauuccgcuugacuuuaguuagcgacugcuaggucaaaacuucuggagucugacaccaauaugucuuuaccuguuuaaacacaguaaaacuuuggggaaaaguuuccacauaacaauuauuacaacaaaacuuuaggcauggcuuuauuggaacucccuuguauaauaggacaucucuuuaggaaagcaccuaugaccuuuaccauaaagaugggcucuacugacagagaaacagugcucaggagucugggccuagggagggaagguuuguaacaagcacaagagcaaacucauuugcaaagugcauaggaccucuuucaugaggacugagaaacaguacuuaguauuauugacugagaaacaguacuuaguauuuugggggauucugugagggcuggcuuuacagaauagcaaagauuaccauucacagcuuucuggauggaaaauaggugucaauuucuucuguugaagaaaaaggcuuggguauuuaacaauucugauuuuucuagcgcuuuucugugagcuccuguccacuacugcugcauauugagauugugucuccaaaaccaaacuuguagaguuugcauugcuugcuguaugguggugcaagccuuuaguccuaguacuugggaggcagagaccggaucucugugaguuuuggguccaguguggucuacacagugaguucuaggacggcuagggcuacauagugagacccuguuucaaaaacaacaaaacaaaaguuugcauugcucucuucuccaguuggaaggaaaacagcaaaaccaaguuuccuuacuagagcaaggcuugcaugcaauaaaccagagguuuaaaggguuaaaaugagagagagagagagagagagagagagagagagagagagagagagagagguguaauggcaagcagcuguauccuuguagucaggcaugaggacugcaagccugcaaggcugaggcuagucuaaauuacuuuaugauuucuaggcccaccugggcaauucagcaagagcuugggugaaggcaaacagacaaaagacagaugacaaaaaaucaguaaagugaaacaaagaacaaaaccaagcuaagcaguugccuuugcaacacggcagccucuccuugcacucagcuuagacuucaaggcugcuacaacauuaaagcuguaaugucaagguuuugaggaacaaagaggagaaucuugugcuacugacuggacaauacaauugauguaaaauauuauaugcuucacuuuauggacuacaagauggcucauucugauaaagcuggugagaaacaaaacaaacaaacaacaacaacaguguuuaguggcucccuugcuuuuugcugccugugggaggauugcaauuugaauuaagaauuggaaacacaacaaaccuccauuaguaaugauuuccauguacugcugcuccaugcaaaagagaaacaaaaggaaaagacuagaagucuccacaucacaauccacuguucaaaucuucaaaggagcuuugcuaauguguucuuguugcccugaaaugucuggucucaguggcuggagguuuuacagacucacaugcguguuuugagugggucuguuuggacuuucugacugacaagaucaacaggacuuuuaggaaaaccuggucuguuacuugugccucaaacacaguugucuggcccuccuuaugugucugcuuuccugccaugggaauuaagccacugcauuuuuaacgucuuggauugcccgguagugguggcgcacgccuuuaaucccagcacuugggaggcagaggcagguagauuucugaguuugaggccagccuggucuacagagugaguuccaggacagccaggacuacacagagaaacccugucucaaaacaccaaaaccaaaaaaaaaaaaaaaaaaaaaaaaaagucuuggauugacagaucaaagcuccuugauuuaagucagcugaaacuggauaguguguccugugcugcuucuuccucuaugaagcaggccagaaaugaaaggucaccucaacaacagcacucagccugacauagacucuguggggccaucaaugacaaaaauauggaugcugauggaacugacuggguuacagacaaauccuaacaggaaagggcauauucccaggauacuaucugaaauugcagugcugagugacucuagaaucugcuaaaagauaaauugcauuccuaacccgugguuccucucuugugggaggacacaucacauggaauuugauccccguacucauuucucacauaucagacuugggaccccccuuggauaugucucuucacuguugacuuguauuuuguuuguagauuaguuacagcucacacuaagggacugauagccucuccguugccucuuuccugggaugcacacuuucuuaagguaugauuaucuauagcaaggggcuguaguguccuuuuuuuuuuuucugucuucucccugggcaaaugaucaggacaaaaugaaugggaaguuaaagaaaccuguuguaaaaccaucuuggacucuucuugagcaacucuugaacauuaauaugucuuucccacuaaauugcauaaggguguuuuccaguaacaguuagaugacugggaaauuugaaguuagaauuacagagaaacugacugcuuuuguaacaauggagugaagugggaaauccugggaggcucagcagaggagagaaccaaugcuaagcuucauuuuuuuuccagaccuccuacucaaauuucucccuucuuucuguagaaaaaugcuugccugaugccuuguuuccaaucugcuguugagcacucuauaucaaauacagccuacaagccucccaucacucacagcgggccgcacagagaugagacaggagugaugcuuacaaccacucuuagcacacaauccaugaugcauggggaaggugggaccaacgugauggauaagccaaacugaugggaccugccuauccuuagacaguuucucugaagccaauaauuaaacugaauuauauggacugaaauggguggcaggcuccucuggaaauuaauaccuagccaguguacaucgugcuuuguguacccucuagacuuccugcuugcaugugccuaugcuggucuugccuuggcacuggcgagaauucagauguaguucaacuuacugauaagaauuugccugagccagaaaaaaaaagacaaaaaaaaaaagaaaaagaaaagaaaagaaaagaaaagaaagaaagaaagaaagaaagaaagaaagaaagaaauuuaagaaggaagccacuagcuuucuagggcagaguuuuguaguugaugccauauguuuuaagugguuaacuccagauucucuggagauuagaaguuguuuauuuguuuguuuguuuuccaagacaggguuucucuguauagcccugccuggcuguccuggaacucacuuuguagaccaggcuggccucaaacucagaaauccgccugccucugccuccugagugcugggacuaaaggcaugcgucaccacgccuggcuuauaaauuguuuaaaaauaaacagcaucacaaagaaagagaccaucauuccaacugaagugccuggauaaggcaaacuucauucuuguucaaucgggugugcuacagaaaguggacacagaggccugaaaugcucuugguuuauauucuaucucaggugguggcugugucuuucccccauuggcuggggucugaucuuacaaucuuacucauuuggcuagucugaaaagaauuggcacccaggaagugaaggaaugaaaaaugggucacugcuacaagaagaaaaaugucacuugacaggccauuaacuucauagaauagaaguggguuuuuguguaaacaaagguuuuacuggugggggagaggggugagggcucaaaaugucugcauaaaagugugauggugggagauaaaaagauuuaaauuucuugucccaaacacaaguugugguuuuuguuuuguggguuuuuuuuuuuauuauuauuggauagaaaagacucagccaggcgugguggugcacgccuuuaaucccacccagcagaggcagggggauuucugaguuugaggccagccuggucuacaaagugaguuccaggacagccagggcuauacagagaaacccugucuugaaaagaaaaaaaaagacaagacaagacucauauuugguacuucuuucaaagugaagucaauacuguuguauggccucauccuguugcugggauccuacuacuaauugugcuauaaagaugccuuggucaccuaccuggacacauaacacauuccuguagucccagcuucuagggaggcuuaggcaagaggagcucuucuggauuucagagucaacacagacuguauagacugauguccaaaaaaugccuuauccaucagccaagggacaaacugguugcuuggcagugcaauccauuggcauuuagcuguccuccagaaauguucccugugucucuuuucugcuaaggauggcacacugugucuaaacuauacaaauaguacauuacguuggucaugugcuuguggucugaucaccuagaacuguaguaaacacaaaacaaagagagaaaacccuuggcuccaaaucucugaugugcuucucugggcauguggcauguguugcuguaauguuauugcuagugagaccucccaggagggagcuuguacauagcauccuucagagucuaucuaucuugggaguuuccaacacagagagauauuucaauguauauaagauauuucaaucuuauuauccucugcaucacugaaaacacacacacacacugguauggaauaaagaaauuacagacaaaauuuauaguaaauaaaaagaaaaaaaggagugcagguaagggcaguugcuacuaagccagaugacuugaguaggagagaaacaauucuggcaaguugucuccuaacuuccacagauuuguuauggcaugcguguaugugcacacacacauaaaauauaauuuaaaaaauuaaacacaaauaaagaaauguucugaaauacuuuuucccucuuauaguagauaacaguuaccaucaauggccuguucuuguacauuuaacuuucuaugcuguguccacuauaaaagacacugcccaguauuucccuuuuucauacuucucuuuaagacagaagaagggaaagcgaaguaaguucuuccucuucucaugcuuagagaagaaaaacugggggcggggggaggguauagggagcuuucgggauagcauuugaaauguaaacgaagaaaauaucuaauaaaaaaaaucguuaaaagaaaaagaaaaacugaaauugaaaaugucaucgcuuuuauccagaauugcauuggcauuuuuaguauuucauugugacaaaaaucugccauuuuuuuccacuugugaugauuuauuagcuggaagcaguauucuauacacaacgguccaguuucucugcuguguuuaguacauggagagauugcagagacucgugagaagacaaaaagauagaaaaugucaaccuguggguuucuuuaaaauguuucuuuuaaaacacccagaguacaugaccucugcacaaagaaaaauauagaaggucuggacgaucacacuugaucacacuacauaauuuagaaugaauuggaauguacuggcugaguuuuucugcuuuggagccuggugcuuuuaguucugcugcaucuguggcccaagaucucauuuucaaaacucugccauuguuuugaguagaguuugauacugcauuguuuagcauaguagucuauguugaauguguccaaaguauguuuuccaguuaaaucugaaaacauuuaaacauguuuuguggcaagaugugcacaagguaaaaugugucaccuuaaccauuuuccgaguguuugccauguuuaaguguugauuuuguuguguuuuucauuuuugcuaaccucaaauccuauguccauuaaauaacaacuacccauucuguccucguuccggcaaucaucacucugcucucugucuuuuagaaauuuuauuccuuuggggacuaauauuuuggagcuacauaguguuugcuuuucugcgacuuucuguauuguuucacccacauaauugcuuagugauucauuacaguaaaaacauauucucaggugcuauggagguagcuuaguuaauagaaugcuugccuggcauauacaaaaucccuggcaccagauagauauaccuggcaagguggcgcacagauaacaucucagagcucaggguggggaggcaggagaaucaagaacuucaguguuauucacugcuacaaugagaguggggccauccccagauccaugagcucauuucucauaaaauauuaaaaaaucauuuuaauugggaaauuuaaauauacaaagaagaugguuuaauaaauuccuaugaacuagucuuuauucuaaucauuaucauuaauuugguaguuugguuaauauauucuauggauuauucuuuuuuuccccaaaagauugauuuauuauuacacauaaguacacuguagcugucuuuagauacaccagaagagggcgucaaauuccguuagagaugguugugagccaccaugguugcugggaauugaacucaggaccuucggaagagcagucagcgcucuuaaccgcugagccaucucuccaggcccucuauggguuauucuuauuaagguguuuccccaacauuuuacuaugcaaaguuuccaacacagagauguuuaauauuccuaccaccuagauucuacaauucauauuuugucauauuuaucugugcagccuuccaucccucucucuaccaccccauguugcccuugaaguaguuuuaagaaaaaucccagauguuaucucagugauuaacaguuuaccuuauagccuauguagaaaauaugguuuaacauuaaaaaaacaugauuaugccuaaauaaaacuaacaauuucuuuuuuuguuuuuuguuuuuuguuuuuugcuuuuugaggaaggguuucucuguauagcccuggcuguccuggaacucacucuguagaacaggcuggccuugaacucagaaaucugccucccaagugcugggauuaaaggcgugcucuaccacugcccugcuaagcuaacaauuucuugauaucauguguuuaaugcuugagcaguucauacugagugacauuugauuuccagauaucuuggacuuuuugcauggucccugggccagauucucagcaaaagcuuacaagaucuuccuagcaucuccaguuuaggccauggacaauaccagaauuggggcuccuagaaacaguaucauccagagaacucaguaugaauacuguagccaguggcaacugucucaagagcuuccugaacucagagaaauauagugacucaugggcaguacuggaaaacccagggacaggaauugguccugacagaaaaggcagguacauuuucucaggaaacugauucuuuugcugcgagugagcacuugaugcucuuguuagagaacuggguuugguucccacaucagaacugccuggaauuccagggaauccuauccucuucuggacucugugggugcugcacacauguggcacacacaccgacaagcauauauauauacacauaagaaaauuuuaauguaaaacaggaauuggagcgaugacuuagcaauuaagagcauugcuugcucuuucagagaaccuagguuugauuucccaacauccaaagaguggcuaaaacuccaaucuagggaaucuuaaguuuuucucuuggcuuuugugagcaccagacaugcacaugguacacagacauacauguaggcaaaacacccagacgcauaaaaauaaaauauauuuuuaaagauuuauuuuauuuauuauauguaaguacacuguagcugucuucagacaccagaagagggaaucgggucuuguuacagaugguugugagccaccaugugguugcugggauuugaacucaggaccucuggaagagcagucagugcucuuaacgacucuccggccccaaauaaaauauuuuuuaaaaaauaaaaauuuaaggccugacauagucaugcacgccuuuaaucccagcacucaggaggcagaggcaggcagaucucugaguucaaggccaaccugguauaaaaagcaaguuccaggacaaccuauuguacacagaaaaacccucucucuugaaaaaaaauauagagagagaauuuuuaaauuaaauuuaaaaauuaagaguuuuaaaauggggcuggagagauggcucagagguuaagagcacugacugcucuuccacagguccugaguucaauucccagcaaccacaugguggcucacaaccaucuguaaugagaucugacacccucuucuggugugucugaagacagcguacucacauacaugaaauaaauaauuuuuuuuuuugguuuuucgagacaggguuuccucuguguagcccugguugucuuggaacucacuuuguagaccaggcuggccucgaacucagaaauccuccugccucugccucccgagugcugggauuaaagaauuuuaaaauggguaagaaaauaaugaaagauaaaaaacaaacaaaaagaccccccaagcccucauucauuugcauucaguuucugugacauugucuauucuugauguuucauauaaauauaaucauacaauaugugguuuuucuugucuggcucauuuguuuacuuagcacaauguuuuggaagcucauccauuuugcagcauauuaucugcacuuaauuccuuuuauguauggaaacaugacauuucauuuagccacucuucuuuggaugaacauuuauuugggccauuuccacuuuguggcuauggugaaucacaauaacuuuuguuuguuuugagauaggguuucucuguauagcccuggcuguccugcaacucacuauguagaccaggcuggccucagauucacaggaacccaccugccuuugccuccagaacgcugauauuaaaggcaugcaccaccaccacacccugcucugaggauauguauuugaaaacuaaauccuuguuggggcuugaaagaugacucaggaguuaagaguacugaccgcuuguccagaggacucaggcucuguuaucaucccccaugugauggcucauaacuguccguaauuccaguuccaggggaucuagagcccuauucuggccucugcaagcaguguugugagguucacuuaaauccaacauaacucaaacaccagaucaauagagaugacaaaaauguauuguaaucaagccccuacugauugaucggggcuacagaacagagucaggagcugaacugugacuuugaggggacauuguacagcauauuuaaaguauagaguuguagccuuguccaaucauauuuugacauaagggcguugaacaggggaguuuacaucaggauaggaguagguuccugggcuugcggacaugaacuuaguuugaccccgccagcaagauugaaaaguugucccugagaugucugcacucagacaaucguuuccuuacaacaguagcuguucggcuacugggaagucccuggggccugggacuuagcauuuaguuucuccuucugacuaaauggagucugaaaaugaaaugaauuuagaauaaguuuuuuuuuugcuuguuccauauauauauucagguaaaauauacacauuaaauaaaaauaaauacguuuuuaaaauacuugcugggcuggagagauggcucagcaguuaagaauggacauugcagcuaaccauggugccacauacauauaauucuagaggcagacagaucucugaguuugaggccagccugaucuauacaccaaguuccauaacagcaggagagacacagugagaaccugucucaaaagaaaaacuaaaaccaauaacaaaacaaccuccccaaauuucaccccauaguugguugaaguauggauaugagaccuauagauuuggaggaccauauuaaaaaugauggagaaacagagugggaggauacaaccaugaucagaaaguagauuccuccacuuaauauauggcucucaaguugccauuucuaccuuagcuuugacaauuggagaacugucauguauucuugguucuaaagcacacuauuucccauucuaaugcauccugagauucugaugaacagcaugggugaagugagugagaaauccuuccagauacuagggcaaugugguugggugucaggguggccuaggacauacagcaaaaauagcugcggcagauagauucgggaaguagggaaaaugacaguugucauuuccuggucccuuugaugcccuccuccuagacacguguagugguugaaggcacaagucuuauuugugcccugcagcuuggcacaacgacaggaaguaauguagacagguccacccccucccuuccgugccugagucaguuccagauccugacucaugccuccauugacucaagucauggugacaaauuggaagagagaggccaugccaggugcagagaacaaaagaggccaacacuuuccugagcagaagaagagggacaggaaugagucaggguggcuccacuucucacccccacuccuccaacaucuugcugccagguccucucugacgccaggccaaccaggcauguggggugggggaaaaggacaaguuuguucggcaguuuugacagacauagaccucaguccgucugcaaccagagcugugcaucgagaauacaagagauaggacacucuuuccaucacccuuucaguccaaaggaccaagauagaaugcuccuccacauuugggugaaagaugccgaaacuuccuccucuuacaugguguugucugcugagguuucccuucugugccucuguggggggggggggguagggggugggaguggggggagcagugcgaaagcagauuccuucccugguccagugcccucacccacauagagucaagugaucaaauagaaaggacuagcuuaggaaaucccuggaagugguuggugcuuguuuaguuggggaggagguguuacacaugcacaugugugugauaugcacucucaguauggcccagauugucucgaggaacucauccuacugaguagcugggacuacagguagugcaaccaugcuugccacagugccaguuuagugucuuuuuuuuuucacaacgauguauugggcaccaaauugugccuagcccauaucaucugggucucuuuaaguuccaucuaucacgccaaaagccuugaugcauaggugcucugaagcucccuaguaggaaucacagacuuggaguggaaaucugccucguuugucugauacauuuguaugguguguguguguguguguguguguguguguguaguuucuaggaaccuguaaacuggagucuaaaugucuggcuucuagugccaggugugaauagacuuggccaauuuauuagacugagaaauucuuagcuuuuuuuuuuuucuuuugagacaagguuucucuguguagcucuggcuguccuggaacucacucuguagaccaggcuggccucaaacucauaaauccgccugccucugccucccaaaggcugggauuaaaggcaugcaccaccacugccccgcaauucuuagcuuuuuuuuuuuuuuucagcagagaaauauuaauaggagaucaggaggccuaggauuuuuagauuugagaaggggcuaaaagaugagcguuguuggucaaaagauggaaugccuggguagaaguagaaaggaaacagaugugucucucugacagcugagguuuaauggggaacccuaauguuuuccucaaauccugccccuauaacaaccaaguugcagcuuguaucucuucuuuuguaaacaaagggaggaucauacuucauuugaauaucaguucaucuacacucaaccaauuucaaaauaugggaaaguacuuccacaucuacaaaagguuuuuguuuuuuguuuuuuguuuuuguuuuuuaguuugaauuuuuuuuuugucuucucuuuucauuauuauuugauuuuugagacagggucacuguagcuuaggucagccuagaacucacuauacuacauauagcccagccuggccaggaauuugugaucuuccugccuuagucucuccuguuacaggauuagauuuaaauuaaucuuucuguguugugucaguaauauuuuugaugguuucauaacauuuuagagaaaccaucuauagguuuccuuaauuucuuaguccacacuuucccauacaauauuugaauucaaauguuuccucuuacagaaaauacaaguaccuuuaaacauauaccuuucaauuaauaucuaucaucuaucuacuuauauugauuaagagaggaugaggauggaaaagaagauggggaagauacuaagaggugggaaauggaacagaugauuaguccacguagcaaaccuagauccugaugauggcgcuuaggcaggcagaacuguagccaccacugcaaugcgcgguagggaggcagccccucccugggacugcggacugcguggggacgccaucaugcugcagaccuuggccuuggccucaggcggucucuggcacccccuggcguucaugcuacaaccaucaguucugguuuucucuccccgccccccuucuccacuuugcaucuccugggcuuucuccuggccguucccuccccugccucgucgagcccucccucguguuaauuucagagucaucucccgcgggcacucuugcagaacuagcugguguugcuaggccuagagagaauaggcagacagaagagcccggaauggcuggccagcagggcucaugauacaagccccuguggguacugcggccgugggaguuaaucucgaccugccgcagccccuggaaaucuccggacugaagccucugcaaugaagcaguaccuucugcuuucuggcucuaagaggagcugccaaaaagaacagaacaauuuuggguuggugauuguggcgcuugaagagucauggacuccauucgccuagcugcaggcagaggaauugggaugugagggagguccagaacacucugggcucagggauuugccaguccuagguucaugucccaauaaaugccuagauggcaucucagauggcaagacaauguuuuuaagagccagcagagggaguuguuggugcuaggaaccagccuccuccccaaguccuuuucaaccagauaauaccccucccuauucauccauuuugcauccccuuuccucuuuuucucaaguccaacccuguuuaguucuggguuuuacucugcacacacaugcacacgcacacacacacacacacacacacacacacacacacacacacacacacacacacugcccccggugcugcacaaauccgcuaggaaaucacuccaagugggaaacaguuaacauuucaucauccagcaaaucaugcuuugccacgccucugcuugccucuguuugcuuggaccagacagacuaucucugcugccacccuggggccaaagacuguaugaccugacccaaaccccacaggacggauuuccaggcaagagacaugacccucaguagacaaaagugaagguugauuccagaaagcaccgagcugcugcuugcucuagggacccuacagauguaaacaguagggccacuucaccugugcggcuaccgagaggagggaaaggaaccuauuaacaccgaggcuagggguuccagcuaagacacugagucacugggacauuuuaggucucaggacguggauacuugauuggagcucacaaaaacuugggauccacacauauuuucccauuucuaucaacugggcuagcuaggucaucuucauuuaucugucuacacaaucauaugugucgauuuccuugaccacugagaugcaaagggguauaagaagagcucuggggaggaagacagggccacaucacauucaagugcaguuagggaccgcagaagaccuguuguaagucuggggauagaaaagggggugcaaccuuucuugcacuuuauaaagggccauggcuaacacccuuuagccaagaguaguuaacacaaggaaagcauaugugcgcgcacacacacgcacacacacacaaauaugucuucucacaguuuuacuugauacaguguuacuggggaaaugcggacucccauuuggauucuuaauaaaaagaauuucagccaaggcuacacagagaaacccugucucaaacaaacaaacaaacaaacacaacaaacaacaacaaaaagaauuuuaaaucagacugagaaugaagcugaaggacuauuuuauagaauuuaaaagaaaaacaacagaacaggugagcuguaaucuugccagcugccgagugaagggagaguuaguuauacuccuccucccucccucccucccucccucccucccucccucccucccucccucucucccucccuuccuucuuccuuccaucuucuuuucauuucuuuuagggcuuugguuugguuuggaaaccuugugucuccuccccacuauuaucacuaugcaucucauugugcccgcuaugucaauuuggugguuggcacauaacuagaguauggucaaguagguuaauguaaaugaagaaaauaucuaauaaaaaaaagaaagguuagauuccuuagcauuauuuuuaguucugaaacaaccuaaugucuuauuuaccaauuccuucucuguccaaaacuuucccucuuuuguaaaauagcaauuuuauucauuauuaaaugauuuuuuaauucucauuuuuaaaaaaguagguugcaauaaccucuccugccacagacaggaugucucugacaccuacagauugguagaucucuuaugaguuugagugagugucaaagacacuauauauaguauaggcgcuaaucucaagugcaggaaguaauaaucucagagauaugugauaaaagguuaaucaucucugguuuuggccaauggcaagcucgacuuauuacuaaauggccaauuauggagugggaaugauagcucaggguuuaagaggacuggcauuucuuccagaggauucagguuuguuucccagcacacauagcauacaacccucuguaacuccaacuuuuggccuccaugagcacuuggcacagagguaguacacauguauacacggaagcaaaacauuuacaggguucuacaaccacuacuuaguucuuuaacauuuuuuuuuugucuuuucgagacaggguuucucuguauagcucuggcuguccuagaacccacuuuguagaccaggcuggccucgaacucagaaauccaccugccucugccuccccaagugcugggauuaaaagagugcacuaccaugcccagcucuuaacauuuauuuuauauuugacuacaccaugaagagugagcacuaguccugcuaaaguacagaugaaacaaaaacaaacaaacgaacaagccgggcgugguggcgcacgccuuuagucccagcacucgggaggcagaggcagguggauuucugaguucgaggccagccuggucuacaaagugaguuccaggacagccagggcuacacagagaaacccugucucaaaaaacugaaaaaaaaaaaaccaaacaaauaaaaaacuacuuuaaaaaauaauacauucugaaaaaaagaaagucaguuucguuguaacaaaauacauaacuuccuacaguguaguaguuacagucuuagguaauuauccuagaaaugaauacccccagucacauugaaaacuuuacuggaacgaucauagcaacuuuauuaauaacaaaaguggaagcaucuugucuuccauagucacaugaguggguaagccaugguguauccuaccaugaaauggcacccagugauaaaaaggaacagucaggcauaguagcacacaucugcaaucccagccagcagucaacaggugaaggcaauaguucaaggucaucuuuggguacuacuauagaguuguucacuagaguucaaagccagccuaagcuaaauaagaaucagucuuuuuuuaaaggaaauuaauuauagguaagaaaauauugauacaauggaauaacuuagaugaauuuucaaggcuuuaaacugaaagacuccgagaggagccccucgcucaggccuugggacaauagcagacacccaagaacucacgagagaccaagcuugauauaaaccacaugaggcuuuauuggggaaagccagagcucugggggcgacucauaucccaugcagggguagaggagucaaccccaaggggaaaggggucccaguuuuuauaggcccucaggggggaaaagagaaggggggagaguaggggauuuccagaucuaaacaaugucuauucucaagaaauggguaugggagggguacaaggaaagagucugguguaggugaagcaacuccagauuggcccggcugugguugcuggggagauuuuccaacucuuccccagcaaccaauaucacaaacaccuaccagugaacuucagcagugggcacacaccuggguucaaggaacggucagaacauuggcagacacauggguucuaggaguggccagagcauugugcaccucuauuuuuccaaaucagugaagcuaguucugcuaacacugaugucuaucuugccaauuucagggcuucugugaccuuuuacauucugucaggaucuuucaaaacuaaguggaaaaagccaaaucuggaugagcacacauguggccaggccuagugguccauaccucuaauccuagcacuugggauguggaaggccagaugaguucuaguuugagccuaggcuacacaacuagaucuaaggcagccugggcuacaugguauccucucugcccaaacaaaauaauguaucauauauuuuuuuugcuuuguuuuguuuuguuuuguuuuguuuuuuucgagacaggguuucuuguagcccuggauggcuggucucaaacucagaaacccaccugccucggccucccaaguccugggauuaaaggugugugccaccacugcccggcuuauauuucuauuuauauagcagucuuuuaaugacagaauuugagggauagagcagauuagugccagaucuugaggacacagaugggaaguacauaaaggucaugacugugguccugagucagggcaguagaagagcccuuuggggcugagcuguuacaucggagugcaucucuagcagaugugaucaguggaggaaaucuggugaaggccaugaaacccuuuucuaugucguuacagcugcauguuaaccacauccuuaaagucaaaguuuaauuuuaucagguauguuggcacuugccuaugaucucagcuacuuugaaaguugaugaguuugaaccuaugaggccagcucucuaaagaacaaauuuuaaaauuaugacaagugauaucagaggccaccagcaggauggucaucuauguaguucgcucauggcauauaguuauagcuagagaguguuuguuauaaagcugggugcaauggaauuuuuguuuucuuuuguuuuucaagacaugguauuucuguguagcccuggccauccuggaacuaccucuguagaccaggcuagccuugaacucacagauaucugccuaccucugccuccugggugcuggaauuaaaggcaugcaccaccacugccuagcuaugaugucuuuguuuuuaauagcugaauaguauuccauuaugucaaugugcaacauuuuaucuauugcucucuugagagucaucuagguuguucccaguuucugccuauuagaaauagagcagcagugaacauggcugaacaagugucccugugguaugagggagcagccuuuaugcauaugcccaagagugguaucgcugggucuugagguagauugauuucuaauuuucugaggaacugugcugacaguccuaaaauuuugguuuauuauuuuauuuuauuuuauuuuauuuuuugguuuuucgagacaggguuucucuguguagcucuggcuguccuggaacucacuuuguagaccaggcugcccucaaacucagaaauccgccugccucugccucccgagugcugggauuaaaggcgugcaccaccacacccggcugaaauuuugguuucuuaaaaaagaaaccauaaauauucuaagaauguguuuuuguuuuaaucccagguggggcugcuuuggacugacuacagcacacuaugauuugccucgagcugaggugugguuucugccagcugcagauaguuucugggacagugugauguuuggaauuauuggaacuuuucagaggguauauaaaugggcucuaagaggagagauuggugguuggugguaguuuagggggcguugguugcaguuuguuagcuggccaugcucaaagaagaaaaaaaaggaaaaaauuaggcuuagguacuucuaauucuuucuucccacucuauccuuccuucuuuccuuucuagugauagggggugaaacuaggggggauaaagggugggaaaaagaagaaccaacaaaguagcaaaaaacuagcuacaagaaacugccaugugauuuccagaguaguuguacaaauuuucacucccuccagcaauguuccccuugcgaacaugugcugucacuugaguuuuugaucuuagccauucugacagcuguaagauggaaucucaaaguuguuuuuauuuguauuucucugauggcuaaagauguugaauguuaaguguuucuugaagagauccauauaucugcuucugccuccuaagugcuggaauuaaaguaccauuuuuuuuuucaucugugugugugugugugaguguuugugugcgcguguguucaugccugauacuuauagcccaaagggugucacaguccaugaaagagagcccagagaguguagcaucccuuggaacuggaauuagaggcaguugugagaugccuaauucggguggugggaauuauaccuagguccucuggaggaacaguaaccacucuuagccauggagccaucucuguagucucucuauucauucuuucaucccucccucccccucccucccuccccuccccucccccccccuccccuucccuuuccuuccuucuuuccuucuuucuuuagaggcagaguuucacucugcagucuuggcugaccuguaauucacuauguacaccagcuuggccucaaacucauacagagacuuuggccccguuccccuugguugcuaggauuaaaggugggcaucaccacuccuggcuuacuauuuauuuuaaaucagaguuguauuauguuguucagacuaagucucaaacuucugguccaagcaacugcaguacucuguacucuucuauagugcuccuuuaaauaaaaaagauuuuauguguauggguguuuugcuuacauguauguuuuaaaauaauaacaguugugugucuuuuguccaggaacugaaugaucaaggugagguagaaacuccaaauugggauuaaaaauuuauacaacagugcagcgcuuucaaaggccagaaggcaucagauccccuggaacuggaguuauagaugguuuugagccaccaugugggugcugagaauagaaagaaucugcauccucuagaagagcauucagugcucuuaacugcugaaccaucacucuaggccucuguaauguaauauuuaaugacauauuuauuaccaaccauucuuuugagacaaggucucgugaauuauaggcuggccucaaacuagcuaaggcugaccuugaauuccugauucucuuccuuccaucuuccagaugauaggguuacaaguaugagcuaccaaucccagcuguguuaccgauauaaguuaaagguaauggaauccuuuggaacguuguaagaugccacacuauuuugccuuuucuuuauucaaguaauguccugaaaugggucuauuuuugguaaugauagauuaaguauuuauuccauagucuuuuauggggcaucuucccacuuauaaaacagaauuagucuaagauuuuugaacauuuuuuuccauuaagaguugucaugggggcuggcaagauggcucagugguuaagaacgccaacugcucuucugaagguccugaguucaaaucucagcgaccacaugguggcucacaaccaucaguaacgaaauccgaugcccucuucuggagugucugaagacagcuacaguguacuuacauauaauaaauaaaucuuuggguuuuuguuuguuuguuuguuuguuuguuuguuuuucgagacaggguuucuccauaaagcccugcuggcuguccuggaacucacuuuguagacuaggcuggccucaaacucagaaauccaccugccucugccucccaagugcuaggauuaaagacgugagccaccaccgcccaacaguaaaucuuuaaaaaaaaaaaaaaaaaaagaguugucacuaugguuggagacacacagcuuuagugauagagggauuugucuauaauuucugagagccaggguuuuauuccucaggauuccagcaucaaaacaguuuucuaagccgggcaugguggcgcacgccuuuaaucccagcacucagcaggcagaggcaggcggauuucugaguucgaggacagccuggucuacaaagugaauuccaggauagccagggcuacacagagaaacccugucucgaaaaaccaaaaccaaccaaccaaacaaaacaguuuucuacuaauuucuuccuguguuacuucccuaagaaaggcaaauagcuuccaaauguuucuaggcuacucuaguagcuucuugaaggggacaaacaggaaaauaugguauguauuuuauuagaccucacaccaaaauaaaauuccaccaauauaaaagcuuuaaugcaaaacaaaacaccauggaaauauaaaauuaaaauuaaaaaacaagggcagagcuuuguauggugguguacauauguucaauuuacuauugugauaugucucuuaauguauuuucaccauucacacaucuguguauuuucaauauuguuuucuaagcauuuccauuucucuacaucuuuuaaguauauuuuaaagugagacuagcaaucuuagaagaauaaaggcaggaagauccugaguuugaggcuaggcuaggcuacauagugaggcgcaccccccauuucaaaaaagaguaaaggaagaaaaagaauuuuuuaugauugagaaaucagcauucaugaaagaaacaaugaaaucccuuagcauuugauuauuugcugugcuucugaaguuucuguuggucuuuuauuaagacaguucuguguguuuuacagcgcuucagaccaagcucagaaucauacauaggaagcaauugcugugacacugggcuguagaaucaggcucuaagaaaauuaaaaaaaaaggaaaugagaucggggagcgcucauucucuuacacguuauuuuuauucgcuuggaaauaacacaacagcaucuuucuaaguuagcacauuccuuuaaaugacgguguuuaaugaguuuguggcugucuaugcagaaaugucuuugauuacuacucuuuuuuuaacuaauaacacacgugaggagugaagaaucagccuuauaucgacacuaacaauuucuaaauaucuguaucaaaggguuucagacucauaauccaauugcuuuuauaacauccucugcuccaacuauagcuggagucaaggggcucugagaagaaaacugucagaacacuacccagguagauuugaagucugauauuuaaagaacaaagcagaacuacaaauguuuggaguagcagagagcucaguggauaaagauauccaauaucaagccugaucgacugggggaaggagagaacugagucccuggggauguccucugaccuccacaugugccugcuccaugguaugcaugcacacacauauguacgauaaauaaacuaauuaauuaaaauacauauguuuauuaauauucugaaaauaauaaaguuaagaauguuaaaaaccacaguuuugcuuuucaauaugaugauuuuuuaaaaaaauuauacuuuaguuauccauuaaaaaaaacaaacuuuaauucaauaacacaaaagagagggggaaugagcuuucuaaugugguuaccuaaauaaauuuucuaagcuguuucuaacuggcauuuaaacucagauggauacuugguucuuuuucuuuggcucuuagaauuuuguccuucacuauggcuaauuucuuuccagaaaauucccuagauggaauuuggugcauagcccagcagagggccccauuuccauuuucugagugacacccagcauacaccaaaccacugcgacaacaaucagcaaaucagcagcgaggacugcuguccuccuacauuccaccuacguggcuggggcuauuggguuccaguuccagcugcugagcuuaggacagauggugucugcaauuccuuucagccauggaggcggagauagacgugguuucuaaaaauaacuagugguucuggaggaguccuauuuuguuaaaagcaugcaaguaguuuuuguugcagcuuuuaucccucuaagauuccuauccucguuuuaaaauauacuuaaaagauguagagauauagaaaugcuuagaaaaacauauugaaaagacacagauguauaagugcuuggugaaugcacguugagaaacauuucacaauaguaaauugaacaaauuacaauugaguuuauuacagcuuguuuuuauuuuuguuuuguuuugucuuguuuugagauaagguaggucccaggcuggcuuagaacucaugacucuccugccuuagcuuuccaagugcugggauaaaaggcaugaaccaccaacccaggcucagaaauguguguguguguguguguguuacaguaguagaaagcugucucauagauggaccaguggggacccauccaguuggccucucucuauuccuuauccacagauguagggcaucgcuggaaugaggacccaugagcuccuauuagccaaggcaaauucucaaauuuauggccaacucccauauagaaagacagaaguuuagagcacuauuuccagguuuugugccuugcauugaagaagaggaaggacuaguuuuuauggcuagccuuaggaaagccaaguaagagaaggggcaggggacaaggucagaaaggucuugcuucaacucaaaguacagaauacaucaauucucuauauaauuuguggcaguguguucugagccuguaucacuaaggaguuucuuucuuucuuuuuuuuuuauuagguauuuuccucguuuacauuuucaaugcuaucccaaaggucccccauacccacccccccaauccccugcccacccacucccccuuuuuggcccuggcguuccccuguacuggggcauauaaaguuugcaaguccaaugggccucucuuugcagugauggccgacuaggccaucuucugauacauaugcagcuaaagacaagagcucugagguacugguuaguucauauuguuguuccaccuauaggguugcaauucccuuuagcuccuuggguaauuucucuagcuccuccauuaggggccaugugacccauccaauagcugacugugaucauccacuucuguguuucuucuucaacaaaagaaaacccuggccaggcggugguggcagcacacacacacaccuuuaaucccagcacucaggaggcagaggcaggcggauuucugaguucgaggccagccuugucuacagagugaguuccaggacagccagggcuacacagagaaacccugucucgaaaaaaagagaaaagaaaaaaagaaaacccugaagcacaaacauuaaguaauuaagaggugacucuaguaguggcaugaauuuauaaucccugaacugagaggugggacaaggaagauugugaguucaaagcaaucacugucucaaaaauggggugauauauuuuacuauauuaagaugcauucuucauaaaauuauacuguaauuaggucuaagagauaaaccacaaaaugaaagaaaauaaaaauaaaaauccucuuauuuacaauguaaaagugcaaaacagaauaaaaacuaaggacgcaacaggaagcaggcaguauaggagcagaacccauaaccuaggacauuuuaaaaaugacauauuauugucauuuguugugcuugccucccuaggcuucauguauuaaaauuaaauuuucaucaagagaguggaaauuuaaucugacugcauuauuuagaauuaagguuuuauuauuuuuaaauugaaaauagauucuuauucucauacccuauauccuguuuaauaagauaaaacaaaguacgccacauggaagcuggaccaggcaacccaacagaaguaaaagagacuggggagcaggaacaagaaucagaaguccacucauucacacacucagaaguucuauaaaaauacuaaguggaaagcuacaguauauaugcagaggaccugguguagaccugugaacgcuguguuugcugcuucagucucugagacuucauaugagccuuguuuacuuuuacagaccuuguuuuccugcugcucuccaugcuuucuuucugccuccucuucugaagguuccccugaacucugaagaaaagauuggauggagacaucaucucauuuacaguuguguguuccagggaucucucccucccucccccuccccucugugugugugugugugugugugugugugugugugugucugcacaagcgggaaugcaucuguuucgaucugcugccagaggaagcuucucugaugauggcugauuaaggcauauagcagaauaucaucaggagucauuuuauugacaccccccccauuuuuuagcaauauuaugugguuuuaucccaggucucuuggcuaucuggucucuaguucuuggucacccaagcagugccagguauaaauuccuuccauggagugggccuuaagucaaauuagacauuuguugggaacuuccacaaguucuuugccaccauugcccuaucauaucuuguaugcaggacugauuauaagcuagaguuuuuuuguagcuguguuagcauuuacaucuuucucuugguagcuugcagaguaccuucucacaccaaagagacuaggacauaggagugaaugcuucauguuggcaccagcucuaauuuuccauacaauaagcuguguggguauuguccucagcaaugggucccaguugucagccuggguuguuuagagauuuccaugggacccuguuggcaaagaacucaacugaaugcagcucagccucaguauuggaagcuuccuuuuaugacaagagguggccaguugcgacuucaucuccacgaauauuaggacaccuuauuaggaucaccuucauauauuuuagaaaguuuccacugcacaugauuucaauaccaucccccaaaugcccugcaauuccagcugucucucccugcaauccuuccuuuaaacccaucuccacuuccucuugucaccuuaacuuguucccaucccccacccccaguccacccauaagauauguuuuauucaccccucccaaggagaucagauccauguguuccccacucuacacccagccuuucugggucuacagauuguaaguugauuaccauuuauuuaauggcuaguauccacauaaaagcaaaugcaaaccauauuuauuuuucugagucuggguuaccucacuuaggaugauuauuucuaguuccauccauuugcugcaaauuucaugauuucauucuuuuuaacagcagaauaauacuccauuguguuaauaaaucacauuuccuuuuauccauucuucuguugagggacaucuagguuauuuccagucucuggcuauuaugcauaaaccagcaaugaacauguucaagcaaguguccuugugguaggaugcagcauccuuuggguauaugcccaacagugguauagcugggucuugagguagauccauucccaacuuucugaggaaucuccauacugauuuacauaguaguuguacaauuuuccacuuccaccagcaaugggggaguguauccuuaccccggguucuugcuagcaugugcugucucuuuuguuuuauugaucuuggccauucugacagguauaagaugaaaucucaaaguaguuuugaugugcauuuccaugauggcuaaggauguugaauauaucuuuaaguguuucucagucauuugaguuuccucuauugagaauucucuguguagaucuauaccccacuuuuuaucugaauuguuucauuuucugaaaucuaguuucucuaguucuuuauauauuuuggcuauuacuccucuauuggaugcauaguugguuaaaauauuuccccauucuguaggcugccauuuuguccaauugucagcguccuuugccuuacagaagcuuuuccauuuccugaggccuuauuuauucauugcuugucauagugcuugcacuaucaguggucuguucaggaaguugucucuugugccaacaaauuuaagaucauuucccacuuuucucuuuuaccagguucaguguauccuguuuuauauuuuggucuuugacccguuuggacuugaguuuugugcagaggaauaaguauggaucuauuuggauucuucuacauucugacauccaguuugaccaucaccauuuguugaagaagcugucuuuuuuuccaguguguauuuuuggcuucguuauuaaaaaaaaaaaaguguugauaggugugugaguuugucugagucuucaauucuauuccauugaugaacaugucugcuuuuaugccaguaccaggugguuuuuuauuacuauagcuuuguaauacaaauugaaauugggaauggugagaccucuaguaguucuuuuuuuauauaauguauaaaaauauaauauguauauuuuuuaaagauuuauuuauuuauuauauguaaguacacuguagcugucuucagacacaccagaagagggcaucagaucuuguuacagaugguugugagccaccaugugguugcugggauuugaacuccggaccuuuggaagaacagucgggugcucuuacccacugagccaucucaccagcccuuuuuugguuuuucgagacaggguuucucuguauagcccuggcuguccuggaacucaugcuguagaccaggcuggccuccaacucagaaaucugccugccucccaagugcugggauuaaaggugugugccaccacacccggcccucuaguaguucuuuuauuguucaggauuguuuuagcuauucugggacuuuuguuuuuccauacaaaguugacaacugcucuuuccaggucuguaaauauuguguugaaauuuugaugggacuugcauuaaauuguuuuuggcaggauggcaauuuuuacuaaguuaauccuaccaauccaugagcaucuuuacaucuucugauaucuucaucaauuucuuucuucagagacuuaaaguucuuguuauauagaucuuucucuugcuuuguuagacuuacaugaagauauuuuauauuauuugugguuguugugaaagguguugcuucucugauuuuuuuuccucaaucuauuugucauuuguauauaggugggcuacuggguuaauuuuguauccagcuaauuugaugaaaguguuuaucaacuguaguguaucaagaaaauuuuagaaagauacuuugacuucuuccuuuccaacauguacuuccuugauugccuccaguuuucauaucgcgcucuagcuaagauuucaaguacuauauugaauaggcaugaagaguggacaagcuugucuugguccuaauuuuaguagaauuauuuugaguuucucuccccuuaaguugauguugucuaugggcucacuguuaacggacuuuauuguauugagguauaugccuuguauuucuaaucucuccaggacuuuuaucaugaaggggugcuggauuuugucaaaggcuuuuucagcaucuaaugagauagucuuuuucuuucauuuguuuauauguuuuuuauauguaaucauugacugauuuucauauauugaaccauccccacaucuuuggaaugaaaccuucuucaucacuguggaugaucuucuuaacguguucuuagauucaguuugcaaguauuuuauugaguauuuucccaucuguguucauaggggaaauuggucuguaguucuuuuuuuuuuuuuuuuuuuuuuuaaaguucauuuucuuuguggagucuuugcgugguuugguaucagggaaacuguagucucaucgcauaaaaugaauugaguaauguuccuucuguuucuauuuuguuaugauuugaggaguguugacauuaacucuucuuugaaagucugguacaauccugugcuaaauccaucugaccugugcaguuucugggugggagacuuuuaaugacugcuucuauagccuuagggguuauauguccauuuaaaguguuuaucuaaucuugaauuaacuuugguaaguggugccuauuaagaaaauuaucuguuucuuuuagauuuccaguuugugaaguacagguuuuuaaaaguauaaccuugaggcucucuggauuuccuccgugacuguuauauccauuuugguucugauuuuguucguuuguguauuuccucucugucuuuuagguacuuuggauaaggguuacucuauuuuguugauuuuucucaaagacccaacucugauucuuuguauuguucucuuuguuucuguuuuauugacucagcccugaauuugauuauuucuugccaucuacuuuccuugggugugauuacauguuuuguuguuguucuagaacuuuuagguauguuguuaaguuucuaguaugagaugucucuauuuuuuuaauguuggcacuuagugcaaugaacuugcuucuaagagcaggcuuuauugugucccauaaguuuggauaugcuguauauuucuuuuuauugaauucuagaaaaucuuuaauuucuuucuauuuauuuauuuauuuauuuauuuauuuauuuauuucacuccauauuuuauucccccauccacccucugacugguucacauuccacaccuccucuccacccccugucuccacguggauguccccaccccaccugauuucuaaauucccuggggccuccagucucuugagggcuaggugcaucaucucugaaugaacacagaccuggcaguccucuacuguauguguguugggggccucauaucagcugguguaugcuguuuguuuggugguccaguguuugagagaucuuggggguccagauccaaauaaguugauuucuuucuuucuuucucucucuuucucucucucucuuucucuuucucucuuccuuaaccuacuuuucauucagaacagaguuguucaguuuccaugcauuuauaagcauucuguugguacccagguuuuuuuuuguuuuguuuuuaaagauuuacuuauuuauuauauguaaguacauuguagcugucuucagacacuccagaagagggagucagaucucguuacggaugguugugagccaccaugugguugcugggauuugaacuccggaccuucggaagagcagucgggugcucuuacccacugagccaucucaccaacccgguacccaguuuuaauccaugcuauucugauaggaugcagguucuuauuucaauaauuuuguauguguugagacuuucuuuguuacugauuauguagugaacuuugaagaacauuccaugaccuucugagaagaagauguauucuuuuguguuugaguggaauguucuguaaguaucucuuaggcccaguugcuuuagaaagucugcuagcucuaggauuuuucaguuuaguugcuuuuugucuggaugacuuguccguuggugagagugguguguugaagucucccauuaucagugugugaggguuagugugggauuuaagcugaagucaugguucuuuuacaaacuugggugcccuuguguuugggacauagauguucagaacugaaauggcaucuugauggauuuaucuuuugaugaauaggaaguauucuucccuaucucucuugaguaguuuugguuugaagucuauuuuguuagauauuuaaaauggcuacaccaccuuauuucuuagguccauuugcuugguauaucuuuugccaacucuuuacccugaggcaaugucucucccugauguugagguauguugcuuggaugcagcagaaauacaaaucccaucuucacauccacucuguuaaucugucuuuuuauuggggaauugagauuauugauguugagcuacaucgauaaccaauaauuguugauuccuguuauuuuggugguggugguggugguggugcgagugcacauguuugcgcgcgcgggcgugugugugugugugugugugugugugugugugagagagagagagagagagagagagagagagagagagagagagcacuucccuucuugugauuuugcugagauuauuccuuguguuuucauggguguaucuaacuuccuuagguugaauuuuuuuucuucuagcaccuuuguagauagacauuguuuacauuuggaauuauaauggaauaucuuauuuucuauaucugugguaacugaaauuuuugcuguguauaguagucuuugauggcaucuguggucucuuagaguuugcaacacaucugccagacccuucuuggcuuuuaauguuuccauugagaaaucaaguguaauucuaauaagucucccuuuauauguaacuuauucuuuccccuuuacaccuuuuaauauucucucuuuggucuguauguuuaguauuuuuauaauuauguagcaaggggcauuucauuucuugaccaaucuauuuaguguucuguaugcuucuuuuuaaauuaaucauuccauuuguuuacgucucaaaugauauccuacuucccaguuauccuccacaaucccccaacccacauuugcccucuuccucuuccccuuugccucaaugagggugcucucccacccacccauccucccucuccuacccaacugcuccagcauaccccuacacugaggcaucaaacuuccauaggaccaagggccucccuuccccuugaucagauaaggccaucuccugcuacauauguaucuggacccauggaccccucccuguacucuaguuggugguuuagucccugggagcacuuggugguguggccagaugacauuguucuuccuaugauguugcaauuccucuccacuuucuccaguccuucugccagcuccccaucagggucccugagcucagucugaugguuggaaccaaguaucugcaucuucauuggucaggugcugguagaaccucccagggaacagccacaccagguuccuaucagcaagcauaucuuagaaacagcaacaaugauguaccuuucuuuauacgcaucuucuuuagguuaggaaaauuuucuucuauaauuuuguugaaaauauuuuucuggcucucugugcuuggacucuucuccuuccucuaguccucuuauucuuagcuuuggucuuuucauagugucccagauuuccuggauguuuugugucaggaguuuuuuuugguuuaacuuuuuuuuuuggacauauguaucaauuucuucauuguaucuucaacaccugagauuuuucucuccaaucucuuguauucuguugaugaugguuacaucugcaguuccuuuucaaauucuuaaaguuuucauuuccagcauuuccucaguuuggcuuucuuuguugauucuauuuccauuuuaaagucuugaacaguuuuauuuguuuccucccacugcuuagguuuuccugaauuucuuuaaggaauuucuucauuucuucuuuaaggaccucuaucauuuuuauagagucaauuuuaaggucuuuuuucuuguguuucagcuguguuggaauauucaggaccugcugugguaaaauagcugggcucuaacggugagguauuuauuuguuauugguuguguuuuuaugguguugucuaggcaucugauuugaggugaucauaggucuaggugcugauuucuggauuugucuuuguuugguggguguuuuguuccuugguuucaguuuguuuucuggauuuuucagugugugaugguuguguguugccugauuuuaaaaaaaauccucuuuagacuugucaguugugacuacuggagauuucagguaaaauguguuucuugauauugggaggugacagaaauagggauaggcuaggggucugaaggaguucacaggggaaaggagagcagaguguuaaugaugaucugcuuauuuccgcucuuuggaauggggugggagacagugaagcucugcuauagcacuggggauuggaucuagagaaacugaaggagagaggacuacuuguugcccugauagaaguggacuguggguuagcagggagucccugcuggaauugggggcugagauaaaguaacaaguggggagaaagaaauuaaggagggaaagucugugggguccacgguagauggccacaggguucagggaagguugccacaaguauucugcuuccgagcucaggaugggacugggggauuggaccugggggaacagagggagcagagaagaucuguaggcagcauauaugguuuucugacaggcauggcuauggguuagcagaggauaucugcuggaguuggaggcucuggucagcaacaagugagggaagggaggucagaagaggaaugauuauccaugggauccacaauagauaggaacaaguggggugcacaugggguccgugaaggaaagcgugccagaggugugugccagaggaggggaugagacuagggauuaaaucugagggaauauagggaguucagaagaacugcaggcagccuaccugguccucuggcaggcauagcccauagguuagcagugggugccugcuggauuugccugggcaaagugaguuggaggagggaagccaggaggagaucauuagugggauccacagauauaugugggaugggguggugggaugaaggcugcagauguucugcuauagaucucgggaugagacuggaggacugaaccuggugggaggagggaguggugaagguccuggacuugcucagcugguguguucccagugaaugccugcugguguuggaggcugggauagugggacaaauuaggggaaggaaguuugggagacaaagucccugugauuagcuggggagugggucagaaaggaaagggagaccacaacagguucucugccacagagcugagggugauauugggagucauaucuagaggaacagaugagaaguaaagaucugagcagcgaagucuuuagaaagugauuaggauuagauauuagggugacuaaugguagccuuauuaaaaauaagauaggacaaugagauagcucagcaagucugaagcacuuacaacaacacacacauuacuauuuuuuaaaaguauaaggcagguuuggagagaugguucaauaguuaagaccaccagcugugcucucagaagaacuggguuugauuaccaguuccuauguggcagcucacaaccaucucuaacuccaguuccaggcucugaggcucucuuucugacccuaauggggaccaggcaccuacaugguaugcuuacauacaugcaagaaaaacacucauacacauuaaauaaauaaaucaauagauaaauacaucucuuuuuaaaagaauagggaauuaaaucagaagacacacuuguacacagacacacacacacacacacacacacacaccccaauacucaccaauaucuaagucaucaucauacugcaucauacuggauaaacccuugaccuggggucaggaucuaucuaucuaucuaucuaucuaucuaucuaucuaucuaucuaucuaucuaucuaucuauccauccauccauuuuagccaagauuucuauuccugcacaaacaucaugaccaagaagcaaguuggggaggaaagcguuuauucagcuuacacuuccacguugcuguucaucaccaaggaagucaggacuggaacucaagcaggucaggaagcaggagcugaugcagaggccauggagggauguuccuuacuggcuugcuuccccuggcuugcuuagccugcucucuuauagaaccgagacuaccaguccagagauggucccacccauaaggggccuuucccccuugaucacuaauugagaaaaugccccacagcuggaucucauggagguacuuccccaauugaagcuccuuucucugugauaacuacagcuugugucaaguugacacacaaagccagccaguacaccauccacccacccacuuaucuacuuaccuacccaccuaacuagauaaucuaucuuccuuuauucuuucuuuccugcuuuauuucuucucucucuucuuuccuuuaucuccccuucccccuuucccuucuuucuguuuuauauuuugaaauacagcguccaggggggccuuguacuagcuauauuauccaaguuggccucaaacuugugaucucccugccucugcuuuccaaguauauauacacgcagucugugauguucuguuauuaguaauagaaagauuaauauauguauacauaaauauaugaauaaauauguccaaauaugauaaggaaauuuuuuaaguugcacaucuauuuuuuguuucuauuaaagcaauauuauugguauaauauuuugguccacuuguucugguacuauucaaguuugaauauuuuaauuuaguuucuuaugucuaaaaugagaacuaaguacuucuuuucuuuuuuuaaaaugauauuguuauuuauuuauuuauuuauuuuauuagguauuuucuucauuuacauuuccagugcuaucccaaaaguccccuauauccuaccccccgagaacuaaguauuucacaugagcaaauuaauaugauuuaaguaggugugcuccuuacuauuucucauguacaauagcucaucuuuccuucugcuccccaucucaguagcugugcaucucuucucucacacccagcaacauaauugaaauuagagcaucagucucuguacugaauaaucuccaauuaaugucaaaucuccacauaauuggucauuuccaugguagcuucaaccacucuggucauguuuauacuucccagcaucauuuguaaaaauuaaagugugaaagacauucuaaaaacuccagagucaacaucagcauagcuacuuaaagucaugcagugacgaaaggucccuggacaucgauugcuucgauuucaguuagacuuccuuuggguaaagcagugacuugguaagcagcccuggcaggaaggcuacccuggacauauguuuaugucagccaguaaaacaguuguuuucaccacauuagugaaaucacaaccugcagcuuuaagaaucucacccacguuuuuaaaggcccgcuuagcuucuuuuauuaccccucuuggaacaagcuguccacuggaaggauccaugccuaccugucuagacaugcaaauggucuguccacuagcacagcuuggcuguaggcaccaaugaccaccggggcuuuuguggugcugaucaccuuucugauuagggaugagaugcuaaucuuucccucuugaagacccuccagaagaaacgaugguaaguaacuacacccacucuuuucaccacugacucaggaaauuucaaacuccaaccacaauaaaauauuacuguauacugaacggaguguccaagauuuaagucagauguaaauggaaacaggugcaccaucacuugaaauagcuuggcauuacaugcuaacuuuaaagagaggcagucuucaugaggcaagauguaaauaugugugcaccuaagcucaagagccauucauaaggguuaaugaaagguuucuccaaauauuucaguugguauccuuauuugaauuccaguaaaugugaacaaugggagccgauuucuuuuuuuguuuuuguuuuuuuuuuuuuucgguuuuuugguuuuuugguuuucgagacaggguuucucuguguagcccuggcuguucuggaacucacuuuguagaccaggcuggccuugaacugagaaauccgccugccucugccuccugagugcugggauuaaaggcgugcgccaccacgcccggcgugagcugauuccuaacauccgugagcaaauaacaaauacuaacuucauaaaugaaaagacacugaaacuacucacaaaaauuagcaaagccucuaaguguuugcugaucagagaaaaugacagauaaauaacuuaauagcuuuucagagcgagcauuucuaaucaaaugcuaggucccugcucauagcauaagauccuaaguaggaugagucauuguccuugugugucaagucaucuaagaccaucagacacuuaaccugcugccaaggguccuaaauucaugcugggacuuguugccccagccacugagggugaugugagcaaacaauccucagaugucaaucccuuuggaggugacucaguugccacaagccucccugcucaaggguauaccuuucccagggcaucaacauucauuaauguugaaucucaucucaggaaauacacgauagguuuagcuagguuuagcuagcuccauagaucucuuuugggaucaggcaaaaacugauguagggagugcauaccaagucaacugguuuuucugcuuuacccuguccucaccucuccauaugcacugcuagcaagcuaacaacccaauaaagucugcaugcuaaaugacacugcagagccugcugcuuccagaagucaaccuacaaugccaguuuucaaucuugcugccuaggcuaucaggcuuuaaugcaauaacaagccaagcguccucauguuugcaauccuagcucucaaaagccagaggcaggaagguugugaauucaagaccacccuucuguauuugccuucacauguaugcuguauguugcccauucuuuuucuucuuucccuccuuucucccuuccuaucuuccuugacacagggucuccuuauguaauuuuguuuggccugaaauuugcuauguagcuaaagcuagccucaaacacacagauauccaccugccucugccaucucuucuucuuaaacagauacuacccauaucaaugaaggacccacucuuaugaucucacuuaacuuuuaacacucucaucucuaggacuggggauuaagcuccuaggguagagugcuccccugcaugugggaaacccugguucaauccucagcauugcaaaguuagugugauuucucaagccuguaauaucagcauucaggaguuggaggcaagaggaccaaaaguucaagguuauucuuaggaaauguggaguauccuccagagaagacuacucagacauagcuuuaaggcaauagaaagucuuuuuagccaccuucaauuacacuggauguuuaggaucccagugcagcauggagccuuucucaaggugagauuuuaagcaugaaaaccauauccuggauugacacacuuuaguuaacaagaacaguuagccagaaguagaacuacagaagccaaaaagcaagguuaguacauuuagagacuauauugacuuugauggauuggguguuuguuuuaguuuuggcagauggaacugucuaagugcuaaguuuuacccugaaugguacuuccaucagggagucgaaaggucuaggggccuacuaagaucuggggcccugcuauaaaacuacaaagagaaaccuuguuucaaaaaaagaaggauggaggaggagaaggaaguaguaguucugggacuggauugaugcucacgaguuaaaaguaagaaaggcaccaaggagcacaagaauagaaaggucaaccaggcgugguggcgcacgccuuuaaacccagcacgugggaggcagaggcagguggauuucugaguuugaggccggucuggucuacagaguguguuccaggacagccagggcuauacagagaaauccugucucaaaaaacaaaaacaaacaaacaaacaaacaaacaaacaaacaaacaaccccacaucccuuucuugaucucccaagguauuuuggacccucucacugaguuccagcagcagguaaucaagacauuauaauguaaugggccugcacugggagauggggauuugaggguccagaaauuuaauuuaaaagaaaauucuaaaaaaauaauccauaguuuuuuuguuuuuuguaaaagaaagauugagugcagagaagagagcagugggggcaggagcgauauagcucagcagucaagagcacuugcuguucuuccaguuugguucucagugccuacauaugguagcuuaccuuuaguuccaauuccaggggauucaauguccccuucugaacucugcaggcacacacacacacacacagagugggaagaaauaaaaaaaaauguuuuuuuuuuaagugaggacaaagugggucagauacuauauaacucauccuggggccugggggaauggcucaguaaaacacuugccaugcaguccugaggaccugaagauaaaagccagcagcagcguaugucugugaccccagugcugagaagguauaaauaggcagaucccuggaggucacuggccagccagucuagcaaaaagggugacuuucagauuuaaugacagacacucuccaaaaaauacaguggagaugaguugaaagaggcauacaccagcugauaugaggcccucaacacacauacaguagaggacuuccaggucuguguucauucagagaugauacaccuaacccucgagagacugccccagggaguuuagagguaaggugguggugauggugggguuggggcauccaaguggagacaagggugggguggggaggaggugugggguguggaacagucggaggguggauggaguggggcggguaauggaauauggaguguaaaaaaauaauuaaaaauaaaauuaagaaaauauauaagaaacaggggcauaucaaaaaaaaagaggcaaccuaggccaaucuuuggcuuccacacauacaugcacaugaacuugcaugcacaugugcauauauccacacaaguacauauaucagcauccaccguuaucuuuuauauaugugaauucaugacaccuguacauauauguacauguauauaaaaccaagggaucaauuuccaguauccuucaggugccaucaacuuuguuuacuauuauuacuaauauuauuauuuuguacaugcacaaugggguacacaagugcuauaguauauauguggagguuaaaagacaauuuuguggagucaauuuuuccuuuugccuuuuuguggguuccagggaucaaacucagguuagcuggucugcaacacaagcaccuuuaaccacugaaccaucuugcuagauuucauucaccuugauuguugagacagagccucuucauuggccuggagcucauugacucagcuagacuugcuggcagccagucucagggaucuugcuguuuccuccucucacuggcauuacaaacacagaucaccacacuugguuuauuuuuauguggaaaguaccugaaacacuuacuuuaccaacuugagccgucucccuagaacccaauaagucaguuugaagagcaggaacuaauccauugcugcaagaacuaauccagucuugcacggaugaugucaauccccugaaaggccccaccuaucaguauccaugcacuggcuaccaaaauuccaccaugaauuuugacaagaacagaccacauccacaccauaguaauauucucuuuacucuuuccccaaaugguagcuaguuugauuucuuucacuauaaacugguuuuuccuggcuuagaauuccauugaaaacuauaguaaugaaaacuauaguauuacucuuuaguuccugguuuuuuuuccuucuuuuaaacuuaggucuaggaaauucaucuaugcuguucuauaguugugauugcugaguguucuauuaugugacguugucauaguucauggucuauucuuuuguuggauaccaaggcuguuucuaguauuuuuuuguuuuuaguuuuuacauuuccuaauaugaauaaagcuaaucugaauaugugcauacauguuuuaguguggauauguaaugggcugugguuggcucaccauagccaauuuagggccuuucuuaauucugguucagugaugucauauugguaguuugaaacauccacuguaggaaucuuuauaccacaacugacaaauguuacaaauuacaauuguuuucuuuuugaaaagcugguuguuaacauuuaccagcauaccauguggguauauguuuucauuucucuagaguaaacacuuagaaaugauguuguuggauucaugauugauugauuuucaaauuauuucuuguccuguuuuugcaaagaacuuaaagaaagaaaucuuaucuuuuuauagaaccaacagacucagcccauuacauacagguucucaaaauaacuacuagcucguuuugaaguaagaaaacgugacgguaccauuugggacacagaguuucucuuaaauucaucuaguagucaggguggccaucuguuacuuaacuauauccaaaggaaaaccaagacucauaucuuagaagaaagaaggaacaacuuugagcuggacacauagaggaaguuugcaucagacagggagauagggguguuguuacauuugaaagagaugguuucaaggccuuuaggaaaauuuucugugguuguaaaacuggcaagagacugccauacucuuuggggaggggcagggugcugagaauuuaacucagggcuuugugguucauucucuuguugagcuacaacccuagaacuaagcuuuuaaggaagauuuaucuaucuaucuaucuaucuaucuaucuccaauagacagagaaaauaaaaguuuucugaaggaaaugcuccaaaaaaagaauguagguacauacacaugugugugucugugccuuuucuuauucugaugccuggguaaauucaguuuaagaauuauauucauccuaaaauauguccacaaauggcugccacaggauugcauuccagaacaacacucccuucuucaccuagccagcuguggucugucuuucaaauuccucaaccccuuuccucccucccuagagccagaccuccagcacggauccgcuaauuagcaaaaguuaugacuacaguuucuuagagcugguaaauacugaacaucauuuagucugaguccacccuguuuuaaagaccaucaaauuaagauauaugaauaguccuuuaaaaugugcuuuacacuacuggccaaauugcauuuaaggguuucucuugcucagaucagucuuaaauggccagaaaauacaaaacugaaauggagucgugccucugacacgcacaccaaaaaaagacaagcuucuuuauucuauagcacgguuaggguuaaaguccuuaaaacgcaguagucgcccugacugcgccugcgcgccaaucaggacaggcgaauuugcccuagagacagccauuugagcccaccccuccuaauccggaacacgacccacauuccgcuggcccugucuugaugggcaugaucauccuccaauaagaauggagagacgagucacagcgagccaauagcaaaaagccuagggacgguggcgguggacugagaggaaacaagaagacaagcccaagauggaggcggugguggugguagcggugugacaggugagggcaggcccgguaggguucggguuuuggagcggcugcgggacccggguaugaaguccagaccgaaagcucagcuccaagaugcuuccgucugaaucucagcguucucccgcccggaaccaaaggagugguuugaccagggcgagaccgucgucaucgaccgugggaguggauggaggagucggccugcaggcugcaguggugguuucgcuugcugcgcguggcagugcaccugcacagagcuugaagcccuuggggagggcgggacggagccaaauugggucuggggucuggggcuugggugcgaaauuccaaggugaauucuuaaaccccuuaaaaugucuaaugacguuuccucacgacguccaggagaugcagcucucucccaugguuccuuauugcccuucauauucuacgccaccuaggaagaugucugacgauuaccucauuaucccuaguucacccuaaucccuuuccaugauuucacagugcguuuacaccaguaaucuguuugugacccccaguaguuaucagguacaguuuuuggaaacccuucccccaaccucaccuccaucuucuucaucuggauaccauugucuuccuuugccuuuccucuugauaguguuuucugaugagccaucauugccacugcauuugauuuaguguguaauguggucuguuauccagcuguuuuucacagucuguagugacucuuauuacaucucucuuuagucuaggguauggcgaaccucuguggacucuagagggucuggugaccucuauuagcuaccugacaguaccuuugauucuaccauuagccuuauagcuuaugcucuggaauacccacagugccuuuuaaggucauugguacugucuucauuuccuucaaucuaaaaacaaggucugaugauccuccauuuuccuguccccugucugugucugauuacccauucucugaagcuaagacagccuguuuauuuccauugugugccugagaccugugauuuuucagugcaguacauaauggcuuccccauuaaucucuagagagucauguguucugcacuguccagaaccgugugcacugucuccucacugcagugagucucagaucuugguacucaacuaugacauaagcaauaggagauucucagcagagaaggguuaguaucauugggcugguucauaaaaagugggauuuagggaacagugggaacuuggagauggaauuuuauauguccucugccacucugcuuucaggcugucauuacuagaccucugaauuucuccucuguccucugcuaggaggccuauggcagcugcccaguccuaccucagcccaucuugaaaacaaucuuaggcaacauggaaccaccacgaggcccuccuguuaguggggcugagccaucucgggcaguuggcacugucaaaguguaccugccuaacaagcaacgcacaguggugagucacucaggcaguacuggcagggguuccagauagucguagugugggaucagaaggguggcgaggguuagggaaugaaugcugcagagggaaggaauaauuggcuaggguaccuauuggauacugaagaccccaaucucuacacacacacacacacaggugacuguccgggaaggcaugagugucuaugacucuuuggacaaggcccugaaggugcggggucucaaccaggacugcuguguggucuacaggcucaucaaaggguaaguauggaaaccccaugccauucacugggucccuacacaccuccuuucuucagugccaucuuauuccuccucauuugucuuggagucuuccacuaucugagguaacccaggugacaucuuucguuucccuucauugaccauuggaaggucugcaauucacuaugcacucagcccucaaguccucagucugucaccuuccagaguucaucuguuuuguucuuucaccauuucuugaagucacaagcucuuucuuuucucaugguccccauacaccauggaguugguggucuucauugaccuuucuauucuuuguuuguuuguuuguuuguuuuguuuguuuuuuuuuuuuuuuuuuuuugagacaggguuucucuguauagcccuggcuguccuggaacucacuuuguagaccaggcuggccucgaacucagaaauccacuugccucugccucccgagugcugggauuaaaggugugcgccaccacgccugccugaccuuucuauucuuguguuccuuggugccuuaauguuuuggauggaguuccuguuuucauuuuaccuguuucagugucucaggugcuggcuuacuacgccugagauguaguuucauuugccucucaccacaugcuuaagaucauggauuaaaucugggagugguggguauaccuguuagccuagcgcuugggcaauucaccuaauugcuugagccuguuuccucauguguaaagugggaguaaaaauagugacuaacuuuauuuuuuauuugaaauguuacccuuuuuauguguaugaguguuuugacugcaugcgugugcacuguguguguuccucacgccuauggaggccagaagaagguugaagaucccaccggaguuaaggaugguuaugagccacggugugagugcugggaacugaacccagguccucugaaagaaaagcaaguauucuuaacugcugagccaucaucucuccuguccaaaagugacuaacguagugagaauuaaacaugugggagagugguucguggaugggacugagaggaacuuugggaacuucccugucuacuguggucccaguguaucaucgcucucauucucucccauacuucuugcagaagaaagacagucacugccugggacacagccauugcgccucuggauggugaggagcucauuguggagguccuagaagaugugccacugaccaugcacaauuuuguaagucuaauggggauggugggggaggccacaguguggacagagagggccuucagucgggccugcacuucccugcuuuguggcugcagguacggaagacauucuucagccuggccuucugugacuucugccuuaaguuucuguuccauggauuccgcugccagaccuguggcuacaaguuccaccagcauuguuccuccaagguccccaccgucugcguugacaugaguaccaaccgccgacagugagcccagccugggguggcuugagggguggggaggacggaagccccagcacgagggcuuacagucagccaagcuauacucacagccuucuuguuuuacaccuuuaugcccucaagguucuaccacagcauccaggaucugucuggaggcuccaggcagcaggaggcucccucaaaucucucugugaaugagcugcuaaccccccagggucccagguagggaugucguagaugaaaggccagggggccagugaaagaaggauuggaggacccugagagauuauacuuucguuuauuuguuuacgugauaaauacuauugaguaccuacaaguguugaauaugggcaugggauugugggaucauugguaaggcacccagucacuccagguuucauuuuuuucaucugggaagaggggaugagauuuucccuaguggguucugaagaggauuaaggguugagauauuugcaaugcuuaaagcaagaucugauacagaguaaauaacaaguguuauucauuacaaguguauauauaaaaucaucuaguuuguucauuucuuccaguauaaccacaccccagucuuuucucuuugaaauaaauguuacuguaucagaaaguacuuuuauuucacuuauguuggauaugauagcauauaguuuugcauaauauauaaaaaguaagguuaauguauuauuauuuguaguuaugaguguauguguguugauuuaccugugaauuuaaucucaggauggugaaaguaacagaagaauguuuuucuguaagguauaauucaugggagguggaggcaagacgaucaauaguucaaggcuacccuccacuaaguagcaaguucaaggccagccugggcuacaugagacugucuuaaaacaguaaaaaagguguuuuguaacgugauauauguauaaucguuauaugauguguguaauguguauuacauaauauaauauguguauugaaaacguugccauuuuaauauagguaaugcucauuauuauaaaauaaauaauauauuugaaaaauacaugucauuaugauauguaauaaaaagucauaucuuacccuuucuccaacuaucuuuguccuucauuguuccuucuuuagaccuuucucccaauauuacccucucugagaacccacuccugacucccccagggacacuuucuaccuccuucauuugauuuuccucuuuuugugccuaucacugacaggcacauuauauauuugcuuuuuuauucuucugccucugcuaaaaacucuacaagggcaagagcuuuuuauuuaugguauccacaguuugaucuccucuguuucgaguugcaucuggcacacaggaggcacucaguaaauguuucuugggcagaugauuacuggucugaccaacagacauguacuguuugagugaacgcacauucagggugguggaguugggcuuucuuugcuuuuuaguuccuucugcagcgauuucauagccuuuucucuauuagccccuuuacccagcaacgugaccaggagcacuucucauucccugccccugccaaucccccacugcagcgcauccgcuccacaucuacuccuaacguccacauggucagcaccacagcucccauggacuccagccucaugcaggugggugucaaggaggugacaguggggagcauggagcauugcuuagagccauuacuauugccauauccucacuuugacuucugcucccaccuccuuccaguuuacugcucagagcuucagcaccgauggugagagaacccccaccccuuucugcacccugagcucucugccccaccaccccacuugccuccacucacagcauucuguacaaccacagcugcugguagagguggugauggagccccucgggguagcccuagcccagcuagugugucuucagggaggaaguccccacauuccaaguuaccuucagaacagcgggagcggaaguccuuggcagaugaaaagaaaaaagugguaugccauaggaaauccuugggggccaccauagccugagugcuaugacggaggguuguggguaggccccucugaugccacccaucuggcccacagaagaaccugggguaccgggacucaggcuauuacugggaggugccacccagugagguacagcuguugaagaggaucgggacaggcucuuuuggcacuguguuucgggggcguuggcauggcgauguagcugugaaagugcucaagguggcccaaccuaccgcugagcaggcccaggccuucaagaaugagaugcaggugcucaggugagguugcugugaauguaagugggacaggaugguggcaggcagcauuuaguguuugggaaaaagccaugcugggguacuuccuggguguguacucuauuugugccauguuggaaguauaaugaggcucaauuucucuccaagagaugacccuuucuccucugagcaaugggcugcagaugaggacaaugaugauggucuuucuuuggaugaacauugcuauuugcuggcugggaacuagaucuagccauaggaccuucccaugauuauuuaacacaugaagauuuuauguaauuccagcuccaggagugcucauauccguccuuccuuuugcugagucacugcuauuauacucauuguguugugggcuuguuguuaaucauaauuuuauacuuaaaauuuucuuugaugcaaacaacaauauuaauuauagucauauucuauauucccguuguguaguuauuauaauugauguaauuaagguaugaucaacacuauuaauucauucacacugaaaaaaccaggguggcaccauuuuagccacuacaguuacuauguagcauaguacuuugugccuuuauuuuauauaagcaagguuguauaggguguguguguguguguguaaccauauuaagcacauguaauaccacugagcuauacucccuguuaucaggaagguauaauuucugacaaucugaggaugcauauaugggcuuccccccucuuaucagauaaacacaauggaugccacaauaagaaaacuuauucucagcucaucucuguaaaguuugaugauuugaguaugcacuaauuugcauucuauuuaucuacuggcuucccacuauuaagaaucuuuaugcugcugaggucacuuagcaccaagacugacaaccugaguccauucagucccugggaccuauaugguagaaaagaacuggcuccugaaaguuguccucuguucuccacauguacacuguggcacacaugcucuauauacacagaugaucacagacaaaggaaucuucauauuugcugggaagauagcuccaucaguaaagugcuuaauauguuugugauugaguuuagauucccaucacccacauaaaaaguaaaaagcugggugcaguggugcacaccuguaauccuagcacugggaaagcagagacaagaguggauuacuggugcuuagccagucuaggcaguuggugaggucuagguuuaguuagagauucggucuccaaaaaugagguggagccgggcgugguggugcacaccuuuaaucccagcacuugggaggcagagacaggcggauuucugaguucgaggccagccuggucuacaaagugaguuccaggauagccagggcuacacagagaaacccugucucgaaaaaccaaaaaaaaaaaaaaaaaaaaaaaaaaaaaaaaaaaaacccaaagagguggaacacaaucaagggagauagauaauccaacaucaaccucuggcuucuccacccaugcacaugcacagucauguaugugugccacauacaaaacaauguggagagugauugaagaauacaccugacauugaccucuggucuccguuugugugcacagauguacauguacacgcauaccuguauauugccucugucuuugucugucucuguuucucucuuauacacacgcacacgcacacacacacacaaaucccuguguugagaauguuggugcaugccuguaaucuuaguacuugggagaaaucccuguguugagaaugauggugcaugccuguaaucuuaguacuugggaggcugaggcagaaggaacaacaguuugagaccagaacuggugugauaauguaguaaagugcuuaucauguaagcaagaagaccuauguuugaucucuagcacccauguaaaaggcuggguguggcagcacaggcuuacaagcucagcacuggagaaacacagauaggaagauuccagagguucaucagucuagacuaauuggcaugucccaggucccagugaaaaaucuccugccucaaaaccaguuuauaaaauaaugcaugaacaacucgaguagguccugaaaacaacauccuagguugaccucuggccuccacuuaagucuucauacacacguacuaacacauacauguauacuuucacacacagaaauacauagauuguucaaaaaaucuggaguaugugaugaaaccuagucucaaaaaaaaauuuuuuuugugguaguacacaugucuauacucuuagcacuugguaggcugaggaucaggaauuugaagccagccugcgauacauuaaacccuguuucaaaaaccaaaacuagagcugggcguugguggugcacaccuuuaaucccaguacucgggaggcagaggcaggcggauuucugaguuugaggccagccuggucuacagagugaguuccaggacagccaggacuacacagagaaacccugucucgaaacaacaacaacaaaaaccaaaccccaaaaaacccccuaguccuuguguguaaguauguauccucagugguagagcaugugcuuagcauaugaaagguuauguuccagcucaaguaucaaaacaagaagggaauguccuggugcucuguugucuucugugaucuaaauauuaucccuguuguuugcauuugcguacucaaacagugguuaauacuuaagaaugugguuuucucauaaacuauauuaaagagguuugcaugugacaguuuccaugaaguagacucagguacccagaaacaaacuggaaguuucagaauguuuacuguuuguccagcuguuuuaaggaccgcucagaccauuuguucacccuuugugacauccucagaaagccgcugcuguaaugauagcaguuguaugguuugggaacaagaggaccaaagugguuagaaguccucuucaagguuguacaaugagugacugguaaagguuuggguuguaacaugguuucggacucuagauucuuugccucuaagccucucagugauuaguaaacugucauccucccaugucacacaugucucuaugucuugagccucucucucucaguauugauaaagaagguuggcuuccuacuuugucaucuguaacauagccacugcuagguaugguggcuaaugcccaugaucccagagcuugcgagguugggucagaaggaucacugagagcuugcggccugcccaggcuacuuagcuccaggccagcuugguauacaacauaagacccuguuccaaagccauaaaaaaauaauaaaauaaaauagaauuuuguugaggacggucagaacaucaaccucuacucagcucccagaagcccaucaagucucacagauugcgaucugacaacauuuggcccugagcacccuugaagacaagguaagaucgcuuuuccuauugcugaguaaacacaugacacuuguucuauuucuugaccccuucccccaaccuacccucccugccuacaggaagacacggcaugucaacauuuugcuguucauggguuucaugacucggccgggguuugccaucaucacacaguggugugaggguuccagccucuaccaccaccuacauguggcugacacgcgcuuugacaugguccagcucauugauguggcccggcagacugcccagggcauggagugagccucacaucuuagagacuuggggaggugggagggauagcugaaauagucuccagacaauucacuacccacuuccaucuccacagcuaccuccacgccaagaacaucauucaucgagaccuaaaguccaacaguaucuaccugucccuggcugggacuggggguggguaguaaucagagugguaguuuaaagggaugauuugggggguaagauucuggaggugaagagggaagggccuauauccugugguuucuugccagguaacagagcuauaccugguaaagggccuuuuaaaugaaggaccuuuguuuaggagucagaugguucacguacuguuggguacucugcucaggugagauguaguaguuguagaugacauuacagugucccaggcaugauagcuuuaggugucauccaggagacuuguugguuuugggucacaauggaaccaagugggguccuaucagucguagauaguaugaaauggggguggcuucuggcaagagacauaacucacuagaacagggguucugagaaccauccaguaaggguaugaggcauagcuauugggauuccuuguaauggcccuugacccugcuggauaucuucuuacaugaggggcucacagucaagauuggugacuucggccuggccacagugaagacacgguggaguggggcacagcccuuagagcagcccucagggucugugcuauggaugguaaguugggccaggcuagauggggagcaaugggagauguggacuuuuggauugggacaugccaggcaaaguggggaugucuuugccaggugggaauaucuagacugcccauguuuuaccucacauggguggcacugagucauucucaguguaacuaucaggaucugauacuguggacuagucauuuuuugucccucauggucccccugcccugucuggccuaccuaaggcagcugaggugauccguaugcaggacccgaaccccuacagcuuccagucggaugucuaugccuaugguguugugcucuaugagcucaugaccggcucacugcccuacagccacauuggcagccgugaccaggugagccucauaacuuacccgcaguucucagggcuucacacucuagguccccucacuuguacagacaguagucuccccgcccuaagccuaggauuuuucugaaugaagaguccuggaaucugucuuuuagauaucuuauaucccauccuccucacacauccacaaaccccugagccagaacccuuaaaauccagauuucuuugacucccuauauucagaauguuccuagaccccaaacccuucagaagcccccugaacauucugaguguccaacacucaggcccuuugugcuucucaaauacccauagucacccugaauuuggggucuuggaauucauaacacucuaggucuuaaauucucacacaauucuccgaauuuaagaucuagaaccuucccuguucuuagauaccagguccagauaucaaguauuugagcuuugaguacuacauaaguaagucuacauagacuuauuuaugccccagacuccuacagaaauggaaguuucccccaagaaguagugcucugcauuuucccgaaucuuaguauuuucugagcuuaugccccuuaauaacuccagacuccuauuguucugggccauacacaccuacagucuuugacagccuuaauauaaaucccucucuuuuaucagcagaaaauccucccuaguccucagggacacagacuccucugggccuuaguacuagacaccucuaguccucaaaaauuaaccuaacauauauuuuaagauucauagaucccugggccucccagcucaaaccccaaaucaacccauuccuccccacacaccagaucaucuuuauggugggccguggcuaucugucuccggaccucagcaaaaucuucaguaauugccccaaagccaugaggcgccugcugacugacugccucaaguuccagcgggaggagcggccccuauuuccccaggugggcuggguaggagggcuggauaccuuggggagaugcacugugaguaaagagauagaggcagauauugaaugugaaccauguugaaagcuggggauuggggauauuggaguaucucugggacucuggacaccccucuucaucuccacccgcucccagauucuggccacgaucgagcuacugcagcggucacuccccaagauugagcggagugccuccgaacccuccuugcaccgcacccaggcugaugaguugccugcuugccuucucagcgcagcccgucuugugccuuagaccucacucccagcccaccagggagccaauuucagcauaccaugccaaggcacaccgaccuaccagccaauaacuguucugccucugccuugauacugccucaggauucccuaucccauacccugggaaauuugagggaccccaaaaacugaggucuccugcuuucuccauaauuuggucuccucuuggguuuggggauaguucuaauuuggagagcuguuuuaucuccaauggcugugacucagugcaaggauuccacucagaaccucuuucuaaaguuuuugccugaugugucuucacuggauuuugggguucccagcaccccauguagauuuggggguuucuuuuugucucccccacuauucaaggacucuccucuuuaccaagaagcacagaauucugcuggg

SEQ ID NO: 9424 - RNA, 61589 nt, Mus musculus
guauuuucugagcuuaugccccuuaauaacuccagacuccuauuguucugggccauacacaccuacagucuuugacagccuuaauauaaaucccucucuuuuaucagcagaaaauccucccuaguccucagggacacagacuccucugggccuuaguacuagacaccucuaguccucaaaaauuaaccuaacauauauuuuaagauucauagaucccugggccucccagcucaaaccccaaaucaacccauuccuccccacacaccagaucaucuuuauggugggccguggcuaucugucuccggaccucagcaaaaucuucaguaauugccccaaagccaugaggcgccugcugacugacugccucaaguuccagcgggaggagcggccccuauuuccccaggugggcuggguaggagggcuggauaccuuggggagaugcacugugaguaaagagauagaggcagauauugaaugugaaccauguugaaagcuggggauuggggauauuggaguaucucugggacucuggacaccccucuucaucuccacccgcucccagauucuggccacgaucgagcuacugcagcggucacuccccaagauugagcggagugccuccgaacccuccuugcaccgcacccaggcugaugaguugccugcuugccuucucagcgcagcccgucuugugccuuagaccucacucccagcccaccagggagccaauuucagcauaccaugccaaggcacaccgaccuaccagccaauaacuguucugccucugccuugauacugccucaggauucccuaucccauacccugggaaauuugagggaccccaaaaacugaggucuccugcuuucuccauaauuuggucuccucuuggguuuggggauaguucuaauuuggagagcuguuuuaucuccaauggcugugacucagugcaaggauuccacucagaaccucuuucuaaaguuuuugccugaugugucuucacuggauuuugggguucccagcaccccauguagauuuggggguuucuuuuugucucccccacuauucaaggacucuccucuuuaccaagaagcacagaauucugcugggccuuugcuuguuuauuuugcuucccgacucuucucuuggggguucagagccgcugagggguggggcaaguccaggcaaggaguggagguuggaggaagaugcagaccacaaaaacagugccacuguacgcauuaccacaggcggcaugaaugaggaccacauaugccaagcauggcacaaaaggaggccaagucagucacagauaaacacauuggcaaagguaggggagugggagaccacaggccuuccuugugcaaaggauucugaggauggguggaguuugcauauuuaaagacagcugucagaggcaggaaauuggggagggguuucuggaggagggaacuuagggguccuagaaguggaaggaacuuccaguauauugaaugggauggagaggaagaggugaagggaaguccuugagggacugcuugguggaugguagguggcauuugaagauguggaucuccagagagaugaccuauggaagagguuuaaggauaggggcuucuuauggaauuggaaauuucugauuaggagcaagguguguuggagagauucaggaccaagaguagaauaggguuuuucaggaauuucagagcuccaggagaggauucgauguauuaggucagaaacagguuuucugccauucaggaacuuucagggaagaaaucacccuuuagauguaccagaaguagaggucuucaggaguuuggagguucucaaacagaucuggaggugaccaggaacaggauucuaaauggacuuggggauucccaaaugugagaacuggauuuaggaccagguuucucaagggacauacugaggaaugagaagugggcucuaggagaaccaggagagggguucucaagggauuuggagguuccaaaagugagaaauggacucaggacccagagagggcugucuagggguuuagggguucucagagugggaugucagucggagaagaggcuggcgaaagacuuccucaggcugcggauggucucagcuuucaccucguccuggcuaaggcugggccugggaggggcuggcucuggaagguugaaggcauuggucagagacugggauuugcuagagagagacaagguggaggcaugggaggaagggggaagaggaaggggaggaagggagagaaacacaauguuacccuaggcccagccccagcccugccccucugauccugaggcugugccugugaccuucccacccccaagcaugccccugaacccugauggauucucaagggugaugaagcugagacugaggcgaauguggggucagcugagaggacuuagauauaagauaaaguggugugguuuaaugggaagauuccuuggucaguuugauauggaggaugaaaggagggguuccagcaaggagccuaggaggagccugggcuagggacagucuaguaugagguaagccagucugagggggaacagauggggugggggugggggccagggaaaacuuuggagcuaagggcuaggggaauagaauggacaaggagaagcagaaaggaugguaugaucugggagaguuugaaguggcaggaguaucuggcaauggaccagaaaggagucuuagggaagguuugaggaaaggcugaaaagggaaaugauggaaggcuugcugcaaauuggccugagggaguucagggcugucugggaggagggugauaauaagagaucagauggacagggaaguacuggaaguaggucagccaggcuacugggaugggccaaaggucuggaagggggacuuucccagggcuuguaggggaggaaucugaacuggaaguggagaugcugggauucucccucaacugcugggauugagacaaaagggguuuggcccaggcaaaggagaucugguuuuccuugggaucuggggaugcccuacuggggacagugcacucugugagcagcaaaggccaaggcugcuauaaagguccccuuacuugagcugggggugcgggggucccccggcagcggcggugaugggugguggcacauccuggcuggguuucugggccagcugugguuuggcgggacguccagcaggaccugggccgcugggccggggcugcuguguggugggaggcccagugcgagguccgggaccugccugacuggccugacgagugggaccagcagggccuggggguuuuuggggagggcccuggcgcugcugcccuccggguggggcuccugaggccuucguuggagcuggaccagagauagaugccugacggguagccugcggggcccccgccugacgcuguggagauggggaggcuggugggcgcgcugcuggaggugcuccagggccuccugccacuggccgcgacuggcggccuugacccugggucacugguguggccugagaggcagacugcugaggugcugcggugggacuugguaggcgcugaggcagagggcugccagcuggcgguccaaggccagaaagauguugcuggccuugugggggugggcgcugcugcagcgggggucccuggcgcugagguccugggccuggcuguggagggccuccuaggaacagaaaaaaagaacagcaagugagagugagugagagcugaggccgccugggaugguaggaacccagaaggcuugcccucacuuacccuggggugggggucguuguugagcaggaggaccugcaggcugcugggaggucuggcggcccaaggucagggcuccuggggaugaagacuguggcagaagaguggaauacaagagauuaaaaauaguuaccggagagugggagcaacagccaaucaaaacgacauggguucccugugugcuggguguugccccauuuguggccaguugaggggauauggagcuaugaggccucucaccccauauuuggucaggagacucuuaaagauggcaagguagcagcaauuuagugaggccacaagugcauaaaggugacauuaauaguccauugauaccaccucuauggcaucagguugaugaagggcuggccuccuucccacuagcucaagaccaagggccugaccuggcugugggagccccugccaggggaagcaucccgcugcggcugccgaggcagagccugagucaucuuguugaccacaaguuccacgaugagcugcuugucuucauccuggugaucaccaaugaguggcauggaggagcccaccaccuaugggagggaaaaggauccaguauuaggggaggcaggaagugcaugugaggccacagugucaacaacauacuuucacuuggcaaaaaaacauggugacugcaaagagagcucugucuggcuucuaaguggcgcugauugugcacuguaaggaaagccugccaguuccaaggcucuggacagcuuuguggguggaguguuagagcuggcucugcaaucagugucuaugggggcaaaucuagcuugcuacauguuuuucuauggcucaugagcuaagauauguucuauaucuuuuucuucuuauuuuaaaggaaguagaaccacaaccacccagcaagccuaaaaaccaccagucuaacccuaaaaucauaggcaggauccugccucacccucccaaguugcuaggauuacaggcauguaccauaguuuaggcuacccucaaacucuucauuagugcugggauuaccguuucccgcugcacccagccuccgauggcuuucagugguuggggaaaaagguuucaugugugcaaaagauaugaaauuuaaacucaguguacuuaaaaguuauagacauaaacacaugaguuguauccauaugcacagcugcacaaaucuuccaucuuguuuguggcugcuuuuaugggacugaaucagagugccaaacugcauggcccacaaagcauaaaauauguacuguuggucccagcuuucacuggguacuuugucuuuuaccgagugcuuuguugugguuucuaggacauuuucaagguuaacuaagugcuuugccauuuaccaagauaucucuauucacagagcacuuuauaucuuagcaaguguugcccauucaccaaagaugcccaaguuuuuaccauugucauuugcuagggaugucccagcucacacaauacuuuacaguuccaccacccuuccuggaggacuuuugagucacaaaaugcuuuccaguuuagcccaucguuucugugcagccacucuucccucugugcccaccaaucccuggguguucccaccucaauaaugugaucccuuccguccuugccaugcagcgcuuccacugcgcagaugucaagucccccaaaaaucucugagcacgugucuacccacaacuuguaccugccaagacaaggagcaggauagcuugucauugcucugcucagaugauucuguuccauccuuacucccacuccucaauuaugugucucaccugucagacauggcaaucugcucaagcauagcagaaccuguauuggucuuccaguuacccgacacugauguccuccuaguggggggggggggagaggcuuagugggacaugagaugcacgagguagccccuccacacacacacaaggcccgccucucuacucacauguaggccuuguaguucugcccaaucuucuggacacgcacaucauauuuagcaucaaugaagggcucagcaguggcauaugucuuagucagugccacaacacuugcaauauccuggaagucauguugguugucuaccuugaccuguggguguaggcauggaugaaggcaggagugagggcugaauguaucuggaggaauguguagacaaauacgaaguagauaugccaaggcacccaagcacacauaauuauggguaaccuauuucauacaugugcacacaaacauacaauugcuuguauacaacucugaauauguuaaagaccacuuuuuugcagugcuggggaccaaacagggauguucacauguuacacaagcacucuaccacuguacuacauccucaucucaaauuauccauuuuaaacaggggaguagaauaaaauguggaauuacauuucaauagagcuauuauauauauaauauauaaaaugcuugguacacuagcaugguagcaggacauauaaaauuggcugguugcaugagaaauauaugggcugaaaaaucagcgaaauaugaaaauacaaaagccaauuagaugaagacaucccagaaugcaucaucaaacagaauuauuguuauguguugaguacacagaugcacaucuaacuacuuacagugccaagaacauguacuauacaaacauguacauaugaccuacuagaacuuaccuugcccaucccagaaugugcguggcccaucuucacaaccacaggguauguugugcugcugagcuggugaaaaugaaggcaaaagaggcauggucagagcuguucugcuggucuccaagagcuggugacccauagagugugagccacaccgguugacauuuuuuuccccagaaaaagguuagucaaagacaggcagaacagcagucaauuguuucacagcagcuuugaguucagaacugaaugcaccuccuugccugcugguccacucucuaaaccuuaggcuuuccauaucugauuucccaugcagaguccuuagaugaggaugagggaacuuuccagaauagagaaaguuuguuuauuuauuucauauauucagacacaccagaagagggcaucagaucccauuacagauggcugugagccacaaugugggaauugaacucaggaucucugaaagagcaguuauuguucuuaaccacugagccaucucuccagccugagaaaguuuguuuuuguaugaguuaguguguguaagacggugugguaguuagcaugcagcaaugaggccuucagccacaccuuacauauaagcuucaucuuuauguacacacacaccuuuagaauucuauucaaagccagagguguccacaucuauuaagaacuccacauccacugagaaagacaaccagaaacuuaaaucacauuuaguucuagggcuucacagagauccagugagucaggucauguggucauagcaugggacagcagccaauacuccuaagcaacguguauuccacacuuuuuuuuaauuaaagauuuauuuauuuauuauauguaaguacacuguagcuguccucagauacuccagaagagggcaucagauuucguuauggaugguugugagccaccaugugguugcugggauuugaacucgggaccuucggaagagcagucggcgcucuuaaccacugagccaucucgccagcccccccccccauauuccacacucuuaagacucuuagaguuaacacaugagcuaccuugccuugcucucaccuacauaaaagaaggacauauaacagaacuacuuaugcacuauagaagcacacacuacucucgaggcaaacaauaaauggacauaugcagcaaucacuggcaugcccacagcaaacagaaggauuaauacaacauacagaaggagaaugcauuucuaggcauucauauaaccaaaucgcuguaacuccgaccucaucacauuucuggguccaugaaaaguauaucuagacauucaacauguuuuuuuuccauaucuguaauacaagcauacagaaaaucagacacacagauaauacauauucaggacacauauucaggcaaauauguguuaggcaaagauguguuaagucucccugugucccaggcuaggcaaagaguaugaggacucuagccccaccauaccccaugugcaaauguagggccccugccuccuacugacaggguagagauagcauucuuaggcucugggucaguggcaguucccaacaggcacaggaagccccauagucuaagggugacugauugaccuucaggucucucccucccucuacaaucuccuuccucauuucccaaaugagugacaucauaggaaggcagagaacugagugguaugauguugguaagggugucauccagggagcaggccaaggaaacaaugccaagauguguguguauagggagaaacuuucuacuugggcaucuacucaucacacagagaagcuugagacaggcauaguuacauuggcaaccuuccacucucagaagcaacacacucaggcacacaccuggcucucaggaagggacauggagcaugccuugcaagggacauaagccaccccuugcggcacagauacaugacagagcuguucauauacaagaauaucuauucccaucugcugagcauuguggaucauuuucccaaacuuacuuugcuuccucuguucaugagcuugaacacugugggugcaucuaagugugugccugccauaugugcauacaggggccuugggacuuccuggggagcuuuagccugcuaucuuggccuuuauucuucccaaggccauuaaaaaaucccagguagguacugucuuacugggccucaguuuccagagggaaauaaucaagcucucgcacuuaauacucuggguaucaucagguauuuacacaugacagcagaucacuaugggaaccucacaccuauccaguuuagcagauagucacaggcuaaacaucccucuguaauguccaccccacuccauuucaaaccuguacaauaaucugaauccuuaauguaaacagcuggcaaaacugugcugacucagguuucauaguuaaagagcugucgucagaagcuggcucauagaagaggcgagacaggacuuucccugucuuuacgucuccucaguccugccgccuaguuacucagcccccugucucacuuucuccucacuuucacaaucagaugguugaaaauuuuggucuccuucccuuucuccuuuucucuguaccuccucccaccaccacaguaauuucuucaccaucuuuccuggacaggccauuugauuccuuucugucucuguuuucuuacuaaauaguaaaaauaugaaucauaccucacagauauguugggaagaauaagucaauuauuucagagaaaagaaaaucuuaguauacacauauaguaaaccugaaucuucaaagaguugguuacuauuauuguuguuauugauuuaauaccucuucauuaaauaacauuaaggaacaaggaggacaauggcaaacaaacaaacaaaauuucugagcuggcaauauggcccaucagauaaaggugcuugcugccuccaugccugauaaccugaguuugagcccuagaacccacagggaaggagaggauuggccccugcaaguuguccuuuaagcaaugcaagcaugucauggcacaaacacacacacacacacacacacacacacacacacacacacacacacacacacacacacacacaguguaaaaaaaaaccuuuuaaaacaguguauuguacauaguacccuguugagugcuggcaggagguuuuuguguccugugguuucugaaccaauuuaccuaaguuaauaaaauugaauuagcuaaaguaaauuuacauaauaaccuuaguaaugauguacaguaagcauucaguaaguagcugugaucaccacuaccauauucucucugucucucucucuaucucugucacagguucucacuauguaucgcuggcuguccuggaacucacuguauagacuauguacccucuaauucucuggaucagcuugccugcugcgauuacaaccauugucauuauuauuggucuuuccucccuauauuaauugaagaugcuaaucaguccauagaacccuuccacaggaccccagggaauacuccugcaucaucaggaagcuggugggcagcaguugccucaucccauccccacaaggggugugggcugguuggugggggaaggggcagggcaggauggaguagggaugguuuuucuacugacucacuaacuucuuuuaccaucagucaccaccaccaccaccacccaugcucaccacaccauucccugcuugucaagauuguguccugccugaguuaggacuccagggucaggaagccuagguuuaaaucccuguuuuguccugugacacuaacaaagaucuuuacuucaguuauuugccuguuuggucuuguuucuguuuaagacagggucucuuguagcugaugauaucuucaaauagccucaccggugugugcagccacagcaagguuugggguaccuaggcucugucugcaagcagccucgguucccucccaguucugccagacucaacugcuaucuuggauaagucauagacuuauccaguguaucaauuuccccacuauguauuugugccucuucucccaugucaugucccucaacugcuuuucuaguuugucacccucugacaccccucaccagaauuucagauccacaggaaugccuuucuugugagauuguuacauaguagaugaaaggcgugagaaagaaguuauuggcuucagccacaggaaguuuggggaauaugggaaaccugagaggcacaaagcuuuaggcgcucucucuucugcccuucaaggccgccaggaaggacugugcaugacguggagcugggggaagggggcgcagugggcuggcuggcagaggagggaguaucuuuggguuuauccuggggcccgccccuaggcuuugacuccagcgguggguggaugaguaaugcguccaggaagccuggaggcagugauuuccccgccaacuccgcccuucgcauggacauuuauucuccacugugcagccccugccgccaucaucgcagaucggggcuccuagagacacaccagagguaagugggagccggguguccuggcagaacuggggcuugccuggagccuguguuggugcggcucaugcagcccuugccagacuaacugcucacguggcuugcagguaucaggaucccuaguuagcuaaagaggaauauaacgggagagggccuggaaugaucgucccaagcuggacucuccagacuccuucaugccuuugcuaagugcuccaaacccacaagccuuuaauaccuugaagacuucccaacuugccugucccucaauccuuaugguuccugguaacuccccuguucucuuugccaugucugguucauggaacuucaacaguucuucugccuacaaauuccucaagcauuaccauugucguaaaccuccaaauuccccaagacccuuaacccccauuuucuccagcucccuaaaaccccaaaccuguucuaaccccccaauaucucugaaauccucagcccauuauauuuuaauagcccuaauuccucauuauauuucuccaguuucccaaacuccaaauucaucacuacacaaaugucagauuuucccaauucuguuaaauucucaacguucuccgcucccuuauucaccaacugccacaacuccauucucuaaccuaaagaggucccaaaucucccuaggaccaauggccauguaagccguuggucugggaaccuauuaacaccuacucuuuaccagcagauaccaugauggcccccuuugcaucucuggcaucuggcauccucuuguugcuaucacugauagcuuccaguaaggccuguagcugugccccaccccacccacagacagccuucugcaacucggaccugggugagucuggcccccuuucugucccucuuaauccaauaggguucauuauggcaguugucucuaggacaguucuacuuacccuuccauacaucugcuuuugccacacugacauccuugggccuaagccuaccuuugugcuggcugcucccaguacuauguacaugcuuuucuguaguuaucuacauggguggcugccuuaaaagucaucuuacugaggugcuugccuacuuuuauuuaauuuuaaauuuaaugccagccacauaguacuccugaaccuuuguuacauaugcuguuaauggcacuucuuaggacacaggcaggcagacuucauucaggaccaugacaauuagaauuugccaagagaugggggugguggggggagauagauuaacucucaacauuacaugggcaaauggaacucaauggccaaggaacaguuugggaguuggugaaugggaaaccauugagaagaaauaucaaaggcaagaggauucaggcuaaauccauuaaaaagauuauuuuuauuuauguguauguuuguguguauuccaugugugguguguaggugccuguggguccucaaggcaucaaauccccuggagcuggaguuaugaaugguugugagcuacccuauguggauucugggaacuaaacuugggaccucaaagagcagcaagugcucuuaaccauuaagucaucucucuagccuaucagcuuacuuuuuguuuuugagacuaggucucacuauauaacccaggcuggccuugaaccccugauccuucccacucagccauccaagugcugagauugcaggucugugccaucacacccaguuuaggucucuugaaaacuggcuaguauaaucaucugguggccccaucacauacugaggagaaucagauaaggguggguguuuucacuaaccuaauuuaggauacuucgcuacaaguggauuuuaaagagaaacuguacuaaugagcuuggaagaagguuaaugagccugaguaaauuguggucaagcaaagcaucugucaaccccuucccuauucuaauuuucuaacccacuuaauagccuguaacaauccacauaccuuuuuuucuuuuuccccuugguaccggggauugaaccuaggauccaggcaaauacugcacaauugagcuacaaacccaacccuuuuuuuggugaauuuuuuauuuuaaacagguucucacuaaauugucuagacuagucuugaacucagaguaaagugauccuccaucaggcucugacagagcuaggguuacaggccugugccaccaugccuggcuacuuaauguuagucugucuccuccuggcuugaaugugagcuccauaaggaaauggauuccuguauuugggucacugucccuaacacccugaacaguggcuggcaccaggcacuccaaaauauuuguugaguaagccaauaaauggauauaugaaaagggcuuaaaacagugccuaaaagaauagacaauauguagaugaaucaacugauguggaagccauuugaauuaugcuguauauaugcuuugcugcuauggguucaugcugcuugcccauuugauuccccauuuccccuuccuuuccucuagucauaagggcuaaauucauggguuccccagaaaucaacgagaccaccuuauaccagcguuauaagaucaagaugacuaagguauuuucccuucccucccucccuccauggcuguaccuaaccuauuccuucuccucaaaauagaagcaucuaaccuuucguugguguggauguuuucuguaaacuugugauuuagauauauugccaucaggaaagagaguggagugggaggauuaugucaguaaaagauguacuuuuugucacucaugggcagaugcuaaaaggauucaaggcugugggaaaugccgcagauauccgguacgccuacaccccagucauggaaagccucuguggauaugcccacaagucccagaaccgcagugaagaguuucucaucacgggugaggccccgccccuucaccuugggccacaucccuaaugcuuucaggcaacugggaggaguuaggcucuaaaggaaaagggccugguugaaaugggagugggagggucuguaaccuaaugcuaauuaggugaccacuccgaccccacccagccaauccaaaagccuauugguuucuugcuucucuuacaggccgccuaaggaacggaaauuugcacaucagugccugcagcuucuugguucccuggcguacucugagcccugcucagcaaagagcuuucucaaagaccuauagugcuggcuguggggugugcacaguaagugccuggacccaguuuuccuccaggagauaagucuuggaaugguuucuuuuucccucuggcuauuguaugcaguuguaguugcugcccaaacccaaucacuaucuuugauuucucuugccauugcuccaccccugggccuguucuuuuggaaauuuugguuguuuuguuaucucuggacugccuguucccugaaccuucgcugucugucuaacuuuccuuugugacuauucugagacaccacucucuguuucugaccuccccgauuggauuuugcuuccccaggcauaagcugcaagaauucaaaggacuauucuccaaauccacagggacacacgccagccaucugacuauuucaaaacuuuuuccugguggcaccaaacauccucugaccagcccccuccccagucauuguccaagagccuugcugccuuuccuuuuaaaaaaagauuuauuuauuuuauguauaugaguacacuguagcugucuucagacacaucagaagagggcauuggaucccauuacaaaugguugugagccaccaugucauugcuggggaacugaauucaggaccucuggaagagcagucagugcucuuaaccacugagccaucucuccagcccucccugcugccuuuucuuaugcuugcucuuccugcaugccaacuguuccccauacuaucacuucucugcccugugggacgguucuucaggaggccugucugagugacuucaagugacaguucucuaacagcaauuccagaacacuggcuuucuguuccucaaaugggagaagcuguucuuggguuuaagcacaaguagggcaacacaaacccuuccuagcagcucccugguguguguguguggggggggggagggcgggagagagagagagagacugagacucuauacaagggagagaacaaacagagggaaagagaaauccucagagaugggccuuuuuccccucuucuagguguuucccuguuuaucuaucccuugcaaacuggagagugacacucacuguuuguggacggaucagguccucgugggcucugaggacuaccagagccgucacuuugcuugccugccacggaauccaggcuugugcaccuggagaucccuuggggcccgaugaccugaagccuucccccaggaaaaacugaagccugaacacugucuacuuuuccuccaucuuucuuucucuuagauggugaaauaaagaacuaucagacagcagcaauauuucuguauaguguuugggaacaagcuuaagauacugauaaccugcugggagcuuccagaaaccaaugaacaaggaaaagaugcaaaauguugaguuuggaggcuagaaaugaagcuuagugguagagcacaugccugguauguagaaaacccuagguucaaucucuagcggaaaaauaaagcgggggugggguggggugggaguggggaauaaaggccagccuagucuacagagcaaguuugugaaguucaggacagccaggacuacacagagaaccccuguauuggaaaacaaaacaaaacaaaacaaaacaaaacaaaacaaaacaaaaaagguguugaguuuuuauacuuuacagaaauuuugauauauugguaauaaucucaacauugggauuagcacugagaaccugcaaaacagaaaugaucauuacuuugcauuaucaacuaaaauucauuuaauauucccucuacucaaaacuuagacaucuuaguacaguaauuuuuuuguuuccuuuuauuucucuguauaugcugguguguauuagaaaagguuuauacaugccauggcaggcaaauuauagccuugggugucugaccuccgcuuuacuuugacacgggucucauuguucaccccauacacugggcuagcuuuccugguauucuuuuuucuccuccccccaguuuacauaugaaugcaagucagcuaccgcugcucagcuugauguagauucagugccagguugucauacuugcaugacaagugcuuuguccauuaagacauuuccccagcucuauuuugccacccacccccauuuuaagacaggcugaccucaaauuuacugcaauccuccugccucuguuuuuucauuccugggauuauaauagacauguuccaccagaucaugccuacuauagaaaguucuaauucccacucgcccaagcuucucuaguuaaugaauuaccccacagaugaaaauuccucuauucacagauauuacccauugacaaauuuguugagaaauacccucauauuaacugguaaacaucuuuccuugccucaaggguuguccugguagucuaaugaagauguuucauccaagccuuuguucuuccuaaaucugacuuaagcgagaggaaggggaccuagaaaugucaccuagccaggagcucuggaaaaugggauacagcugaccuuauauccagaaguaugcuggagcaaaugagugaugcugaaaacccucugguuuugauccucuuguuccugucauucugaccgacugugcagggaacacucacugugcacagacaugggguuacgacuuaauauguuugcuuucuucuuuuccuuugugguacuagggauugaaccuaggcuuuauaugugcuaggcaagcagcacgcccuauuauauauaguaggccauauccucuaggcccacguacgguugaaaauuaggaccaugcaggucucaaaaugagacccucaaauuucuugaucauuuuucucuguaaaauuugaaugggaaaucugacaagcaucgcuccagaacucuaggauuuccagcuccuacagauggauccaggucuguccaaccucuuccagcccugggguccuaacccauacuauaaagauucugaccugggaaccagaaauucauauugaggcacucaagagagcaccgaaguauuguguugacgugaauuugcuugauuaaaaaaaaaauaacuccaaugugucuccuuuaguaaacaaaaggauccucaauucccucccaucagacuacccagugcuagaacagguaugcaugguaucuuugccuguaauccuagcacuuggaaggcuuaggcagagagaucacaaguuuaaagcuagcuugacuuacaugcagugauccuuucucaaacacacacacacacacacacacagagagagagacacagccggggugagggagagagagagagagagagaaaacaaagaaaaagaauuaacacgucuuggguuggggggggugugguucauugaucuaacuuauaaaacaaacaaaaaaaaacccauggaaguacagacuucuguaggauauucuaggucagcacauugugguccccagggucucuguaguuuugccuuauaguuuuuuacauugcuaggaggcuuaugcaggcccaaguuauacucuauauaucaggaugagcagaauuauuaaagacaguaucuccuauauugcucagacuagccugaaacuuguuauguagccgaagcuggcuuugaauucaugauccuccugccucagccuccuuaaccuuagggauacaggcagguaucacuaugacagacagauuuuuuuuuuuuaauuagauacuuuuucuuucuuucuuucuuucuuucuuuuuuuuuuuuuuuugguuuuucgagacaggguuucucuguauagcccuggcuguccuggagcucacuuuguagaccaggcuagccucgaacucagaaaucugccugccuggugcugggauuaaaggcaugcaccaccacaccuggcuagauacuuucuuuauuuacauuucaaauguuauccccuuuccuaguuuccccucugaaaauccccuaccaccuccccacucccccugcuccccaacccacccacucccauuccccuauacuggggcauagagccuucacaggaccaagggccucuccucuuauugaucgaguaggccauccucuccuacauauauagcuaaaaccacaaguuccaccauguguuuucuuugauuggugguuuaguuccaaggagcucuggggguacugguuaguucauauugauguuccuccuauggggcuucagaccccuggguacuuacuuuggcuccuucauuggggacccugugcuccauccaauggaugacugugagcauccacuucuguauuugccaggcacugguagagccucacaggagacagcuauaccaggcucugacaggcagauuuugaguacaugguacauauucacuugagaagggaaugcuugcugcagcaacaaugucugcauaaacacugugcugauggguaggacugccagacagaggucuagguccuguuuuggccuugggaacuuuguugacauugcuucaggugcuuaaaagauuuuggcagcuucugaccagucaccaaacucuaguacuagcucccugaacaccaaugagauuccugacuucagucguguuccuuagaacccucaacuauuuuagcucuuggacggaagcagaagguaguagggggaggauaaagauacugagagccauucuucuaccaaccugucaagcaccuguauccagaccuacuauguaggagaaaaugcaagaaugaccugauggucagccaccuggcauaccacgcuguuucuaaguaagaagcauggugguacauuacauuccugaauuuucucagaaguccgaucauugaauucugaacuacuguuaguagccaguagcuggccuguugauaugucuguacucuccacaucuccuuuaauaugcuucuuugguauagagauccuggugguaugagugcucauuguccaaucugaggcaauguucuaacuaaucauagucuauaggcuucuacuauauaagcaguuucucaaugcaauaaagcagaaguuguucccugaaaccaucuccagaaugguucaucuccaugaccagcacacaggcauugcagauuuguugggggacacccugguaaugauugcaauggcaccagugcagcauggacagggcugacaagcacuccagggaacacagaguucagaagaguauauaaggucauuucccccagagaccuggcacaagcucuuggcaguauuuauaguucugggagucucuaucuccuaucacuuuccuagaaaaaccauuuaaaagccaguguauucauuugugaccuucuuugagaaauuuguaucacagcugagauuaagcgcauguguagggucacagcucugcuaauccaguccaguugaugaccuggggaauuugucccuuuccugagccucaguccuucucuuucaaaacugggaauuauaguccuuacccagacccuuuagauuaguaaggguugacagguaaagugucauugcccugugcugagugagugaaugagguucugaguaaaauguaugcugcugacauagguaugaauugucggggacuccagugucucagcccuaugggaguagcaaaaccuucccggagugaugcucagagggauggcaaagccuuccucaggagucugagugcaaaugcugacagugugugcagaaaauguucacuguagcucucucuccccauguuuauggccugaagacuaucccuguaaagacgaauccuaucaagauuagcuaaacuugccuucuugauuuaacuguauaccauaaacacuaucuccuuguucagcugucugcaauaagcccaucuuucuguccgacgacaucuaaugaacaugcugagauggggguagagggaagagggcugugcuuuugccaucagagagccugaaccauccaaucaguuuuucuguguaugugugucuguguuucuguauguuuuccuuuuuucuuuuccucaagccccauuuacaccaugucccugaggccugcaagaguaauuuucucccuuuuuuuccaguuuauaauuuugcgugcauguguaguuuugcuugcaugugugucugugcccaaggaaucagcauuagaucaccugggacuggacuucuggcuaguugugaauugcuacguggaugcugggaauugaacuuagguccucuggcagaaccucucaggaaggagaugugucacugcacuugccuaacagguaccaggccugaguuaggcccccagccugagcccuguagaaaaagauaucauaaaaauuuuauaucaauaacuaaauauauaauauuaauaacugugaccuaauuucuacacaggcauaaacccugaaguuggaucaucuacauucuaaucuugcuccuugcauguauucuuggggaaaucagauugcuaguuugugcuucauuuucugcaucuacaaaaugggcauaaaaacaugccuaauucauuagaacaauggcuguaugaaugaaauaacaugcauagugcauaaaguagugcuaggaauguagugcuuaaaguagucacaguaaauagaauuggauguacaacuucaguagugauaauuaucaauaaugauuauuauaauacuauacauuguguuugauauuagaaauaacaaacuauugaaaacgauguauauauaguauuaguaacaauaauuuaaugcacccuggaauuaaguucagcuuaauucacgauugugacaaucucccucagaauguaacagauacuuaauauguuccuuuguauuauggugcuuauauguugcuugcuugcuugcuugauuucuuucuuucuuucuuucuuucuuucuuucuuucuuucuuucuuucuuucuuucuuucuuucuuucuuucuuuuuuugauuuuuugagacaggguuucucuguguggccuuggcuguccuggaacucacucuguagaccaggcuggccucgaauucagaaauccgccugccucugucuccugagugcugggauuaaaggcgugcgccaccaugccuggcuguauauguugcuuucuauugugcaaaucugugaaucucuccuuugacaaguaucaacauucucaaagacuucugaggaacaucaaccucacaaaugagguacuguuacucacugcgcaauccucauuguggacaaaucccuacuuugaaaaaucucuacucuugccaaggcuacagaagcuaaaacucgaagcccuuguaaauucuuccuuugauuaggcccuuuuccucaaggaaauaaucugcugucagaaauaccucacuaagaaauaauauuuuauuacuauuucauaaauaccuccccauuaguuaaccuauagagauauaacaaacaacucuauuuacaaaugcucagcagcaaucuacugccugcugauggaccucagccacaaguaucuuucuuaauaauuacucaccuguuggcaccucccuugcugacaaauaucucuuuaugacuaucugucuaugaugcaaucuuuguuggcaaauuuucccacuaacaaauugugaccuacuagcauauuucuccauuugaguuaggaaugauaagccuccccagccauauuuuuccaaguccccucaauaagcucucaaucuugucacugacaaauaccacuacaaauaauuauuucauuaauaauccugauaaaaauccuucuauucauaaauccuuaucuauccauauauacuuucuauugauugacccccauugauacauuucugaucuuagguauguccauauggaaaauaccccugcuagaacauuucccaacauauacccccauaugguaaaccauuucuccccauuauccagugacagauggagaagucaauuuguguuuguguauguuuuacuggggauucaacgcagggccuagaauauucuuggcaaguauucuauacugaguuacaucacucgcccagagaaauuuauuuauauaaagcacagucuuuccacuuuuuauuaauagucaagcuccacaaagaaaaugauuacagcacaaauucugccaggcaguggugccgcauaccuuuaaucccagcccuugggaggcagaggcaggcgauuucugaguuugaggccagccuggucuacagagugaguuccaggacagccagggguacacagagaaacccugucuugaaaaaacaaaaaacccaaacaaacaaacaaacaacagcacaaauucucucuggagaagucccuuccuccaucuccccucuucuucucugagagaguggaggcacccuggcacauuaagucucugcaggguuaggugcuucuucucccacugaggccagacaagacagcugaguuaaggggauggcuagaaacaaccuagaugucccucaagugaagaauggauaaagcaaaauauggcacaucuacacaauggaguacuauuuagcuauuaaaaacaaagaccucugacucuucaucuuucuuuuaucuccaaaguggugggcuuauagguaugcaccgccacauccacuuuaugucuugacaugguugcuuuuuuuuuuuuuuuuuuuaauugagacagggucucaugcagcccaggcuugccuggaacuccugauccucuugccuccacuucccaagugcuggcaucuaauucaugcagcacacaccuggaguuugucuuuguuuaaaggagauugagaguuuagaaggguuaggaagauggcucagaagcuaagagcacuuugcuguacaauccugaagaccggagugcugaucccagcacccacauaacaagccaggcaugauccugcacauaccuguaagcccagcaccaaugaagcagagacuggaggauugcuggggcuugcugacugccagccuagcugaaaagaggaucuccaaguuuucuuccagaaagacccuucaucaaaggaauaaacuguagacuacuagaggaacauauuuaaugcucuucucuggccuccaugugcauccucuaaaguguucauaugucauacacacacuugaauauauacuuucaagaaaaauacuuuuaaagaaagacuuacagucaguuaaaggugucacaugccuguaauucuacaaguuaagagauugaagcagggggcuggaaaaaugguucagugaugaagagcauauacuuucaaagcaccuggguuugacaggggcuuacaaccaccucuaauuccaguuccaggaauaucuaacuccucuagcuucugcaggcaccuacacuaauauacacauacccugaccaaaccacacaauuuaaaauaauaaaaugugaaauuaaaaaaaagagacugggaguucaggcagugguggcgaacaccuuuaaucccacuuaaagcacuuggagaggcagaggcaggcaauuucugaguucaaggccagccuggccuacagaguguguuucaggacagccaggacuauacagcuauacagagaaacccugucucgaaaaacaaaaacaaacaaacaaagacuggggaaagaggauuuguacuuucaggugagucuggacuauguggugagaccuugucucaaaaaauaaaaagcaacgagagggguguagcucaacgguaguagauaacuugccuaguacaagccccugagacugauacccaguauuacacaaaaagaaaggaaggaaagaagaaugaaaaagaaaaaaguaguauaaaaauaagaaagaagauugguugagagucauuaagauguacuuaaagcuccagauacauucucuacaaacuagcuccugguuccaguggaagcugcccugguccccugagaaaguagaaugaacuauuucauccuggcagcaaugucuaggcugccccucccagauguggacaacuuaccuuccaucgagcuugugcauccugaugaguucuuuguggagcucucuaucaacuucugauggagguggaaccccuucucaagugucuauuggcucccuaccucaauauaggagccccucucugacaccagaugcucccaccugucuuccaaacacucagcccuaggcuccugccaugaauccugccuuccuuuaaaaauuaauuucucauuguaguucaauugaucugcucacauucaggagaccguauccucaggccucucucagaacaaagucuccauuucaacccuacuucugucaccaacacauguuacuggguuuuuaauuuuagccugcaauagaaaaauuuguccccaacccauaguggauagaauuuuuugacuuggguaucaugcauaguagccaaggcauaccagggcaugcuuuuacugaucagugggguauggcuucucuccacaaucaucuguggcugacaagaagcauuccacaaggcucagagcugaguccuuggaaaggguucagggguagcauauaaaaggccuucuugaauacugauaagaaaagauaccauucgucccugaauggcaugccugcagccaucuauuuccucucuggguguucuaguuugucccuuguuauuucugcucccuggcagucuuuguucuuccucauuugcuccuucuugucucugcucccuaucccuguucccuacucucagccaucucuuccuuguucacagucccuacucucaacccccugcugugacccuuuauucacccccccacccaccccccacacucuacuacacccuauguccucuuccuugucuauguuccccuauuccuguuucccuacuccuggccaucuguuccuuauucccagcacuugggagacagaagcagacagaucucuguauguucaagaccagucugcucuacacaguuagacacuguuuuaaaauaaaauagcaaaaaccacugaccacccaaaagaaucucccacccaucaacacaccaccucuguccuuccuuuaauuccucacucacucuugucuucuuccccaaccccaaauuaccacauuccugacacuguuuauucuuaccucaaaguauacuuucuuuauggaaagcaaggauccuggacucagggaagggacuagagcuagagaggucuugggauuggacaugagcucucaguaacuauuuguugauaugagacagcaaaagaaaggaauucccuauuuucacaacaaccaccucaaaucugugugacaaaauugacaugaccaaaucacaaggcuuagagaguggaggugaagaaacauccaauuacgcuuaugggaaucuuccucugccuaacucuacauuccacuuuugaccacuuagguacagccgagcuagacagucuucagaggauuccuaccaucccgcaucugccuggaaacaggugggacauugaguuuagaguagcaugggcauccacaccaaagcuuccugaugcaguauguacagugaauaucuaggccuagcuuuugauccuucaugguucacaaugaggugguggacaaaagaggaaaagaccugguaagcugugcuaugggggagucuaaugccucugccacacugcacuuaaacuuuuaacuuugucuguuugccaggcacagaaauccugcucucugugcaugacaaaauaaccucugcacaaggagccaggaaguauggcuguccaagcagauaucagaaaugaaugaggaaauauuguuaagaugcugugaugccagguguggugggauacacuuguuauccuagcagguuggaagucaaggcagaaggaucaagaguucaaggccaaccucugacauguaaggaguugucuuucuuuuucccuuugguuuuuaaaaaagggucucucuccauagcccugguuguucugaaacacaauauguaggccagaguggucuuaaacucagagagcaccuucugcuuuugccuccugaguucuggaauuaaagauuuguaccaccaugcccagcuauauaaggaguuugaggucagccuggauaacaugagacccugucucauagaauaaauaaacaaacaaaagaacaaacauuugagacugauauaacuacagagaaagugauaaggagaacagacagagucaagaccuucuucacauauaugugaaauguuaauuuaugaaagggguggcauacuaguaggggaaaacuaguuauuugaagguuaagagugaacugauaccuaccuaccugcuaccauuuggauacagcuuguguguccccagagguuugugugucggaagcuugguccccagugugguugugcugaugggauggaacuuuuaagaugugaggguccaauggaaggugguuaggcccuuggggauacagugcuuggaaggcauuaauguaguccucaugggaccuugguaaguucccuagauagguuguuauaaaaaggaugagccuagucacugaaucuccuggcuuccuguuuugucaugugaucauucccucaagcacgcacuuccagaacaaacuacaguacugcuacacagugcauaucaaaaucuauuucagaugaaugaagcguaucaaugcaaaauauaauguacuauaaagcaccucuuuucucuggucauugucauuguuaucauaagcuacauuuucauauguauauagaucugguccauugccuuuuauauuuauuguuguuguucugcauguuuauuuuauuuuauuuuuguuuuguuuuuucaagccaggguuucucuguguagcccuggcuguucuggaacucacucuguagaccaggcuggccuugaagucagaaauccaccugccucugccucccaagggauuauuaaaggcgugcaccaccacugccuggcugaauuuuuuauuagauauuuuauuuauuuacauuucaaauauuauccccuuuccuaguuuccccuccaaaaauccccuauccccucucccucccccugcucaccaacccacccacucacccacccacuccuacuuucuggcccuggcauuccccuacacugggucaucaagucuucacaggaccaagggccucuccuuccauugaugacugacuaggccauccucugcuacauaugcagcuggagccaugugucccacuauguguuuucuuugauuggugguuuagucuuagggagcucugagcguuacugguuaguucauaauguuguuccuccuaugggcugcaaaccccuucagcuccuuggauaauuucucuagcuccuucauuggggacccugugcuccgucuaauggauggcugugagcauucacuucuguauuugucaggcacuggcagagccucucaggagacagcuauaucaggcuccuguuagcaagcucuucuuggcaucuggguuuggugacuguauauaggauggaucccuagguggggcagugauguguguggggagugauucacaugaaccacagcgugucagucuguuuguucugugaagcauuauacgacuuaaauaauaaaagucuuaugaugcguuugguagcagagguauuagauucccuguaaguggguagagucaguaucuccucugaacuugucuuugucagagcucucuuggucauucuuuuguguuuacucuccaauguguacuucuaucaacucaucuaguucuagauaaaacuuuuuagguauuuaaaauauuuuuguuguuauugugaauacuguuuucuaauauaucuuuuauuuuuaauuguauaucagaaaacgaaugauuuucaucauacauucugcucuguugcuacuacauuaucauacugcccaguuuagcauuauaauugguucuuuuuggguuuucuagguaugccaucauaucaucuacacagauacuuuauuauuuuggggaucacaucuggguuguuuuuguugcuguuguuguuguuguuuugagccaggguuucuuuguguagcccuggcuguccuguaacucacucuguagaccaggcuagccucgaacucagaaauccaccugccucugccucccaagugcugggauuaaaggugugcgccaccacugccaugcaaacuugggguuucauacaugcuaggcaaguacucugcuacuaagauaaauuccuggaccaaaaaaagauugucaaauguccucuuacucauuuuuauggcuauaguuguuuuguauuacaucuaaauacauuaguucaacauuucuauaaaaguuucaaaaagaagcagagacagugaacaccuuugccuugcuccugauauuacugaauacaccuuuaguguugucuauuacggugauaaucgcagaacugagcuaugcagauuuuaucaugauaaagcacugccaauuaauuucuauuuuaaaugcuuuuauuaagauaaacugcuaaaaguuuccuaaguaacuauggaaauaacagaauuuucuccuaaaauuuaugaacauacugcgugauuguacuacauuaauuuaaaugaaauauucuuguguucuuagaaacucucuugaucuuccuucuuucuaucuuuuguuguuguuuuguuuguagagacagaguuucacucuauagcccaaguuguccuaauacucacuauauagacaaggcuuaucuggaacuuaagauaauccuuuagaagcaccauaagugcucuucuuaauuuuauuauuauuauuauuauuauuauuauuauuauuauuauugcaaaguggcaaagaagcaauaaagcaaacagauaaaacaaggccaaaauacaguguacagugucaagacugauagcaggucacauggauaaggguacugaagagucuaaaaauuaauauuuucuuguuauuuuuuauauuuuaauuuauuaguuaaaauucaagauuuuugcauugauauucauguguaaaauuguauauuguuuaauuuugugcuaucaauuuuauaaaugcuuuagaaaaauaaugggcaggguuuuuuacucuuuauuauuuggaguaaauguaaaaaguuaaaauaaaaucagcauauuuuuaaaaacuaaacauuuaauaagauuuuucgguuagacuuacuccaagauauuuuauauuauuuguggcuauugugaagggaguuguuucccuaauuucuuuuucagccuguuuauccuuuguauaaaggaaggcuaugauuuauuugaguuuauuuuguauccagccacuuugcugaaguuguguaucagcuggagaaguuuucugguaggauuuuuggugucacuuauguauacuaucauaucaucugcaaauaguaauacccuuauuucuucuuuaccaauuuguaucuauuugaucucuuuuuguugucuuauuauucuagcuaacacuucuaguacuauauugaauagauauggggagagugaguauccuuguguugucccugauuucagugggauugcuucaaguaugucuccauuuaauuugauauugacuguugguuuucaguaaauugcuuuuauuauguuuagguaugggccuugaauuccugaucucuccaauacuuuuaacaugaaggguguuguauuuugucgaaugcuuuuucugcaucuaaggaaaugaucaugugauuuuuuuucuuugaguuuguuuauauaguggauuacauuaguggauuuucguauauuaaaccaaccuuacaucccugggaugaagccuacuugacuguggugaaugauguuuuuuaaaaauguguucuugaauucaguuugcaagaauuuuauugaauauuuuugcaucgauauucauaagcgagauuggucugaaguucucuuuuuugguuagguccuugugugguuuagguaccagaguaauuguggcuuuauagaaugaguuaggcaguguuccuucuguuucuauuuuauggaauaguuugaggaaaauugguauuaggucuucuuuaaggucugguagaauucugcacuaaauccuucuggccuugggcuuuuuugguugagaggguuuuguuuuuuuguuuuuuguuuuuguuuuuugguguuuuuuuuuuguuuuguuuuguuuuuuugguuuuuuugguuuuuacaagacacgguuucucuguguuucccuggcuguccuggaacucacuuuguagaccaggcuggccucaaacucagaaaucugccugccucugccucccgagugcugggauuaaaggugugcaccaccacgcccggcucgugaaaacaauucuuaacaauaaaagaacagcugggggaaucaccauuccugaccucaagcuuuacuacagagcaauagugauaaaaacuguaugguauugguacagagacagacacguugaucaauguaauagaauugaagacgcagaaauaaaaccacacacuuacagccacuugaucuuugacaaagaugccaaaaauauacaauggaaaaaagaaagcaucuucaauaaauggugcugaucuaacuggaugucuuuauguagaagaaugaaaauagacccauauuugucaccuuguacaaaacucaaguccuaguagaucaaggaccucaacauaaaaccagauacacugaaucuaauagaagagaaaaugggaaagagccuugaacucauuggcacggggcgggggagggggggcggggauuuccuaaacagaacuccaaugguucaugcucucagaucaauuaauugauaaaugggaccucaugaaacuggaaaguuucuguaaggcaaaggacauagucaagaagacaaauugucaaccuacagauugggaaaaaaucuucacuaaccccacauccgauauagagggcuaauauccaaaauauauaaagaacucaagacguuaaucaccaaaaaaaccacacaacccaaucaaaaaaaugggguauagaucuaaaccaagaauucacaacugaagaaucucgaaugucugagaagcaccuaaagaaauguucaaaguccuuagugaucagagaaauacaaaucaaaacgacucugaggccaggcagugguggcacaugccuuuaaucccagcacuugggaggcagaggcagccagauuucugaguucgaggacagccugcucuauagagugaguuccaggacagccaggggaacacagagaaccccugucucaaaaacaaacaaacaaacaaaaaacaaaaaacaaaaaaaaaccaaaagauaaaaacaaaacaaaaaaccaaccccgagauuccauccuacaccaaucagaauggcuaagaucaaaaccucagguaacaacacauguuggagaggauguggagaaagaggaacacuccuccauugcuggugggauuaaaaacuaguacaaccauucuggaaaucaaucuggagguuucucagaaagauugaaauagaucuaccugaagacccagcuauaccauucuugggaauauacccaaaagaugccccuccauaccacaggggcacgugcuccaaaauguucauagcagccuuguuugugacagccagaagcuggaaaacaacccagaugucccacgacagaagaaugaauacagaaaaugugguucauuuacacaauggaauacuacucagcuauuaagaacgagaacaucggggcuggugagauggcucaguggguaagagcacccgacugcucuuccgaagguccggaguuuaaaucccagcaacaacaugguggcucacaaccauguaacgagaucugacucccucuucuggagugucugaagacagcuacaguguacuuacauauaauaaauaaauaaagcuuaacaagaaaaaagaacgagaacauuguaaguuuuucaggcaaauggauggaacuagaaaauaucauccugaguaagguaacucagccccaaaaggaugugcaugguauacacucacuaauaaguagauauuagcaaaaaaaaaaaaguacagaauacccaaaauacaguccauagaacucaaaaaggucaacaagcugaagugcccaagugaggaugccucagucccacuaaggagagagaagaaagcaaucacaaguggggagggagggagagaccugggaagaaaaguggauguggguggggggugggggaugggggaugggggcaggggaggagugguggggagagggaaaccugaucugguauugggugagggaaaaugacugaaguccugaggggcagcagaaagaaugcaaacaggcaacuucaggaaauaggagguugaguggacccuccagaaugcaccagagaccugggaggugaaagacucucaggacucaucaauuccuuagaugaaaugcuggacaguagggagagagaacuuauagagcccaccuccagcaggaagacagggcaucaagugagggaugggguugccaucccacagucacaucucugacacauaauuguuccugucugauagaauuacaggagaggagccugaggaaacgaagguccagugacaggccuaaagugggauccagcucaaggucccaaggucugacacuauuacugaggcuauggaaugcucacaaaaagggaccuaucaugacugccuucugaaagacccaacaaacagcugaaagagucagaugcugauauuugcacccaggcaauggacagaagccccaaauuuacucucuuuacagaaagaugagagguucaagucauccuuugcuacauaacaaguacauagcaugagccuauuuugaaaaauaguuaagaaguaauuucaucuuaaccacuaauuuuucuauggcucuaucuccccacuccaagcuuguaaagagaguaaauuugaaauggcuacuagauuuugucucuuguuucugcuuuccuuguuuuuuuuuuuuuaauaucuauaaaauuaaucuccuucuuagggcguugccagcuuuuagaauugaaaauaaagucaauuagaaucacuaaauugggaggccugcucuuuucugaaggggaacagggggagugaauugggggagaggggaggguaggaggaggggcuggugggagcagagggaggggaacuacaguugauaccuauuuuaugagagaagaauuuuuagaaaauaauuuaaaaauuguuguaauuuugccuuuugacauuagagcaaccacuggaugagauggagcagggcuggaaaucuuccaaagccuuccaugacaacuggcugaccucgaagcucuacacaagcagagguaaaguuguaaauaguaugccagggcauuaaaggcaugccauaacacgcacaacaagcucaucaacaagguguugaugucuaaacauuaucuagccagauguguuaccauauaccuguaaccucagcacucaggaggcugaaacaggagaauuguauggcuuuuacgucaaguugggguuacacagugagacuccgucucaaaagaaaaaagaaaaugggcucaauuaagaguggcucacucacccaccaggcagcauaaaaccugcuggucugaagcacccccagcacauauacagcagaggacugcuuggucuggacucagugggagaagauguacuuaauccuugagagacuugagaccccagggaguggggaggucugguggcugggaugggggugggggugggguggguggguagaccacccucucagaggcaaggggaggaggaguggaaguggggacugggaggaggguagcaguuggaaccuaaauaaaauaauuaaaaaaaaaagagugguucacuaauggaguagaggcuuccauggcugcacaugauaaauaauuuaaacuuuaaauaaucaguucaggaaagucacuaaaaacacaacagaaauauguuugggcuggguguggaauaaacuauuccugaguugccacauaagauuaagaugaacaguuucaacaagaauguacgagcuaugcaaagaaaugacaaaacaugguauaaacacagggacugucagaaaucaagccuucccccugccugccuucagcaacucagugccaguagcuaaacuaugucauuauuacucaccaacccuuuaaacguccccucugucugucugucugucugucugucugucugucugucuuguucucucucucucucucuugugugcccacucugauggcuuccacaacccucuacaaaccucuugccugagaucuacuguguggugccaucucugcugcagcauuucuuggcuuccaucugccaagacacccugcugcuaaguccuaucauuggugcugaugacucuguagguucuccugggccugugcacucaccaccaccccaguaccaccccacucuacuccccaaccccuacuaccagcaguccaaaccauacuggaacccuacccaccuguuucaccugcaacagauccaccuuuuggaccaccaaucgguuggccuuccauccaucacuggcaauuggugagugaucccucucauuuggcuuaaaugcuucccaagucucugguaaucuuggaaguggaagugccuacuuaugacucuuuccccugggugaggcuucauuuuuuuagcucaguuuucaccuuuugguuucauuugaaaagucuugguaccauguacugagugucuccuugggcuuagccaggcuaaaccccuggcuaugcccucaauugugaggcaauggcccacuguuugguuugugccuuccucauucaguuccucuucugccucaccuaugagguaccucuuggagaacauccuauccacuuagugcuuugacucaagggccucuaaacauaucuaccuuuugaaucuggucuuaauaccccuuaggaaaccaauacaaauauggacaccuaaugguaccauaaaucccaauauuaucuuggauccuaacaaauauuacaagggaucagaauggaauaaagacuucccauuccuucuuucuuucucuuuuuuuuuccaccucagguccuguuuugugugugugugugugugugugugugugugugugugugugugugugugugucugguacucucucccacacacguuguaaaaguccugucuuuaaguuaugguugauggaucuguaaguuuguugcaaagugggagcuggagcuggaccaaaaggagcagaaaaaaagcaauggagcaggucagcugcaggugcacacacccagcacguagcuauucgccccuguagcaaacaaaaguaccacucuaacacuccuaaaguguguacaguuuguuggugaauuuuauuccaauucuagaguccaauccuucagcugcugcuuugcucugaccugcugugcccuccaugugggcaccuauaugcuuuucuggcucuugcagccuucugcacucauguggaugucuuccuucucuccugcucaucucuggcuccagccugcaaucccacagcaucagcucucagcuccaucuuggaguuucuaggaacacacuagcauaguguucaguuuuuugacugucucucccuggacucagauucuauuacaacagcuuggccuuaguacagaucaauggcaaaaaaaaauaauaauaaaaaguaaaaaaauuggcaaacucaauuucaaaauuuucacaaauuguuaacaagugcuacugcacagaaaaaugaucccuaaauaucuuauauaucuugcuuuguucuacacuuuuucuacuucccacucuuaaaaauaugcuaucucuaugauuccuuuguacuuuguucuaaaaaaaaucuguuaagauuaugcuguaaccucuuaucucaggauuugcaaauucacuggguaugcuauaaaaucuguaacaaaauuuagcuuuaaacuugaaacaaagggcuuauuauaaaaaaucuauacauaugugauucaacucuggauuaggauauauguaacuuguauucaagucuauaugcguauggauguggcuuggauucaacucugcguguaagugacuugaauucaacucucauuaaaaacuguguauguguguuaggaaaauagauauuuuuaaaauagcaacuauguggcucucuuccaucuuaucuggugaccucaucaggauauaagcagccacauggcuggcaacuauuuuuacuaagguuaaggaggauacgccaugugacuucaccaccuuaagaugaucacagagaauaaagcaacauuuguaaaacugucaguccuuuuuuaucuguuuaucauuuuagacuaaagaagcaacaauaagucucaaauaccuuggauugauauggacuuguguaugaugauacagauuuaugguuauaucuacuacaacauacuguauuugugauuuaauucugguuuagacuauacuguauaugacgauaaaauauuaagguuauaaaggccuauucagauuaacaaaaacugauuuaagaugcuaucuauucaacaccaagcugcuagaacauuuagauaaguaacaacauaugcuuaauaaauaagguauauuaguaaauuaguaaaucccccccuuuuuuuucaagacaggguuucucugugcaguccugguuguccuggaacucacuagacacauuacaaacaaacuuaugaaagucaaagagaagagucuaaaaguaguagaaaugacuuaucaugcucaaaggauucucaauacgauuagcaagcugaaacuuuggaagucaggaggcagugaaauaacaaagugcugaaaggaaaggccuauacaaaucaagaauucuguauccugcaaugcaaucccugauaguuuuaauugucaacuugacacaaucuagcaucaucuagguagagagucgcacugaggaauugcuuagaucaggcuggucugugggcauggcagcaccauucuuugguuuagggaccugggcuguauaagcagagaaagcuagcugaguacuacgcauggauacauuuauuucuuucuauuuugauuauggauaugacuagcuguuucaaggucugccauugugacuuagaugcuaugauggacuauaaccuggaauugugaguggaaauaaacaucuuucuccacuaauugcuuuuuguugugguauuuuaucauagcaauugaaauaaaacuuggauauuggggcuggagagauggcucagcgguuaagagcccugacugcucuuccaaagguccugaguucaaaucccagcaaccacaugguggcucacaaccauccguaaugagauuugaugcccucuucuggugugucugaagacagcuacaguguacuuagacauaauaaagaaauaaaucuuuaaaaaaacuuggauauugucuuucaaaauugaagaagaaauaaagauaucagauaaaaucugaaaugauuaaucauuaguacaucuauccuauaaaaacagucaaaugaaauauugucuagucacuugaaucuucaugaagaaauaaagaacaacuaaugguaaccauacagguauuauauauaugcacacauguacacaaaauaucuauacacauacacacacacacacacacacacacauuuauuuauuuauuuauuuauuuauuuauuuauuuauuuauuauuuauuuagucucuuguagccccuugaacucuauuuagcugugguugugaccucuaaauguugggauuccaggcauguucuaccuagccugucuuugcugguaaauacaaauaaugauaugaaugcuuuguuugguuugauauacuucuuucuucccuaacuuaaaggcaacuauauaaaguauaauuauguuuauagucuuuggugcacaauuggcaaagauguuauuuguaugcuaauaguaucauaaaguguaaagguaacuuuuauucaccugauguaacuguggucuccaaggcuuacugccucuguaugcaaccuagaccuaggccuggaagcuucuggccuuuguacagucuaaucuaggccuagaguguuuucagccucugagacuuacugcugaaugggcucacuccuuagcucuuucucagcuauagcuggcugcuuucaacuaagcuguuugggcucaaacgccucuccaagcugacugacucaaucuggcuucuuuaguuucuccugaauuacuuugcuuggccucagaauaacacuggcaauuuguuuuaaaauucuggcucauucucauucuccgguuuguccugucuuuaucugugucgagcuuguucucuuuucugcaaccugucucgguaccuguucaguaaaauugccuucuuuccucucucuucgcugccucucuuuuuuucaaaaacaauuuuuauuagauauguucuucauuaacauuucaaaugcuauuccaaauguccccuauagacccccccgccccgcccugcucuccaacccuccuacuccugcuuccugguccuggcauuccccuguauuguggcauauaaucuuugcaagaucaagggacucgccucccaaugauggcugauuaggccauccucugcuacauaugcagcuagagacaugagaucugggaguacugguuaguucauaucgguguuccaccuauaggguugcagaccccuuuagcuccuuggguacuuucucuagcuccugcguugggggcaauguguuccauccaauagaugacugugagcauccacuucuguauuugccaggcacuggcauaccuucacaggagacagcuauaucaggguccugucaacaaaauuuugcuggcauaugcaauagugucuggguuuggugguuguuuaugggauggauccccaguggggcagucugugcauacucauuccuuuaggcucagcucugaacuuuaucucuguaacuccuuccauggguauuuugcuccccauucuaagaaggauggaaguaucucuuaaguagcuucccuuuccucucucucucucucucucucucucucucucucucucuuuuugugaguugggcauauccucuucugucaaaucuuucucugacuugucacguucucugcugcucaaauuucaauuagaguuguauaaguuaagaaaucacuuauaauccccaggaaaaauacuaaaacuauauguuugaaaaagcaaauauugaaaaaaaaagcccucaaaauuguaaacauaagaauaaaagaguugcuggaugugguggcgcacaccuuuaaucucagcacucaggaggcagaggcaggcagaucucugaguugaaggccagccuagucaguauagugacuuccaggauugccagggcuacauagugagacccugugaaaugugcuuuuaguccuagggggccaaggcagaaggauuauguuuaagaucugucugggcuacauugugaauucaaggccagccuggacuacaaagagacacuccgucuuaaagaaaaaagaaauaaaagaaggaaaauugcaagcauaaauucuaacuuacuaguaauuagguuaaaugaaaauaaacacuccauuuaaaaugcaggaagggaauagagagauggcucaguagcauuugcuacucuugcagaggacucagguucaauuccuaguaccaacauagcugccaucauacaugcaggcaaaugcucauguguauaaaauuuaaaaaauaaaaucuuucuaaaaaggcauaaggaauauaaaacaugacuuaacuauaugcugucuacaagagacacauuuaauuaauuaauuaauuuauuuauuuuuaauauuuuuuguguguauggacaacauucuucuuuuauuuugagauagucucucuauguggucuugacuguccuggagcuauguagagacuaggcuauccucaaauuuacaaagcuccucuugccccugcuuccugagugcuggguauguaccaccacacccagcuggacaaguucucaaaaacagaacaaaacaaaacaaaacacccuuuuauuuauucagugugugugugugugugugugugugcgcgcgcgagcgagugcacugauaccugcacacaugcuacagugcaccauguggaggucaugguacaacuugugggaguggauuaucuccugcuauguagauccuggcuggacucgagucaucaggcuuggugucaaguacuuuuaacugcagagucaucuugcuagcccaagacacauguuuuauauuuaaauacaaaaauagaaagaccauaaauugauggaaaaaauuaccauauaaauaauaacaaagagagauagaauggcuauacaaauaucagauaaaacagacauuuaagcagauugucauuagagauaaggguauuuuauaguaagaucaaaucauuaagaagauacaacaaauaacaaauaugccaguaacaacagagcuccaaaauacauaaagugagaggacugaguuagucagagccaagcuaacuccauguuaggcugaaaacuggcaguuuggaagacuaggccuaaauuucuguuuccuagaaaugagaaucuggauccaggaacacauggucagccaaccacagcggcaggcagccaauucaaggacaccuugcuacccugaaaaguccccagaguguuaaccaaucacaaaaacacccauaccccuaacaggcuuuaaacugaucuugcaaagcauacaccuuggucuccauucccaaagggggagacugcugaaggaaauucugaugaauaaacacucuuugggguuuuuuuuugcauacuaguugagucuggaguaucauucuuuggcaguucuuggacccuaacaaaagcaaaacaugggauuacaaaaauauuguauaagacugacuuugaguuauaaggcauaugugacagaauucuugcuuagaaugugugaagccccaggcucaaucccaguauuacaaaggaaaauguguauauaaugcguuuaauuuaccuugcauuaucuaguuuacuaucaauauucuuaaacacauuagauuuuaguugggcaaagucaucuaaugcagucuuuuuuuuuuuuuaaaucacagucuauuuuuauuuuauuaucuuuauuuuauuugagacaaguucucaaucuaugccgcacugcucaaacucauagagaucuuccugcugcugccuccuuaguguugggauaacagguaugcaccacugugcccagcucucaaagccuauuuuuaauacauaccaucccuuccauagacacuccucauauacacaauuaaaaauuuuaaaaauuggccuggaaagaugguuuagugguuaagaggagcagaguucaguccccaacaccuauacuagguggauggcaaauacuuguaacgucagcuguaggagaucugaagccuucuggccugugcugccacaugcauucacaugcacaaauacaucuucauuuuuaaaaauuauuaaaaauaaaauaaagccagguggcaagggcccagugcuuuaauccuagcacucagaaggcagagguaggcagauaucugugaguuugaagccagcuugguucacagagugaguucuaggccagccaggacuacacagaaaaaccuucaaauaaauaaaaacauaaauaaaaauaaaugaacaaauaagauaaaauagucaaucaucuuaagaaauuccuuccaucuuaagaaauuaggaagaaaaacaaaauucaaagcaagcagaaaaggauuaauaagcauuagaguagaagugaugaaaaagauaagaaaaauacauaauacagaaaguugagacgcuuuuaaacaaaaaagcgucucaacuuuccuuuaaacaaaggaaacauauauaaaacucuuaauuacuaacaucaaggauaaaagccacauugcuuuuuuuauuuauggaaauaaaaauuguaauacaggcuaugguauaacaaauuuauaaaacuaaaugaaaugaaugaauuucuauaaaaacacaaacuucuaaaacugaauuuagcugggcaaugguggugcaugacuuuaaugccagcacuugggaggcagaggcagguggauuucugaguuugaggccagccuggucuacagagugaguuccaggacagccagggcuacacagagaaacccugucucaaaaaaaaaaaaaaaaaaaaaaaaaaaaaaaaaaaacugacuuuagaggaaaggaaaaaucugaauagaucuauauauaauaaaugaauuagaaucuuaaguuagaacauuuuccauagaaaaagcuggaugugguagcucauaucuguaauccuagcacuuagaaggcugaaauucuugcauuaaggucaaaacuagccuggacuauauaaugagauccaggcuagccaggguuuuauuuguuauuuguuucuuuucuuuucuuuucuuuucuuuucuuuucuuuucuuuucuuuucuuucuuuuucuauuuuuuuuuuggggggguguagcccuggcuguccuggaacucacucugugaccaggcuggccucgaacucagaaaucugccuacuucugccucccaagugcugggauuaaaggcgugagccaucacugcccggccuauuuguuucauugaugacuaccaguaugaugauuagcauggauaaaaucucaaaauauuuuuaauuugcauuuuucuggugacgguuuguacguuauuguggggagccgcccucacauucgccguuacaagauggcgcugacauccuguguucuaagugguaaacaaauaaucugcgcaugugccaaggguaguucuccaccccaugugcucugccuuccccgugacgacaacucggccgaugggcugcagccaaucagggagugacaaguccuaggcggaggauaauucuccuuaaaagggacgggguuucgccauucucucucuugcucuugccuuugcacucuugcucuggcucuugcacucuagcgcucuugcgcucuggcuccuaaagauguaagcaauagagcucuugcucucuugcacucuugcuccugaagauguaagcaauaaagcuuugccgcagaagauucugguuuguugcgucuuuccuggccggucgcgugaaugcguguaagacguuaucuuuugaaaacuguuugcuuauuuccguagccuaucuacugacuggauuauuugaguuuuugcuauuagauuauuuaguucuuuauauauuguacauaucaauccuuugucaucuaguaaauauuuucuccuauucugacggcugugucuugguuaacucaggaagacucauuuuucaauuguuaaccuuaacuuccugagugacuagaguuguauuuagaaagcccuugccuacuccaauaacaugaagugggguuuuucuucuacuuuuucuaucaguuuuagaguuuugggucuuaugcuaauguuucaggaaacuaaacuagaucuaccuagcuacaccaugccuggguauuuacccaaaagauaucacagaacuuuucacaauagcuaaacugugaaacuaacaagguaucccucaacagaagcacaugaaaugugguuauauacacaaugaagauuuucagucauaaaggaaaaugaaguuauaccuucugcaggaaaauggguauaaugagauaauuauauuaagcgaaguaaguuaguuucagaaagguaaauaucauguuuuuuuucugcagguccuagauuuuuaaauagauacauaaaauugcauauauacaaauggcaugaaaauggaaucaaggggcuggugagauggcucaguggguaagagcacccgacugcucuuccgaagguccagaguucaaaucccagcaaccacaugguggcucacaaccgucuguaaugagaucugacucccucuucuggagugucugaagacagcuacaguguacuuacauauaaucaauaaauaaaucuuuaaaaaaaauggaaucaaaauuaucuggagaacugaugcggggggaggggcgaauagugagaggggagaguagccagauuugggagagggugaugcucaaaguacaauauauacuugcaugaacauggccuuauguaacccagcauaauaaaauaaaauacagaaaaauccuugaacuagaugucuucuugauuaaucccaccaaauauuuaaagaagauauaacauuaauucccccauaaaaauagaagggaaucaaauauugucaagcuuuuuuguaagaaaaauaguauccugauacccaaacuacauuagaaaagaaaauuauaacccaguacuccuuacaaauacagacaccauaaucuuuaacaauauacuaucugaaucccacaguggauuugugcuaugaccaagugagccuaguaaugcaaaauuuuacaccaagacacaucauaaacacauuuaugaaacuaugaacuuauaugaaaaaucaauuaauguaauaguguauauucauagaauaaagagcaaaagccacaugaucaugucaauaaaacagcaaaagcauuugacaaagucuaacacucuuucaugaucaaaacaaucaccuacaaauagaaagauaacuucuaccuacacaaugagcaguuaagauaugcuaggugaaggaguuuaacuacuuuacauuuauucaguaauuuaauucucacaccaacucuaugauucaagaaauauuaucaccugcauuuuacugauggauaaacugagcugcauggcaucuaauuaaauucucuuguguuaguaaguaguaaauuguagggcuaggauuuccacgcagaaauuccaguuauggauucuaugcucauaauggcacucuacugaacugguucucaaagaauaaggaauaaauaauaauugagauaaguagauuugagaggaaauuggauuuucuuagaccuaaugguuuugccugggcauggcagugcauaucuuuagucccagaacuaagguacagaggcagauguaucucugugaguucaaagccaacauggucuacaaagaaaguucugggacagccaaggugguuuacacagagaaacccugucucaaaagaucaaaucaaaccaaauaaaacaaagcuaaugccuugaucugcaaauaagccuaauucauacauuuuuaauuuauacgaacaaccauaauauuugcaauauugguaguaaaguuaauaauacuagauucucacugauauuuaauuauaauuuaagccauaaaguugguaauguuuauuuauguaaguaaauauaacuuguagcauuggaaaaauuaguaauuaguuguaaacuuugauggaguuacuaacaaugauucaauuucuauuuguaacuaaaacuugacauauaaccauagcacuuauaguuuauaguaaccauaauguaaaugucaauauccauauagccacugaaauauuaacaauuugauuucuucuuagcauaaguacuaaucauguauauugguaaccuuaguuugcuacaaaugcaauaaacuauaguauuaguuguuacaucuaauacaucaaguauuaguaaugauaauuucuguuugaauauacuucagagaagacacuucuaauuuguaugcaagcauaauuugugauacacuuaccuauacucuuugaugaugcuaguaaugauuauuugauuucuauguagccaggcuggccucaaacuuauaguccucagccggguggugguggcacacgucuuuaaucccagcacuugggaggcagaggcagguggauuucugaguucgaggccagccuggucuacaaagugaguuccaggacagccagggcuauaaagagaaacccugucucaaaaaaaaaacaaaccaaaaaaaccuuauaguccuccugccucuacccgcucauugcuagaauuauagacccacaucaccauaucuggcugguuguuuaauuucuaguaaaauucuaauuuaauuuauaauauugguaucuacaauauauaucaauuacaaugacuuguagcauucauguucauuuguaguaaugauuauauuuuaugauaauaaacaauucaauuuuuaauuuguaaauaauuuauaauaccacugcugaacacuuuuguuggcaaucugaauuugaaauaacggguaaaauuucuaucagaaugaauauuucauaauguuaguaauaauuauaugcuuucuacaugaaauacaaucugauacauuauguuaauucuauuaauucacacuagaaauagauauuuaauacugguaagaguaaauaauagggaggcagaggcagguggauuucugaguuugaggccagccuggucuacagagugaguuccaggguggccaaggcuauacagagaaacccugucucggaaaaaaaaaaaaaaaaccaaccaaccaaccaaacaaacaaacaaaaaaacaaaacaaaacaaaaacaaacaaaaaagaguaaauaauauaaaaauaagauuugauaaauacugggaucaauaacuuaguucauacuuguaacuacugggaaauuugugguccugguugaacauuccucaucaaaaaucuagaaucugaaauguucccaaugcugaaaccuuuugagcaccauuaugugcuccacaagugucauguucuacaugugaccucauguuccagguagcagucaauacauaggcuuacuaaaaauacucuguaagaguaaggccgggcagugguggugcacaccuuuaaucccagcacuugggaggcagaggcagguggauuucugaguuugaggccagccuggucuacagagugaguuccaggacagccagggcuacacagagaaaccauggcucgaaaaaauaaaaaauaaaauaaaagaguaaguuggaguuaugugaauaaggcauauguacuggcugguuugugucucaauuugacacaagcuggaguuauuacagagaaaggagccucccuugaagaaaugccuccaugagauccagcuauaaggcauuuucucaauuagugaucaaggguggaggguccauuguggguggugccauuccugggcugguagaccuggguucuauaagaaagcaagcugagcaagccaggggaagcaagccaguaaagaacaucccuccauggccucugcaucagcuccugcucccugaccugccugaguuccaguccugacuuccuuuggugaucaacaguaacauggaaguguaagccaaauaaauccuuuccuccccaacuugcuucuuggucauauuugugcaggaauagaaaccuugauuaagacagcauaugugaaacauuaauuucauguuuggacuugggucccaggcuggagagaugguucagggguuaaaagcucuuacagagaacugggguucagguucaggugguacacaaaagcaccuacaugacagcuuaccacugucuguaacuccaguuucaggggauuugaccuuuuuuuggcccccgugggcaccaugugaguaugguacaucaacacauauauaggcaaagcacccacacauauaaaauaaaauaaaucuuuagacucaagucccaugcuuaaaauaccuuauacgaauauuucaaaauccaaaaugaaaacucugaaauuugaagcauuuauguuuucuaagcauucuggacaaaggcuauauaauagacucaacuauaaagugacuucaauucucuauacuaguaguucucaaccuucauaaugcuauggcccuuuaauauaguuccucucauuguggugacccccaacuauaaaauuacuuuuguugcuacuucauaacuguaauuuugcuacaguuaugaauugcaauguaaauaucugauauucaaucccuaugaaaguguuguaacacacagguugagaacuuguguauaauacucagauaucagccuaucagccaugauaacauuacaguaguucugaaucuuucccacuccauucucccagacuuaccaucucuuugugauuaggauagaaagucugaucaaucagagggaauuccucuguuccaagcuucuuguguagucgaaccaucugggcaaacuaugaaaaccagaagacaugaaucagugaguucuuuaccucagguaagucucuaaacuguuaucucaagugcuaauuuggauuuggaauauccucaaggucuaugucuuaaaaauuuguuccccagaaacuuuaagagaugaggccuaccuagauguuuuagguuuucugggggguacucucacaggggauuauaacucccugguuguugucuuucuucuucuucuucuucuucuucuucuucuucuucuucuucuucuucuucuucuucuucuucuucuucuucuucuucuucuuccuucuccuucuccuucuccuucuccuucuccuucuccuucuccuucuccuucuccuucuccuucuccuucuccuucuccuucuccuucuccuucuccuucuccuccuccuccuccuccuucccuccucuuucaucccuccuucuuuucuuccuccuuuaauuccuggccacagagugguaacuuugcuccacugugcacuuccaccaugauguucugccaugcuacaaccccccagcaacagggccaacacaacauggauugaaaccucaaaaacugagguaaaauaaaccauuucauuuugugaguugauuaugucauguauuuguuagugaugcaaagcuaauuugcauauuaaacuuuuaaacaucuucacuucugaaaagacagaguggcuccagauucccucaugcacauaugagcaauucuaucugcauuaguacucuuccuguaacucuaucugcauuaguacucuuccuguaacuuaccacccaggguuugucacagaaguuguagacagaaugcaaagaguuuacacuggggauuccagcauacugcagcccaaugaccaaacuucgguagucuccauuacgugccaugcugaaggcaugcuggcggaucagcacaaagucuggcuucagagaccuggguugguggcauagauacaaauggugagcacucccaacaccccccccccccaccuaaccaggaaguucccuaccaaucuuuugaauuucuaaguauucauaagucuugaaaauugcaaaguguuuuuuuuucccucucuguccacauacacaaacugguccuucugccuggagcagaaggucuccaaccuuucuccaucuggugauugacuccuuuucagacuuuccuaucuccuggacgucagcuugcaacucuguccacgugagucuggugucuccuuggucucaaucucucaggcucccaguuguccuccaaguguguugcucagaauagacugcagccucaggguaucuaugagcucuucccuccgccugcaauauuccccuagcauaccuacaagaaucucucuuucccuuucuucagguccuucucaacuguuucuuaugcuaccagguuacucuuuccaaacugcaaaccccaguaucuuccaacaagcccugcaucugcuuuacuguucuggguuuuccuuugugguuucacuuuuuuuuguuauuguuauauauauauauauauauauauauauauauauauauauauauauauauacucuaucuuccugcacaccagaagcaggaaucaucucucauuacaucucuuauuacaguugugagucaccaugugguugcugggaauugaacucaggaucucuggaagagcagccacugagcuauuucuccagccccuguuguuguuguuguuuugagacaggguuucucuguguaguccuggcugaccuggaacucacucuguagaccaugcugaccucaaauucacagaaaucugccugccucugccucccuguuuauguuuucucauuaucugcucaaauaacaagggcagagagcuuuauuuuuuuggggggugguuguucugcuuuguuuaccauuaggucacucagcauguauaagaguucuuggcauacagugggugauaaauaaaugucuguuggugucaagugcugaggauagaaccuacaaugaagagaugcuuaacaaauauuuguugaaugaauaauugagaaguuuccuuguggucugcuaggcucuuuggcucucccugcaccuaagguuuugcucauugaagggggaguuaaugauucucucucaguucuaagguaguccccuauacuuucccccauaguaccaguaugccuuuuucaugcuuaccucacaacuuugacuccauuccgaagaacuuccauguccacagagaauccaccauuggcaugagccacaagauugagaucagagaauucagccuggaaaagacagaaaaaucagugauuugcccacaucaugugugaacaauuggucugcggcucagacaguggaguuccaagugugccucaacuuacuugcucuacuuuaaugucaauuucuccauggaucuucuucccuuugaaguauuuugcccuggggagaaauacagaagggcacauccaucaguguucagaucucagauaugaggaccacauccagguuggucucuugaaccuuucccccuucagugcugguacagaaacuacauaauacuuuaaauuguaauaguuuguaaaaacuaauugacaauacuuugugaacaauaaagucuagugugauaucuguggaaguauguaaagacauuguaaaaggccacagagaguaggcaugccccaaaauauggcaucucaccacauuacuauucuaaauguuucaguaaaagcuguggaaaaugagugguguugugucaauuauaacagacuuugaacugcauggaggucuguaaauggcuaagaaccucagagaguguaaauauaugacaugugccuguugugugguguguuccagugccugugugguucuugguacuuaugucugcaaggguccaaagugacucuguguucucuccuuuaccaugaagcagcaccuugaucaugggugucaucugcuauggguggacaguugcgucugaauaggagcugccaauugagagguacaggcugcagcugguuguaaagaagcuguagccagcaaugaugggagggggagggaugcaucuaaggaugagggaacgccccaagcagaggagcaggagcagcagcaguaggcacaucgcaaauugcuuugucauuguguccagccccacccagauaagcucagcuuucagcagccuucucucccaggcucaagauuccuaccagacaggcuucuucacagagguuccaguucugauuuucauggaagggacaugaaauuaagagacacuccuaggaacacuggucacuggcauguacauagucagcaacucugauauauguauauugcacaaaugaguucugucggcuucacugaugagcacaaaaggacucaagagcaucuguuuccuuuuuuucuguaaaauuugucucucuuugauaucgcugucucccccaacugugucucugucccuuucugugccucugucucucucugcaucuguuucucucucugucucugucucugucucugucucucucucucucucucacacacacacacaaacaaacacuguuuccucacaaccaucagacgagaauguggcuaauuucuuaagguuagccccugaccuaucucuggucucauggguuauaagggugugcugaauaguuuuaugucaacuuaacaguaacugaagucaucagagaggaagaagccucaagugaaaaaaaugcaucuucaaguuuucuuuuguuuguugacaauaaauauagugucuacuacaguauucugcucaggcuccucuuugaaaucaauaagucugggucuuuuuugacagcuccuggcuuugccuccauagaccaaggugacaccuaauuuccuccuuuccuuuuccuuuuccuuuuccuuuuccuuuuccuuuuccuuuuccucuuccucuuccucuuccccuuccccuuccucuuccuucccuucccuucccuuccguucccuucccuucccuuuccuuuccuucacccccacccccaggcaaggucucacuguguagcccuggcuagucuggacuugcuuuguagaacagucuggccuugaauucacagagaccugccugccucugccucccaaguaauuggauuaaggcaugagucaccauguccaacaacgcuuaauuucuugagcuuaaccccagacuauuucugaucuugaagggaauaugaaggugugcuugcuaguuuuaugucaacuugacacaguuuaagccaucugagagaagggaacgucaauugagaaaaaugcaccggguuguaggcaaaccuguuuucuuaauuagcaauugguguaggaugacccagcccacuguggauggugcuaccccugggcuaaaagaaagcaggcuagguuuuucuuguacucuuuuguucuacuauucagcuuuucgggugcuugcuagugcugaacacccaucaccacgccuugagaaauugaggaaaucaagggcuuuucugcucacagcccaggagaaggaugcaaaauccaucaagaucaagaacaacaaggguaaugcuaaguucaagguucacuguagcaguuaccuuuauacccuagucauugcagacaaggagaaggcagagaagcuaaggcaggccuccuccacuccccccgcuuggcgugaaggggcugaaaugaacuagaccuccacaguugauuauuaaaaacacugaaaagugauaaaagaaagaaaaagaaaggaaagugaggcuaagcaagcaauggaaagcaagcaagugaacaacacuccuccauggccucugcaucagcacuugccucuuugaauuccugcccugacuucuuuucuuuucuuuuuaagauuuauuugauuauuauauguugaguacacuguagcugucuucagucacuccagaaaagggugucagaucucuuuacggaugguugugagccaccaugugguugcugggauuugaacucaggacuuucugaagagcagucagugcucucucagccacuaaggcugagccauuucuccagcacccccucccccgacuucuuuuaaugaugaacuaugauguggaaauguaauccaaaggaacccuuuucuuuccaacuugcuuuuggucauaauguuucaauguagcaaugcuaacccugagaaagaaggcuagccucuuuuccucagucugggcugacucugaagggccaucucagcuucagagcacccccugggaacagcugagaucucugaccugaugaugguccagccuuuccucuacucuuuacucacuacaguguugaccccaaagguagacccaguuaggccuucugcaugaaaaucccugccucuugaaacugcuccagaaagccaaccuaaaauacugggccagaggagucaaacuacauaaguagacucuuaacaugauucuguagcugggucauccagcucccaguuggaauugagcaccuuuagugacaggacagcccauaacauacuaccuaucaccaugcaaauuccucugaggcaagugcaguuugugcuggaaccuugauauguaucagugaauggaacaauaauauggaacauugauauggaucaaugccauauguucuggcaggcccuaugacacuggaagugucuugguggcaaaggaugaaauaugaaauuuuucucuugagugaugaagaguggcaccaugggccccucguguugggagcagcagugacuuuuccugauaguggacuacacuaggaaucugaaagugaagcagcugcugaaauagcuuugacacuugacagaugugagggaaaugguaaccagauugugguaauuguuugcuaaauggcacugguuaacuguagaaaaaucugauauacccgccaacucaagguaaaauaugaaaggcagaggaugucccuggcucuuuuuaaagaaaccuuaagguguagcuagagaacauauggaagggaggaccaggcucaggauuuaacuuuaaguaguguugaacuucagagaagaguggucuaccucucugccacaucaugcucagcccuaguaggacuggagugguauccuaaggcuugggacaaggauacaugaauagaugcaguuaaacauccugaccuuacaggccuaccugaagccauuguaccagcagaaacaguuuacucacccuuacuccauagacagcuucccucuguuugggaaaaugcagaaugccuuacgugaaccagguacuuuauaaaucagugucugcccugcucaggauauacuccuaauuacuacccuggucccccagacccagagacauccuaauguucauauccaugacugaccccagugggauuaagagcuaguccagaggagaaguccaaauagaagcuucugagauggcaccuccaugccucuacaaaagcaguaaaucagggcuagguguauagcuuaguggcagaacacuugccuaauguguauggaauucuagguuucaaccccggcacuggggagaaaaacagaacaaaacaacaguaaauugaaagcaaugcuauaugcauucugggggagaugguagaaaaugaagcaacuaagauuaagagaggauacgagggcacgucccucaucauaucucuacugaauuaccaguugugucucugaggagacugggcagauccagagaauucuuguagaccacugcaaaugucaccaaccaguaccucugcuugcagcuaccgugcuagacaugcuauuauuacagauuaagaagguaucaaguauggcauggagccaacaauuuggcaaauucgcuucuucaauucugauuagaaaagaggaacaaaagcagcucauguggcacggacaauaucugucaaugguuuuucccuauacagcacucugcuguuuccuucaaccuacauuauaauaucguucagaggaaucuggagcaucuggacaucccacagaauaucacacuggaccauuauaucaguuccaucacauggauuaugcaagaugaaaagagaugguuagcauauugccuugauaagacacaugugaucugagguggggaugguagcacagcacucagaagccuaaggcaggaggaucaugaauuugaagccagcuuaggccaaccuagugaguucuaagcugguuuaggguacauauuaagaauaugucucucaaacaucaaaagacucaugagcuugaguggguaguagagaauccauucaaagacacaggggcauaccauauuaguaauauuucagggauccagugaccaaaaccaugccagacuaacacuuccaaagaguagagcagaguuuugcauuucaugccuuuuacugugaagagagacagcaggcaggcuucuuucaaauucuggaagcaucauauucuauaccaggacccaaguuucaagcaauauguaaaguuaucauuuaugaguauggaucagaguauaagggggcuggguggcagauccaagauguagugcagacagucuuaccacuuaggcuauuugaccugccaagucuucugguaccagaggucucagaaguggagacagaugcauaguggagccuaugaggagccuaaguaugagacuuucaggguucuggagcuagggcauaacaucuucaguaggggcuuagauaucuuaugguuguuguauuugagauagggucuuacuauguagccuaugcuggcaucaaacuagugauuccguuaccuuaguuuccugagcugggguuccaggcaagugccaccaugccuggcucaauuauaugccaucugauaaacagauuccacuacaguauuucucucugauagagacagaauguuugaccauggggcaccaagugacugugcacccagaacagcucauuaugagcugagucaggccacacccaccaaauaaagucagauauuuauggacaaugaaugguuugcaugguuguuuaggguucaggaaggaaaaugaccaaaaaaucaugacaaggaggucugggauacagacugugggugaacauauauggaagugggcaaaagggaaggauaaagaucuuuuuacugugugcuaacacccaccaggcuucauccacuauggaagugguacuaggcaaccaaguagauaggaugagucagcuagaugaugucagccagccucuaaugagccaccccagugcuagcagaugggagcacaaaugaaaugccaauagcagcagagauaaaagcuauauguggagucaacuuuccagucuuccagcaagaaagaucaacauugaaucuuugauaugacaccauaccucaagaccaagcagucacuuggggcaagcugacugcauugggcuucuucuacucuaccaaaaaaaaaaaaaaaaaaagugaucuguuuugacuagaaauuuccacgugugguuugccuuuucauuuucugacuaagacuagcaagcaucagugcccaaggguuuaaaacuauauuugaucccuagcaggaugggauccauauaacauugcaacaaaccaaaggacacaugucauaacaaaguaaaggaaagugaaauaaagaggugacuacggaaucaaccagugagguuccauaccacaccacccagaggcuguuggccugagagaaugaagccauagguaugaccucauuuuggagaugacaccaugcaagaaugggcauuaccuuccuaaaagcaguccaugacuauuguguaugcuauucucauaguagguagaguacacgagucugggaaguuagaggucacagugggaauggcccagcuuaccauuaaucccagugauccacucuuagaaucugugcuuccuguucccucaggguucugcaagguuagagguccugguucuccaaggggcaacacugcuaccagggacacagcaggaaucucauuaaacucuaagcuaugaacaccaccugagaacuucagguuucuuuugauaaguaaagagaagucacuagcagaagaauguaacaucgauagcuaggaaguaagagguugguauacagugagggcacccaggccucccacuuuggcaucuguuggaacuccuuguucagcuuucaugguaaguagacaagaagcagccagaaucugagucugguguggggacacaggcucagggaucccucaaagaugaaggaauggaucacccaccaaguaagccacugagaccaacagaggugcuagcugaaggugaagggucuguuuccaggaaagucuaucuaagaaaagaagccacaauaagaaacacaguuuauauaacccacuauauaaauauuuacauaacucaugcuauauauacacacauauauauuauauaagacccauauguuuuaugucaaacaggauucagauaugccuuauauaauauauaccacauaaaauauauaucauacaugucucuagguuguauaacagaauauacauaaguacacauauacaaguggaaucaaaguuucagcugggcauaguucuacacauugguaauccaucacuugaaagauagaaauaggaagaucaugaguuugaagccagccuggguuacacagcaaggcccucucucaaaaauuaguuuaguaaauaauuaccuuuacuauaugcaauacaguuuuguauuucuuguuccacuuuauucuauuuuguggagaaaauccuauacuuguagauauacuauagagaauaaagucauuauauaacacaugcaauaugcaguucaugucauauauaauauauuauacaucauauauuauauauuauuggaauaauagucuuauuaaauaacugcuuacuauguaaaacauacucugcucucuauuuucacuuaucuugcuucaugaaaaaaguggcaugcugaucaugggcaauaguugugccacagauugaaauacacaggagcaacuuaucucaaaaaaaaaaaaaaaaaaaaagauggagcacaugccugcaaauccuagaucuuaagagguagaggcagcagaaugauaaauuuaaggccagccuuguguauguagacuguguguuaaacauuaaaaaauuaaauccucucaucuuagaggaugcaacaucgaaguacaggggcucaggaugaaaggagaauggugaagacugaagagauggcagcaggcuauacauaaggaugcauuucuuucaaaacugucaacuuccuccucuguuccaaccugaaauccucaaagcuugcaugguucugaaggucugcaagcucaugcagggcucuguucccaaauugagccugauauacuuaggcucucuccuucuguccauguuaccacccaccuagcagacacuaaaugaauauuggccaaauugccuagaaaaaaaaaagacugaaggagcuguugcaauaaaugggggcuuugaggauggugaaggagagggagaauaaucuuuuuguugaguucaguaaguacucaauaaauguuuucuggagauuagaaaaaaaaagguagauauuggauugccaucacaagaaaggggaauggacaccauauucaguugagacacugggggaggggcaauuaaauaaccuguuuauaggguuggagcagagaaggaaugucuaccaauacguaguacaggccucauuaaugcuugcugacuucaauaaagcaaauggagccuaaacaacagcgcccuaaaggaauuucugaacucugcucaauauauauuuuaaggguugcuggaggaaaggugaagaagccugcuguauugaugagaaugugguuauuugaacagaauacagcuugagauuaauaaauacuuucuggauuaaugagagaggggaaggacugcuggggaggugacuacaaaguguguguguguaggcaggaucuagucaaaauauuggagagaagggcuggagagauggcucaggggcuaggaacgcugggugcucuuccagaggucccaaguucaauccccagcgacaacaugguggcucacaaccaucuguaaugagaucugaugccuucuuccggugugucugaagacagcuacaguguacucauauacauaaaauaaauaaaucuuaaaaaauaauggggagaaauuguacuucaggggguauguucuucaaaguauacaauauuugcauaucaaaugcuuauggggauaaguaggaaaaguuauaggaaauucagcuagugauuaggaguagaagaagggggaacuaagggagguuucuucccaggauagaaaagugcuuaacaaaugcaucccauauucugucacauagaaagaaugcaacaacuaucuguagaauggauuaaagggcuuaaacagaaaggauggcauggcaagagcuucugagggaggggugaccaagccaguaggcagaugguaccccguaaguguugacugaaaucgaucuuuggagugugagcucuuaaggcaauggcagggacuuccagagcccuggaaagaggagacugagggugacucauacagcugaugcucaguacguguugacuggcuuaaauagaccaacgauauuucgcugcauggacuuaagguugggaagagaggauucucagggguuacuaaaggggaugggaaaggguaaaucuuauauacuggguccuggguuaaugaaggaaagccuuuagagggcaggcuucacggcuggggcagguucuccuagggauaaugaaaggagauguacguccuauaaacaacagguacugcauaggugcuggcuacauucacugcaggaaacuguauccgaggagcaagcauaaacacacaaaucuccauaaaugcucaugggggucacuggaggaaagggucuuuggaggaaaguuaucagacuggaguacaggguggaugagaaauuaguguucacugaauuuauucacaaaugaccuuugaugaggaaggcuaggaauuauuugauaaaugcccucuuggaggaaaagccccgaauggaaaggggaagggaaugcagaaacuugaucuaggcaagcacaacucuccuuuuauccaagaaagauguuuguggagaaggccuauguagaccaaguguuccauaaaugcucuaaagaagggugaaacaaaaaagccuuuggcaaaagugacccaaauggugcccacagcaacugcuagauguuugaguauuggauuaacucuuaucacagaccuuuguggagaggucuuuggcugggucauguaaaaggugcucaguauauggugauggaagccccuaaaggacaaaucauuagauagaggauugggagugggguauauagcugacauucaacagacacuugcugaaaggaaaggaucuuuugacaaggcucucauuuuagggaacuaaucaauauugaauggauccaccaaagaccuuuggaaaagugucuggagaacaggagauucagaaagcacucaauaaaugucuuguagagucauuauaggaaaaggucauugaggagagacugguaaugagucacacauagaaagcuugaaaacccucacagaauucaugcuuggaaaaugauuuguuugaggcagguuuaggaauaguacauguuaagcauuuaaugccucuuagauccuucagagaaaaugggucccuucagagcacguaccuggacuuggcauucagucaagguucauaggauccauuagagucagagcuugugaugagaaaaugagguggaauacacaacagacacauucaaucacugcuuacagacaaguuugaaaggucuuugaugagggcucuggggugggacauauagcaucaauuggauacacguucacaagauccauuagagagauggccuuugggcaaggggugaggguaacugcgugaaucaggcucucaaaacaugcucaaggaaguccuuagagccaaagacuuccagggaagggcucugcagugagguauaaugcaggugcuaaugcuuacaagacucauuagggaaugagaccuuccaggcaagagcuggacagaggagguagggcacauuuggcccuugaaagcuuucugcauauauugaagccaaaagcuuuugggaaugaguaauaagaagaggcaacagauaauugcuccuuguacccauuuuaguuugggggagguaaaaguggggcuuaaagggagagcugagcacaaaucauuaaaaggaaggaacugggcgagggggccagauaucaggcgcacaaguggcgcucgauaauagcucauucacuguagaaacaucuggguacccaggcccucgaggaggcgcaacagcggcuuaccagucggugugcgguucgucgaugaccagcagcacccuggcggcggcgcccccgcggccugcgcccccagagccaccgcccaccugcucgcugaagguggcggcugcggcugcugugguuugcuugaccgcguuagacagcgacgagaagaagccgccgccccccgaggacccaggacuaggggcugcuggagaagccacuggagcagcuguggaggcccucucggcagaggcugucgcggagccgggcguggccccagggcuggcggccgagggaggcggcgggggcgguugcgggcgcugcaggucugucauguacccauucggcagauuggccaugaaguugcuguccgacaggcggcgccgcagguaguucaugguggcggcguggggcaggggauccaaggggcagugggucugugggccgcgggggcggagcgcgaggggcucaggagcacggcggugcucucuggcacgacgcgacuccucugcugcccgcugcagacugaggcagcgccgaggcucugccgccgcagagcguauggucgcgcccgcaccucccuaucuugcaccucucguggugcgguccgacug

SEQ ID NO: 9425 - RNA, 61589 nt, Mus musculus
cagucggaccgcaccacgagaggugcaagauagggaggugcgggcgcgaccauacgcucugcggcggcagagccucggcgcugccucagucugcagcgggcagcagaggagucgcgucgugccagagagcaccgccgugcuccugagccccucgcgcuccgcccccgcggcccacagacccacugccccuuggauccccugccccacgccgccaccaugaacuaccugcggcgccgccugucggacagcaacuucauggccaaucugccgaauggguacaugacagaccugcagcgcccgcaaccgcccccgccgccucccucggccgccagcccuggggccacgcccggcuccgcgacagccucugccgagagggccuccacagcugcuccaguggcuucuccagcagccccuaguccuggguccucggggggcggcggcuucuucucgucgcugucuaacgcggucaagcaaaccacagcagccgcagccgccaccuucagcgagcaggugggcgguggcucugggggcgcaggccgcgggggcgccgccgccagggugcugcuggucaucgacgaaccgcacaccgacugguaagccgcuguugcgccuccucgagggccuggguacccagauguuucuacagugaaugagcuauuaucgagcgccacuugugcgccugauaucuggcccccucgcccaguuccuuccuuuuaaugauuugugcucagcucucccuuuaagccccacuuuuaccucccccaaacuaaaauggguacaaggagcaauuaucuguugccucuucuuauuacucauucccaaaagcuuuuggcuucaauauaugcagaaagcuuucaagggccaaaugugcccuaccuccucuguccagcucuugccuggaaggucucauucccuaaugagucuuguaagcauuagcaccugcauuauaccucacugcagagcccuucccuggaagucuuuggcucuaaggacuuccuugagcauguuuugagagccugauucacgcaguuacccucaccccuugcccaaaggccaucucucuaauggaucuugugaacguguauccaauugaugcuauaugucccaccccagagcccucaucaaagaccuuucaaacuugucuguaagcagugauugaaugugucuguuguguauuccaccucauuuucucaucacaagcucugacucuaauggauccuaugaaccuugacugaaugccaaguccagguacgugcucugaagggacccauuuucucugaaggaucuaagaggcauuaaaugcuuaacauguacuauuccuaaaccugccucaaacaaaucauuuuccaagcaugaauucugugaggguuuucaagcuuucuaugugugacucauuaccagucucuccucaaugaccuuuuccuauaaugacucuacaagacauuuauugagugcuuucugaaucuccuguucuccagacacuuuuccaaaggucuuugguggauccauucaauauugauuaguucccuaaaaugagagccuugucaaaagauccuuuccuuucagcaagugucuguugaaugucagcuauauaccccacucccaauccucuaucuaaugauuuguccuuuaggggcuuccaucaccauauacugagcaccuuuuacaugacccagccaaagaccucuccacaaaggucugugauaagaguuaauccaauacucaaacaucuagcaguugcugugggcaccauuugggucacuuuugccaaaggcuuuuuuguuucacccuucuuuagagcauuuauggaacacuuggucuacauaggccuucuccacaaacaucuuucuuggauaaaaggagaguugugcuugccuagaucaaguuucugcauucccuuccccuuuccauucggggcuuuuccuccaagagggcauuuaucaaauaauuccuagccuuccucaucaaaggucauuugugaauaaauucagugaacacuaauuucucauccacccuguacuccagucugauaacuuuccuccaaagacccuuuccuccagugacccccaugagcauuuauggagauuuguguguuuaugcuugcuccucggauacaguuuccugcagugaauguagccagcaccuaugcaguaccuguuguuuauaggacguacaucuccuuucauuaucccuaggagaaccugccccagccgugaagccugcccucuaaaggcuuuccuucauuaacccaggacccaguauauaagauuuacccuuucccauccccuuuaguaaccccugagaauccucucuucccaaccuuaaguccaugcagcgaaauaucguuggucuauuuaagccagucaacacguacugagcaucagcuguaugagucacccucagucuccucuuuccagggcucuggaagucccugccauugccuuaagagcucacacuccaaagaucgauuucagucaacacuuacgggguaccaucugccuacuggcuuggucaccccucccucagaagcucuugccaugccauccuuucuguuuaagcccuuuaauccauucuacagauaguuguugcauucuuucuaugugacagaauaugggaugcauuuguuaagcacuuuucuauccugggaagaaaccucccuuaguucccccuucuucuacuccuaaucacuagcugaauuuccuauaacuuuuccuacuuauccccauaagcauuugauaugcaaauauuguauacuuugaagaacauacccccugaaguacaauuucuccccauuauuuuuuaagauuuauuuauuuuauguauaugaguacacuguagcugucuucagacacaccggaagaaggcaucagaucucauuacagaugguugugagccaccauguugucgcuggggauugaacuugggaccucuggaagagcacccagcguuccuagccccugagccaucucuccagcccuucucuccaauauuuugacuagauccugccuacacacacacacuuuguagucaccuccccagcaguccuuccccucucucauuaauccagaaaguauuuauuaaucucaagcuguauucuguucaaauaaccacauucucaucaauacagcaggcuucuucaccuuuccuccagcaacccuuaaaauauauauugagcagaguucagaaauuccuuuagggcgcuguuguuuaggcuccauuugcuuuauugaagucagcaagcauuaaugaggccuguacuacguauugguagacauuccuucucugcuccaacccuauaaacagguuauuuaauugccccucccccagugucucaacugaauaugguguccauuccccuuucuugugauggcaauccaauaucuaccuuuuuuuuucuaaucuccagaaaacauuuauugaguacuuacugaacucaacaaaaagauuauucucccucuccuucaccauccucaaagcccccauuuauugcaacagcuccuucagucuuuuuuuuuucuaggcaauuuggccaauauucauuuagugucugcuaggugggugguaacauggacagaaggagagagccuaaguauaucaggcucaauuugggaacagagcccugcaugagcuugcagaccuucagaaccaugcaagcuuugaggauuucagguuggaacagaggaggaaguugacaguuuugaaagaaaugcauccuuauguauagccugcugccaucucuucagucuucaccauucuccuuucauccugagccccuguacuucgauguugcauccucuaagaugagaggauuuaauuuuuuaauguuuaacacacagucuacauacacaaggcuggccuuaaauuuaucauucugcugccucuaccucuuaagaucuaggauuugcaggcaugugcuccaucuuuuuuuuuuuuuuuuuuuuugagauaaguugcuccuguguauuucaaucuguggcacaacuauugcccaugaucagcaugccacuuuuuucaugaagcaagauaagugaaaauagagagcagaguauguuuuacauaguaagcaguuauuuaauaagacuauuauuccaauaauauauaauauaugauguauaauauauuauauaugacaugaacugcauauugcauguguuauauaaugacuuuauucucuauaguauaucuacaaguauaggauuuucuccacaaaauagaauaaaguggaacaagaaauacaaaacuguauugcauauaguaaagguaauuauuuacuaaacuaauuuuugagagagggccuugcuguguaacccaggcuggcuucaaacucaugaucuuccuauuucuaucuuucaagugauggauuaccaauguguagaacuaugcccagcugaaacuuugauuccacuuguauauguguacuuauguauauucuguuauacaaccuagagacauguaugauauauauuuuaugugguauauauuauauaaggcauaucugaauccuguuugacauaaaacauaugggucuuauauaauauauauguguguauauauagcaugaguuauguaaauauuuauauaguggguuauauaaacuguguuucuuauuguggcuucuuuucuuagauagacuuuccuggaaacagacccuucaccuucagcuagcaccucuguuggucucaguggcuuacuuggugggugauccauuccuucaucuuugagggaucccugagccuguguccccacaccagacucagauucuggcugcuucuugucuacuuaccaugaaagcugaacaaggaguuccaacagaugccaaagugggaggccugggugcccucacuguauaccaaccucuuacuuccuagcuaucgauguuacauucuucugcuagugacuucucuuuacuuaucaaaagaaaccugaaguucucaggugguguucauagcuuagaguuuaaugagauuccugcugugucccugguagcaguguugccccuuggagaaccaggaccucuaaccuugcagaacccugagggaacaggaagcacagauucuaagaguggaucacugggauuaaugguaagcugggccauucccacugugaccucuaacuucccagacucguguacucuaccuacuaugagaauagcauacacaauagucauggacugcuuuuaggaagguaaugcccauucuugcauggugucaucuccaaaaugaggucauaccuauggcuucauucucucaggccaacagccucuggguggugugguauggaaccucacugguugauuccguagucaccucuuuauuucacuuuccuuuacuuuguuaugacauguguccuuugguuuguugcaauguuauauggaucccauccugcuagggaucaaauauaguuuuaaacccuugggcacugaugcuugcuagucuuagucagaaaaugaaaaggcaaaccacacguggaaauuucuagucaaaacagaucacuuuuuuuuuuuuuuuuuuugguagaguagaagaagcccaaugcagucagcuugccccaagugacugcuuggucuugagguauggugucauaucaaagauucaauguugaucuuucuugcuggaagacuggaaaguugacuccacauauagcuuuuaucucugcugcuauuggcauuucauuugugcucccaucugcuagcacugggguggcucauuagaggcuggcugacaucaucuagcugacucauccuaucuacuugguugccuaguaccacuuccauaguggaugaagccugguggguguuagcacacaguaaaaagaucuuuauccuucccuuuugcccacuuccauauauguucacccacagucuguaucccagaccuccuugucaugauuuuuuggucauuuuccuuccugaacccuaaacaaccaugcaaaccauucauuguccauaaauaucugacuuuauuugguggguguggccugacucagcucauaaugagcuguucugggugcacagucacuuggugccccauggucaaacauucugucucuaucagagagaaauacuguaguggaaucuguuuaucagauggcauauaauugagccaggcaugguggcacuugccuggaaccccagcucaggaaacuaagguaacggaaucacuaguuugaugccagcauaggcuacauaguaagacccuaucucaaauacaacaaccauaagauaucuaagccccuacugaagauguuaugcccuagcuccagaacccugaaagucucauacuuaggcuccucauaggcuccacuaugcaucugucuccacuucugagaccucugguaccagaagacuuggcaggucaaauagccuaagugguaagacugucugcacuacaucuuggaucugccacccagcccccuuauacucugauccauacucauaaaugauaacuuuacauauugcuugaaacuuggguccugguauagaauaugaugcuuccagaauuugaaagaagccugccugcugucucucuucacaguaaaaggcaugaaaugcaaaacucugcucuacucuuuggaaguguuagucuggcaugguuuuggucacuggaucccugaaauauuacuaauaugguaugccccugugucuuugaauggauucucuacuacccacucaagcucaugagucuuuugauguuugagagacauauucuuaauauguacccuaaaccagcuuagaacucacuagguuggccuaagcuggcuucaaauucaugauccuccugccuuaggcuucugagugcugugcuaccauccccaccucagaucacaugugucuuaucaaggcaauaugcuaaccaucucuuuucaucuugcauaauccaugugauggaacugauauaaugguccagugugauauucugugggauguccagaugcuccagauuccucugaacgauauuauaauguagguugaaggaaacagcagagugcuguauagggaaaaaccauugacagauauuguccgugccacaugagcugcuuuuguuccucuuuucuaaucagaauugaagaagcgaauuugccaaauuguuggcuccaugccauacuugauaccuucuuaaucuguaauaauagcaugucuagcacgguagcugcaagcagagguacugguuggugacauuugcaguggucuacaagaauucucuggaucugcccagucuccucagagacacaacugguaauucaguagagauaugaugagggacgugcccucguauccucucuuaaucuuaguugcuucauuuucuaccaucucccccagaaugcauauagcauugcuuucaauuuacuguuguuuuguucuguuuuucuccccagugccgggguugaaaccuagaauuccauacacauuaggcaaguguucugccacuaagcuauacaccuagcccugauuuacugcuuuuguagaggcauggaggugccaucucagaagcuucuauuuggacuucuccucuggacuagcucuuaaucccacuggggucagucauggauaugaacauuaggaugucucugggucugggggaccaggguaguaauuaggaguauauccugagcagggcagacacugauuuauaaaguaccugguucacguaaggcauucugcauuuucccaaacagagggaagcugucuauggaguaagggugaguaaacuguuucugcugguacaauggcuucagguaggccuguaaggucaggauguuuaacugcaucuauucauguauccuugucccaagccuuaggauaccacuccaguccuacuagggcugagcaugauguggcagagagguagaccacucuucucugaaguucaacacuacuuaaaguuaaauccugagccugguccucccuuccauauguucucuagcuacaccuuaagguuucuuuaaaaagagccagggacauccucugccuuucauauuuuaccuugaguuggcggguauaucagauuuuucuacaguuaaccagugccauuuagcaaacaauuaccacaaucugguuaccauuucccucacaucugucaagugucaaagcuauuucagcagcugcuucacuuucagauuccuaguguaguccacuaucaggaaaagucacugcugcucccaacacgaggggcccauggugccacucuucaucacucaagagaaaaauuucauauuucauccuuugccaccaagacacuuccagugucauagggccugccagaacauauggcauugauccauaucaauguuccauauuauuguuccauucacugauacauaucaagguuccagcacaaacugcacuugccucagaggaauuugcauggugauagguaguauguuaugggcuguccugucacuaaaggugcucaauuccaacugggagcuggaugacccagcuacagaaucauguuaagagucuacuuauguaguuugacuccucuggcccaguauuuuagguuggcuuucuggagcaguuucaagaggcagggauuuucaugcagaaggccuaacugggucuaccuuuggggucaacacuguagugaguaaagaguagaggaaaggcuggaccaucaucaggucagagaucucagcuguucccagggggugcucugaagcugagauggcccuucagagucagcccagacugaggaaaagaggcuagccuucuuucucaggguuagcauugcuacauugaaacauuaugaccaaaagcaaguuggaaagaaaaggguuccuuuggauuacauuuccacaucauaguucaucauuaaaagaagucgggggagggggugcuggagaaauggcucagccuuaguggcugagagagcacugacugcucuucagaaaguccugaguucaaaucccagcaaccacaugguggcucacaaccauccguaaagagaucugacacccuuuucuggagugacugaagacagcuacaguguacucaacauauaauaaucaaauaaaucuuaaaaagaaaagaaaagaagucagggcaggaauucaaagaggcaagugcugaugcagaggccauggaggaguguuguucacuugcuugcuuuccauugcuugcuuagccucacuuuccuuucuuuuucuuucuuuuaucacuuuucaguguuuuuaauaaucaacuguggaggucuaguucauuucagccccuucacgccaagcggggggaguggaggaggccugccuuagcuucucugccuucuccuugucugcaaugacuaggguauaaagguaacugcuacagugaaccuugaacuuagcauuacccuuguuguucuugaucuugauggauuuugcauccuucuccugggcugugagcagaaaagcccuugauuuccucaauuucucaaggcguggugauggguguucagcacuagcaagcacccgaaaagcugaauaguagaacaaaagaguacaagaaaaaccuagccugcuuucuuuuagcccagggguagcaccauccacagugggcugggucauccuacaccaauugcuaauuaagaaaacagguuugccuacaacccggugcauuuuucucaauugacguucccuucucucagauggcuuaaacugugucaaguugacauaaaacuagcaagcacaccuucauauucccuucaagaucagaaauagucugggguuaagcucaagaaauuaagcguuguuggacauggugacucaugccuuaauccaauuacuugggaggcagaggcaggcaggucucugugaauucaaggccagacuguucuacaaagcaaguccagacuagccagggcuacacagugagaccuugccugggggugggggugaaggaaaggaaagggaagggaagggaacggaagggaagggaagggaaggaagaggaaggggaaggggaagaggaagaggaagaggaaaaggaaaaggaaaaggaaaaggaaaaggaaaaggaaaaggaaaggaggaaauuaggugucaccuuggucuauggaggcaaagccaggagcugucaaaaaagacccagacuuauugauuucaaagaggagccugagcagaauacuguaguagacacuauauuuauugucaacaaacaaaagaaaacuugaagaugcauuuuuuucacuugaggcuucuuccucucugaugacuucaguuacuguuaaguugacauaaaacuauucagcacacccuuauaacccaugagaccagagauaggucaggggcuaaccuuaagaaauuagccacauucucgucugaugguugugaggaaacaguguuuguuugugugugugugugagagagagagagagagacagagacagagacagagacagagagagaaacagaugcagagagagacagaggcacagaaagggacagagacacaguugggggagacagcgauaucaaagagagacaaauuuuacagaaaaaaaggaaacagaugcucuugaguccuuuugugcucaucagugaagccgacagaacucauuugugcaauauacauauaucagaguugcugacuauguacaugccagugaccaguguuccuaggagugucucuuaauuucaugucccuuccaugaaaaucagaacuggaaccucugugaagaagccugucugguaggaaucuugagccugggagagaaggcugcugaaagcugagcuuaucuggguggggcuggacacaaugacaaagcaauuugcgaugugccuacugcugcugcuccugcuccucugcuuggggcguucccucauccuuagaugcaucccucccccucccaucauugcuggcuacagcuucuuuacaaccagcugcagccuguaccucucaauuggcagcuccuauucagacgcaacuguccacccauagcagaugacacccaugaucaaggugcugcuucaugguaaaggagagaacacagagucacuuuggacccuugcagacauaaguaccaagaaccacacaggcacuggaacacaccacacaacaggcacaugucauauauuuacacucucugagguucuuagccauuuacagaccuccaugcaguucaaagucuguuauaauugacacaacaccacucauuuuccacagcuuuuacugaaacauuuagaauaguaauguggugagaugccauauuuuggggcaugccuacucucuguggccuuuuacaaugucuuuacauacuuccacagauaucacacuagacuuuauuguucacaaaguauugucaauuaguuuuuacaaacuauuacaauuuaaaguauuauguaguuucuguaccagcacugaagggggaaagguucaagagaccaaccuggaugugguccucauaucugagaucugaacacugauggaugugcccuucuguauuucuccccagggcaaaauacuucaaagggaagaagauccauggagaaauugacauuaaaguagagcaaguaaguugaggcacacuuggaacuccacugucugagccgcagaccaauuguucacacaugaugugggcaaaucacugauuuuucugucuuuuccaggcugaauucucugaucucaaucuuguggcucaugccaaugguggauucucuguggacauggaaguucuucggaauggagucaaaguugugagguaagcaugaaaaaggcauacugguacuaugggggaaaguauaggggacuaccuuagaacugagagagaaucauuaacucccccuucaaugagcaaaaccuuaggugcagggagagccaaagagccuagcagaccacaaggaaacuucucaauuauucauucaacaaauauuuguuaagcaucucuucauuguagguucuauccucagcacuugacaccaacagacauuuauuuaucacccacuguaugccaagaacucuuauacaugcugagugaccuaaugguaaacaaagcagaacaaccaccccccaaaaaaauaaagcucucugcccuuguuauuugagcagauaaugagaaaacauaaacagggaggcagaggcaggcagauuucugugaauuugaggucagcauggucuacagagugaguuccaggucagccaggacuacacagagaaacccugucucaaaacaacaacaacaacaggggcuggagaaauagcucaguggcugcucuuccagagauccugaguucaauucccagcaaccacauggugacucacaacuguaauaagagauguaaugagagaugauuccugcuucuggugugcaggaagauagaguauauauauauauauauauauauauauauauauauauauauauauauauaacaauaacaaaaaaaagugaaaccacaaaggaaaacccagaacaguaaagcagaugcagggcuuguuggaagauacugggguuugcaguuuggaaagaguaaccugguagcauaagaaacaguugagaaggaccugaagaaagggaaagagagauucuuguagguaugcuaggggaauauugcaggcggagggaagagcucauagauacccugaggcugcagucuauucugagcaacacacuuggaggacaacugggagccugagagauugagaccaaggagacaccagacucacguggacagaguugcaagcugacguccaggagauaggaaagucugaaaaggagucaaucaccagauggagaaagguuggagaccuucugcuccaggcagaaggaccaguuuguguauguggacagagagggaaaaaaaaacacuuugcaauuuucaagacuuaugaauacuuagaaauucaaaagauugguagggaacuuccugguuaggugggggggggggguguugggagugcucaccauuuguaucuaugccaccaacccaggucucugaagccagacuuugugcugauccgccagcaugccuucagcauggcacguaauggagacuaccgaaguuuggucauugggcugcaguaugcuggaauccccaguguaaacucuuugcauucugucuacaacuucugugacaaacccugggugguaaguuacaggaagaguacuaaugcagauagaguuacaggaagaguacuaaugcagauagaauugcucauaugugcaugagggaaucuggagccacucugucuuuucagaagugaagauguuuaaaaguuuaauaugcaaauuagcuuugcaucacuaacaaauacaugacauaaucaacucacaaaaugaaaugguuuauuuuaccucaguuuuugagguuucaauccauguuguguuggcccuguugcugggggguuguagcauggcagaacaucaugguggaagugcacaguggagcaaaguuaccacucuguggccaggaauuaaaggaggaagaaaagaaggagggaugaaagaggagggaaggaggaggaggaggaggagaaggagaaggagaaggagaaggagaaggagaaggagaaggagaaggagaaggagaaggagaaggagaaggagaaggagaaggagaaggagaaggagaaggaagaagaagaagaagaagaagaagaagaagaagaagaagaagaagaagaagaagaagaagaagaagaagaagaagaagaagaaagacaacaaccagggaguuauaauccccugugagaguaccccccagaaaaccuaaaacaucuagguaggccucaucucuuaaaguuucuggggaacaaauuuuuaagacauagaccuugaggauauuccaaauccaaauuagcacuugagauaacaguuuagagacuuaccugagguaaagaacucacugauucaugucuucugguuuucauaguuugcccagaugguucgacuacacaagaagcuuggaacagaggaauucccucugauugaucagacuuucuauccuaaucacaaagagaugguaagucugggagaauggagugggaaagauucagaacuacuguaauguuaucauggcugauaggcugauaucugaguauuauacacaaguucucaaccuguguguuacaacacuuucauagggauugaauaucagauauuuacauugcaauucauaacuguagcaaaauuacaguuaugaaguagcaacaaaaguaauuuuauaguugggggucaccacaaugagaggaacuauauuaaagggccauagcauuaugaagguugagaacuacuaguauagagaauugaagucacuuuauaguugagucuauuauauagccuuuguccagaaugcuuagaaaacauaaaugcuucaaauuucagaguuuucauuuuggauuuugaaauauucguauaagguauuuuaagcaugggacuugagucuaaagauuuauuuuauuuuauaugugugggugcuuugccuauauauguguugauguaccauacucacauggugcccacgggggccaaaaaaaggucaaauccccugaaacuggaguuacagacagugguaagcugucauguaggugcuuuuguguaccaccugaaccugaaccccaguucucuguaagagcuuuuaaccccugaaccaucucuccagccugggacccaaguccaaacaugaaauuaauguuucacauaugcugucuuaaucaagguuucuauuccugcacaaauaugaccaagaagcaaguuggggaggaaaggauuuauuuggcuuacacuuccauguuacuguugaucaccaaaggaagucaggacuggaacucaggcaggucagggagcaggagcugaugcagaggccauggagggauguucuuuacuggcuugcuuccccuggcuugcucagcuugcuuucuuauagaacccaggucuaccagcccaggaauggcaccacccacaauggacccuccacccuugaucacuaauugagaaaaugccuuauagcuggaucucauggaggcauuucuucaagggaggcuccuuucucuguaauaacuccagcuugugucaaauugagacacaaaccagccaguacauaugccuuauucacauaacuccaacuuacucuuuuauuuuauuuuuuauuuuuucgagccaugguuucucuguguagcccuggcuguccuggaacucacucuguagaccaggcuggccucaaacucagaaauccaccugccucugccucccaagugcugggauuaaaggugugcaccaccacugcccggccuuacucuuacagaguauuuuuaguaagccuauguauugacugcuaccuggaacaugaggucacauguagaacaugacacuuguggagcacauaauggugcucaaaagguuucagcauugggaacauuucagauucuagauuuuugaugaggaauguucaaccaggaccacaaauuucccaguaguuacaaguaugaacuaaguuauugaucccaguauuuaucaaaucuuauuuuuauauuauuuacucuuuuuuguuuguuuuuguuuuguuuuguuuuuuuguuuguuuguuugguugguugguugguuuuuuuuuuuuuuuuccgagacaggguuucucuguauagccuuggccacccuggaacucacucuguagaccaggcuggccucaaacucagaaauccaccugccucugccucccuauuauuuacucuuaccaguauuaaauaucuauuucuagugugaauuaauagaauuaacauaauguaucagauuguauuucauguagaaagcauauaauuauuacuaacauuaugaaauauucauucugauagaaauuuuacccguuauuucaaauucagauugccaacaaaaguguucagcagugguauuauaaauuauuuacaaauuaaaaauugaauuguuuauuaucauaaaauauaaucauuacuacaaaugaacaugaaugcuacaagucauuguaauugauauauauuguagauaccaauauuauaaauuaaauuagaauuuuacuagaaauuaaacaaccagccagauauggugaugugggucuauaauucuagcaaugagcggguagaggcaggaggacuauaagguuuuuuugguuuguuuuuuuuuugagacaggguuucucuuuauagcccuggcuguccuggaacucacuuuguagaccaggcuggccucgaacucagaaauccaccugccucugccucccaagugcugggauuaaagacgugugccaccaccacccggcugaggacuauaaguuugaggccagccuggcuacauagaaaucaaauaaucauuacuagcaucaucaaagaguauagguaaguguaucacaaauuaugcuugcauacaaauuagaagugucuucucugaaguauauucaaacagaaauuaucauuacuaauacuugauguauuagauguaacaacuaauacuauaguuuauugcauuuguagcaaacuaagguuaccaauauacaugauuaguacuuaugcuaagaagaaaucaaauuguuaauauuucaguggcuauauggauauugacauuuacauuaugguuacuauaaacuauaagugcuaugguuauaugucaaguuuuaguuacaaauagaaauugaaucauuguuaguaacuccaucaaaguuuacaacuaauuacuaauuuuuccaaugcuacaaguuauauuuacuuacauaaauaaacauuaccaacuuuauggcuuaaauuauaauuaaauaucagugagaaucuaguauuauuaacuuuacuaccaauauugcaaauauuaugguuguucguauaaauuaaaaauguaugaauuaggcuuauuugcagaucaaggcauuagcuuuguuuuauuugguuugauuugaucuuuugagacaggguuucucuguguaaaccaccuuggcugucccagaacuuucuuuguagaccauguuggcuuugaacucacagagauacaucugccucuguaccuuaguucugggacuaaagauaugcacugccaugcccaggcaaaaccauuaggucuaagaaaauccaauuuccucucaaaucuacuuaucucaauuauuauuuauuccuuauucuuugagaaccaguucaguagagugccauuaugagcauagaauccauaacuggaauuucugcguggaaauccuagcccuacaauuuacuacuuacuaacacaagagaauuuaauuagaugccaugcagcucaguuuauccaucaguaaaaugcaggugauaauauuucuugaaucauagaguuggugugagaauuaaauuacugaauaaauguaaaguaguuaaacuccuucaccuagcauaucuuaacugcucauuguguagguagaaguuaucuuucuauuuguaggugauuguuuugaucaugaaagaguguuagacuuugucaaaugcuuuugcuguuuuauugacaugaucauguggcuuuugcucuuuauucuaugaauauacacuauuacauuaauugauuuuucauauaaguucauaguuucauaaauguguuuaugaugugucuugguguaaaauuuugcauuacuaggcucacuuggucauagcacaaauccacugugggauucagauaguauauuguuaaagauuauggugucuguauuuguaaggaguacuggguuauaauuuucuuuucuaauguaguuuggguaucaggauacuauuuuucuuacaaaaaagcuugacaauauuugauucccuucuauuuuuaugggggaauuaauguuauaucuucuuuaaauauuuggugggauuaaucaagaagacaucuaguucaaggauuuuucuguauuuuauuuuauuaugcuggguuacauaaggccauguucaugcaaguauauauuguacuuugagcaucacccucucccaaaucuggcuacucuccccucucacuauucgccccuccccccgcaucaguucuccagauaauuuugauuccauuuuuuuuaaagauuuauuuauugauuauauguaaguacacuguagcugucuucagacacuccagaagagggagucagaucucauuacagacgguugugagccaccaugugguugcugggauuugaacucuggaccuucggaagagcagucgggugcucuuacccacugagccaucucaccagccccuugauuccauuuucaugccauuuguauauaugcaauuuuauguaucuauuuaaaaaucuaggaccugcagaaaaaaaacaugauauuuaccuuucugaaacuaacuuacuucgcuuaauauaauuaucucauuauacccauuuuccugcagaagguauaacuucauuuuccuuuaugacugaaaaucuucauuguguauauaaccacauuucaugugcuucuguugagggauaccuuguuaguuucacaguuuagcuauugugaaaaguucugugauaucuuuuggguaaauacccaggcaugguguagcuagguagaucuaguuuaguuuccugaaacauuagcauaagacccaaaacucuaaaacugauagaaaaaguagaagaaaaaccccacuucauguuauuggaguaggcaagggcuuucuaaauacaacucuagucacucaggaaguuaagguuaacaauugaaaaaugagucuuccugaguuaaccaagacacagccgucagaauaggagaaaauauuuacuagaugacaaaggauugauauguacaauauauaaagaacuaaauaaucuaauagcaaaaacucaaauaauccagucaguagauaggcuacggaaauaagcaaacaguuuucaaaagauaacgucuuacacgcauucacgcgaccggccaggaaagacgcaacaaaccagaaucuucugcggcaaagcuuuauugcuuacaucuucaggagcaagagugcaagagagcaagagcucuauugcuuacaucuuuaggagccagagcgcaagagcgcuagagugcaagagccagagcaagagugcaaaggcaagagcaagagagagaauggcgaaaccccgucccuuuuaaggagaauuauccuccgccuaggacuugucacucccugauuggcugcagcccaucggccgaguugucgucacggggaaggcagagcacaugggguggagaacuacccuuggcacaugcgcagauuauuuguuuaccacuuagaacacaggaugucagcgccaucuuguaacggcgaaugugagggcggcuccccacaauaacguacaaaccgucaccagaaaaaugcaaauuaaaaauauuuugagauuuuauccaugcuaaucaucauacugguagucaucaaugaaacaaauaggccgggcagugauggcucacgccuuuaaucccagcacuugggaggcagaaguaggcagauuucugaguucgaggccagccuggucacagagugaguuccaggacagccagggcuacacccccccaaaaaaaaaauagaaaaagaaagaaaagaaaagaaaagaaaagaaaagaaaagaaaagaaaagaaaagaaacaaauaacaaauaaaacccuggcuagccuggaucucauuauauaguccaggcuaguuuugaccuuaaugcaagaauuucagccuucuaagugcuaggauuacagauaugagcuaccacauccagcuuuuucuauggaaaauguucuaacuuaagauucuaauucauuuauuauauauagaucuauucagauuuuuccuuuccucuaaagucaguuuuuuuuuuuuuuuuuuuuuuuuuuuuuuuuuuuugagacaggguuucucuguguagcccuggcuguccuggaacucacucuguagaccaggcuggccucaaacucagaaauccaccugccucugccucccaagugcuggcauuaaagucaugcaccaccauugcccagcuaaauucaguuuuagaaguuuguguuuuuauagaaauucauucauuucauuuaguuuuauaaauuuguuauaccauagccuguauuacaauuuuuauuuccauaaauaaaaaaagcaauguggcuuuuauccuugauguuaguaauuaagaguuuuauauauguuuccuuuguuuaaaggaaaguugagacgcuuuuuuguuuaaaagcgucucaacuuucuguauuauguauuuuucuuaucuuuuucaucacuucuacucuaaugcuuauuaauccuuuucugcuugcuuugaauuuuguuuuucuuccuaauuucuuaagauggaaggaauuucuuaagaugauugacuauuuuaucuuauuuguucauuuauuuuuauuuauguuuuuauuuauuugaagguuuuucuguguaguccuggcuggccuagaacucacucugugaaccaagcuggcuucaaacucacagauaucugccuaccucugccuucugagugcuaggauuaaagcacugggcccuugccaccuggcuuuauuuuauuuuuaauaauuuuuaaaaaugaagauguauuugugcaugugaaugcauguggcagcacaggccagaaggcuucagaucuccuacagcugacguuacaaguauuugccauccaccuaguauagguguuggggacugaacucugcuccucuuaaccacuaaaccaucuuuccaggccaauuuuuaaaauuuuuaauuguguauaugaggagugucuauggaagggaugguauguauuaaaaauaggcuuugagagcugggcacaguggugcauaccuguuaucccaacacuaaggaggcagcagcaggaagaucucuaugaguuugagcagugcggcauagauugagaacuugucucaaauaaaauaaagauaauaaaauaaaaauagacugugauuuaaaaaaaaaaaaagacugcauuagaugacuuugcccaacuaaaaucuaauguguuuaagaauauugauaguaaacuagauaaugcaagguaaauuaaacgcauuauauacacauuuuccuuuguaauacugggauugagccuggggcuucacacauucuaagcaagaauucugucacauaugccuuauaacucaaagucagucuuauacaauauuuuuguaaucccauguuuugcuuuuguuaggguccaagaacugccaaagaaugauacuccagacucaacuaguaugcaaaaaaaaaccccaaagaguguuuauucaucagaauuuccuucagcagucucccccuuugggaauggagaccaagguguaugcuuugcaagaucaguuuaaagccuguuagggguauggguguuuuugugauugguuaacacucuggggacuuuucaggguagcaagguguccuugaauuggcugccugccgcugugguuggcugaccauguguuccuggauccagauucucauuucuaggaaacagaaauuuaggccuagucuuccaaacugccaguuuucagccuaacauggaguuagcuuggcucugacuaacucaguccucucacuuuauguauuuuggagcucuguuguuacuggcauauuuguuauuuguuguaucuucuuaaugauuugaucuuacuauaaaauacccuuaucucuaaugacaaucugcuuaaaugucuguuuuaucugauauuuguauagccauucuaucucucuuuguuauuauuuauaugguaauuuuuuccaucaauuuauggucuuucuauuuuuguauuuaaauauaaaacaugugucuugggcuagcaagaugacucugcaguuaaaaguacuugacaccaagccugaugacucgaguccagccaggaucuacauagcaggagauaauccacucccacaaguuguaccaugaccuccacauggugcacuguagcaugugugcagguaucagugcacucgcucgcgcgcgcacacacacacacacacacacacacugaauaaauaaaaggguguuuuguuuuguuuuguucuguuuuugagaacuuguccagcuggguguggugguacauacccagcacucaggaagcaggggcaagaggagcuuuguaaauuugaggauagccuagucucuacauagcuccaggacagucaagaccacauagagagacuaucucaaaauaaaagaagaauguuguccauacacacaaaaaauauuaaaaauaaauaaauuaauuaauuaauuaaaugugucucuuguagacagcauauaguuaagucauguuuuauauuccuuaugccuuuuuagaaagauuuuauuuuuuaaauuuuauacacaugagcauuugccugcauguaugauggcagcuauguugguacuaggaauugaaccugaguccucugcaagaguagcaaaugcuacugagccaucucucuauucccuuccugcauuuuaaauggaguguuuauuuucauuuaaccuaauuacuaguaaguuagaauuuaugcuugcaauuuuccuucuuuuauuucuuuuuucuuuaagacggagugucucuuuguaguccaggcuggccuugaauucacaauguagcccagacagaucuuaaacauaauccuucugccuuggcccccuaggacuaaaagcacauuucacagggucucacuauguagcccuggcaauccuggaagucacuauacugacuaggcuggccuucaacucagagaucugccugccucugccuccugagugcugagauuaaaggugugcgccaccacauccagcaacucuuuuauucuuauguuuacaauuuugagggcuuuuuuuuucaauauuugcuuuuucaaacauauaguuuuaguauuuuuccuggggauuauaagugauuucuuaacuuauacaacucuaauugaaauuugagcagcagagaacgugacaagucagagaaagauuugacagaagaggauaugcccaacucacaaaaagagagagagagagagagagagagagagagagagagaggaaagggaagcuacuuaagagauacuuccauccuucuuagaauggggagcaaaauacccauggaaggaguuacagagauaaaguucagagcugagccuaaaggaaugaguaugcacagacugccccacuggggauccaucccauaaacaaccaccaaacccagacacuauugcauaugccagcaaaauuuuguugacaggacccugauauagcugucuccugugaagguaugccagugccuggcaaauacagaaguggaugcucacagucaucuauuggauggaacacauugcccccaacgcaggagcuagagaaaguacccaaggagcuaaaggggucugcaacccuauagguggaacaccgauaugaacuaaccaguacucccagaucucaugucucuagcugcauauguagcagaggauggccuaaucagccaucauugggaggcgagucccuugaucuugcaaagauuauaugccacaauacaggggaaugccaggaccaggaagcaggaguaggaggguuggagagcagggcggggcgggggggucuauaggggacauuuggaauagcauuugaaauguuaaugaagaacauaucuaauaaaaauuguuuuugaaaaaaagagaggcagcgaagagagaggaaagaaggcaauuuuacugaacagguaccgagacagguugcagaaaagagaacaagcucgacacagauaaagacaggacaaaccggagaaugagaaugagccagaauuuuaaaacaaauugccaguguuauucugaggccaagcaaaguaauucaggagaaacuaaagaagccagauugagucagucagcuuggagaggcguuugagcccaaacagcuuaguugaaagcagccagcuauagcugagaaagagcuaaggagugagcccauucagcaguaagucucagaggcugaaaacacucuaggccuagauuagacuguacaaaggccagaagcuuccaggccuaggucuagguugcauacagaggcaguaagccuuggagaccacaguuacaucaggugaauaaaaguuaccuuuacacuuuaugauacuauuagcauacaaauaacaucuuugccaauugugcaccaaagacuauaaacauaauuauacuuuauauaguugccuuuaaguuagggaagaaagaaguauaucaaaccaaacaaagcauucauaucauuauuuguauuuaccagcaaagacaggcuagguagaacaugccuggaaucccaacauuuagaggucacaaccacagcuaaauagaguucaaggggcuacaagagacuaaauaaauaauaaauaaauaaauaaauaaauaaauaaauaaauaaauaaauguguguguguguguguguguguguauguguauagauauuuuguguacaugugugcauauauauaauaccuguaugguuaccauuaguuguucuuuauuucuucaugaagauucaagugacuagacaauauuucauuugacuguuuuuauaggauagauguacuaaugauuaaucauuucagauuuuaucugauaucuuuauuucuucuucaauuuugaaagacaauauccaaguuuuuuuaaagauuuauuucuuuauuaugucuaaguacacuguagcugucuucagacacaccagaagagggcaucaaaucucauuacggaugguugugagccaccaugugguugcugggauuugaacucaggaccuuuggaagagcagucagggcucuuaaccgcugagccaucucuccagccccaauauccaaguuuuauuucaauugcuaugauaaaauaccacaacaaaaagcaauuaguggagaaagauguuuauuuccacucacaauuccagguuauaguccaucauagcaucuaagucacaauggcagaccuugaaacagcuagucauauccauaaucaaaauagaaagaaauaaauguauccaugcguaguacucagcuagcuuucucugcuuauacagcccaggucccuaaaccaaagaauggugcugccaugcccacagaccagccugaucuaagcaauuccucagugcgacucucuaccuagaugaugcuagauugugucaaguugacaauuaaaacuaucagggauugcauugcaggauacagaauucuugauuuguauaggccuuuccuuucagcacuuuguuauuucacugccuccugacuuccaaaguuucagcuugcuaaucguauugagaauccuuugagcaugauaagucauuucuacuacuuuuagacucuucucuuugacuuucauaaguuuguuuguaaugugucuagugaguuccaggacaaccaggacugcacagagaaacccugucuugaaaaaaaagggggggauuuacuaauuuacuaauauaccuuauuuauuaagcauauguuguuacuuaucuaaauguucuagcagcuugguguugaauagauagcaucuuaaaucaguuuuuguuaaucugaauaggccuuuauaaccuuaauauuuuaucgucauauacaguauagucuaaaccagaauuaaaucacaaauacaguauguuguaguagauauaaccauaaaucuguaucaucauacacaaguccauaucaauccaagguauuugagacuuauuguugcuucuuuagucuaaaaugauaaacagauaaaaaaggacugacaguuuuacaaauguugcuuuauucucugugaucaucuuaagguggugaagucacauggcguauccuccuuaaccuuaguaaaaauaguugccagccauguggcugcuuauauccugaugaggucaccagauaagauggaagagagccacauaguugcuauuuuaaaaauaucuauuuuccuaacacacauacacaguuuuuaaugagaguugaauucaagucacuuacacgcagaguugaauccaagccacauccauacgcauauagacuugaauacaaguuacauauauccuaauccagaguugaaucacauauguauagauuuuuuauaauaagcccuuuguuucaaguuuaaagcuaaauuuuguuacagauuuuauagcauacccagugaauuugcaaauccugagauaagagguuacagcauaaucuuaacagauuuuuuuuagaacaaaguacaaaggaaucauagagauagcauauuuuuaagagugggaaguagaaaaaguguagaacaaagcaagauauauaagauauuuagggaucauuuuucugugcaguagcacuuguuaacaauuugugaaaauuuugaaauugaguuugccaauuuuuuuacuuuuuauuauuauuuuuuuuugccauugaucuguacuaaggccaagcuguuguaauagaaucugaguccagggagagacagucaaaaaacugaacacuaugcuaguguguuccuagaaacuccaagauggagcugagagcugaugcugugggauugcaggcuggagccagagaugagcaggagagaaggaagacauccacaugagugcagaaggcugcaagagccagaaaagcauauaggugcccacauggagggcacagcaggucagagcaaagcagcagcugaaggauuggacucuagaauuggaauaaaauucaccaacaaacuguacacacuuuaggaguguuagagugguacuuuuguuugcuacaggggcgaauagcuacgugcugggugugugcaccugcagcugaccugcuccauugcuuuuuuucugcuccuuuugguccagcuccagcucccacuuugcaacaaacuuacagauccaucaaccauaacuuaaagacaggacuuuuacaacgugugugggagagaguaccagacacacacacacacacacacacacacacacacacacacacacacacacacaaaacaggaccugagguggaaaaaaaaagagaaagaaagaaggaaugggaagucuuuauuccauucugaucccuuguaauauuuguuaggauccaagauaauauugggauuuaugguaccauuagguguccauauuuguauugguuuccuaagggguauuaagaccagauucaaaagguagauauguuuagaggcccuugagucaaagcacuaaguggauaggauguucuccaagagguaccucauaggugaggcagaagaggaacugaaugaggaaggcacaaaccaaacagugggccauugccucacaauugagggcauagccagggguuuagccuggcuaagcccaaggagacacucaguacaugguaccaagacuuuucaaaugaaaccaaaaggugaaaacugagcuaaaaaaaugaagccucacccaggggaaagagucauaaguaggcacuuccacuuccaagauuaccagagacuugggaagcauuuaagccaaaugagagggaucacucaccaauugccagugauggauggaaggccaaccgauuggugguccaaaagguggaucuguugcaggugaaacagguggguaggguuccaguaugguuuggacugcugguaguagggguuggggaguagaguggggugguacuggggugguggugagugcacaggcccaggagaaccuacagagucaucagcaccaaugauaggacuuagcagcagggugucuuggcagauggaagccaagaaaugcugcagcagagauggcaccacacaguagaucucaggcaagagguuuguagaggguuguggaagccaucagagugggcacacaagagagagagagagagaacaagacagacagacagacagacagacagacagacagacagaggggacguuuaaaggguuggugaguaauaaugacauaguuuagcuacuggcacugaguugcugaaggcaggcagggggaaggcuugauuucugacagucccuguguuuauaccauguuuugucauuucuuugcauagcucguacauucuuguugaaacuguucaucuuaaucuuauguggcaacucaggaauaguuuauuccacacccagcccaaacauauuucuguuguguuuuuagugacuuuccugaacugauuauuuaaaguuuaaauuauuuaucaugugcagccauggaagccucuacuccauuagugaaccacucuuuuuuuuuuaauuauuuuauuuagguuccaacugcuacccuccucccaguccccacuuccacuccuccuccccuugccucugagaggguggucuacccacccaccccacccccacccccaucccagccaccagaccuccccacucccuggggucucaagucucucaaggauuaaguacaucuucucccacugaguccagaccaagcaguccucugcuguauaugugcugggggugcuucagaccagcagguuuuaugcugccuggugggugagugagccacucuuaauugagcccauuuucuuuuuucuuuugagacggagucucacuguguaaccccaacuugacguaaaagccauacaauucuccuguuucagccuccugagugcugagguuacagguauaugguaacacaucuggcuagauaauguuuagacaucaacaccuuguugaugagcuuguugugcguguuauggcaugccuuuaaugcccuggcauacuauuuacaacuuuaccucugcuuguguagagcuucgaggucagccaguugucauggaaggcuuuggaagauuuccagcccugcuccaucucauccagugguugcucuaaugucaaaaggcaaaauuacaacaauuuuuaaauuauuuucuaaaaauucuucucucauaaaauagguaucaacuguaguuccccucccucugcucccaccagccccuccuccuacccuccccucucccccaauucacucccccuguuccccuucagaaaagagcaggccucccaauuuagugauucuaauugacuuuauuuucaauucuaaaagcuggcaacgcccuaagaaggagauuaauuuuauagauauuaaaaaaaaaaaaacaaggaaagcagaaacaagagacaaaaucuaguagccauuucaaauuuacucucuuuacaagcuuggaguggggagauagagccauagaaaaauuagugguuaagaugaaauuacuucuuaacuauuuuucaaaauaggcucaugcuauguacuuguuauguagcaaaggaugacuugaaccucucaucuuucuguaaagagaguaaauuuggggcuucuguccauugccugggugcaaauaucagcaucugacucuuucagcuguuuguugggucuuucagaaggcagucaugauaggucccuuuuugugagcauuccauagccucaguaauagugucagaccuugggaccuugagcuggaucccacuuuaggccugucacuggaccuucguuuccucaggcuccucuccuguaauucuaucagacaggaacaauuaugugucagagaugugacugugggauggcaaccccaucccucacuugaugcccugucuuccugcuggaggugggcucuauaaguucucucucccuacuguccagcauuucaucuaaggaauugaugaguccugagagucuuucaccucccaggucucuggugcauucuggaggguccacucaaccuccuauuuccugaaguugccuguuugcauucuuucugcugccccucaggacuucagucauuuucccucacccaauaccagaucagguuucccucuccccaccacuccuccccugcccccaucccccaucccccaccccccacccacauccacuuuucuucccaggucucucccucccuccccacuugugauugcuuucuucucucuccuuagugggacugaggcauccucacuugggcacuucagcuuguugaccuuuuugaguucuauggacuguauuuuggguauucuguacuuuuuuuuuuuugcuaauaucuacuuauuagugaguguauaccaugcacauccuuuuggggcugaguuaccuuacucaggaugauauuuucuaguuccauccauuugccugaaaaacuuacaauguucucguucuuuuuucuuguuaagcuuuauuuauuuauuauauguaaguacacuguagcugucuucagacacuccagaagagggagucagaucucguuacaugguugugagccaccauguuguugcugggauuuaaacuccggaccuucggaagagcagucgggugcucuuacccacugagccaucucaccagccccgauguucucguucuuaauagcugaguaguauuccauuguguaaaugaaccacauuuucuguauucauucuucugucgugggacaucuggguuguuuuccagcuucuggcugucacaaacaaggcugcuaugaacauuuuggagcacgugccccugugguauggaggggcaucuuuuggguauauucccaagaaugguauagcugggucuucagguagaucuauuucaaucuuucugagaaaccuccagauugauuuccagaaugguuguacuaguuuuuaaucccaccagcaauggaggaguguuccucuuucuccacauccucuccaacauguguuguuaccugagguuuugaucuuagccauucugauugguguaggauggaaucucgggguugguuuuuuguuuuguuuuuaucuuuugguuuuuuuuuguuuuuuguuuuuuguuuguuuguuuguuuuugagacagggguucucuguguuccccuggcuguccuggaacucacucuauagagcaggcuguccucgaacucagaaaucuggcugccucugccucccaagugcugggauuaaaggcaugugccaccacugccuggccucagagucguuuugauuuguauuucucugaucacuaaggacuuugaacauuucuuuaggugcuucucagacauucgagauucuucaguugugaauucuugguuuagaucuauaccccauuuuuuugauuggguugugugguuuuuuuggugauuaacgucuugaguucuuuauauauuuuggauauuagcccucuauaucggaugugggguuagugaagauuuuuucccaaucuguagguugacaauuugucuucuugacuauguccuuugccuuacagaaacuuuccaguuucaugaggucccauuuaucaauuaauugaucugagagcaugaaccauuggaguucuguuuaggaaauccccgcccccccucccccgccccgugccaaugaguucaaggcucuuucccauuuucucuucuauuagauucaguguaucugguuuuauguugagguccuugaucuacuaggacuugaguuuuguacaaggugacaaauaugggucuauuuucauucuucuacauaaagacauccaguuagaucagcaccauuuauugaagaugcuuucuuuuuuccauuguauauuuuuggcaucuuugucaaagaucaaguggcuguaagugugugguuuuauuucugcgucuucaauucuauuacauugaucaacgugucugucucuguaccaauaccauacaguuuuuaucacuauugcucuguaguaaagcuugaggucaggaauggugauucccccagcuguucuuuuauuguuaagaauuguuuucacgagccgggcgugguggugcacaccuuuaaucccagcacucgggaggcagaggcaggcagauuucugaguuugaggccagccuggucuacaaagugaguuccaggacagccagggaaacacagagaaaccgugucuuguaaaaaccaaaaaaaccaaaaaaacaaaacaaaacaaaaaaaaaacaccaaaaaacaaaaacaaaaaacaaaaaaacaaaacccucucaaccaaaaaagcccaaggccagaaggauuuagugcagaauucuaccagaccuuaaagaagaccuaauaccaauuuuccucaaacuauuccauaaaauagaaacagaaggaacacugccuaacucauucuauaaagccacaauuacucugguaccuaaaccacacaaggaccuaaccaaaaaagagaacuucagaccaaucucgcuuaugaauaucgaugcaaaaauauucaauaaaauucuugcaaacugaauucaagaacacauuuuuaaaaaacaucauucaccacagucaaguaggcuucaucccagggauguaagguugguuuaauauacgaaaauccacuaauguaauccacuauauaaacaaacucaaagaaaaaaaaucacaugaucauuuccuuagaugcagaaaaagcauucgacaaaauacaacacccuucauguuaaaaguauuggagagaucaggaauucaaggcccauaccuaaacauaauaaaagcaauuuacugaaaaccaacagucaauaucaaauuaaauggagacauacuugaagcaaucccacugaaaucagggacaacacaaggauacucacucuccccauaucuauucaauauaguacuagaaguguuagcuagaauaauaagacaacaaaaagagaucaaauagauacaaauugguaaagaagaaauaaggguauuacuauuugcagaugauaugauaguauacauaagugacaccaaaaauccuaccagaaaacuucuccagcugauacacaacuucagcaaaguggcuggauacaaaauaaacucaaauaaaucauagccuuccuuuauacaaaggauaaacaggcugaaaaagaaauuagggaaacaacucccuucacaauagccacaaauaauauaaaauaucuuggaguaagucuaaccgaaaaaucuuauuaaauguuuaguuuuuaaaaauaugcugauuuuauuuuaacuuuuuacauuuacuccaaauaauaaagaguaaaaaacccugcccauuauuuuucuaaagcauuuauaaaauugauagcacaaaauuaaacaauauacaauuuuacacaugaauaucaaugcaaaaaucuugaauuuuaacuaauaaauuaaaauauaaaaaauaacaagaaaauauuaauuuuuagacucuucaguacccuuauccaugugaccugcuaucagucuugacacuguacacuguauuuuggccuuguuuuaucuguuugcuuuauugcuucuuugccacuuugcaauaauaauaauaauaauaauaauaauaauaauaauaauaaaauuaagaagagcacuuauggugcuucuaaaggauuaucuuaaguuccagauaagccuugucuauauagugaguauuaggacaacuugggcuauagagugaaacucugucucuacaaacaaaacaacaacaaaagauagaaagaaggaagaucaagagaguuucuaagaacacaagaauauuucauuuaaauuaauguaguacaaucacgcaguauguucauaaauuuuaggagaaaauucuguuauuuccauaguuacuuaggaaacuuuuagcaguuuaucuuaauaaaagcauuuaaaauagaaauuaauuggcagugcuuuaucaugauaaaaucugcauagcucaguucugcgauuaucaccguaauagacaacacuaaagguguauucaguaauaucaggagcaaggcaaagguguucacugucucugcuucuuuuugaaacuuuuauagaaauguugaacuaauguauuuagauguaauacaaaacaacuauagccauaaaaaugaguaagaggacauuugacaaucuuuuuuugguccaggaauuuaucuuaguagcagaguacuugccuagcauguaugaaaccccaaguuugcauggcagugguggcgcacaccuuuaaucccagcacuugggaggcagaggcagguggauuucugaguucgaggcuagccuggucuacagagugaguuacaggacagccagggcuacacaaagaaacccuggcucaaaacaacaacaacaacagcaacaaaaacaacccagaugugauccccaaaauaauaaaguaucuguguagaugauaugauggcauaccuagaaaacccaaaaagaaccaauuauaaugcuaaacugggcaguaugauaauguaguagcaacagagcagaauguaugaugaaaaucauucguuuucugauauacaauuaaaaauaaaagauauauuagaaaacaguauucacaauaacaacaaaaauauuuuaaauaccuaaaaaguuuuaucuagaacuagaugaguugauagaaguacacauuggagaguaaacacaaaagaaugaccaagagagcucugacaaagacaaguucagaggagauacugacucuacccacuuacagggaaucuaauaccucugcuaccaaacgcaucauaagacuuuuauuauuuaagucguauaaugcuucacagaacaaacagacugacacgcugugguucaugugaaucacuccccacacacaucacugccccaccuagggauccauccuauauacagucaccaaacccagaugccaagaagagcuugcuaacaggagccugauauagcugucuccugagaggcucugccagugccugacaaauacagaagugaaugcucacagccauccauuagacggagcacaggguccccaaugaaggagcuagagaaauuauccaaggagcugaagggguuugcagcccauaggaggaacaacauuaugaacuaaccaguaacgcucagagcucccuaagacuaaaccaccaaucaaagaaaacacauagugggacacauggcuccagcugcauauguagcagaggauggccuagucagucaucaauggaaggagaggcccuugguccugugaagacuugaugacccaguguaggggaaugccagggccagaaaguaggagugggugggugaguggguggguuggugagcagggggagggagaggggauaggggauuuuuggaggggaaacuaggaaaggggauaauauuugaaauguaaauaaauaaaauaucuaauaaaaaauucagccaggcagugguggugcacgccuuuaauaaucccuugggaggcagaggcagguggauuucugacuucaaggccagccuggucuacagagugaguuccagaacagccagggcuacacagagaaacccuggcuugaaaaaacaaaacaaaaauaaaauaaaauaaacaugcagaacaacaacaauaaauauaaaaggcaauggaccagaucuauauacauaugaaaauguagcuuaugauaacaaugacaaugaccagagaaaagaggugcuuuauaguacauuauauuuugcauugauacgcuucauucaucugaaauagauuuugauaugcacuguguagcaguacuguaguuuguucuggaagugcgugcuugagggaaugaucacaugacaaaacaggaagccaggagauucagugacuaggcucauccuuuuuauaacaaccuaucuagggaacuuaccaaggucccaugaggacuacauuaaugccuuccaagcacuguauccccaagggccuaaccaccuuccauuggacccucacaucuuaaaaguuccaucccaucagcacaaccacacuggggaccaagcuuccgacacacaaaccucuggggacacacaagcuguauccaaaugguagcagguagguagguaucaguucacucuuaaccuucaaauaacuaguuuuccccuacuaguaugccaccccuuucauaaauuaacauuucacauauaugugaagaaggucuugacucugucuguucuccuuaucacuuucucuguaguuauaucagucucaaauguuuguucuuuuguuuguuuauuuauucuaugagacagggucucauguuauccaggcugaccucaaacuccuuauauagcugggcauggugguacaaaucuuuaauuccagaacucaggaggcaaaagcagaaggugcucucugaguuuaagaccacucuggccuacauauuguguuucagaacaaccagggcuauggagagagacccuuuuuuaaaaaccaaagggaaaaagaaagacaacuccuuacaugucagagguuggccuugaacucuugauccuucugccuugacuuccaaccugcuaggauaacaaguguaucccaccacaccuggcaucacagcaucuuaacaauauuuccucauucauuucugauaucugcuuggacagccauacuuccuggcuccuugugcagagguuauuuugucaugcacagagagcaggauuucugugccuggcaaacagacaaaguuaaaaguuuaagugcaguguggcagaggcauuagacucccccauagcacagcuuaccaggucuuuuccucuuuuguccaccaccucauugugaaccaugaaggaucaaaagcuaggccuagauauucacuguacauacugcaucaggaagcuuugguguggaugcccaugcuacucuaaacucaaugucccaccuguuuccaggcagaugcgggaugguaggaauccucugaagacugucuagcucggcuguaccuaaguggucaaaaguggaauguagaguuaggcagaggaagauucccauaagcguaauuggauguuucuucaccuccacucucuaagccuugugauuuggucaugucaauuuugucacacagauuugaggugguuguugugaaaauagggaauuccuuucuuuugcugucucauaucaacaaauaguuacugagagcucauguccaaucccaagaccucucuagcucuagucccuucccugaguccaggauccuugcuuuccauaaagaaaguauacuuugagguaagaauaaacagugucaggaaugugguaauuugggguuggggaagaagacaagagugagugaggaauuaaaggaaggacagaggugguguguugaugggugggagauucuuuuggguggucagugguuuuugcuauuuuauuuuaaaacagugucuaacuguguagagcagacuggucuugaacauacagagaucugucugcuucugucucccaagugcugggaauaaggaacagauggccaggaguagggaaacaggaauaggggaacauagacaaggaagaggacauaggguguaguagaguguggggggugggugggggggugaauaaagggucacagcaggggguugagaguagggacugugaacaaggaagagauggcugagaguagggaacagggauagggagcagagacaagaaggagcaaaugaggaagaacaaagacugccagggagcagaaauaacaagggacaaacuagaacacccagagaggaaauagauggcugcaggcaugccauucagggacgaaugguaucuuuucuuaucaguauucaagaaggccuuuuauaugcuaccccugaacccuuuccaaggacucagcucugagccuuguggaaugcuucuugucagccacagaugauuguggagagaagccauaccccacugaucaguaaaagcaugcccugguaugccuuggcuacuaugcaugauacccaagucaaaaaauucuauccacuauggguuggggacaaauuuuucuauugcaggcuaaaauuaaaaacccaguaacauguguuggugacagaaguaggguugaaauggagacuuuguucugagagaggccugaggauacggucuccugaaugugagcagaucaauugaacuacaaugagaaauuaauuuuuaaaggaaggcaggauucauggcaggagccuagggcugaguguuuggaagacaggugggagcaucuggugucagagaggggcuccuauauugagguagggagccaauagacacuugagaagggguuccaccuccaucagaaguugauagagagcuccacaaagaacucaucaggaugcacaagcucgauggaagguaaguuguccacaucugggaggggcagccuagacauugcugccaggaugaaauaguucauucuacuuucucaggggaccagggcagcuuccacuggaaccaggagcuaguuuguagagaauguaucuggagcuuuaaguacaucuuaaugacucucaaccaaucuucuuucuuauuuuuauacuacuuuuuucuuuuucauucuucuuuccuuccuuucuuuuuguguaauacuggguaucagucucaggggcuuguacuaggcaaguuaucuacuaccguugagcuacaccccucucguugcuuuuuauuuuuugagacaaggucucaccacauaguccagacucaccugaaaguacaaauccucuuuccccagucuuuguuuguuuguuuuuguuuuucgagacaggguuucucuguauagcuguauaguccuggcuguccugaaacacacucuguaggccaggcuggccuugaacucagaaauugccugccucugccucuccaagugcuuuaagugggauuaaagguguucgccaccacugccugaacucccagucucuuuuuuuuaauuucacauuuuauuauuuuaaauugugugguuuggucaggguauguguauauuaguguaggugccugcagaagcuagaggaguuagauauuccuggaacuggaauuagaggugguuguaagccccugucaaacccaggugcuuugaaaguauaugcucuucaucacugaaccauuuuuccagcccccugcuucaaucucuuaacuuguagaauuacaggcaugugacaccuuuaacugacuguaagucuuucuuuaaaaguauuuuucuugaaaguauauauucaaguguguguaugacauaugaacacuuuagaggaugcacauggaggccagagaagagcauuaaauauguuccucuaguagucuacaguuuauuccuuugaugaagggucuuucuggaagaaaacuuggagauccucuuuucagcuaggcuggcagucagcaagccccagcaauccuccagucucugcuucauuggugcugggcuuacagguaugugcaggaucaugccuggcuuguuaugugggugcugggaucagcacuccggucuucaggauuguacagcaaagugcucuuagcuucugagccaucuuccuaacccuucuaaacucucaaucuccuuuaaacaaagacaaacuccaggugugugcugcaugaauuagaugccagcacuugggaaguggaggcaagaggaucaggaguuccaggcaagccugggcugcaugagacccugucucaauuaaaaaaaaaaaaaaaaaaagcaaccaugucaagacauaaaguggauguggcggugcauaccuauaagcccaccacuuuggagauaaaagaaagaugaagagucagaggucuuuguuuuuaauagcuaaauaguacuccauuguguagaugugccauauuuugcuuuauccauucuucacuugagggacaucuagguuguuucuagccauccccuuaacucagcugucuugucuggccucagugggagaagaagcaccuaacccugcagagacuuaaugugccagggugccuccacucucucagagaagaagaggggagauggaggaagggacuucuccagagagaauuugugcuguuguuuguuuguuuguuuggguuuuuuguuuuuucaagacaggguuucucuguguaccccuggcuguccuggaacucacucuguagaccaggcuggccucaaacucagaaaucgccugccucugccucccaagggcugggauuaaagguaugcggcaccacugccuggcagaauuugugcuguaaucauuuucuuuguggagcuugacuauuaauaaaaaguggaaagacugugcuuuauauaaauaaauuucucugggcgagugauguaacucaguauagaauacuugccaagaauauucuaggcccugcguugaauccccaguaaaacauacacaaacacaaauugacuucuccaucugucacuggauaauggggagaaaugguuuaccauauggggguauauguugggaaauguucuagcagggguauuuuccauauggacauaccuaagaucagaaauguaucaaugggggucaaucaauagaaaguauauauggauagauaaggauuuaugaauagaaggauuuuuaucaggauuauuaaugaaauaauuauuuguagugguauuugucagugacaagauugagagcuuauugaggggacuuggaaaaauauggcuggggaggcuuaucauuccuaacucaaauggagaaauaugcuaguaggucacaauuuguuagugggaaaauuugccaacaaagauugcaucauagacagauagucauaaagagauauuugucagcaagggaggugccaacaggugaguaauuauuaagaaagauacuuguggcugagguccaucagcaggcaguagauugcugcugagcauuuguaaauagaguuguuuguuauaucucuauagguuaacuaauggggagguauuuaugaaauaguaauaaaauauuauuucuuagugagguauuucugacagcagauuauuuccuugaggaaaagggccuaaucaaaggaagaauuuacaagggcuucgaguuuuagcuucuguagccuuggcaagaguagagauuuuucaaaguagggauuuguccacaaugaggauugcgcagugaguaacaguaccucauuugugagguugauguuccucagaagucuuugagaauguugauacuugucaaaggagagauucacagauuugcacaauagaaagcaacauauacagccaggcaugguggcgcacgccuuuaaucccagcacucaggagacagaggcaggcggauuucugaauucgaggccagccuggucuacagagugaguuccaggacagccaaggccacacagagaaacccugucucaaaaaaucaaaaaaagaaagaaagaaagaaagaaagaaagaaagaaagaaagaaagaaagaaagaaagaaagaaagaaagaaagaaaucaagcaagcaagcaagcaacauauaagcaccauaauacaaaggaacauauuaaguaucuguuacauucugagggagauugucacaaucgugaauuaagcugaacuuaauuccagggugcauuaaauuauuguuacuaauacuauauauacaucguuuucaauaguuuguuauuucuaauaucaaacacaauguauaguauuauaauaaucauuauugauaauuaucacuacugaaguuguacauccaauucuauuuacugugacuacuuuaagcacuacauuccuagcacuacuuuaugcacuaugcauguuauuucauucauacagccauuguucuaaugaauuaggcauguuuuuaugcccauuuuguagaugcagaaaaugaagcacaaacuagcaaucugauuuccccaagaauacaugcaaggagcaagauuagaauguagaugauccaacuucaggguuuaugccuguguagaaauuaggucacaguuauuaauauuauauauuuaguuauugauauaaaauuuuuaugauaucuuuuucuacagggcucaggcugggggccuaacucaggccugguaccuguuaggcaagugcagugacacaucuccuuccugagagguucugccagaggaccuaaguucaauucccagcauccacguagcaauucacaacuagccagaaguccagucccaggugaucuaaugcugauuccuugggcacagacacacaugcaagcaaaacuacacaugcacgcaaaauuauaaacuggaaaaaaagggagaaaauuacucuugcaggccucagggacaugguguaaauggggcuugaggaaaagaaaaaaggaaaacauacagaaacacagacacacauacacagaaaaacugauuggaugguucaggcucucugauggcaaaagcacagcccucuucccucuacccccaucucagcauguucauuagaugucgucggacagaaagaugggcuuauugcagacagcugaacaaggagauaguguuuaugguauacaguuaaaucaagaaggcaaguuuagcuaaucuugauaggauucgucuuuacagggauagucuucaggccauaaacauggggagagagagcuacagugaacauuuucugcacacacugucagcauuugcacucagacuccugaggaaggcuuugccaucccucugagcaucacuccgggaagguuuugcuacucccauagggcugagacacuggaguccccgacaauucauaccuaugucagcagcauacauuuuacucagaaccucauucacucacucagcacagggcaaugacacuuuaccugucaacccuuacuaaucuaaagggucuggguaaggacuauaauucccaguuuugaaagagaaggacugaggcucaggaaagggacaaauuccccaggucaucaacuggacuggauuagcagagcugugacccuacacaugcgcuuaaucucagcugugauacaaauuucucaaagaaggucacaaaugaauacacuggcuuuuaaaugguuuuucuaggaaagugauaggagauagagacucccagaacuauaaauacugccaagagcuugugccaggucucugggggaaaugaccuuauauacucuucugaacucuguguucccuggagugcuugucagcccuguccaugcugcacuggugccauugcaaucauuaccagggugucccccaacaaaucugcaaugccugugugcuggucauggagaugaaccauucuggagaugguuucagggaacaacuucugcuuuauugcauugagaaacugcuuauauaguagaagccuauagacuaugauuaguuagaacauugccucagauuggacaaugagcacucauaccaccaggaucucuauaccaaagaagcauauuaaaggagauguggagaguacagacauaucaacaggccagcuacuggcuacuaacaguaguucagaauucaaugaucggacuucugagaaaauucaggaauguaauguaccaccaugcuucuuacuuagaaacagcgugguaugccagguggcugaccaucaggucauucuugcauuuucuccuacauaguaggucuggauacaggugcuugacagguugguagaagaauggcucucaguaucuuuauccucccccuacuaccuucugcuuccguccaagagcuaaaauaguugaggguucuaaggaacacgacugaagucaggaaucucauugguguucagggagcuaguacuagaguuuggugacuggucagaagcugccaaaaucuuuuaagcaccugaagcaaugucaacaaaguucccaaggccaaaacaggaccuagaccucugucuggcaguccuacccaucagcacaguguuuaugcagacauuguugcugcagcaagcauucccuucucaagugaauauguaccauguacucaaaaucugccugucagagccugguauagcugucuccugugaggcucuaccagugccuggcaaauacagaaguggaugcucacagucauccauuggauggagcacaggguccccaaugaaggagccaaaguaaguacccaggggucugaagccccauaggaggaacaucaauaugaacuaaccaguacccccagagcuccuuggaacuaaaccaccaaucaaagaaaacacaugguggaacuugugguuuuagcuauauauguaggagaggauggccuacucgaucaauaagaggagaggcccuugguccugugaaggcucuaugccccaguauaggggaaugggaguggguggguuggggagcagggggaguggggaggugguaggggauuuucagaggggaaacuaggaaaggggauaacauuugaaauguaaauaaagaaaguaucuagccaggugugguggugcaugccuuuaaucccagcaccaggcaggcagauuucugaguucgaggcuagccuggucuacaaagugagcuccaggacagccagggcuauacagagaaacccugucucgaaaaaccaaaaaaaaaaaaaaaagaaagaaagaaagaaagaaagaaaaaguaucuaauuaaaaaaaaaaaaucugucugucauagugauaccugccuguaucccuaagguuaaggaggcugaggcaggaggaucaugaauucaaagccagcuucggcuacauaacaaguuucaggcuagucugagcaauauaggagauacugucuuuaauaauucugcucauccugauauauagaguauaacuugggccugcauaagccuccuagcaauguaaaaaacuauaaggcaaaacuacagagacccuggggaccacaaugugcugaccuagaauauccuacagaagucuguacuuccauggguuuuuuuuuguuuguuuuauaaguuagaucaaugaaccacaccccccccaacccaagacguguuaauucuuuuucuuuguuuucucucucucucucucucucccucaccccggcugugucucucucucuguguguguguguguguguguguuugagaaaggaucacugcauguaagucaagcuagcuuuaaacuugugaucucucugccuaagccuuccaagugcuaggauuacaggcaaagauaccaugcauaccuguucuagcacuggguagucugaugggagggaauugaggauccuuuuguuuacuaaaggagacacauuggaguuauuuuuuuuuuaaucaagcaaauucacgucaacacaauacuucggugcucucuugagugccucaauaugaauuucugguucccaggucagaaucuuuauaguauggguuaggaccccagggcuggaagagguuggacagaccuggauccaucuguaggagcuggaaauccuagaguucuggagcgaugcuugucagauuucccauucaaauuuuacagagaaaaaugaucaagaaauuugagggucucauuuugagaccugcaugguccuaauuuucaaccguacgugggccuagaggauauggccuacuauauauaauagggcgugcugcuugccuagcacauauaaagccuagguucaaucccuaguaccacaaaggaaaagaagaaagcaaacauauuaagucguaaccccaugucugugcacagugaguguucccugcacagucggucagaaugacaggaacaagaggaucaaaaccagaggguuuucagcaucacucauuugcuccagcauacuucuggauauaaggucagcuguaucccauuuuccagagcuccuggcuaggugacauuucuagguccccuuccucucgcuuaagucagauuuaggaagaacaaaggcuuggaugaaacaucuucauuagacuaccaggacaacccuugaggcaaggaaagauguuuaccaguuaauaugaggguauuucucaacaaauuugucaauggguaauaucugugaauagaggaauuuucaucugugggguaauucauuaacuagagaagcuugggcgagugggaauuagaacuuucuauaguaggcaugaucugguggaacaugucuauuauaaucccaggaaugaaaaaacagaggcaggaggauugcaguaaauuugaggucagccugucuuaaaauggggguggguggcaaaauagagcuggggaaaugucuuaauggacaaagcacuugucaugcaaguaugacaaccuggcacugaaucuacaucaagcugagcagcgguagcugacuugcauucauauguaaacuggggggaggagaaaaaagaauaccaggaaagcuagcccaguguauggggugaacaaugagacccgugucaaaguaaagcggaggucagacacccaaggcuauaauuugccugccauggcauguauaaaccuuuucuaauacacaccagcauauacagagaaauaaaaggaaacaaaaaaauuacuguacuaagaugucuaaguuuugaguagagggaauauuaaaugaauuuuaguugauaaugcaaaguaaugaucauuucuguuuugcagguucucagugcuaaucccaauguugagauuauuaccaauauaucaaaauuucuguaaaguauaaaaacucaacaccuuuuuuguuuuguuuuguuuuguuuuguuuuguuuuguuuuguuuuccaauacagggguucucuguguaguccuggcuguccugaacuucacaaacuugcucuguagacuaggcuggccuuuauuccccacucccaccccaccccacccccgcuuuauuuuuccgcuagagauugaaccuaggguuuucuacauaccaggcaugugcucuaccacuaagcuucauuucuagccuccaaacucaacauuuugcaucuuuuccuuguucauugguuucuggaagcucccagcagguuaucaguaucuuaagcuuguucccaaacacuauacagaaauauugcugcugucugauaguucuuuauuucaccaucuaagagaaagaaagauggaggaaaaguagacaguguucaggcuucaguuuuuccugggggaaggcuucaggucaucgggccccaagggaucuccaggugcacaagccuggauuccguggcaggcaagcaaagugacggcucugguaguccucagagcccacgaggaccugauccguccacaaacagugagugucacucuccaguuugcaagggauagauaaacagggaaacaccuagaagaggggaaaaaggcccaucucugaggauuucucuuucccucuguuuguucucucccuuguauagagucucagucucucucucucucucccgcccuccccccccccacacacacacaccagggagcugcuaggaaggguuuguguugcccuacuugugcuuaaacccaagaacagcuucucccauuugaggaacagaaagccaguguucuggaauugcuguuagagaacugucacuugaagucacucagacaggccuccugaagaaccgucccacagggcagagaagugauaguauggggaacaguuggcaugcaggaagagcaagcauaagaaaaggcagcagggagggcuggagagauggcucagugguuaagagcacugacugcucuuccagagguccugaauucaguuccccagcaaugacaugguggcucacaaccauuuguaaugggauccaaugcccucuucugaugugucugaagacagcuacaguguacucauauacauaaaauaaauaaaucuuuuuuuaaaaggaaaggcagcaaggcucuuggacaaugacuggggagggggcuggucagaggauguuuggugccaccaggaaaaaguuuugaaauagucagauggcuggcgugugucccuguggauuuggagaauaguccuuugaauucuugcagcuuaugccuggggaagcaaaauccaaucggggaggucagaaacagagaguggugucucagaauagucacaaaggaaaguuagacagacagcgaagguucagggaacaggcaguccagagauaacaaaacaaccaaaauuuccaaaagaacaggcccagggguggagcaauggcaagagaaaucaaagauagugauuggguuugggcagcaacuacaacugcauacaauagccagagggaaaaagaaaccauuccaagacuuaucuccuggaggaaaacuggguccaggcacuuacugugcacaccccacagccagcacuauaggucuuugagaaagcucuuugcugagcagggcucagaguacgccagggaaccaagaagcugcaggcacugaugugcaaauuuccguuccuuaggcggccuguaagagaagcaagaaaccaauaggcuuuuggauuggcuggguggggucggaguggucaccuaauuagcauuagguuacagacccucccacucccauuucaaccaggcccuuuuccuuuagagccuaacuccucccaguugccugaaagcauuagggauguggcccaaggugaaggggcggggccucacccgugaugagaaacucuucacugcgguucugggacuugugggcauauccacagaggcuuuccaugacugggguguaggcguaccggauaucugcggcauuucccacagccuugaauccuuuuagcaucugcccaugagugacaaaaaguacaucuuuuacugacauaauccucccacuccacucucuuuccugauggcaauauaucuaaaucacaaguuuacagaaaacauccacaccaacgaaagguuagaugcuucuauuuugaggagaaggaauagguuagguacagccauggagggagggagggaagggaaaauaccuuagucaucuugaucuuauaacgcugguauaagguggucucguugauuucuggggaacccaugaauuuagcccuuaugacuagaggaaaggaaggggaaauggggaaucaaaugggcaagcagcaugaacccauagcagcaaagcauauauacagcauaauucaaauggcuuccacaucaguugauucaucuacauauugucuauucuuuuaggcacuguuuuaagcccuuuucauauauccauuuauuggcuuacucaacaaauauuuuggagugccuggugccagccacuguucaggguguuagggacagugacccaaauacaggaauccauuuccuuauggagcucacauucaagccaggaggagacagacuaacauuaaguagccaggcaugguggcacaggccuguaacccuagcucugucagagccugauggaggaucacuuuacucugaguucaagacuagucuagacaauuuagugagaaccuguuuaaaauaaaaaauucaccaaaaaaaggguuggguuuguagcucaauugugcaguauuugccuggauccuagguucaauccccgguaccaaggggaaaaagaaaaaaagguauguggauuguuacaggcuauuaaguggguuagaaaauuagaauagggaagggguugacagaugcuuugcuugaccacaauuuacucaggcucauuaaccuucuuccaagcucauuaguacaguuucucuuuaaaauccacuuguagcgaaguauccuaaauuagguuagugaaaacacccacccuuaucugauucuccucaguaugugauggggccaccagaugauuauacuagccaguuuucaagagaccuaaacugggugugauggcacagaccugcaaucucagcacuuggauggcugagugggaaggaucagggguucaaggccagccuggguuauauagugagaccuagucucaaaaacaaaaaguaagcugauaggcuagagagaugacuuaaugguuaagagcacuugcugcucuuugaggucccaaguuuaguucccagaauccacauaggguagcucacaaccauucauaacuccagcuccaggggauuugaugccuugaggacccacaggcaccuacacaccacacauggaauacacacaaacauacacauaaauaaaaauaaucuuuuuaauggauuuagccugaauccucuugccuuugauauuucuucucaaugguuucccauucaccaacucccaaacuguuccuuggccauugaguuccauuugcccauguaauguugagaguuaaucuaucuccccccaccacccccaucucuuggcaaauucuaauugucaugguccugaaugaagucugccugccuguguccuaagaagugccauuaacagcauauguaacaaagguucaggaguacuauguggcuggcauuaaauuuaaaauuaaauaaaaguaggcaagcaccucaguaagaugacuuuuaaggcagccacccauguagauaacuacagaaaagcauguacauaguacugggagcagccagcacaaagguaggcuuaggcccaaggaugucaguguggcaaaagcagauguauggaaggguaaguagaacuguccuagagacaacugccauaaugaacccuauuggauuaagagggacagaaagggggccagacucacccagguccgaguugcagaaggcugucugugggugggguggggcacagcuacaggccuuacuggaagcuaucagugauagcaacaagaggaugccagaugccagagaugcaaagggggccaucaugguaucugcugguaaagaguagguguuaauagguucccagaccaacggcuuacauggccauugguccuagggagauuugggaccucuuuagguuagagaauggaguuguggcaguuggugaauaagggagcggagaacguugagaauuuaacagaauugggaaaaucugacauuuguguagugaugaauuuggaguuugggaaacuggagaaauauaaugaggaauuagggcuauuaaaauauaaugggcugaggauuucagagauauugggggguuagaacagguuugggguuuuagggagcuggagaaaauggggguuaagggucuuggggaauuuggagguuuacgacaaugguaaugcuugaggaauuuguaggcagaagaacuguugaaguuccaugaaccagacauggcaaagagaacaggggaguuaccaggaaccauaaggauugagggacaggcaaguugggaagucuucaagguauuaaaggcuuguggguuuggagcacuuagcaaaggcaugaaggagucuggagaguccagcuugggacgaucauuccaggcccucucccguuauauuccucuuuagcuaacuagggauccugauaccugcaagccacgugagcaguuagucuggcaagggcugcaugagccgcaccaacacaggcuccaggcaagccccaguucugccaggacacccggcucccacuuaccucuggugugucucuaggagccccgaucugcgaugauggcggcaggggcugcacaguggagaauaaauguccaugcgaagggcggaguuggcggggaaaucacugccuccaggcuuccuggacgcauuacucauccacccaccgcuggagucaaagccuaggggcgggccccaggauaaacccaaagauacucccuccucugccagccagcccacugcgcccccuucccccagcuccacgucaugcacaguccuuccuggcggccuugaagggcagaagagagagcgccuaaagcuuugugccucucagguuucccauauuccccaaacuuccuguggcugaagccaauaacuucuuucucacgccuuucaucuacuauguaacaaucucacaagaaaggcauuccuguggaucugaaauucuggugaggggugucagagggugacaaacuagaaaagcaguugagggacaugacaugggagaagaggcacaaauacauaguggggaaauugauacacuggauaagucuaugacuuauccaagauagcaguugagucuggcagaacugggagggaaccgaggcugcuugcagacagagccuagguaccccaaaccuugcuguggcugcacacaccggugaggcuauuugaagauaucaucagcuacaagagacccugucuuaaacagaaacaagaccaaacaggcaaauaacugaaguaaagaucuuuguuagugucacaggacaaaacagggauuuaaaccuaggcuuccugacccuggaguccuaacucaggcaggacacaaucuugacaagcagggaaugguguggugagcauggguggugguggugguggugacugaugguaaaagaaguuagugagucaguagaaaaaccaucccuacuccauccugcccugccccuucccccaccaaccagcccacaccccuuguggggaugggaugaggcaacugcugcccaccagcuuccugaugaugcaggaguauucccugggguccuguggaaggguucuauggacugauuagcaucuucaauuaauauagggaggaaagaccaauaauaaugacaaugguuguaaucgcagcaggcaagcugauccagagaauuagaggguacauagucuauacagugaguuccaggacagccagcgauacauagugagaaccugugacagagauagagagagagacagagagaauaugguaguggugaucacagcuacuuacugaaugcuuacuguacaucauuacuaagguuauuauguaaauuuacuuuagcuaauucaauuuuauuaacuuagguaaauugguucagaaaccacaggacacaaaaaccuccugccagcacucaacaggguacuauguacaauacacuguuuuaaaagguuuuuuuuuacacuguguguguguguguguguguguguguguguguguguguguguguguguguguguguguguguuugugccaugacaugcuugcauugcuuaaaggacaacuugcaggggccaauccucuccuucccuguggguucuagggcucaaacucagguuaucaggcauggaggcagcaagcaccuuuaucugaugggccauauugccagcucagaaauuuuguuuguuuguuugccauuguccuccuuguuccuuaauguuauuuaaugaagagguauuaaaucaauaacaacaauaauaguaaccaacucuuugaagauucagguuuacuauauguguauacuaagauuuucuuuucucugaaauaauugacuuauucuucccaacauaucugugagguaugauucauauuuuuacuauuuaguaagaaaacagagacagaaaggaaucaaauggccuguccaggaaagauggugaagaaauuacugugguggugggaggagguacagagaaaaggagaaagggaaggagaccaaaauuuucaaccaucugauugugaaagugaggagaaagugagacagggggcugaguaacuaggcggcaggacugaggagacguaaagacagggaaaguccugucucgccucuucuaugagccagcuucugacgacagcucuuuaacuaugaaaccugagucagcacaguuuugccagcuguuuacauuaaggauucagauuauuguacagguuugaaauggagugggguggacauuacagagggauguuuagccugugacuaucugcuaaacuggauaggugugagguucccauagugaucugcugucauguguaaauaccugaugauacccagaguauuaagugcgagagcuugauuauuucccucuggaaacugaggcccaguaagacaguaccuaccugggauuuuuuaauggccuugggaagaauaaaggccaagauagcaggcuaaagcuccccaggaagucccaaggccccuguaugcacauauggcaggcacacacuuagaugcacccacaguguucaagcucaugaacagaggaagcaaaguaaguuugggaaaaugauccacaaugcucagcagaugggaauagauauucuuguauaugaacagcucugucauguaucugugccgcaagggguggcuuaugucccuugcaaggcaugcuccaugucccuuccugagagccaggugugugccugaguguguugcuucugagaguggaagguugccaauguaacuaugccugucucaagcuucucugugugaugaguagaugcccaaguagaaaguuucucccuauacacacacaucuuggcauuguuuccuuggccugcucccuggaugacacccuuaccaacaucauaccacucaguucucugccuuccuaugaugucacucauuugggaaaugaggaaggagauuguagagggagggagagaccugaaggucaaucagucacccuuagacuauggggcuuccugugccuguugggaacugccacugacccagagccuaagaaugcuaucucuacccugucaguaggaggcaggggcccuacauuugcacaugggguaugguggggcuagaguccucauacucuuugccuagccugggacacagggagacuuaacacaucuuugccuaacacauauuugccugaauauguguccugaauauguauuaucugugugucugauuuucuguaugcuuguauuacagauauggaaaaaaaacauguugaaugucuagauauacuuuucauggacccagaaaugugaugaggucggaguuacagcgauuugguuauaugaaugccuagaaaugcauucuccuucuguauguuguauuaauccuucuguuugcugugggcaugccagugauugcugcauauguccauuuauuguuugccucgagaguagugugugcuucuauagugcauaaguaguucuguuauauguccuucuuuuauguaggugagagcaaggcaagguagcucauguguuaacucuaagagucuuaagaguguggaauaugggggggggggcuggcgagauggcucagugguuaagagcgccgacugcucuuccgaaggucccgaguucaaaucccagcaaccacaugguggcucacaaccauccauaacgaaaucugaugcccucuucuggaguaucugaggacagcuacaguguacuuacauauaauaaauaaauaaaucuuuaauuaaaaaaaaguguggaauacacguugcuuaggaguauuggcugcugucccaugcuaugaccacaugaccugacucacuggaucucugugaagcccuagaacuaaaugugauuuaaguuucugguugucuuucucaguggauguggaguucuuaauagauguggacaccucuggcuuugaauagaauucuaaagguguguguguacauaaagaugaagcuuauauguaagguguggcugaaggccucauugcugcaugcuaacuaccacaccgucuuacacacacuaacucauacaaaaacaaacuuucucaggcuggagagauggcucagugguuaagaacaauaacugcucuuucagagauccugaguucaauucccacauuguggcucacagccaucuguaaugggaucugaugcccucuucuggugugucugaauauaugaaauaaauaaacaaacuuucucuauucuggaaaguucccucauccucaucuaaggacucugcaugggaaaucagauauggaaagccuaagguuuagagaguggaccagcaggcaaggaggugcauucaguucugaacucaaagcugcugugaaacaauugacugcuguucugccugucuuugacuaaccuuuuucuggggaaaaaaaugucaaccgguguggcucacacucuaugggucaccagcucuuggagaccagcagaacagcucugaccaugccucuuuugccuucauuuucaccagcucagcagcacaacauacccugugguugugaagaugggccacgcacauucugggaugggcaagguaaguucuaguaggucauauguacauguuuguauaguacauguucuuggcacuguaaguaguuagaugugcaucuguguacucaacacauaacaauaauucuguuugaugaugcauucugggaugucuucaucuaauuggcuuuuguauuuucauauuucgcugauuuuucagcccauauauuucucaugcaaccagccaauuuuauauguccugcuaccaugcuaguguaccaagcauuuuauauauuauauauauaauagcucuauugaaauguaauuccacauuuuauucuacuccccuguuuaaaauggauaauuugagaugaggauguaguacagugguagagugcuuguguaacaugugaacaucccuguuugguccccagcacugcaaaaaaguggucuuuaacauauucagaguuguauacaagcaauuguauguuugugugcacauguaugaaauagguuacccauaauuaugugugcuugggugccuuggcauaucuacuucguauuugucuacacauuccuccagauacauucagcccucacuccugccuucauccaugccuacacccacaggucaagguagacaaccaacaugacuuccaggauauugcaaguguuguggcacugacuaagacauaugccacugcugagcccuucauugaugcuaaauaugaugugcguguccagaagauugggcagaacuacaaggccuacaugugaguagagaggcgggccuuguguguguguggaggggcuaccucgugcaucucaugucccacuaagccucuccccccccccccacuaggaggacaucagugucggguaacuggaagaccaauacagguucugcuaugcuugagcagauugccaugucugacaggugagacacauaauugaggagugggaguaaggauggaacagaaucaucugagcagagcaaugacaagcuauccugcuccuugucuuggcagguacaaguuguggguagacacgugcucagagauuuuugggggacuugacaucugcgcaguggaagcgcugcauggcaaggacggaagggaucacauuauugaggugggaacacccagggauuggugggcacagagggaagaguggcugcacagaaacgaugggcuaaacuggaaagcauuuugugacucaaaaguccuccaggaagggugguggaacuguaaaguauugugugagcugggacaucccuagcaaaugacaaugguaaaaacuugggcaucuuuggugaaugggcaacacuugcuaagauauaaagugcucugugaauagagauaucuugguaaauggcaaagcacuuaguuaaccuugaaaauguccuagaaaccacaacaaagcacucgguaaaagacaaaguacccagugaaagcugggaccaacaguacauauuuuaugcuuugugggccaugcaguuuggcacucugauucagucccauaaaagcagccacaaacaagauggaagauuugugcagcugugcauauggauacaacucauguguuuaugucuauaacuuuuaaguacacugaguuuaaauuucauaucuuuugcacacaugaaaccuuuuuccccaaccacugaaagccaucggaggcugggugcagcgggaaacgguaaucccagcacuaaugaagaguuugaggguagccuaaacuaugguacaugccuguaauccuagcaacuugggagggugaggcaggauccugccuaugauuuuaggguuagacuggugguuuuuaggcuugcugggugguugugguucuacuuccuuuaaaauaagaagaaaaagauauagaacauaucuuagcucaugagccauagaaaaacauguagcaagcuagauuugcccccauagacacugauugcagagccagcucuaacacuccacccacaaagcuguccagagccuuggaacuggcaggcuuuccuuacagugcacaaucagcgccacuuagaagccagacagagcucucuuugcagucaccauguuuuuuugccaagugaaaguauguuguugacacuguggccucacaugcacuuccugccuccccuaauacuggauccuuuucccucccauagguggugggcuccuccaugccacucauuggugaucaccaggaugaagacaagcagcucaucguggaacuuguggucaacaagaugacucaggcucugccucggcagccgcagcgggaugcuuccccuggcaggggcucccacagccaggucaggcccuuggucuugagcuagugggaaggaggccagcccuucaucaaccugaugccauagaggugguaucaauggacuauuaaugucaccuuuaugcacuuguggccucacuaaauugcugcuaccuugccaucuuuaagagucuccugaccaaauauggggugagaggccucauagcuccauauccccucaacuggccacaaauggggcaacacccagcacacagggaacccaugucguuuugauuggcuguugcucccacucuccgguaacuauuuuuaaucucuuguauuccacucuucugccacagucuucauccccaggagcccugaccuugggccgccagaccucccagcagccugcagguccuccugcucaacaacgacccccaccccaggguaagugagggcaagccuucuggguuccuaccaucccaggcggccucagcucucacucacucucacuugcuguucuuuuuuucuguuccuaggaggcccuccacagccaggcccaggaccucagcgccagggacccccgcugcagcagcgcccacccccacaaggccagcaacaucuuucuggccuuggaccgccagcuggcagcccucugccucagcgccuaccaagucccaccgcagcaccucagcagucugccucucaggccacaccagugacccagggucaaggccgccagucgcggccaguggcaggaggcccuggagcaccuccagcagcgcgcccaccagccuccccaucuccacagcgucaggcgggggccccgcaggcuacccgucaggcaucuaucucugguccagcuccaacgaaggccucaggagccccacccggagggcagcagcgccagggcccuccccaaaaacccccaggcccugcuggucccacucgucaggccagucaggcaggucccggaccucgcacugggccucccaccacacagcagccccggcccagcggcccagguccugcuggacgucccgccaaaccacagcuggcccagaaacccagccaggaugugccaccacccaucaccgccgcugccgggggacccccgcacccccagcucaaguaaggggaccuuuauagcagccuuggccuuugcugcucacagagugcacuguccccaguagggcauccccagaucccaaggaaaaccagaucuccuuugccugggccaaaccccuuuugucucaaucccagcaguugagggagaaucccagcaucuccacuuccaguucagauuccuccccuacaagcccugggaaagucccccuuccagaccuuuggcccaucccaguagccuggcugaccuacuuccaguacuucccuguccaucugaucucuuauuaucacccuccucccagacagcccugaacucccucaggccaauuugcagcaagccuuccaucauuucccuuuucagccuuuccucaaaccuucccuaagacuccuuucugguccauugccagauacuccugccacuucaaacucucccagaucauaccauccuuucugcuucuccuuguccauucuauuccccuagcccuuagcuccaaaguuuucccuggcccccacccccaccccaucuguucccccucagacuggcuuaccucauacuagacugucccuagcccaggcuccuccuaggcuccuugcuggaaccccuccuuucauccuccauaucaaacugaccaaggaaucuucccauuaaaccacaccacuuuaucuuauaucuaaguccucucagcugaccccacauucgccucagucucagcuucaucacccuugagaauccaucaggguucaggggcaugcuugggggugggaaggucacaggcacagccucaggaucagaggggcagggcuggggcugggccuaggguaacauuguguuucucucccuuccuccccuuccucuucccccuuccucccaugccuccaccuugucucucucuagcaaaucccagucucugaccaaugccuucaaccuuccagagccagccccucccaggcccagccuuagccaggacgaggugaaagcugagaccauccgcagccugaggaagucuuucgccagccucuucuccgacugacaucccacucugagaaccccuaaaccccuagacagcccucucuggguccugaguccauuucucacuuuuggaaccuccaaaucccuugagaaccccucuccugguucuccuagagcccacuucucauuccucaguaugucccuugagaaaccugguccuaaauccaguucucacauuugggaauccccaaguccauuuagaauccuguuccuggucaccuccagaucuguuugagaaccuccaaacuccugaagaccucuacuucugguacaucuaaagggugauuucuucccugaaaguuccugaauggcagaaaaccuguuucugaccuaauacaucgaauccucuccuggagcucugaaauuccugaaaaacccuauucuacucuugguccugaaucucuccaacacaccuugcuccuaaucagaaauuuccaauuccauaagaagccccuauccuuaaaccucuuccauaggucaucucucuggagauccacaucuucaaaugccaccuaccauccaccaagcagucccucaaggacuucccuucaccucuuccucuccaucccauucaauauacuggaaguuccuuccacuucuaggaccccuaaguucccuccuccagaaaccccuccccaauuuccugccucugacagcugucuuuaaauaugcaaacuccacccauccucagaauccuuugcacaaggaaggccuguggucucccacuccccuaccuuugccaauguguuuaucugugacugacuuggccuccuuuugugccaugcuuggcauaugugguccucauucaugccgccugugguaaugcguacaguggcacuguuuuuguggucugcaucuuccuccaaccuccacuccuugccuggacuugccccaccccucagcggcucugaacccccaagagaagagucgggaagcaaaauaaacaagcaaaggcccagcagaauucugugcuucuugguaaagaggagaguccuugaauagugggggagacaaaaagaaacccccaaaucuacauggggugcugggaaccccaaaauccagugaagacacaucaggcaaaaacuuuagaaagagguucugaguggaauccuugcacugagucacagccauuggagauaaaacagcucuccaaauuagaacuauccccaaacccaagaggagaccaaauuauggagaaagcaggagaccucaguuuuuggggucccucaaauuucccaggguaugggauagggaauccugaggcaguaucaaggcagaggcagaacaguuauuggcugguaggucggugugccuuggcaugguaugcugaaauuggcucccuggugggcugggagugaggucuaaggcacaagacgggcugcgcugagaaggcaagcaggcaacucaucagccugggugcggugcaaggaggguucggaggcacuccgcucaaucuuggggagugaccgcugcaguagcucgaucguggccagaaucugggagcggguggagaugaagagggguguccagagucccagagauacuccaauauccccaauccccagcuuucaacaugguucacauucaauaucugccucuaucucuuuacucacagugcaucuccccaagguauccagcccuccuacccagcccaccuggggaaauaggggccgcuccucccgcuggaacuugaggcagucagucagcaggcgccucauggcuuuggggcaauuacugaagauuuugcugagguccggagacagauagccacggcccaccauaaagaugaucugguguguggggaggaauggguugauuugggguuugagcugggaggcccagggaucuaugaaucuuaaaauauauguuagguuaauuuuugaggacuagaggugucuaguacuaaggcccagaggagucugugucccugaggacuagggaggauuuucugcugauaaaagagagggauuuauauuaaggcugucaaagacuguagguguguauggcccagaacaauaggagucuggaguuauuaaggggcauaagcucagaaaauac

SEQ ID NO: 9426 - RNA, 4574 nt, Mus musculus
uaggcuuugacuccagcgguggguggaugaguaaugcguccaggaagccuggaggcagugauuuccccgccaacuccgcccuucgcauggacauuuauucuccacugugcagccccugccgccaucaucgcagaucggggcuccuagagacacaccagagguaagugggagccggguguccuggcagaacuggggcuugccuggagccuguguuggugcggcucaugcagcccuugccagacuaacugcucacguggcuugcagguaucaggaucccuaguuagcuaaagaggaauauaacgggagagggccuggaaugaucgucccaagcuggacucuccagacuccuucaugccuuugcuaagugcuccaaacccacaagccuuuaauaccuugaagacuucccaacuugccugucccucaauccuuaugguuccugguaacuccccuguucucuuugccaugucugguucauggaacuucaacaguucuucugccuacaaauuccucaagcauuaccauugucguaaaccuccaaauuccccaagacccuuaacccccauuuucuccagcucccuaaaaccccaaaccuguucuaaccccccaauaucucugaaauccucagcccauuauauuuuaauagcccuaauuccucauuauauuucuccaguuucccaaacuccaaauucaucacuacacaaaugucagauuuucccaauucuguuaaauucucaacguucuccgcucccuuauucaccaacugccacaacuccauucucuaaccuaaagaggucccaaaucucccuaggaccaauggccauguaagccguuggucugggaaccuauuaacaccuacucuuuaccagcagauaccaugauggcccccuuugcaucucuggcaucuggcauccucuuguugcuaucacugauagcuuccaguaaggccuguagcugugccccaccccacccacagacagccuucugcaacucggaccugggugagucuggcccccuuucugucccucuuaauccaauaggguucauuauggcaguugucucuaggacaguucuacuuacccuuccauacaucugcuuuugccacacugacauccuugggccuaagccuaccuuugugcuggcugcucccaguacuauguacaugcuuuucuguaguuaucuacauggguggcugccuuaaaagucaucuuacugaggugcuugccuacuuuuauuuaauuuuaaauuuaaugccagccacauaguacuccugaaccuuuguuacauaugcuguuaauggcacuucuuaggacacaggcaggcagacuucauucaggaccaugacaauuagaauuugccaagagaugggggugguggggggagauagauuaacucucaacauuacaugggcaaauggaacucaauggccaaggaacaguuugggaguuggugaaugggaaaccauugagaagaaauaucaaaggcaagaggauucaggcuaaauccauuaaaaagauuauuuuuauuuauguguauguuuguguguauuccaugugugguguguaggugccuguggguccucaaggcaucaaauccccuggagcuggaguuaugaaugguugugagcuacccuauguggauucugggaacuaaacuugggaccucaaagagcagcaagugcucuuaaccauuaagucaucucucuagccuaucagcuuacuuuuuguuuuugagacuaggucucacuauauaacccaggcuggccuugaaccccugauccuucccacucagccauccaagugcugagauugcaggucugugccaucacacccaguuuaggucucuugaaaacuggcuaguauaaucaucugguggccccaucacauacugaggagaaucagauaaggguggguguuuucacuaaccuaauuuaggauacuucgcuacaaguggauuuuaaagagaaacuguacuaaugagcuuggaagaagguuaaugagccugaguaaauuguggucaagcaaagcaucugucaaccccuucccuauucuaauuuucuaacccacuuaauagccuguaacaauccacauaccuuuuuuucuuuuuccccuugguaccggggauugaaccuaggauccaggcaaauacugcacaauugagcuacaaacccaacccuuuuuuuggugaauuuuuuauuuuaaacagguucucacuaaauugucuagacuagucuugaacucagaguaaagugauccuccaucaggcucugacagagcuaggguuacaggccugugccaccaugccuggcuacuuaauguuagucugucuccuccuggcuugaaugugagcuccauaaggaaauggauuccuguauuugggucacugucccuaacacccugaacaguggcuggcaccaggcacuccaaaauauuuguugaguaagccaauaaauggauauaugaaaagggcuuaaaacagugccuaaaagaauagacaauauguagaugaaucaacugauguggaagccauuugaauuaugcuguauauaugcuuugcugcuauggguucaugcugcuugcccauuugauuccccauuuccccuuccuuuccucuagucauaagggcuaaauucauggguuccccagaaaucaacgagaccaccuuauaccagcguuauaagaucaagaugacuaagguauuuucccuucccucccucccuccauggcuguaccuaaccuauuccuucuccucaaaauagaagcaucuaaccuuucguugguguggauguuuucuguaaacuugugauuuagauauauugccaucaggaaagagaguggagugggaggauuaugucaguaaaagauguacuuuuugucacucaugggcagaugcuaaaaggauucaaggcugugggaaaugccgcagauauccgguacgccuacaccccagucauggaaagccucuguggauaugcccacaagucccagaaccgcagugaagaguuucucaucacgggugaggccccgccccuucaccuugggccacaucccuaaugcuuucaggcaacugggaggaguuaggcucuaaaggaaaagggccugguugaaaugggagugggagggucuguaaccuaaugcuaauuaggugaccacuccgaccccacccagccaauccaaaagccuauugguuucuugcuucucuuacaggccgccuaaggaacggaaauuugcacaucagugccugcagcuucuugguucccuggcguacucugagcccugcucagcaaagagcuuucucaaagaccuauagugcuggcuguggggugugcacaguaagugccuggacccaguuuuccuccaggagauaagucuuggaaugguuucuuuuucccucuggcuauuguaugcaguuguaguugcugcccaaacccaaucacuaucuuugauuucucuugccauugcuccaccccugggccuguucuuuuggaaauuuugguuguuuuguuaucucuggacugccuguucccugaaccuucgcugucugucuaacuuuccuuugugacuauucugagacaccacucucuguuucugaccuccccgauuggauuuugcuuccccaggcauaagcugcaagaauucaaaggacuauucuccaaauccacagggacacacgccagccaucugacuauuucaaaacuuuuuccugguggcaccaaacauccucugaccagcccccuccccagucauuguccaagagccuugcugccuuuccuuuuaaaaaaagauuuauuuauuuuauguauaugaguacacuguagcugucuucagacacaucagaagagggcauuggaucccauuacaaaugguugugagccaccaugucauugcuggggaacugaauucaggaccucuggaagagcagucagugcucuuaaccacugagccaucucuccagcccucccugcugccuuuucuuaugcuugcucuuccugcaugccaacuguuccccauacuaucacuucucugcccugugggacgguucuucaggaggccugucugagugacuucaagugacaguucucuaacagcaauuccagaacacuggcuuucuguuccucaaaugggagaagcuguucuuggguuuaagcacaaguagggcaacacaaacccuuccuagcagcucccugguguguguguguggggggggggagggcgggagagagagagagagacugagacucuauacaagggagagaacaaacagagggaaagagaaauccucagagaugggccuuuuuccccucuucuagguguuucccuguuuaucuaucccuugcaaacuggagagugacacucacuguuuguggacggaucagguccucgugggcucugaggacuaccagagccgucacuuugcuugccugccacggaauccaggcuugugcaccuggagaucccuuggggcccgaugaccugaagccuucccccaggaaaaacugaagccugaacacugucuacuuuuccuccaucuuucuuucucuuagauggugaaauaaagaacuaucagacagcagcaau

SEQ ID NO: 9427 - RNA, 4574 nt, Mus musculus
auugcugcugucugauaguucuuuauuucaccaucuaagagaaagaaagauggaggaaaaguagacaguguucaggcuucaguuuuuccugggggaaggcuucaggucaucgggccccaagggaucuccaggugcacaagccuggauuccguggcaggcaagcaaagugacggcucugguaguccucagagcccacgaggaccugauccguccacaaacagugagugucacucuccaguuugcaagggauagauaaacagggaaacaccuagaagaggggaaaaaggcccaucucugaggauuucucuuucccucuguuuguucucucccuuguauagagucucagucucucucucucucucccgcccuccccccccccacacacacacaccagggagcugcuaggaaggguuuguguugcccuacuugugcuuaaacccaagaacagcuucucccauuugaggaacagaaagccaguguucuggaauugcuguuagagaacugucacuugaagucacucagacaggccuccugaagaaccgucccacagggcagagaagugauaguauggggaacaguuggcaugcaggaagagcaagcauaagaaaaggcagcagggagggcuggagagauggcucagugguuaagagcacugacugcucuuccagagguccugaauucaguuccccagcaaugacaugguggcucacaaccauuuguaaugggauccaaugcccucuucugaugugucugaagacagcuacaguguacucauauacauaaaauaaauaaaucuuuuuuuaaaaggaaaggcagcaaggcucuuggacaaugacuggggagggggcuggucagaggauguuuggugccaccaggaaaaaguuuugaaauagucagauggcuggcgugugucccuguggauuuggagaauaguccuuugaauucuugcagcuuaugccuggggaagcaaaauccaaucggggaggucagaaacagagaguggugucucagaauagucacaaaggaaaguuagacagacagcgaagguucagggaacaggcaguccagagauaacaaaacaaccaaaauuuccaaaagaacaggcccagggguggagcaauggcaagagaaaucaaagauagugauuggguuugggcagcaacuacaacugcauacaauagccagagggaaaaagaaaccauuccaagacuuaucuccuggaggaaaacuggguccaggcacuuacugugcacaccccacagccagcacuauaggucuuugagaaagcucuuugcugagcagggcucagaguacgccagggaaccaagaagcugcaggcacugaugugcaaauuuccguuccuuaggcggccuguaagagaagcaagaaaccaauaggcuuuuggauuggcuggguggggucggaguggucaccuaauuagcauuagguuacagacccucccacucccauuucaaccaggcccuuuuccuuuagagccuaacuccucccaguugccugaaagcauuagggauguggcccaaggugaaggggcggggccucacccgugaugagaaacucuucacugcgguucugggacuugugggcauauccacagaggcuuuccaugacugggguguaggcguaccggauaucugcggcauuucccacagccuugaauccuuuuagcaucugcccaugagugacaaaaaguacaucuuuuacugacauaauccucccacuccacucucuuuccugauggcaauauaucuaaaucacaaguuuacagaaaacauccacaccaacgaaagguuagaugcuucuauuuugaggagaaggaauagguuagguacagccauggagggagggagggaagggaaaauaccuuagucaucuugaucuuauaacgcugguauaagguggucucguugauuucuggggaacccaugaauuuagcccuuaugacuagaggaaaggaaggggaaauggggaaucaaaugggcaagcagcaugaacccauagcagcaaagcauauauacagcauaauucaaauggcuuccacaucaguugauucaucuacauauugucuauucuuuuaggcacuguuuuaagcccuuuucauauauccauuuauuggcuuacucaacaaauauuuuggagugccuggugccagccacuguucaggguguuagggacagugacccaaauacaggaauccauuuccuuauggagcucacauucaagccaggaggagacagacuaacauuaaguagccaggcaugguggcacaggccuguaacccuagcucugucagagccugauggaggaucacuuuacucugaguucaagacuagucuagacaauuuagugagaaccuguuuaaaauaaaaaauucaccaaaaaaaggguuggguuuguagcucaauugugcaguauuugccuggauccuagguucaauccccgguaccaaggggaaaaagaaaaaaagguauguggauuguuacaggcuauuaaguggguuagaaaauuagaauagggaagggguugacagaugcuuugcuugaccacaauuuacucaggcucauuaaccuucuuccaagcucauuaguacaguuucucuuuaaaauccacuuguagcgaaguauccuaaauuagguuagugaaaacacccacccuuaucugauucuccucaguaugugauggggccaccagaugauuauacuagccaguuuucaagagaccuaaacugggugugauggcacagaccugcaaucucagcacuuggauggcugagugggaaggaucagggguucaaggccagccuggguuauauagugagaccuagucucaaaaacaaaaaguaagcugauaggcuagagagaugacuuaaugguuaagagcacuugcugcucuuugaggucccaaguuuaguucccagaauccacauaggguagcucacaaccauucauaacuccagcuccaggggauuugaugccuugaggacccacaggcaccuacacaccacacauggaauacacacaaacauacacauaaauaaaaauaaucuuuuuaauggauuuagccugaauccucuugccuuugauauuucuucucaaugguuucccauucaccaacucccaaacuguuccuuggccauugaguuccauuugcccauguaauguugagaguuaaucuaucuccccccaccacccccaucucuuggcaaauucuaauugucaugguccugaaugaagucugccugccuguguccuaagaagugccauuaacagcauauguaacaaagguucaggaguacuauguggcuggcauuaaauuuaaaauuaaauaaaaguaggcaagcaccucaguaagaugacuuuuaaggcagccacccauguagauaacuacagaaaagcauguacauaguacugggagcagccagcacaaagguaggcuuaggcccaaggaugucaguguggcaaaagcagauguauggaaggguaaguagaacuguccuagagacaacugccauaaugaacccuauuggauuaagagggacagaaagggggccagacucacccagguccgaguugcagaaggcugucugugggugggguggggcacagcuacaggccuuacuggaagcuaucagugauagcaacaagaggaugccagaugccagagaugcaaagggggccaucaugguaucugcugguaaagaguagguguuaauagguucccagaccaacggcuuacauggccauugguccuagggagauuugggaccucuuuagguuagagaauggaguuguggcaguuggugaauaagggagcggagaacguugagaauuuaacagaauugggaaaaucugacauuuguguagugaugaauuuggaguuugggaaacuggagaaauauaaugaggaauuagggcuauuaaaauauaaugggcugaggauuucagagauauugggggguuagaacagguuugggguuuuagggagcuggagaaaauggggguuaagggucuuggggaauuuggagguuuacgacaaugguaaugcuugaggaauuuguaggcagaagaacuguugaaguuccaugaaccagacauggcaaagagaacaggggaguuaccaggaaccauaaggauugagggacaggcaaguugggaagucuucaagguauuaaaggcuuguggguuuggagcacuuagcaaaggcaugaaggagucuggagaguccagcuugggacgaucauuccaggcccucucccguuauauuccucuuuagcuaacuagggauccugauaccugcaagccacgugagcaguuagucuggcaagggcugcaugagccgcaccaacacaggcuccaggcaagccccaguucugccaggacacccggcucccacuuaccucuggugugucucuaggagccccgaucugcgaugauggcggcaggggcugcacaguggagaauaaauguccaugcgaagggcggaguuggcggggaaaucacugccuccaggcuuccuggacgcauuacucauccacccaccgcuggagucaaagccua

SEQ ID NO: 9428 - RNA, 22621 nt, Mus musculus
cagucggugugcgguucgucgaugaccagcagcacccuggcggcggcgcccccgcggccugcgcccccagagccaccgcccaccugcucgcugaagguggcggcugcggcugcugugguuugcuugaccgcguuagacagcgacgagaagaagccgccgccccccgaggacccaggacuaggggcugcuggagaagccacuggagcagcuguggaggcccucucggcagaggcugucgcggagccgggcguggccccagggcuggcggccgagggaggcggcgggggcgguugcgggcgcugcaggucugucauguacccauucggcagauuggccaugaaguugcuguccgacaggcggcgccgcagguaguucaugguggcggcguggggcaggggauccaaggggcagugggucugugggccgcgggggcggagcgcgaggggcucaggagcacggcggugcucucuggcacgacgcgacuccucugcugcccgcugcagacugaggcagcgccgaggcucugccgccgcagagcguauggucgcgcccgcaccucccuaucuugcaccucucguggugcgguccgacuggacucacggcagcauggacgcgaccaaggcggcgaggaaggggaguuuggggagggcuagugagugacgucagucagccuuuggugcuggggaggugguggugcgcgccggcagcggaggcgaaggcucugaccgcggugcugaauccgacagugcgcaugcgccgcgccgcaaccucuuccccucccccucugaugggggcgggggaugcgcaauuuggggagugggggugggguucuuguccugaggguccggaccuguaguaacgaaacucccucccacgauccuacccuguuuaccaaccucuuccuauuccuuaggcuaacuugcacuuacacacucuugcccuucccagauacuuggguuuccaguguugauuuucaccuuugaaggcauuuuggggauagaagcacacucagaggggaacauaaauguagaaauucuccuuccugcaguguucccggggagacaucuccuauaacaacucugucgggcaaagaaaagagcacggggguggcguaaacaucaccagacaggcggagguggacacuuggguaguuaacauauccuugcccuugguggugagaaucugaaagaacacauggaauaacacaaauagaaaaggaaggaaagacagaauauauauguacaucacagaacacacaggcauccagguauauauguagacacagaagcucaggguaacacacaugagcauauugagcacacauuacacauucagauaacacuuugacucacacccagagaaucucacacaagugcacacaucuaggaaaaacacagacucccagaugagcaaggaaacucuggguaugcaaugcagaagcauuuccugcagcgcuagcucugauguguuuucagccuccuccacaugcacauauuuagucuacauggccucauuccucugcuccggacauagcccaaacccagugucauuaguguucauggaugucuuccucuuugcagacaggaagccacauaauacuuucauguggaaaaauaaaguaauuuugguggucugaauaagaaggcucauauauuugaaugcuuagucaccagggacuggugcuguuuggaaagauuaaaaggauuagaauguguggccuuguuggagaaagcacgucacugggguggguuuuggggguucaaaaguccaugccaagcccagagccagccagccagccagccagccagccagucagucugucugucugucugucugucugucugucugugucuguugucuguggaucagcauauagcucucagcuauggcuccagcaucaagccugugucugccacaacacuccugauuaugguaauaauuuacucaucucugaaacuguaagaaagcucccaauuaaauguuuuuuuuuuuuuaaugagaacugccuuggugaugguaccucuucacagcaauagaccuaaaacaguaauucaggcaguaauaagauguagaagccauuaugucaacuuguaagagucuggcuauaacaaaauugcaaaugcauaguuauuuguuuaaauguaccuuggcuuauccaacaaucugaucuacagauaauauuucuacuuugcaaauuaggaauuaggagaauuuaugaacuucaaauaaucucccaagaauaauguuugcugugauugguauaugaggcaggaagaugaaacagcuagugccagugucuucacaacaaacuggagugagauuuuaguaaggaauagggccaaaaugauuggguacaucauugaccccagugagcaaugacaguggaacaaguggcagaaguuucuugccugaaagauuuuagaaucaccuacuuauucauuucuuuuaaaaccagaucuugcugugcagcccaaguuagccuggucucagccccuacauuaaugagauucccgguguucauuaccaacucuggccacuugcucauuccuuauuuaugaaaucaacaguuuguuaaacacagcaauaauagugugguaucuggagucacauagcuuaguucaagaccagccuccacaauaugguugggaaagugaguuaaucuuucugaaaguuuuuuuuuuuuaaucuuuaaaugaggaaggagaggcauaaccucugugcuuuugcaagugcuguagccccaucagaaaccugccugcucauuuugucuccagaaaccaugccuccacuucaccuuuuuccaucccuuucucccuagguucuuaggguuccuaaguucaauauuuccaagccauccucauaauuccuccucuauccuagugaguuccagucucaguagaauuagccuuugcuugccuaauccuucuuucuuucuucuuuuucuuuuuaaagauuuauuuauuuauuagauguaaguacacuguagcuaucuucagacgcaccagaagagggcauccaaucucauuacagaugguugugagccacuauaugguugcugggauuugaacucaggaccuucggaagagcagucagugcucuuuuaacugcugagccaucucuccagcccccuaauccuucuuucuuugcaggauacucucuggcaauucaaauaaggaacuuccugcauauggguauuucuuaauguuuuaaacuauguaacuauauugcugauuuaagaagaaaagcauggccucuggugaccucuuuggugacucagaagcagaugcaggucuucacacuguuuuggcuccucugggccugaaucagggcucugcacaaccaccccgacuguggcaauuccugggaaacauuuagacuccuaguacuguuagcuuccuagugccauuauuuuccccagguggcuuaguuucuagaaaugaacuuuugcagauugucuuuuaaaggaagcuccuccccuccuucuggaguaucuuaaaucuucaaggauagacaaagcuccacaccaacuucuacagcaggaguaggcauacagaagagucuaagaaucacuuucuuguguuuuggugaacguacuuaaauaugcacuccugacacaaguucaugcaggauugugccuaugacacauaccuaccaauucuaccuuagugugagcgaacauacacacauccguuaugguuuuguuauaguuauaaccuuuuguaccacacacauccaauucacccguaauucuugcacaucucuggaagucaacauuaccgagagauauguacuucacaaugcauacauaugcagacaagcuucuauuuucuuccaagcaaguaucucuuacauccugagcagcgacuaaaaacccucacuuugacucauucuucucaagaugacuaaauccucaucgacuugucuccaugucuauccaucaagugcuuuacauguucugauaagacucugggucucacaaaucuccuauggaaacacucccacacagaagggucccuuucacccacuguacaaaguugcaaacucugcuccuaauacuuaacaacacugcauccaguucuguucugugcguuucuuccuuuguaaaauggggauaauauugauucuccuggguucacuguggauuaaaugaauccacacuauggaaagaccuaaggcacuguugggcuuccaguaaauugcuuucuaaguguuagcuauuaccccaauuaugaugauuccuucgugauuccaucaugaaggaguucggcauucagugaaugguaaaaugaaugagcaaauucuaagaacacugaugucuggguuuguccccuuuacuguggagacacaggucccugauuccuuccuuguguccccauacucagcacuauuguuaguauacaguagguguuaaacauugaacacauguuugaacaaaaggaaugccuacuuugagucugcucacuggcucucagauauucucaccuucuaccaguccucccccagcucagacuuaucucuagcauacaguagacauuaacgugcuaaauuaacaaauacaaaaagaaggugcauuuggguuuguuuuugggguuccucuaggccaaucuaacucuagcuucuagagaggcagcagagccaccuccucagggccccuuuccccagcuauuuguuguugauaauugugguguuggacuuagucugcuuucagugggugggugcaggugcuuucucagcugggugccaacucugguaacaucccacccaauucaucacuguagcagaucugacagcugagaggcucugguaagugggugggaaccuaggaaaccucauaaaguaagagacagcauuaaauagcacacaggccaaucaaaaaauuuccugcuaaggugaguagccaauggcaaaccccacuuuguugcccuccccucuagucccacucccuuacacuuguugcaaagacaggcuggggcuggacacuuacuuucagguuuuccaagguacuaacacaauacaacagaauauuucacaauauuauguugcucuagaaaauucuauugccccacuuccaauauugggggcagguucccccuucgucauuacagaaucuuagaaagagucuagaaaggcugguuuauuguggucuagaaagucagggggucagaauggaagcaagggauuuuaggguuucuucucuucugggucuuugcagacaggcacauguagacaugaccguuucucuuccaccaccagcuucugccccuguagcgcuucacacaguggccguggagucccccagaagguaacauucuucucacccugaccuucaaccauugaaacuguaggccuggaguauuggggaagcaauggaggagagcagcucagguaagacaagaaugcauugaaacaacuuuguuuuuugagaguaucuuaucucaaaaucaaugauaccccugccucagcuucccaaaugugggaauuauaggcaagugucauaucaauuuuuugugguauuagagauuaaaccuaggacuuuguauuugcuaggaaagugcuccacuauaucccuaauagcccagcauucuuuuugucuguuuguuuguuuagguccuacugaccuauucccucucuuuuacccaggcuaacccugaacucauucuguagccuaggaaugucuugaacaugugguccuuuugguuccagcguuucaagcaguuaggauuauagguuugcccuacuacaccugaauuaacaucucacuguacauuuaacucuaugucuaacugugauacuggaguauuucugauaaagaaauaggaaagaugauucccugugcaucaguuucccucaucuacaaaauggaaguaagaggaauaauauuuaccaccaaacccuuucucuuuucucauacucaccuuaaaucccuauccuaagccauuauuucuccucuccccuugauuuccaucucucuuuucuuuguuccuccccacuuuacccaaauagaacuuuauguccaggaagguuuuugccagauagauuucuccuaguaggcaagcacucuauucauuuuuacccagccucuauguggaaaacuuaggaaauuaggaacugguuccuaacuucaggaaccagucugacuccucgcccccacccccccacauuugcaaaauccuaucccagugacaggcuauuuaacagcugggaaaaggccauuuaaccaugauguaugugguguaagaagggauagguaacuuaucccauucuaacuccugggccacugugguguccaguaaacacucaagguggcuggcuaaucagcucugucaagaacaugcucacaaucuggaugucaggaaugcuucuccagaagggccuaauuuagcucucuaggcccagaggguagugauagucucauugcuacuuaccugucauuuuuagauuguaucuaucacaacucaucuggguaccuucuacccauagaucuggguucuuuuuuagagacuguugcuaaaaaaugccuuggaguaccucaagguagugaaauguggaguggauaaauggaggcauggaugacugaguaacucaaaaguacgcuaagagcucagugagaaggcugcaugaaggacuauaugcaugggaguacagcuaugugacugcauuagaaacugaggcacacagaggcugggaagucuucccuaauugcuccuccuccucuuuucuuucucuccucuucucuaagcuaggagauggcacuggcaaggcaggcaccuuugauccaggggugaagcuccaguucaauguaaccaauucccuucucauccuucagcaucaugagccccuccuagaaacacaauguccuucaacucacggguacuuggggagcaaaggugugcagaggcgcuggcggacacggguggcguugggacuacaugguggugugcacagacuccagguacuccacugugaccaugaaccuuucacugcaauaggaggggguaauacagugucacauagucaaaacuggaggucucaauggaaaaaggagaccgcaagggcauuggguacccagcauagcuacagcaugguugcccacccuuacagugcugccugugggucacucacugauacaguuauggauguuauagcagugucgaauauccuggaguuuuccagcacauggcuucccauuaaauuugcggccgccacagcuccuugaacgugacugcuggccugggguuccuucacaguugauggacauucucagccggcugcagucacuccauuuuccccaggccucccacuccccguuuacuguagagacaaggagcaagaggguuuggggccaguaaagggccucaggggaaggaaugaagaaggcuuugagagggagugggagugaacagauguggggaugaaggaggagaggugaaccaggguaugaaggcaggaacaagguuuugguagcaagugggcagcagugaugggcauagggcuugggcaggggguuaggcaugggcauggugccuuuugacuugcuaaccagggcaagguacggcuuuguuacacauuugguuccgaguggcaucaccagcacaaaaggggcccccaugacggggugcagggugaucacauguccguugcucuagggucuggcccaggccacaagucacagagcaggggcucaaagggcuccauggcccccagccaccagccacuguuggaauggagagaaagugacaauaaagaccaccuuaaucaugcacucuccccagcuucccucccuaucaccucuagacaucugaggcaaacuccucagaugauaggcuucugaucacgugguacaagaauuccauucaucuuugccagaaaucuaaagccccacuagcugcaugacgauggccucaucccugcauaccugggcaaggugguaggccacugcaggccuuaugcucauaggcugguccugagcaggguuucccagggggcuggugugaaggugcuggugcagaacaugagcggcuucgugucuccuuagguucuugagcaccaccaaggcaggauccugagcaggggcuccaggggccccaggaugcccaggccccaugugcugugguagaaauggaaggaugaacuguagucaagcaagcauaaaaguuuuuuuuucucccucacaguuucuugcuguaacccaacauuaucccuuccauguccugugacuacucuuacucacuggggcaggucuucugggugucacaggccugugauugcugggccucuccugggcaguggcccccacacuuaggagcaggauuaucacauacucguugacggaucuggguuccuuuggagcaugugacagagcaaggcccccaggguccccacucagaccagccacccaucucugugggagaaaaagagaagaaguggggguguguguggcaacuuaggauuccuuucuuuccacaggguccccaaugaaggagcuagagaaaggacccaaggagcugaaggggucugcaucccccuaggaggaacaacaauaugaacuaaccaguacucccagagcucccugggacuaaaucacuaaccaaagaguacacaugguaggacucguggcuccagcugcauauguagcagaggauggccuagucggucaucaauaggaggagaggcccuugguccugugaauguucuaugcccugguauaggggaaugccagggccaggaagaaggaguggguggguuggugagcagggggaggggaggggauaggggauuuucgaagggaaaacgaggaaaggggauuacauuugaaauguaaagaaaaccuaauaaaaaccaaggaucccuuucuuucaugugugucccacaucaucuuagccuguccuaucucuugucccuauaccugaccuagcaguacugcucauguggacuauagcagcagcuuucauacuccagauuuggccuguccucuucccaaagcaagucaaaguaaaucucuccccuuccaauaauccaaaucauucagccucaagccaauguuuuuacuuucgaacauccuucagcgauccuagccuccuccauucuccuuaaagccauacaaaggucuguccucaggaccucugcacugauucuucuaguguugugggcugguuccauguccgcauuguugaucuuccuuaccuggacagcauggcugguccucacaggccuguagcugccacucaagaguuccaggagccacauucucagagcacugaccaccucugcccacacagcgccugugucgcagcugggaccccucagaacauguaacugagcagggcccccauaaggaccaugcugaccauuguggagaccuguagagaggagccgauguucuauccugguaugaagugacaggauagaucacugagagccuacuuaccacuuagggauggugggugauugaacaggaagaagugaauauacaggaaauaucuaauaaauuucauuucccuucauuuuccucuggaaaccccccagggucauagccagauguacaauaagcaaauuuacagacuaaaaaaccagaacuucugccaggaacucaauaggucacuacccuguacaguaccacacagagaggaaguccuuacuaaacagaagcucugcggucccuucacaacauccuagagaaacacauugcuucugcacagaacuggguuugcaugauaauauggguaugcaugccagugcuaaagagacaugaacuguuagcaugacuggcagcucagagcugcuuuccaagaucuucaagccuaucaucuuuacaauguuaucugaaauacauaguaagcagucauaaacuauaucuacaguauaguaagacucaacauauguaaacuggaagucaugauuaggagcuuugaagugccuucagagaccaaacugccacaaaagaguugcacaaugaaugugucaucacaauuaaagauuuggcauuguccucagaauuuccuuaaaguccuccauuucuauaaugguucuauauauaauaagcacucaauuaugaucuauuguaaguuaggagaauagagcuaccauagaaaauauccaaauugcaccccaccugcaauguuuacaggaagcccugacuuuuaaagcauuuuaaaauuaggguuaauuuugucucuccuaagggacauuuggcaguaucuggauucagcuuuuuuaaaaacucuucucucauacaagacagccuaacuauaguuuccuuuccccucguuucuuucagcccccaccuccuacaaccuccucucuuccccagauccuccuccuccaguuccccuucagaaaaaaaucaggccuuccaggaauauuaaccaaacgugucauaagaagaugcaauaagacuaggcacaaauucuuauaucaaggcuggaugaggcaacucaggaggagaaaagggguccuaagcacagaugaaagagucagagacaccccacacccacuaauaaucagugcagagaguuguuaaaaacauuuagggguaggucagauauguuauaaacuaccaaacaaugcacagcuaagaacucauacccuuaacaaagagcuccaaauggcaacagugccaagauuuugaaacccugagcuauggucauaaggagggcuuguggaggagguggcacucuuagaagcuccagggcaacgaguacaguucuagguuacaggguucagcccagguuccuccaaaccugcaugccugacagaggccaccaucaugcuccuggaaggcauaggcagcguugagacagcagucuucuacccugaugucucucccaaguaggccuuugcaccugccagaggacuccucauacugggugaagcagagcacagggucugagccuguaagaucaggggagaggaauggcaaaucaggagugugguuggccugggcaucccuuggaggacaugugggcgcucauccacuuaccuguggcuggcaggauaaccaguagcagcaggagccacugaggggcuugcauuucagcaggcauuuugaacacuauguuucugcacuccucacagagaggaggccuugguuuugucuggacugaccugcuccagaaagaggaacccagggcaggaggaacugggaggguauggccucauuaacugugaagucucccuugugcacucugccccuccucuuuucucccuucuccauuuccuuguagcugcuuugucacccuugaugcugcuuuguuagucaaucuuuaccaccuaauaccccaccuuacccagaaaucacuuaguuuuucacucaaugcuuaggagacaaauucucacugaagggcacuggggucugaaaacaagaaccaccuaggcgugugaacguuggcaagucacuuuaaauucucagcuuuaguuuuccuuuuuuuuuuuuuuuuuuuugcaagguuuuacaacauagccauaccugaaauuugcuuuaaacaccaggcuggucuugaacaggcaaguaacaccauggcuggcucauuuucuuaccuguaaaaugcauaaucuugacuauggugaccaauuucauggggguacuggagaagggugagaugagggaaggccucauuugugaagaaggcaucauggcagcuacuuuaucuaccaucuugaaaacuuagcccuuuccuaaaagugagguuccuguggucagcauguaugugugugaggucaaugcaagggaagugaaaaagggaaguggcauugugugggaagugauucagaagaggggauguucaggcauacccacugcccaagguggggggaggggcucagugguaugccauuugccuagcaugugagcagcuuuaggucuguaugcaguacaaauuuacagcacuggacacagcuuagaucugucacagcccgacaaugaaaauacucagaauagugccuggcuguguuuacuaaauugguuuguucaacaauuauugagcaccuacugagcaucaguaguucucagcauuaaauggaauagaaaacaagacaggaaaaaaaaucacugucucuaaaggacuuaaacacucuacaaagggagacuagcaauaaaaaucuuucagaaaggucuucuccugugacccuucuuggaugucauuacucucuagccuuaggacacacaagaaucacccacagggcuucuugauccaacugcacauugcuggauccuaccuauuucucauucagcagguguagugugggccuccaguuuuucagacacacauacuucucagacaccauuugguugucaaguuucucacaacugcugacugugaguccuucuuuucuccucagcuccucagucucaccagaaccuauggaagcugcaacuguuuuguuguuuuaagauuuacuuauuuuauuuauuuuauguauauggguacacuguggcuguacaugauugugagccauccugugguugcugggaaugaagguugcuugcuuuggucgagccugcucgcuccggcccuguucacucuggccuaaagauuuauuguuauaucuaaguacacuguagcugucuucagaugcaccagaagaaggugucagaucccauuacagaugguugagucaccauguguuugcugggauuugaacucaggaccuucgaaagagcagucagugcucuuaaccagagccaucucuccagcccaaagcugagacuuguuaaccagcugcuacccacuaguagcggguaacauuuucagucucucuccuacacacacacacacacacacacacacacacacacacacacacacaccagccuuuuagacuuuagcagccacaaccaauccauuucuccaucuuuccuaugguuucuaugaaacauuuuaguuucacaccuaugucuuaucagucacuugggccucaugaucauuuucuuucacacaaucaguaacuucuuguucuuccuccuucauuucccucuucuuuuuuugagacaggguuucucuguguagcccuggcuguccuggaacuugcucuguagaccaggcugaccuugaacucugagaccuacuugcuucuccuuccccagugcugggauuaaagacgugugccucuaccaccuggcucacacaaucagcuucuuaaacauauaccuccaugacuuaauuucacacacaaaccauuucucaaaaccauuucucuacuaacagugugacuuuucaucuacaaaugguugggacuggagaaauggcccagucaauaaaacacuugcuuugcacaacccugugaauaaaggagucaacgugguaaaaggugaccguuugaucccuacaauacagguaaaaauuccaggcauagaaguacaugcuuguaaucccaagguagaaccagguagauccuugagacuugauggccagcaaguguaucccaacugguaaguuuaggcaaagaugagacccugucucaaaggaggggacaguguuccaguagacaacacaccacacauaagaccaugcauacacauguacaaaaauguuugcggucacacuucugaccugcgacacacauauuuaaaaucuuucgguuucucucaucacacugguuaccaaucagcagucuguaucagucucugacauaugccaucauuuugccucucucacagucaaucuuugccucgcccuuauuguucuucauauucguggcugucauggcuuauuuuggugacacaggagaaaaaaaaauaccaacagcuuucagcaacaccuuuaaaaauauauauuuacaggaacaauuccccauucucugggacucuuagaaaaaaagguccauuuuggggaagcaaaacaaguaguggagacgaguauagcaccgucccccaaaucaccaacccccaggucuucaggccuggucugggccagugcugacaggaggugagccugggagucuuuugauccaccuccuccagccuagauugauauaagacaggcuccaugucccccauuccucccucccaacuccagggacacuuaaaaggguccuuuguacccgccugcaggaaauuggggggcugggagggagccaaaaauacauguuugguauaaaaaauaaacacuuggggguggcaggaagaccgccuccaaaucccuuacuucccacccacccgccuacccacccaucugauauaggaagagauguuucccucuccccuauugaaaagccccauuuaaaaauagauuauacuaucaaaauggaagggggugggagacagagaccuggaguacuagcuggaggggccccccagacggggaccaccacccaaaaaaacccuccauugggagguaauaggcagggccccaggaaauuuggcagacaaaggaauggcuucucaggggggaagaacaacaaaaggaauaguccucccuggccaaaagguuacuugagaaaagaacaagcugacugagaagaagguuagggagguagcaauuccuauuuuaacaguguugauucccuggcuaccacucccaaaccauuaaaucguacaagggcucccuggacucagauacagccaggaauaauaaaacaaaacaagcuaguucuucaacccaugucgcaaaaugaagacagggcacccucaacuccccaagggcaggcugagaaauaaauaaauaaagguuccucucaagccaugcccugauugucuuguuuuaggaaaaaauggggaggaaaugggugagaugucuuacccacuccccuaaaaagguugggccagauucuucccaguggccuucaaaaaauaaauaaauaaaccgccccaccauugaaguaggagacguguaagggcagccacugggaggcuggcaaagaagaaagaaguugucuguuuuggguggaggaguuagugaaauauucacuuuuccaggaauauccaccccaccacaaucagagcuuaagucugucaguuuaacuauguuucuccuugagauggcuaacuggagaguucaggagcauagauggauggacuccaaaaaaggggugguggugguagucauggcuucuggggcccuggggagagcaccacgggggucgagaggccauccacacugauggaagggaugugcaccugugcgcugccacuggacggaaacugggggaagagacaaggagagguuaugggugaaccgugcuaguaacucuuaagcuuccaacagagcgggaggcaauccuaccuggaaggagagcuuggcuggacuacggggugcaauuggacucagagugcuccagaaauggaugcuagggggcagcgagcugggugucagcagcaccggggucuguagagacggaguggcaggaacucaagugaacaggugacaaguaugagaagauggaaagaaccuacuuucagcaccucuucauggaucuccuucagaguucuacaguuacuccucaaaaguucauaaaccuagaguauaacuacuaugaccaugccuaugacaucccucaaucauuacaccuaggagcucaguuccuguuacugagacuucgguaagacuauccaccagauucuauccaugcacugcucucaaaccuugugaccaccggaagaacucaacuucccagucuuagauuccaccaauauaccucacuagggaacccacuaugcaaaccccguggaaagcauuagggagucaggcugccacaaagaccuaagaccugcucuucuuaauuagccccaucacuucagcguaagcccaagaacagcuuguaaguuaccaguaccaaugccacucaucuaggcugccagcccuugcuccucugcaaggcacucaccaagguauguguggggagcagggauggcguuagcgcuggccccggugccugaagaccagagcuuguuccugauccuggaguccguucaggucccuggccacccagcaggcuugggcuaaguggaaguuccaggucccgaggcuuucggcccuucugcgguugggugaucucagugguggaaguggagaggccacacaccugggcuguguucucuguuaggauggcugggagccgagccagcaggccuucugaggcugagacuucugguucagcuuugacagcuucugaacugaagccuccagcccuugcagcuuccaauucuuccuuaggccccuccacuuugacuucugggggcuguggauggccaaaacuuggguccagacucaacucuucggauuucugguuuggggccucuggugggguuaggauaaccuggaaaaggggugugugcaaagggaaugcauaggauuguucauguguaaaaccuuucucugugggucauccaagaaugucucugggugagacucuagaguaucagugucauccaucuucauacccacauuaaucagaaacuuuggaaaugggcccaagcaacuuuaaggccacucucgugacuaugaugagugcuaaagcaugacaaucagcacauuagaugugacccuguaagggacuaauguacacauuagaugugacccuguaagggacuaauguacaaggagaggcauaacuuuccuaucuauuucucugagagaacuuguauccccucuuccgccucuauguccuauaccaggacaccuaucucuauucuaugaguucugugcuucauuucagaaugaugcauccuucuccaagcccuuuccuaaauuuccaaguuccaguacucaccugcaggggcagaccagccucuucugcuuccaaacaggcuucuaagggguuuggacuggugcuccugcucccugaggcgggugcugguacuccugcagggguaguguugggaagcacugaggcaggccgaggaggaauggguggcuguggcuguggcugcagggauuguauugugaagguagaauagaggcccgagcgcauguauucauuccggcugcuucgugcuaagccaccuuggccugucauuccugcacccuuugguguuccuggcuuuccaguggcaguguccccugggccugcauggacaguagcaggggccauggcuauggccgagguuacagacaccucaggcuggggugggcagucuucaguggagcacccugcaaccucuggguaggacacaaacuuguagacaaacuucuggccgcucaccuugcggaugauauucugagaagugaagaacagggugaauggagggucuugagggcuguuucucuucuccugaugucuuucuuuccacuugcuccuauuucacuccucucuuuuaggcuuguggagucuuuccaucugucuaugcuuuccuuucuuccccacucucugcaucccucugcaguuucaacuccuucucugggcuuccuuuaccaauucuuucuuuagugucccucccacccauuucccuucaagucuuuuucuguuauucaucuucaucagucuaauuccccuuuuuccacugacuacauuucaucagggaccaauuuaagggaaugggugagaucuaugaaccuggguuuaacagagucagguuuguuuuggaaauguuaacaggacugcaguaauaaaaugaaguaacugauacauguuggaagagacuaaacuaguauagaugaauagggagagaaauaccaagauugauacagagggcugacuguugugggaaggggaacugagggugacugacugauugugggguauaaguguaccauagcacauagacaggucagaggaggacaaauugcagaagaugguugucccuucuaguaugugggucccagggauugaacucagguucucaggcuuggcaacaagagccuuuaccugcuaagccaucgccuuggccagagcuaguggauuuuuaaaagcuagcgaugcugacauggagcagaaaaagcauguugguuauuuguuuuuguuaacuugacacaagccagagucauuuaagaagagaaaaaaaaaugccucuuucagauugucuuuaggcaagucaguaggcauuuuccugcuguagguggugcuuucccugggaaggugguccugggcuguguaaaagagguagcugaacaagcuaugaaaaacaagccaguaagcaguauuccuccauggacuuggcuucaguuccuguuuccagguuccuaucuugaccucccucaaugauggaccuugcuaagccaucucacuggaaagagagaguggauuuuucaagaugaaguaaagccuuuccuccucaaguaacuuuuggucaugguguuuauuacagcagcagaaagcacacuaugacagaaauuaguaccacacagggcuuacugcggugacagaccugagcguguuguuuuggaaagagcuguggcagcaucuggaacuuuugcuagcaucugaacguuuguucagagcuuuagaugagagaugccaagggaacuuggaagauaauucugauagcagugcagaugguggagggcuggcuugugaagguucagagggaagucugagagccccucagucucuauaggggucauuuaugugauauuuuguauuaagacucugguuucugguuaccacagaaccagaaggaucagcugugauuaacaagagaccagcaucccugaagugaaaucuugacuuuacugggacaaccgagaguaauuagcagaggcugacaaaaaaucagcugugaguagagaucagcaucacugaggugaaaucuuucaggaaguauuuucucagggucaguacacagaaccugugguccagaggagccaagaaugcauauuaugcugguagcuugaacuuggcaauguguaagaagagucuuccacaugguauuuggcauaaaagccucaugccaagggguuguggagagcagcugaggccugguacuuugaaaggcuaggagaagucacuggugaagaugaaaccucaguugcaauagaugcuccaggauugaaagggucauggagagaagcuggggcuugguaccauauaauaggguuggaaucccuguagagaggcuaagaggccaguggugagggugcauccucaguugcagugaagaccccagccuauuggagaagcaaagacugugggacaccacuuagaauggugaaaguaugauauggagcuagacucaggccaggagaugcaguuggugcagcuguagcaguggagcugcccaagcucucuggagccuaaaagaucaugagugagucccaggugccagaucuucaucugcagaucuugacacugcuacaguuuggucauguuuugaucugauuguaacuggcucuuuccucuuggaguaagaguaaauaagugcuuauuuuuuauuuuauaggagcugacaguugagagauacuagauauuuuagagacauugaaucuuugaaguuuuaaaaggacuuucaaaguuauacuauguuuuauuuugugauacugauauuaacaugagaucuuggggauaaauacaaaguuaacaauuauacuuuaacagugucaagaugacaaaaagagacaaauguccugguuagcuuuuugucaacuugauacaaacuacaguuaucuaggaagaaagaccuucaauuaagaaaguacugccaucagacugccuguaggcaagucugugggacauuuuacugauuagugauugaugugguaggggccagcauacuuagggugguaccacccuugggaauguggucaaggguaguauaaaaaaaaagcacacugagugacccaugggguagcaagccaguaugcagccuuccucuauggccucugcuuuagcuucugccuccagguuccugccuugaguucuucccuuggcuucccucaaugauggacugugacauggaaguagaagagaaacaaacccuuuccuuuugaucaucaugcuucugcuaacaagagaauacauuaggacagaaauaucacaaaagaggacaggugauguuuuauuauuaguaccauucuggauauuuaagcuaaaguacuaagaaaaugagguaacuggcaggaauuagagaagagaguaagaagcugguguaaccaugagggggauagcaagguuuguuugggugggucagaaaacaugguuuggacgguuucagggaugucuugguggucucgggacaaaacgaggcauuauuuuggagauuugaacugaaagaguaauguaugaaacuggaauauaugccauaaacuaccgaggacagaaagcacaggugagaacuauuuggggugguggcaugaagaauauggggcacuaggcauuuuggugaaugucuuaaugcuggccauaggggauccuuguauuuuacagaaaaugaaggaaaauggguaauuauuaauauuguuuugaagguuuacccugaagaaauaugaaauaauuagugcacauauuggugggaauacaaugcagaucugggagcuugagagaguaagaugagaaaaaucuaaaaauugagucccuguaagaugaugaacuaaagcaagugauauagauacugaggcgcugcucuagggaucuaagagggguggguaugagcuggcacuacaaacauuuuucuggagcauuuacuuaaaggcaaagauuuguaaucuuagcacucaggagacuaagcaagagaaaugcaaguuugaggccaucuucagcaacacaaagagagccugccucaaaaauaaaaacaaaacaaaacaagugauuaaagauauuggggguucuagaaaauggaguaaggaaacuuaguauuacaaugucgggaugauucugagucuaggaauaagaacauggauuuuucgguaguaagagaagauaaaguaacuaggggaaucuaacauuggucugaggauucugaaaaacacaccuauuaucuccaggcaugcagggaacuagaguauagggccaaaauuaguaaguuuuaauacugucuucaaaguuauagcuauacuaauugagacaacaaaaugaaauuucuaggccugaaguguaauuccagaaauuggggguagagacaggacagugaaacugaggccagcuuaggcuacauaguuaaguuccagacaaaucuagacuacauuauaagaccuugucucaaaaggaaaaaaaaaaaaacagaguuuuuccgacaguaauuucaaggguuugcaguccuggucuuugaggccauaccuuaucauaguaguaccgcaaggcccggcuaagcuugucguaauucauguuggucuuguucuugcgcaguccccauagccgggccaccuccucugcauccaccaacuugaacucaccaccaucccgugagguccaggagaugauguggccauuaccuuguucucucagaagcugcagcagaaacugccacagcgucacagauggguccaucacuagggaagcacucacgccauuccaggaguaccuggaagagagcaaaaaugauucguuucuuguuaccuugccuccacaucuguucccaaaucucacuacuauucccuaaacagucuccuaaacuucuucauguagcuuuggaugccccuuguauuuuacaugugugacaaaaaagaauuaaaggaaaaaauaugugaguauguccaugugacuauauguacacaugugugcuggugccaagagagaucagaagagggcaauggauucccuggagcuagaguucaggcaguuauaaacugcccaacaugggugcugggaacuggacucugcuucucugugagagcagcaagcauucuuuauauugagcccucaguccagccuugaugcaugugaaucuuuaggagccagagggaagacagaauacaacccgagccccaaagaguuccauauccuaguuauuggagucugugaccagguuaggcuacauagcauaaaugaauucugagaugaaauuaagauuacagaccuuaagauauagcaaucacucuggcuuuauuugaggucaaccacuguaugagcucuuuucaaagcagagaaaugaggcuaaaacagaguuuagggcagaauggcagaaggacuuucucugcuauuucuugauucuggagaaggcucuaagacaggaaaauugggcagcuccacaaaucuggaaugacccucagcuuaaagccaguaaggaaaucagcauuacaacuaaagggacaaccugaaugagcaggaaacaaaccucuucuagaaaggacuaaaaguccugcuagacuuuaaugcuagccuggcaagaucaguguugggcuucugucagaugauaaauuauauauuuuuuuaaaugacagagucuuacuauguagcccgggcuggucuugaacucuugccucagcuuccugaguacugggaauacagguauguaccaaugcaucuacagaaauguauaguuucaaugagaauaaauuauauagcgggacuagaaaacuaguguaauauccauaacuuaacucacauuaacucucucucucucucucucuccccuuuccuaucaacuuuucuaggaugugccuuuugguagcccuuugcaaguacuguucacuguacauggagcuccuuuccucuuugagcagucguccucuaaaaacgacgaagaggacccacugaaaaguccuuugcguuaugaagccuuccugaaucugaauacguacucuucucuguuccuuga

SEQ ID NO: 9429 - RNA, 36569 nt, Mus musculus
ugcucuagaaaauucuauugccccacuuccaauauugggggcagguucccccuucgucauuacagaaucuuagaaagagucuagaaaggcugguuuauuguggucuagaaagucagggggucagaauggaagcaagggauuuuaggguuucuucucuucugggucuuugcagacaggcacauguagacaugaccguuucucuuccaccaccagcuucugccccuguagcgcuucacacaguggccguggagucccccagaagguaacauucuucucacccugaccuucaaccauugaaacuguaggccuggaguauuggggaagcaauggaggagagcagcucagguaagacaagaaugcauugaaacaacuuuguuuuuugagaguaucuuaucucaaaaucaaugauaccccugccucagcuucccaaaugugggaauuauaggcaagugucauaucaauuuuuugugguauuagagauuaaaccuaggacuuuguauuugcuaggaaagugcuccacuauaucccuaauagcccagcauucuuuuugucuguuuguuuguuuagguccuacugaccuauucccucucuuuuacccaggcuaacccugaacucauucuguagccuaggaaugucuugaacaugugguccuuuugguuccagcguuucaagcaguuaggauuauagguuugcccuacuacaccugaauuaacaucucacuguacauuuaacucuaugucuaacugugauacuggaguauuucugauaaagaaauaggaaagaugauucccugugcaucaguuucccucaucuacaaaauggaaguaagaggaauaauauuuaccaccaaacccuuucucuuuucucauacucaccuuaaaucccuauccuaagccauuauuucuccucuccccuugauuuccaucucucuuuucuuuguuccuccccacuuuacccaaauagaacuuuauguccaggaagguuuuugccagauagauuucuccuaguaggcaagcacucuauucauuuuuacccagccucuauguggaaaacuuaggaaauuaggaacugguuccuaacuucaggaaccagucugacuccucgcccccacccccccacauuugcaaaauccuaucccagugacaggcuauuuaacagcugggaaaaggccauuuaaccaugauguaugugguguaagaagggauagguaacuuaucccauucuaacuccugggccacugugguguccaguaaacacucaagguggcuggcuaaucagcucugucaagaacaugcucacaaucuggaugucaggaaugcuucuccagaagggccuaauuuagcucucuaggcccagaggguagugauagucucauugcuacuuaccugucauuuuuagauuguaucuaucacaacucaucuggguaccuucuacccauagaucuggguucuuuuuuagagacuguugcuaaaaaaugccuuggaguaccucaagguagugaaauguggaguggauaaauggaggcauggaugacugaguaacucaaaaguacgcuaagagcucagugagaaggcugcaugaaggacuauaugcaugggaguacagcuaugugacugcauuagaaacugaggcacacagaggcugggaagucuucccuaauugcuccuccuccucuuuucuuucucuccucuucucuaagcuaggagauggcacuggcaaggcaggcaccuuugauccaggggugaagcuccaguucaauguaaccaauucccuucucauccuucagcaucaugagccccuccuagaaacacaauguccuucaacucacggguacuuggggagcaaaggugugcagaggcgcuggcggacacggguggcguugggacuacaugguggugugcacagacuccagguacuccacugugaccaugaaccuuucacugcaauaggaggggguaauacagugucacauagucaaaacuggaggucucaauggaaaaaggagaccgcaagggcauuggguacccagcauagcuacagcaugguugcccacccuuacagugcugccugugggucacucacugauacaguuauggauguuauagcagugucgaauauccuggaguuuuccagcacauggcuucccauuaaauuugcggccgccacagcuccuugaacgugacugcuggccugggguuccuucacaguugauggacauucucagccggcugcagucacuccauuuuccccaggccucccacuccccguuuacuguagagacaaggagcaagaggguuuggggccaguaaagggccucaggggaaggaaugaagaaggcuuugagagggagugggagugaacagauguggggaugaaggaggagaggugaaccaggguaugaaggcaggaacaagguuuugguagcaagugggcagcagugaugggcauagggcuugggcaggggguuaggcaugggcauggugccuuuugacuugcuaaccagggcaagguacggcuuuguuacacauuugguuccgaguggcaucaccagcacaaaaggggcccccaugacggggugcagggugaucacauguccguugcucuagggucuggcccaggccacaagucacagagcaggggcucaaagggcuccauggcccccagccaccagccacuguuggaauggagagaaagugacaauaaagaccaccuuaaucaugcacucuccccagcuucccucccuaucaccucuagacaucugaggcaaacuccucagaugauaggcuucugaucacgugguacaagaauuccauucaucuuugccagaaaucuaaagccccacuagcugcaugacgauggccucaucccugcauaccugggcaaggugguaggccacugcaggccuuaugcucauaggcugguccugagcaggguuucccagggggcuggugugaaggugcuggugcagaacaugagcggcuucgugucuccuuagguucuugagcaccaccaaggcaggauccugagcaggggcuccaggggccccaggaugcccaggccccaugugcugugguagaaauggaaggaugaacuguagucaagcaagcauaaaaguuuuuuuuucucccucacaguuucuugcuguaacccaacauuaucccuuccauguccugugacuacucuuacucacuggggcaggucuucugggugucacaggccugugauugcugggccucuccugggcaguggcccccacacuuaggagcaggauuaucacauacucguugacggaucuggguuccuuuggagcaugugacagagcaaggcccccaggguccccacucagaccagccacccaucucugugggagaaaaagagaagaaguggggguguguguggcaacuuaggauuccuuucuuuccacaggguccccaaugaaggagcuagagaaaggacccaaggagcugaaggggucugcaucccccuaggaggaacaacaauaugaacuaaccaguacucccagagcucccugggacuaaaucacuaaccaaagaguacacaugguaggacucguggcuccagcugcauauguagcagaggauggccuagucggucaucaauaggaggagaggcccuugguccugugaauguucuaugcccugguauaggggaaugccagggccaggaagaaggaguggguggguuggugagcagggggaggggaggggauaggggauuuucgaagggaaaacgaggaaaggggauuacauuugaaauguaaagaaaaccuaauaaaaaccaaggaucccuuucuuucaugugugucccacaucaucuuagccuguccuaucucuugucccuauaccugaccuagcaguacugcucauguggacuauagcagcagcuuucauacuccagauuuggccuguccucuucccaaagcaagucaaaguaaaucucuccccuuccaauaauccaaaucauucagccucaagccaauguuuuuacuuucgaacauccuucagcgauccuagccuccuccauucuccuuaaagccauacaaaggucuguccucaggaccucugcacugauucuucuaguguugugggcugguuccauguccgcauuguugaucuuccuuaccuggacagcauggcugguccucacaggccuguagcugccacucaagaguuccaggagccacauucucagagcacugaccaccucugcccacacagcgccugugucgcagcugggaccccucagaacauguaacugagcagggcccccauaaggaccaugcugaccauuguggagaccuguagagaggagccgauguucuauccugguaugaagugacaggauagaucacugagagccuacuuaccacuuagggauggugggugauugaacaggaagaagugaauauacaggaaauaucuaauaaauuucauuucccuucauuuuccucuggaaaccccccagggucauagccagauguacaauaagcaaauuuacagacuaaaaaaccagaacuucugccaggaacucaauaggucacuacccuguacaguaccacacagagaggaaguccuuacuaaacagaagcucugcggucccuucacaacauccuagagaaacacauugcuucugcacagaacuggguuugcaugauaauauggguaugcaugccagugcuaaagagacaugaacuguuagcaugacuggcagcucagagcugcuuuccaagaucuucaagccuaucaucuuuacaauguuaucugaaauacauaguaagcagucauaaacuauaucuacaguauaguaagacucaacauauguaaacuggaagucaugauuaggagcuuugaagugccuucagagaccaaacugccacaaaagaguugcacaaugaaugugucaucacaauuaaagauuuggcauuguccucagaauuuccuuaaaguccuccauuucuauaaugguucuauauauaauaagcacucaauuaugaucuauuguaaguuaggagaauagagcuaccauagaaaauauccaaauugcaccccaccugcaauguuuacaggaagcccugacuuuuaaagcauuuuaaaauuaggguuaauuuugucucuccuaagggacauuuggcaguaucuggauucagcuuuuuuaaaaacucuucucucauacaagacagccuaacuauaguuuccuuuccccucguuucuuucagcccccaccuccuacaaccuccucucuuccccagauccuccuccuccaguuccccuucagaaaaaaaucaggccuuccaggaauauuaaccaaacgugucauaagaagaugcaauaagacuaggcacaaauucuuauaucaaggcuggaugaggcaacucaggaggagaaaagggguccuaagcacagaugaaagagucagagacaccccacacccacuaauaaucagugcagagaguuguuaaaaacauuuagggguaggucagauauguuauaaacuaccaaacaaugcacagcuaagaacucauacccuuaacaaagagcuccaaauggcaacagugccaagauuuugaaacccugagcuauggucauaaggagggcuuguggaggagguggcacucuuagaagcuccagggcaacgaguacaguucuagguuacaggguucagcccagguuccuccaaaccugcaugccugacagaggccaccaucaugcuccuggaaggcauaggcagcguugagacagcagucuucuacccugaugucucucccaaguaggccuuugcaccugccagaggacuccucauacugggugaagcagagcacagggucugagccuguaagaucaggggagaggaauggcaaaucaggagugugguuggccugggcaucccuuggaggacaugugggcgcucauccacuuaccuguggcuggcaggauaaccaguagcagcaggagccacugaggggcuugcauuucagcaggcauuuugaacacuauguuucugcacuccucacagagaggaggccuugguuuugucuggacugaccugcuccagaaagaggaacccagggcaggaggaacugggaggguauggccucauuaacugugaagucucccuugugcacucugccccuccucuuuucucccuucuccauuuccuuguagcugcuuugucacccuugaugcugcuuuguuagucaaucuuuaccaccuaauaccccaccuuacccagaaaucacuuaguuuuucacucaaugcuuaggagacaaauucucacugaagggcacuggggucugaaaacaagaaccaccuaggcgugugaacguuggcaagucacuuuaaauucucagcuuuaguuuuccuuuuuuuuuuuuuuuuuuuugcaagguuuuacaacauagccauaccugaaauuugcuuuaaacaccaggcuggucuugaacaggcaaguaacaccauggcuggcucauuuucuuaccuguaaaaugcauaaucuugacuauggugaccaauuucauggggguacuggagaagggugagaugagggaaggccucauuugugaagaaggcaucauggcagcuacuuuaucuaccaucuugaaaacuuagcccuuuccuaaaagugagguuccuguggucagcauguaugugugugaggucaaugcaagggaagugaaaaagggaaguggcauugugugggaagugauucagaagaggggauguucaggcauacccacugcccaagguggggggaggggcucagugguaugccauuugccuagcaugugagcagcuuuaggucuguaugcaguacaaauuuacagcacuggacacagcuuagaucugucacagcccgacaaugaaaauacucagaauagugccuggcuguguuuacuaaauugguuuguucaacaauuauugagcaccuacugagcaucaguaguucucagcauuaaauggaauagaaaacaagacaggaaaaaaaaucacugucucuaaaggacuuaaacacucuacaaagggagacuagcaauaaaaaucuuucagaaaggucuucuccugugacccuucuuggaugucauuacucucuagccuuaggacacacaagaaucacccacagggcuucuugauccaacugcacauugcuggauccuaccuauuucucauucagcagguguagugugggccuccaguuuuucagacacacauacuucucagacaccauuugguugucaaguuucucacaacugcugacugugaguccuucuuuucuccucagcuccucagucucaccagaaccuauggaagcugcaacuguuuuguuguuuuaagauuuacuuauuuuauuuauuuuauguauauggguacacuguggcuguacaugauugugagccauccugugguugcugggaaugaagguugcuugcuuuggucgagccugcucgcuccggcccuguucacucuggccuaaagauuuauuguuauaucuaaguacacuguagcugucuucagaugcaccagaagaaggugucagaucccauuacagaugguugagucaccauguguuugcugggauuugaacucaggaccuucgaaagagcagucagugcucuuaaccagagccaucucuccagcccaaagcugagacuuguuaaccagcugcuacccacuaguagcggguaacauuuucagucucucuccuacacacacacacacacacacacacacacacacacacacacacacaccagccuuuuagacuuuagcagccacaaccaauccauuucuccaucuuuccuaugguuucuaugaaacauuuuaguuucacaccuaugucuuaucagucacuugggccucaugaucauuuucuuucacacaaucaguaacuucuuguucuuccuccuucauuucccucuucuuuuuuugagacaggguuucucuguguagcccuggcuguccuggaacuugcucuguagaccaggcugaccuugaacucugagaccuacuugcuucuccuuccccagugcugggauuaaagacgugugccucuaccaccuggcucacacaaucagcuucuuaaacauauaccuccaugacuuaauuucacacacaaaccauuucucaaaaccauuucucuacuaacagugugacuuuucaucuacaaaugguugggacuggagaaauggcccagucaauaaaacacuugcuuugcacaacccugugaauaaaggagucaacgugguaaaaggugaccguuugaucccuacaauacagguaaaaauuccaggcauagaaguacaugcuuguaaucccaagguagaaccagguagauccuugagacuugauggccagcaaguguaucccaacugguaaguuuaggcaaagaugagacccugucucaaaggaggggacaguguuccaguagacaacacaccacacauaagaccaugcauacacauguacaaaaauguuugcggucacacuucugaccugcgacacacauauuuaaaaucuuucgguuucucucaucacacugguuaccaaucagcagucuguaucagucucugacauaugccaucauuuugccucucucacagucaaucuuugccucgcccuuauuguucuucauauucguggcugucauggcuuauuuuggugacacaggagaaaaaaaaauaccaacagcuuucagcaacaccuuuaaaaauauauauuuacaggaacaauuccccauucucugggacucuuagaaaaaaagguccauuuuggggaagcaaaacaaguaguggagacgaguauagcaccgucccccaaaucaccaacccccaggucuucaggccuggucugggccagugcugacaggaggugagccugggagucuuuugauccaccuccuccagccuagauugauauaagacaggcuccaugucccccauuccucccucccaacuccagggacacuuaaaaggguccuuuguacccgccugcaggaaauuggggggcugggagggagccaaaaauacauguuugguauaaaaaauaaacacuuggggguggcaggaagaccgccuccaaaucccuuacuucccacccacccgccuacccacccaucugauauaggaagagauguuucccucuccccuauugaaaagccccauuuaaaaauagauuauacuaucaaaauggaagggggugggagacagagaccuggaguacuagcuggaggggccccccagacggggaccaccacccaaaaaaacccuccauugggagguaauaggcagggccccaggaaauuuggcagacaaaggaauggcuucucaggggggaagaacaacaaaaggaauaguccucccuggccaaaagguuacuugagaaaagaacaagcugacugagaagaagguuagggagguagcaauuccuauuuuaacaguguugauucccuggcuaccacucccaaaccauuaaaucguacaagggcucccuggacucagauacagccaggaauaauaaaacaaaacaagcuaguucuucaacccaugucgcaaaaugaagacagggcacccucaacuccccaagggcaggcugagaaauaaauaaauaaagguuccucucaagccaugcccugauugucuuguuuuaggaaaaaauggggaggaaaugggugagaugucuuacccacuccccuaaaaagguugggccagauucuucccaguggccuucaaaaaauaaauaaauaaaccgccccaccauugaaguaggagacguguaagggcagccacugggaggcuggcaaagaagaaagaaguugucuguuuuggguggaggaguuagugaaauauucacuuuuccaggaauauccaccccaccacaaucagagcuuaagucugucaguuuaacuauguuucuccuugagauggcuaacuggagaguucaggagcauagauggauggacuccaaaaaaggggugguggugguagucauggcuucuggggcccuggggagagcaccacgggggucgagaggccauccacacugauggaagggaugugcaccugugcgcugccacuggacggaaacugggggaagagacaaggagagguuaugggugaaccgugcuaguaacucuuaagcuuccaacagagcgggaggcaauccuaccuggaaggagagcuuggcuggacuacggggugcaauuggacucagagugcuccagaaauggaugcuagggggcagcgagcugggugucagcagcaccggggucuguagagacggaguggcaggaacucaagugaacaggugacaaguaugagaagauggaaagaaccuacuuucagcaccucuucauggaucuccuucagaguucuacaguuacuccucaaaaguucauaaaccuagaguauaacuacuaugaccaugccuaugacaucccucaaucauuacaccuaggagcucaguuccuguuacugagacuucgguaagacuauccaccagauucuauccaugcacugcucucaaaccuugugaccaccggaagaacucaacuucccagucuuagauuccaccaauauaccucacuagggaacccacuaugcaaaccccguggaaagcauuagggagucaggcugccacaaagaccuaagaccugcucuucuuaauuagccccaucacuucagcguaagcccaagaacagcuuguaaguuaccaguaccaaugccacucaucuaggcugccagcccuugcuccucugcaaggcacucaccaagguauguguggggagcagggauggcguuagcgcuggccccggugccugaagaccagagcuuguuccugauccuggaguccguucaggucccuggccacccagcaggcuugggcuaaguggaaguuccaggucccgaggcuuucggcccuucugcgguugggugaucucagugguggaaguggagaggccacacaccugggcuguguucucuguuaggauggcugggagccgagccagcaggccuucugaggcugagacuucugguucagcuuugacagcuucugaacugaagccuccagcccuugcagcuuccaauucuuccuuaggccccuccacuuugacuucugggggcuguggauggccaaaacuuggguccagacucaacucuucggauuucugguuuggggccucuggugggguuaggauaaccuggaaaaggggugugugcaaagggaaugcauaggauuguucauguguaaaaccuuucucugugggucauccaagaaugucucugggugagacucuagaguaucagugucauccaucuucauacccacauuaaucagaaacuuuggaaaugggcccaagcaacuuuaaggccacucucgugacuaugaugagugcuaaagcaugacaaucagcacauuagaugugacccuguaagggacuaauguacacauuagaugugacccuguaagggacuaauguacaaggagaggcauaacuuuccuaucuauuucucugagagaacuuguauccccucuuccgccucuauguccuauaccaggacaccuaucucuauucuaugaguucugugcuucauuucagaaugaugcauccuucuccaagcccuuuccuaaauuuccaaguuccaguacucaccugcaggggcagaccagccucuucugcuuccaaacaggcuucuaagggguuuggacuggugcuccugcucccugaggcgggugcugguacuccugcagggguaguguugggaagcacugaggcaggccgaggaggaauggguggcuguggcuguggcugcagggauuguauugugaagguagaauagaggcccgagcgcauguauucauuccggcugcuucgugcuaagccaccuuggccugucauuccugcacccuuugguguuccuggcuuuccaguggcaguguccccugggccugcauggacaguagcaggggccauggcuauggccgagguuacagacaccucaggcuggggugggcagucuucaguggagcacccugcaaccucuggguaggacacaaacuuguagacaaacuucuggccgcucaccuugcggaugauauucugagaagugaagaacagggugaauggagggucuugagggcuguuucucuucuccugaugucuuucuuuccacuugcuccuauuucacuccucucuuuuaggcuuguggagucuuuccaucugucuaugcuuuccuuucuuccccacucucugcaucccucugcaguuucaacuccuucucugggcuuccuuuaccaauucuuucuuuagugucccucccacccauuucccuucaagucuuuuucuguuauucaucuucaucagucuaauuccccuuuuuccacugacuacauuucaucagggaccaauuuaagggaaugggugagaucuaugaaccuggguuuaacagagucagguuuguuuuggaaauguuaacaggacugcaguaauaaaaugaaguaacugauacauguuggaagagacuaaacuaguauagaugaauagggagagaaauaccaagauugauacagagggcugacuguugugggaaggggaacugagggugacugacugauugugggguauaaguguaccauagcacauagacaggucagaggaggacaaauugcagaagaugguugucccuucuaguaugugggucccagggauugaacucagguucucaggcuuggcaacaagagccuuuaccugcuaagccaucgccuuggccagagcuaguggauuuuuaaaagcuagcgaugcugacauggagcagaaaaagcauguugguuauuuguuuuuguuaacuugacacaagccagagucauuuaagaagagaaaaaaaaaugccucuuucagauugucuuuaggcaagucaguaggcauuuuccugcuguagguggugcuuucccugggaaggugguccugggcuguguaaaagagguagcugaacaagcuaugaaaaacaagccaguaagcaguauuccuccauggacuuggcuucaguuccuguuuccagguuccuaucuugaccucccucaaugauggaccuugcuaagccaucucacuggaaagagagaguggauuuuucaagaugaaguaaagccuuuccuccucaaguaacuuuuggucaugguguuuauuacagcagcagaaagcacacuaugacagaaauuaguaccacacagggcuuacugcggugacagaccugagcguguuguuuuggaaagagcuguggcagcaucuggaacuuuugcuagcaucugaacguuuguucagagcuuuagaugagagaugccaagggaacuuggaagauaauucugauagcagugcagaugguggagggcuggcuugugaagguucagagggaagucugagagccccucagucucuauaggggucauuuaugugauauuuuguauuaagacucugguuucugguuaccacagaaccagaaggaucagcugugauuaacaagagaccagcaucccugaagugaaaucuugacuuuacugggacaaccgagaguaauuagcagaggcugacaaaaaaucagcugugaguagagaucagcaucacugaggugaaaucuuucaggaaguauuuucucagggucaguacacagaaccugugguccagaggagccaagaaugcauauuaugcugguagcuugaacuuggcaauguguaagaagagucuuccacaugguauuuggcauaaaagccucaugccaagggguuguggagagcagcugaggccugguacuuugaaaggcuaggagaagucacuggugaagaugaaaccucaguugcaauagaugcuccaggauugaaagggucauggagagaagcuggggcuugguaccauauaauaggguuggaaucccuguagagaggcuaagaggccaguggugagggugcauccucaguugcagugaagaccccagccuauuggagaagcaaagacugugggacaccacuuagaauggugaaaguaugauauggagcuagacucaggccaggagaugcaguuggugcagcuguagcaguggagcugcccaagcucucuggagccuaaaagaucaugagugagucccaggugccagaucuucaucugcagaucuugacacugcuacaguuuggucauguuuugaucugauuguaacuggcucuuuccucuuggaguaagaguaaauaagugcuuauuuuuuauuuuauaggagcugacaguugagagauacuagauauuuuagagacauugaaucuuugaaguuuuaaaaggacuuucaaaguuauacuauguuuuauuuugugauacugauauuaacaugagaucuuggggauaaauacaaaguuaacaauuauacuuuaacagugucaagaugacaaaaagagacaaauguccugguuagcuuuuugucaacuugauacaaacuacaguuaucuaggaagaaagaccuucaauuaagaaaguacugccaucagacugccuguaggcaagucugugggacauuuuacugauuagugauugaugugguaggggccagcauacuuagggugguaccacccuugggaauguggucaaggguaguauaaaaaaaaagcacacugagugacccaugggguagcaagccaguaugcagccuuccucuauggccucugcuuuagcuucugccuccagguuccugccuugaguucuucccuuggcuucccucaaugauggacugugacauggaaguagaagagaaacaaacccuuuccuuuugaucaucaugcuucugcuaacaagagaauacauuaggacagaaauaucacaaaagaggacaggugauguuuuauuauuaguaccauucuggauauuuaagcuaaaguacuaagaaaaugagguaacuggcaggaauuagagaagagaguaagaagcugguguaaccaugagggggauagcaagguuuguuugggugggucagaaaacaugguuuggacgguuucagggaugucuugguggucucgggacaaaacgaggcauuauuuuggagauuugaacugaaagaguaauguaugaaacuggaauauaugccauaaacuaccgaggacagaaagcacaggugagaacuauuuggggugguggcaugaagaauauggggcacuaggcauuuuggugaaugucuuaaugcuggccauaggggauccuuguauuuuacagaaaaugaaggaaaauggguaauuauuaauauuguuuugaagguuuacccugaagaaauaugaaauaauuagugcacauauuggugggaauacaaugcagaucugggagcuugagagaguaagaugagaaaaaucuaaaaauugagucccuguaagaugaugaacuaaagcaagugauauagauacugaggcgcugcucuagggaucuaagagggguggguaugagcuggcacuacaaacauuuuucuggagcauuuacuuaaaggcaaagauuuguaaucuuagcacucaggagacuaagcaagagaaaugcaaguuugaggccaucuucagcaacacaaagagagccugccucaaaaauaaaaacaaaacaaaacaagugauuaaagauauuggggguucuagaaaauggaguaaggaaacuuaguauuacaaugucgggaugauucugagucuaggaauaagaacauggauuuuucgguaguaagagaagauaaaguaacuaggggaaucuaacauuggucugaggauucugaaaaacacaccuauuaucuccaggcaugcagggaacuagaguauagggccaaaauuaguaaguuuuaauacugucuucaaaguuauagcuauacuaauugagacaacaaaaugaaauuucuaggccugaaguguaauuccagaaauuggggguagagacaggacagugaaacugaggccagcuuaggcuacauaguuaaguuccagacaaaucuagacuacauuauaagaccuugucucaaaaggaaaaaaaaaaaaacagaguuuuuccgacaguaauuucaaggguuugcaguccuggucuuugaggccauaccuuaucauaguaguaccgcaaggcccggcuaagcuugucguaauucauguuggucuuguucuugcgcaguccccauagccgggccaccuccucugcauccaccaacuugaacucaccaccaucccgugagguccaggagaugauguggccauuaccuuguucucucagaagcugcagcagaaacugccacagcgucacagauggguccaucacuagggaagcacucacgccauuccaggaguaccuggaagagagcaaaaaugauucguuucuuguuaccuugccuccacaucuguucccaaaucucacuacuauucccuaaacagucuccuaaacuucuucauguagcuuuggaugccccuuguauuuuacaugugugacaaaaaagaauuaaaggaaaaaauaugugaguauguccaugugacuauauguacacaugugugcuggugccaagagagaucagaagagggcaauggauucccuggagcuagaguucaggcaguuauaaacugcccaacaugggugcugggaacuggacucugcuucucugugagagcagcaagcauucuuuauauugagcccucaguccagccuugaugcaugugaaucuuuaggagccagagggaagacagaauacaacccgagccccaaagaguuccauauccuaguuauuggagucugugaccagguuaggcuacauagcauaaaugaauucugagaugaaauuaagauuacagaccuuaagauauagcaaucacucuggcuuuauuugaggucaaccacuguaugagcucuuuucaaagcagagaaaugaggcuaaaacagaguuuagggcagaauggcagaaggacuuucucugcuauuucuugauucuggagaaggcucuaagacaggaaaauugggcagcuccacaaaucuggaaugacccucagcuuaaagccaguaaggaaaucagcauuacaacuaaagggacaaccugaaugagcaggaaacaaaccucuucuagaaaggacuaaaaguccugcuagacuuuaaugcuagccuggcaagaucaguguugggcuucugucagaugauaaauuauauauuuuuuuaaaugacagagucuuacuauguagcccgggcuggucuugaacucuugccucagcuuccugaguacugggaauacagguauguaccaaugcaucuacagaaauguauaguuucaaugagaauaaauuauauagcgggacuagaaaacuaguguaauauccauaacuuaacucacauuaacucucucucucucucucucuccccuuuccuaucaacuuuucuaggaugugccuuuugguagcccuuugcaaguacuguucacuguacauggagcuccuuuccucuuugagcagucguccucuaaaaacgacgaagaggacccacugaaaaguccuuugcguuaugaagccuuccugaaucugaauacguacucuucucuguuccuugaucccccaauuuuucuaaccugggauuguuccuguacgguuuaagcguuuaaauuuuuuucuuuuugaugagcauauauuaauuauacauaguggguuucuauuauuuauacauaauggguuucauuauaacauuucuuuuucuuucuuuuuuuuuuuguuuuuguuuuuuucgagacaggguuucucuguguaguccuggcuguccuggaacucacuuuguagaccaggcuggccucgaacucagaaaucaacuugugucugucucccaagugcugggauuaaaggcgugcgccaucauuauaccauuucuaauauaaugacuuugauuaaauuucccuccauuaaccuaucccguuccccucccuucccacugauuaucuuccucuucccaacuaggcuucuuuguauauuaugacuuuuuugugauccaaugaauuuuaguagaguugcuuacaaggccauggugaagguuuguuuucaggaacauggacccugcaucacugaaguaaccauuaaaggccuuuagauccacaggaaaggaugaggccacaugaaucuucucucucucucucucucucucucucucucucucucuuuuugccauuguugcugcugcauugugauaggguauuauguaguucaagcuguccucaaguuccugaugcuauuguuuccauuucccaagugcugagauuacacacaccccagcaaacaaggcagcuacuucuuucuguagugcuagagaucaaauccagggacuuaugcauguuaaguacaagauuuaucacagagcuucacccggaacccaugccuuuuaauuucuuuuuauuuuuauuggauauuuuauauauuuacacuucaaauguuauccccauuuccaguuuucccucugggaacccccaucccauccucccucccccugcuucuaugagggugcuuccccaccccccaccccgccucuccacccuacacugggacauugagccuucucaggaccaagggucucuccucccauugaugcccgacaaggccauccuuugcuacauauguagcuggaaccaugggucccuccauguguacucuuugguuggugguuuagucccugggagcucugggggggucugguugguugauacuguuguucuuccuauggggcugcaaaccccuucagcuccuucaguccuuucucuagcuccuccauugagaacccugugcucaauccaaugguuggcuaugagccuuuuuaaaaacaaguauguauuuacucuuuaugugaagcacugcucuaagcagaaagccaucuugccuacugcacaaucaaccuaaacuguuagacuuuuaugguuuaaauccuggaucugcuaguuauuagcugugggauuuuggccaauucauuauacuuauuuuguauuacaaaucuucucaucugugaaacagggauaguaauauacuuaucuauagagaccauguaucauuauuauuaugugaauuuuaaauuuaacaugcuuggguuauaaacuuuacauaaauauuuucuaauuuguucacaaaucuuuuuuucugcuauuccuuaauccaaaacagucuaagaacgaaggcuucuuuuuaguucuuuuggcaacaaaacaugauuggaaagaaagcaaggcccauucugguuuuuauugaucuuugcuuaguaugacuguucauacauuuuggugcagcgaucuaaaagcagcuggugacagagcugguugaagguguuauguaacaugucauaugugcaccaugcuaccuuucuaaacugaaaaauucacaauucugaaauauaacuggucuaugggguuuuagauaaaggcaugggcuguuauuuuuauaggcacugacucacuuaucucucaucccaacucagaaaaauaggcauuuuuuuccuuuuggaaaggagauauucuuauuacaauaucacuaauuuuacacaagggaaaagauguccaagugacuucacuguugugacaguuccugcauuugacccaaguaucacccuucaggggucuaagugguuuuguuauuuauuuauuuuuagagacagggucuagauagcccaggaaagccucaaacuugccauccagcugaggaugaccuugaacuccuguuuuaccugcuuccacuucccuaguacugagauacuuggcaugggucaccaugaccaguuucaggagucugagcauuuaaccaccugcaucagauccuuuguguauauauuauggcuuccaauuuaguguuuuaugggauucccuaguguucaaaugaaugggucuguuucuugggccuucucuugggcucuuuuucuuuucuuuuauuauauuuuauuauuaucucuuagaagccuguucuguuccuuuccuuucuuuccuuccuguuuuuauuuugagacagggucuguauaguacuggauguccugaaacuagcaagauggccuuggccucagcgauccaccugccucugccuccugagauuugggauuaaaggcacuugcuaccacugccuggcuuuuuguuguuguuuuuuugagacagggccucuuggcugcccuggauuaaaggccuguaccacaccaugacuacccugcugccuguuuguuuucuaaugggaggggaggugggaaagaacugggaggaauacagaugggggcaaacuguaagauaucuauagguagauaucuauaccuauagauaucuuacaguuuauggggauagagagaaaucuauguucaauaaaaaaagcaaaacaaauuaucaccucauuagaaggauguucacuguucaccuguuauccuaccauuacccuuuccuauaaccaaacuggaacuaacacugaaccugcuuaagucccugcaaggaugggacuuaaucaaccagcuguccaccuggcucggauuguuggauuaaggauuaagaauaaaccuuuuaagguuuugaagaaccuaugauuuagauuuauagcuuuauucuuuaaucugcaugaaauuauaguaugauccucauaugucugagccaguucaagguucuuuuagcagaaacaguguuaggcagcuguccaaauuagagugccgagggacaguggaucagagucccgcccccgccccccccagcucuaagggacuaaauauucccaacaccagauucuuucagaggccuauagagugcagugugaccccuaguggcaaaaacaggcaauuucaccgccuccucugagcuaugccagaacccagcagcugagugaaaucugaucaacuacuagcuuaucaaagagacaggcugaauuugauugcugcuuuuuuuuuuucccacacaggccuuaccaggaauccuaguuaccugcccuucccagaaggcuuucuuuccacuccucaccucauucucugggugccuuaaaacagcuuaggacacaacagacaggagcccuugcauauuauaauccacacauucauagggcaguaagaaaugucucaaaaaaaaggaagaaaacaaaauaauaauacccuccaaaagguggacuguauuaugcuucccauuuugcagacaagugagugaaguguggagaaagauguuaaguaaccugccuaaggucucacccuuggaggagcugcuggaugcuggcagucaaacugagcaccccuagccaaucaaggccaguucucaaagaaaacauaaacaggcaagaucccagagugacaaguaggacacuucccugaagaagcgauguuugguggaggggagguagcaagucauauugauguccaugggaaggauaauucugauaaagagaaaagcauauauaaaagcucuaaagugucuaccugaggccauaauguuucuugccagguagaguuuuuccucugcacgauccaaugcauggaguaacuuguuuguucuugcaaaguuguucugugcugaucuucacagccucauacucugcccuguucugccugugugacuuugagcaaguuguucaaccucucuaugccuuguucuauaucuguaaaauaggguaucuuacucucaaaucaaaaaauacuuuuuaaaaaugaggacucaaugugucucuauauauguaaaguacuuagaaaacugucuguagcacaugcuagaaaugcaauaaacauuagcccuuagguuguauggcauccuucucccucccccuuaacuuucuguacgacuucaccaucuggcuuccauaauuucuaugaccuugacuucuaucccucccucucaacuuguuuccagucacacuggcuuuugaacaugguagccauaaucugggcuucagggucuuugcauugaguguucuuucugguacauucuuccuuuacacaauauggcuuacuccuuuguuucuuucaggccuuaacuuaugagucacauuuccaaguguagcaugccuugucucuaagaguucaaauaccuugauacucuaguccuauuugccccacuucaugucuguuccuuagccuuuguauaaugugguauuucauuuuaccuaucuauacagucugucucccucacuuuuaguaaugccugccugcuuucuauguacagggauuucugccuguuuugcuucucuauaucuccagcaucuacaauaagugccugguacucacuaggugcuuaguaaauagcuguuaaauauuuaaaaagucguaacugacaucuuaauuaauuccuacauucccuuuuuuaucugcacuccccuuggugaugucugggauacaauuuucauugucaguuuugugacagcaucucacucuguaguucagguuggucuggaauucgcuaugucacccaggcuaguuuuuauuuccuguaaauucucucuuggucuuccaugcuggaaauauauagccgugagccaucauucaucgucuagauacuacaccccccaaguuaauuugugcagcagauuauuccaagcaccuacuguacagagguauauuuuuacaugaagggcagauaaagccuguaaguucccauaggauguuuauucugaggaggauagacagauaucuauuuauauaagcuauauagcaugucuaaccaugacagaguauaaagggccaaagcaagcaggaaagagaucugaacccugcucgguauacaaaaucagauagucaaagagagguggguguugacuacuuugauacaaaaaaugauauuugaaaccuuuuuauguauauaccuuuauacauuauaucccaagcaccagugugacaaauacauguuuuacuaaaauuacacuacccaagaugcaaagacaugaaagcacucucugaaacaucuuuucuauuugugccuuuucauaucaccaacaucacauuuccuuuacgcucauuuuauucacaaaucaaaugacauucuuacaaauaucuuuaguguguucccugcacaggguagugaaaaaauuccuuuggguauggcaaguguacaguaccuugaaaguuaccauacagagaugugggaguaguguuaauggagaaagaagagcuaaugcaaaggcccugaggcuggccuguaccggcuguuuuugagaagcagugagguuagcauggcuauagcauggaucugaaauguggagaugaaagagauaaggucagugaggugacuuguuuaacccacacauuuuuuucacacuggaaaggcuauaguucugacucccccauuuuagcccaguacaggaagaaaguaguuaagucauucauguaaagucacaccacugcuaggacuugagcugauggguccugagaacagaguagaauggagacagcucuguugucagaaagaacagcagaaacaaaagcugggugauugaaacuaauuuggcuguuaaggaaugugcccucauaugggaugcaaugaggugagagaggggcaugucaaaaguguuccccuaucuaaguaguuauugggccaucugugaacccacaugcccuaguuuucucaguuaucugucucacagggcuaugaugaagacuggagacuauaagcaagcuggagacuauagaauacugccugguacacagcaaguguaaaguauaaaguuagauccgacugucauuagcaauaguaccacuacuauaguugagaacuauagcaaaguaaaaugccuaguggcuaagaguguuuaugagggcugggcagugguggcacacgccuuuaaucccagcgcuuggguggcagaggcaggcggauuucugaguucgaggccagcuuggucuacagagugaguuccaggacagccagggcuauacagagaaacccugucuugaaaaaaaaacaaaaaacaaaaacaaaacaaaaaacaaacaaacaaaaagagaguuuaugaggaacauggcauauauuaaaagucccuggguuuuacaaguacacaggacuuccuaggagaugggggcagagaagacugacccaauacauaggaggaggaggagggaaauaaaguacaaagccuaucuauccccuuuggggagggauugcaagcucugaggauuugagagacuguaaacacugggguggcagaaggcuucugaacagacucauucauuacaaaagugagaugugguuuaagcugauaccuauacaaccgcagagaagaaaagccaucacauaauaauuaauuaaagugaaggauaggacaaggccauagacugggcuguugaaaaugaaaauaaaaauugcaaagcaccaaacugacccacuguuaaaaggaagcagcucaaagacuggagucuacaaauaagggagaaaaguuagggcggugauaacuagaggaauaugaaugcaagcaugcaaacuaauucacaguaagaugggggcaaugggaggagguggauaaagucaugggcuuaugcacuggggacucaaggggggcaauaauguaaacuuagguggacucacuguugaacaaacaauggggugucuuaagugggaacagugccacagauugauucacuacaauaaacaugagggguucaguaaacaaagccacagaagguuccccuuaaauuugaggcuaggggaaauggaaacacuuuagacacagcuacgacuaaagggggacuggacaaugcaacagacugguuuccaauaaguggggguuggggagggcaagaccacggacgaguccauuaaguugggguggggaaaaucauaagcucacagacagauccauuauacagacagcaggauguuagcccacguucagaucuacuauaaagggcaaaaggagcaggcaaugcacacacaggggcaaucaguugaugguaguggagccaaauaccagcaggcugggccaaaccacaucccuugcgcgggggugaggauacguggggucauggacaggguccuccaccuugugggccugggcucaccugcgaguggcgcggcgguggcaguggcagcuccggggggcgggggcuccauacgaggccccaccgccccccaggccccgguuccaaggcggcggcggugguggcggcgacagcagaagcagcaaccagaagccgccccugcguuuccccaccgcucacgugggcucucaugggaggagccaagcguccuccugcuugcugauuggacaaaaugccaaggauccuaagcacaggggccugggugguggaggaauacuaacagagcuguaacacaauuggcuuaaaagggauugauggacugcggguggccaacugaaucuauagagguguugggcggcgcuagugccucacgccgauugggucaaggaggacugccaagugccaagguuugaggagggauggggaggucgcccaguucacaccgauuggcuuaagugagauugauggcagacagacagucccagaggauggagggguggugaugggcuguuuucagcugauuggaggauucucccagacaguggccaaaacaccaaaguagguggugcuguacaccauaccguucagcagaaacaggacuuauuuagaaagggccauagcagcaggguaggacucaacucuguggagggggguaggguaacgcuauggguaauuagcuaggcaaaaacuaacuuugaauucagcaaaagguggaggccggaauggcugccggauauacagaggaaauguauaugagagguggaaauuaacugucuacaagggcagagucuagccacagucaguuguaaggguggauuuagguucuuagugaucuaugacuggacuuaaaccuagggacuguaggggcuguagcagggagggcaggaucucugcauacuguugaaaguagaacuauuagaacuacgauuuagggaccaagucaaggguugggcaguaguguuauuuaggguaccuggaugaccacuggacugugagagacaauaaaccuuaagaucugaaguaaaaagcugacggccauggaaacaaauuacuuugaacuggaacuguaaaaauuuguuucaagugucucauguagcccaggauuaccuuaaacuuaaauccuucugccucuaucucuugaagucacaggugugccacacaccuagcuuauguacacaguacuggggacugaauuuuaaguuucaugugugacaggcaagcaugcuaccaauugaaucucaucuucagcccauucaguccauucuuuaugguaagacaaagggcacagauacaaauaucuaggaaaaggaauugugaggagcagggccaagguucuaaaggcgacaaaagagaguaaagcauaaagucaggagaaaaacacaaguucuaggcaagaccucuagaacguuuuagagguucuacagaaaggaugggucuuccaguaauuuuggucucuagggcacuuaguaaauuagugagaauuagggaaaaaaggacuaugugauuccaaggcauucaggugcuuuaauauuggaggcugggaagaugcagucaauggggagauggcucugggaaauucugcaggccuuguaguucucuaagucccuguaaaaagaggacaacguauacugaaccgaggcaggguccagguccugucccagguuugcucuguuuuucacuucuuugguuucaauuuagaaggaaagaugaccccucccuucuuuggcuuucuccugucuucagguuaucacccuaaauauauuugaaggguggagugagcugcucucaccucuagcaucauguggauaugggccuugauauucauggaguccuuggugaggcugucgcugagccuagaaaaaaaggaacaaaaaagggcaaaaugggcccacuuaggccccacuaugcagagaugucuggcuaccacuuggaauuucccuacuuaaagacugagggaaauagggccagugaggugguucagcuugcaaagguugauugcugccaagccugagaacuugaguucaauacccaggacccacacaguggaggagaaaacugacuucaaauaguugcccucuaaccuucacauguacucauaaaaaauguaguaacaauuuuuaaaaaacaauuaaggggaugagggaaguggguauggguauauuaauaugaucaaacuacgggauacacucgaaacccaucacaaugacuaucugaugauaagaaguaaagauuauugagugccuucuguaugccagggagcuuuaaauaauagcagaaacagcaguaaauuauacaaaauucuuugucuccuggagcuccuuuauuaucuaucuguuauaggcaugggaaauacaccaugaaugucgguucccagagguuagaagaagauaucagauucccuggagcuguaguugcaggugguugugagcuaccugacaugggugcugggaacugaacucaaguuacucugaacagcuguguguacacuuaagcacuaagccauuucaaauacuaagagacaaaguauacacacacacaauuauuaugauguguuagaucuaccuaaguauaaggaacuaaauacugaagaagugguaggaagaggagccuucaauuucaaagaaugcucagguuuggcuucacuaagagcuuucccuuuaagacuauauaguacagccuggcuucuaauucaagauccuccugucccgacugcugagauuacagauguguaacccuaccaccuagugggggugauguggaagauaagugcuccaccacaaggagaaaccaauauaaagaugcugggguaggaacaugcuugguaugguacaggcacagccaagaagccauuguggcuaaagaauaagaagugaagucaagagaggugaggaaggaggcagaggguggaaagucuacaguaccaugguaaagaucuuagcuuuuacauuaaauaaggugcuaauaaggggaagguugugaguggaggacagaugcaaacugauuugagaauaaacuuauuagaguuuaaaagaauccaccuggcuguugggcagugcacugacaggacaagaaacccaaaugugaaggcagcaagucuagugaagagcauaaugcgauagugcagguaaacaauggaggcucaggucacagggaagauaguugaaguaaugauaaaugacucauuuugggguguauuuugaaggcagugccaaaggauuacagucagguaugagagaaaggacucuaggaagaggcuaaggcacaaaacacccgggaaaauggagcugcuugaaaccacccucgcccugaacugcugaguuccauaaaucagucaacuccuucuguccgaaucugcuugcaucaggucucaucuaagagaaucuuuauguacacaaucagucaaaaugaauacauuggaccaaaaaaauacguucugaagaauaaaaaaagaagaauugaagauggagugagagcuaagcaguaaaaaggucuuuugcacagaaagacaaagaggcacaaaagagcucugugagaagcgaucaguguuagaaguuaagugaagcauucagaaagauuauauaagauaauguggaagcaccaggaggggcuggacagugcaaggcuugauaacaugauaggaaauccaguuuaauugugcugcucuauuagcuaaugcaggauucaguauguguguguguguguguguggggggggguaaaugaaacuaaauacugcaugagauaguuagguuggaaaaaaacagucugagucuaccuauauacuacuaucuuucaaauuuauauugccaacuaucuucaaacaccuaucucagugucaaaguuucuuauacuuuauaggucccacacugagauccagcucuuccguccuggucugcucuuccaucucagauagaaggaacaccaucuuucuggaugcuuagcaaaaaucuagaauuuccucuuuuugcaggaauagcauugaauuuagugccucacacauucuaguaauauacucuacuacuaauggacauguaccccaguuucaaagcucuucucuguuuuucauuuccaaucagccauucuauccaacaccacaacugcuccaucccaagcaaaacuucugcucuccauuauguacuguuuguagcacugucagcaucuauuacauuacaucuuggccuuacucauuaagucuccuuugaccgaaaugauagcugugagaauagacuguguucuguuucuguuuguuuguuugcuguauaaugagggccagaacagugugugauccagagugggcacccaacugaugcugaaugaauaaagacugauccagucaaaagguuccaaauccuuagaaaauacuuaaggcuaugguuaggauaggaugcuggagaguaagaauaccuuuucuuagccaugaaccucguugauuuauucauucacaauagcuaggaaauggaaacaaccuaaaugucauccacuagauaaauggaugaugaagaugugguacauuuacaaaauggaauucuguucaguuauaaagaaaaaugaaaucaaaaaauuuauagguaaauggauggaacuagaacauauuacacugaaagguaauucagauccagaaagauuaacacugaaaauuuucucuuauuuguggauccuagcuucaaaucuuuagaugugaguauguaaguuggaauaaccacagaagcuaguaaaguaaaaagggaccagagagugggaagagaaugaacuguacagaaugagacaguaggucacaggugcugugauggggaaauuggaaaagugggggaggcuuuuaucuggggaguggagaggaaaagaaacacugaggaagagggacaggagguauaaaaaauaccaaggaugacugaaagguuauagggaaacacuauuauauguuuacuuaaaauacauauaaaauacacacacacacacacacauuuaaaugaaguuauacuauuuggggugauaaugcucucuccaaaagcuauagacuauuuaacaaaacccccaguggcaggaauagcucagcuggccuccaauucaagauccuucugccuggacuauugcagaguuguuggucaggguaauucaagagacucucaaaacaauauaggcaauugauguugcucuugguugccucccagaaccugaagguaagaccacugcugcaaauaccacauuccuuagucauaagacuuaggaggaaucaagcuggaacuaaccuagaagccucuuccuuggagacuggcuaucauaggugcuaugcaagaugccaagggagaggaucaauccaauaguccuagccaacuguagagccaugaaccacaacaaugaucugacuagcaagauauuacuaccuagccaacuacccauggcuagagugcucauagaccugagaaccuaaauuaauauaauuucuguuuucuaaaaccauauccuuuuacucacagauaaauguagcugucaucccucauuuaaaaaccuucguuuuggaacagauagggacuauuacagagauccacaacuggucaaaaugcagagaauaagugacugugaggugccugaccccaacugauacaucuguaguccaacuccuauaccuaagggucagggaaaaucauagagaaaggcuggaaagacuuuaagaggaggaggcccaggaugucugcuguuaagaucaugauggggaaacuguacccaugaaugcccaccaauaugguugccugaauaagaccagcaugacaacagcaguugacauguccacguggaaaggggaaauuaccauggaccuacuuuagaugaaggacuacaaguggucaaugucugcugaaagagggagaaucagucucaaugccaaguugucagcccuggauacauguucauagaagcaaagcuaaaugggcucagcagauuauaucuacaugugugauacauacauacauacauacacacguauacauauauacacauguaacaacaauaaucaucaaagaaauacacuaaaaacaauaaguaccuacaggcaauuuuggauacaugaaauaaccagacguaugcuaguuugaaguggaucccaaguaaguaaguuuuaaagagagaguucaacuauacagacucaaauccuaaucuaggaugaugaaacuuugagguagcucuauuaguuauaauagagcaauaugaggucaagcacacauuucaucacacugguagaaagcaguucaacagauuagaaagaccaggcaaggagucuguuaacuucaaauaccucauauauguauguauguauguacauauauauauauaucaauucucauuaaaaacagaaauaaaacaaacaaacaaaaacccccugugacauaggaggaaaacaugugauaaaaauuggacuuguagcagggcaugguggcacacaccuuuaauuccagcucucaggaggcagaggcagguggauuucugaguucaaggccagccuggucuacaaagugaguuccaggacagccagggcuauacagagaaauccugucucaaaaaaccaaaaaaaaagaaaaaaaaagugggacuuguucuaaauguccauaguucagcauuacaaugaccuugaucaaauuauaguuugaucagcaaaauuuagaaaucuuagcagguuucaggucuacuaauacuaaaaucucuggaaagcuuaagagaagaacuacuggaaccguacaggcgacaacucuaggaacgaauccaggaaugaucauugcaggugcucauacuugugagugguuauuuaucuaagggaguacguucccucauacucauuuuuccuaagcuaugucacaugugacaguuuuucaagccugccagacacacugucccuuuugucaagaauauucuuccccagauagcucauggcuugauucacccaauaaacugacucaaaugucacuugucugagagugggaguuugaggccuucuguguggccuccaguaccuacguauuauguguauggaugauuugccugcauguaugucuguauagcacuugugugcuugguguucagaggccaggagagggagucagauacccuggcacuggaauuauagaagcuugcgaacugcuaugcaggcucuggaaauagaaccugggacuccugaaagaguaauaaaugcucuucacugcugagccaucucuuuaacuacagcacuaucuauauuucaagcuucucacccaaaguaguucuucccuacacaaaaacaaaacuuggagcccacauuuucucuacucaccacuacccacauagauaaguuuugaccaucccuucauuuguuucuagcauaauucauucaaaagaaacugugcuuuacacuauuuuaguuacccacaguauaagcuuuuuccuuuacacugccuguaacuugggcuagggacauagaguucaguaauagagcucuugcuuacuacacaggagaccuuggcuucaagucucagcccuguaaaaaacuguaagugauacuuauuaucugacuguaaaagacaaugagcgugagaaagaaaggcauuucacaguacaauuuaacagguacuaagaugguagauagagaaaaaauuagaagauggcugguaugauagcucagugggugcuugucacaugagccuggggaucugaguuccauucauggagucccuggaaggauagcaucaacucuacaaaacuaugcucugaucuacacauggaugcuauagcacauauguccacagacaugcacauauacacacuaauggucauuuuuuuaaguagaagggggugcaauucaagaacacuaggaguugcaauuuugaaguuagaucacagaagaacuuguucagggagcuuguuauuuaugcaagacaaucaaguauugagaaaagaaaccacauggagaaagugcugcagagcagacagacaccaguagcuacugaaugcucccaaaggugggaaaugcuuaaagcauguguuagggcuagggagguggcucaguggacaagaacauuugcugcucaagcauaagaaugggaauuggaucccuaguaccaauggaaaaacucacacaccucugaccccggcaugggugcuugcugaagccaaaaaauggcaagcuuuagguuugguggagacccuauuucaagagaaauaaauaaagcagacagcaauagaggaaggcauugucucugcauguguggguacaggcacaugaaguucagagaggggagagaccaacaaaugagcaggaaaaugagcagauaguuaagugagaagcagcuucuuagacuguuaacugauucuuagguugaaaucucacggauguggucacagauguauguacaugagauuucaacauaguucuagaaauguaagcuucuaagacucuucuguuguuuacugcuauauucucaacauuaaccacagaaccugguauacauaagauacucaauaaauguaugaaggaauaauauaaaaaguacuuauugaguguuuaguaugacacccuggcugaacuuugcauccucaguuuucuuagucugagccccgaagaggaagguaguauguuuuucuaaguaccaucccagguagccacagggaaaaggguagaguauuaaaauuugugaugucuauuuauuauuuuuucuguuuguuuuauacacagagauuuguuuuaucacccagaguugcuucaaauucaugauccuccugcuugauucucuagaauccugggauuacaggugugaacuaccauaucuggcuuuuauauauuuuguguauguguuugugugaugugugauauggauagaaccuagggcuucacacaugcuaagcaaauguucuuaccacuucccuguacccuuagccaauguaguggcuuuagauacuauccucuuggaaugcacucacucugugaggagagaacucuuucggucaaugaacuugagugcuucagccagugucaguuccaggaaaaaaccauaucccagggccacauagaugcgugaaguaucugggcugaggaaagaggucagaggaaguggaagaagucuuuauuacuauuuagcacacuguaugguuuaagguguuuccuauuccuuccuguuucucaaaaugaaggcucuguaaaggcagauacuuuguguucauuuuggccacacccacaacauguugcucauauccuaaugaaauauaaaagcuacuagagccuuguauauagaaaauacuaagaaauacuuguuccaugaaaaaagggagaaacucaggaggggagagaauauacucacaccacugugucaacgaagaaguuacagcccaaauccaccugcauauauaacuccgagugauuaguuuccuauagggccaggagaaaagagguaggugucagcgggcaauuuuaaaggcagauaagguuuuguucuugggguuucuucccgccucccuucuuuguacacauacacaaagugguacccaauuuaaaaaccuuuaccuggagucgcucaaugacauuucuuaguugaagauauacggacagcugcucauauaccuugucucgaugauccagcaccuuucugauauguagaaauacaacagugaacauuaggcagccuuauuccucuugagaugccaggcauuuuaagucagguugugguugacauggauguaauucaugggcugaggcaggaggauucugagcucaagaccagcuugugcuacaucgugagaucccgugcuccccuccuccaaaacacacacaaugggguauagacagagacacagcaggcauuucaauaaauacaggucagacuguaguucagccugaccucuaccucuuacuaggaaugugacuauggaaaguagaaaaccuaccuaggauuaaguuucuucacauagaaaacagagauggccguaguagcacauaagagucauuagaaucgaguguuuacuacaaaguguuuuaaaugcuagccaaaugguaagcauuauauacuuguuaccuauuauaauuauaaauauuacauuuuauucagugacuuaugccaauuaaaaugucccaucuucacccuaaauguaccucuccaucucuuuuagcaugcucacacaguccuaguucuaaauaccuaacuuucuauucagauuaguaaugacagcaauagcaaucauccaguuguugagucuuuaguguauuucaggcacuggggucaaauuccuuuccuaaaacaacuauuuagguuauuuguuuuauuacccaagacaauaucugaguuucucaggcuaaguauugaauuuguaaacacaccaaacaauucuuuccucucagccucaauauaauaauagugggguuuaucugcauuuuuaaaauguguucuuacuugcauuuauguguuuauuuuguguacauguaugggugccaugauacauaccuggaggucagaggucagguuuuugggagucuuucuuucuuccaccaugugggucccagagaucuaacuuagggcaugggguuggaggcaagccaucuugcuggcccuaguuugcuuguuuugagacauaaucucaaagcccaggcuauacacaaccucgaauguaggugaagaucaccuucaacucugggucauccugcuccugacacuaucccaaguacagcaauugcaggccugugucaccacacuggauuuuuuuuaaaauagaauauuguucuauuuucaaggcuggcuuguaauccuggcuaaacaagugaauuuucccaucucuccacuagaaguggcacacaccauggagcuugagccuggcuuuauucuauuuuuuucucccuuugagaaaguuagucuguagcccagacugguucucagcuuuacaaagauccuccugcuucuggcucccaagugccggaguugacacauuuaaaacucaaacaccacguuaagaaggccuaauaaacuuuuccauuucacagaugaauaaaguucacaaaggugaaguaagguacaacuuguucauaaauauugguuaaauggccuagucagaaacacccuguguucggaaugacuauuuuaaaccaacaaacaaggucagagcucugcuaaagggacaaguuccaaccacaucucagcccagaagucaacccuauucccagaagucugggcggccaauccgaaaguuuggucggcauucugucccacccaccacgugaaauuucucaaacgucacgccucccacguugucacucacugcaagucucgcugcaguacgucacugauaaaggucucguaccgcagcacuuucucccccaccguauccaaggcccgccguuucgggggcgucgccaugacgggcaccugggggaguaaaggggggggcacguugagcgcucuauuuaaacuucacaaaauucucuccagccacucaacguuggggaugacuucuuucggcucgagcuacggaguugcuucugcccaacccgauuuuggaacucguucacucaccgguacaggaguacggcguuuaccguagggccaccggcaauaacuguuaguaugagccgcggcuuccggguggcgcggauggaugaug

SEQ ID NO: 9430 - RNA, 36569 nt, Mus musculus
caucauccauccgcgccacccggaagccgcggcucauacuaacaguuauugccgguggcccuacgguaaacgccguacuccuguaccggugagugaacgaguuccaaaaucggguugggcagaagcaacuccguagcucgagccgaaagaagucauccccaacguugaguggcuggagagaauuuugugaaguuuaaauagagcgcucaacgugccccccccuuuacucccccaggugcccgucauggcgacgcccccgaaacggcgggccuuggauacggugggggagaaagugcugcgguacgagaccuuuaucagugacguacugcagcgagacuugcagugagugacaacgugggaggcgugacguuugagaaauuucacguggugggugggacagaaugccgaccaaacuuucggauuggccgcccagacuucugggaauaggguugacuucugggcugagaugugguuggaacuugucccuuuagcagagcucugaccuuguuuguugguuuaaaauagucauuccgaacacaggguguuucugacuaggccauuuaaccaauauuuaugaacaaguuguaccuuacuucaccuuugugaacuuuauucaucugugaaauggaaaaguuuauuaggccuucuuaacgugguguuugaguuuuaaaugugucaacuccggcacuugggagccagaagcaggaggaucuuuguaaagcugagaaccagucugggcuacagacuaacuuucucaaagggagaaaaaaauagaauaaagccaggcucaagcuccauggugugugccacuucuaguggagagaugggaaaauucacuuguuuagccaggauuacaagccagccuugaaaauagaacaauauucuauuuuaaaaaaaauccaguguggugacacaggccugcaauugcuguacuugggauagugucaggagcaggaugacccagaguugaaggugaucuucaccuacauucgagguuguguauagccugggcuuugagauuaugucucaaaacaagcaaacuagggccagcaagauggcuugccuccaaccccaugcccuaaguuagaucucugggacccacaugguggaagaaagaaagacucccaaaaaccugaccucugaccuccagguauguaucauggcacccauacauguacacaaaauaaacacauaaaugcaaguaagaacacauuuuaaaaaugcagauaaaccccacuauuauuauauugaggcugagaggaaagaauuguuugguguguuuacaaauucaauacuuagccugagaaacucagauauugucuuggguaauaaaacaaauaaccuaaauaguuguuuuaggaaaggaauuugaccccagugccugaaauacacuaaagacucaacaacuggaugauugcuauugcugucauuacuaaucugaauagaaaguuagguauuuagaacuaggacugugugagcaugcuaaaagagauggagagguacauuuagggugaagaugggacauuuuaauuggcauaagucacugaauaaaauguaauauuuauaauuauaauagguaacaaguauauaaugcuuaccauuuggcuagcauuuaaaacacuuuguaguaaacacucgauucuaaugacucuuaugugcuacuacggccaucucuguuuucuaugugaagaaacuuaauccuagguagguuuucuacuuuccauagucacauuccuaguaagagguagaggucaggcugaacuacagucugaccuguauuuauugaaaugccugcugugucucugucuauaccccauuguguguguuuuggaggaggggagcacgggaucucacgauguagcacaagcuggucuugagcucagaauccuccugccucagcccaugaauuacauccaugucaaccacaaccugacuuaaaaugccuggcaucucaagaggaauaaggcugccuaauguucacuguuguauuucuacauaucagaaaggugcuggaucaucgagacaagguauaugagcagcuguccguauaucuucaacuaagaaaugucauugagcgacuccagguaaagguuuuuaaauuggguaccacuuuguguauguguacaaagaagggaggcgggaagaaaccccaagaacaaaaccuuaucugccuuuaaaauugcccgcugacaccuaccucuuuucuccuggcccuauaggaaacuaaucacucggaguuauauaugcagguggauuugggcuguaacuucuucguugacacaguggugugaguauauucucuccccuccugaguuucucccuuuuuucauggaacaaguauuucuuaguauuuucuauauacaaggcucuaguagcuuuuauauuucauuaggauaugagcaacauguuguggguguggccaaaaugaacacaaaguaucugccuuuacagagccuucauuuugagaaacaggaaggaauaggaaacaccuuaaaccauacagugugcuaaauaguaauaaagacuucuuccacuuccucugaccucuuuccucagcccagauacuucacgcaucuauguggcccugggauaugguuuuuuccuggaacugacacuggcugaagcacucaaguucauugaccgaaagaguucucuccucacagagugagugcauuccaagaggauaguaucuaaagccacuacauuggcuaaggguacagggaagugguaagaacauuugcuuagcaugugugaagcccuagguucuauccauaucacacaucacacaaacacauacacaaaauauauaaaagccagauaugguaguucacaccuguaaucccaggauucuagagaaucaagcaggaggaucaugaauuugaagcaacucugggugauaaaacaaaucucuguguauaaaacaaacagaaaaaauaauaaauagacaucacaaauuuuaauacucuacccuuuucccuguggcuaccugggaugguacuuagaaaaacauacuaccuuccucuucggggcucagacuaagaaaacugaggaugcaaaguucagccagggugucauacuaaacacucaauaaguacuuuuuauauuauuccuucauacauuuauugaguaucuuauguauaccagguucugugguuaauguugagaauauagcaguaaacaacagaagagucuuagaagcuuacauuucuagaacuauguugaaaucucauguacauacaucugugaccacauccgugagauuucaaccuaagaaucaguuaacagucuaagaagcugcuucucacuuaacuaucugcucauuuuccugcucauuuguuggucucuccccucucugaacuucaugugccuguacccacacaugcagagacaaugccuuccucuauugcugucugcuuuauuuauuucucuugaaauagggucuccaccaaaccuaaagcuugccauuuuuuggcuucagcaagcacccaugccggggucagaggugugugaguuuuuccauugguacuagggauccaauucccauucuuaugcuugagcagcaaauguucuuguccacugagccaccucccuagcccuaacacaugcuuuaagcauuucccaccuuugggagcauucaguagcuacuggugucugucugcucugcagcacuuucuccaugugguuucuuuucucaauacuugauugucuugcauaaauaacaagcucccugaacaaguucuucugugaucuaacuucaaaauugcaacuccuaguguucuugaauugcacccccuucuacuuaaaaaaaugaccauuaguguguauaugugcaugucuguggacauaugugcuauagcauccauguguagaucagagcauaguuuuguagaguugaugcuauccuuccagggacuccaugaauggaacucagauccccaggcucaugugacaagcacccacugagcuaucauaccagccaucuucuaauuuuuucucuaucuaccaucuuaguaccuguuaaauuguacugugaaaugccuuucuuucucacgcucauugucuuuuacagucagauaauaaguaucacuuacaguuuuuuacagggcugagacuugaagccaaggucuccuguguaguaagcaagagcucuauuacugaacucuaugucccuagcccaaguuacaggcaguguaaaggaaaaagcuuauacuguggguaacuaaaauaguguaaagcacaguuucuuuugaaugaauuaugcuagaaacaaaugaagggauggucaaaacuuaucuauguggguaguggugaguagagaaaaugugggcuccaaguuuuguuuuuguguagggaagaacuacuuugggugagaagcuugaaauauagauagugcuguaguuaaagagauggcucagcagugaagagcauuuauuacucuuucaggagucccagguucuauuuccagagccugcauagcaguucgcaagcuucuauaauuccagugccaggguaucugacucccucuccuggccucugaacaccaagcacacaagugcuauacagacauacaugcaggcaaaucauccauacacauaauacguagguacuggaggccacacagaaggccucaaacucccacucucagacaagugacauuugagucaguuuauugggugaaucaagccaugagcuaucuggggaagaauauucuugacaaaagggacagugugucuggcaggcuugaaaaacugucacaugugacauagcuuaggaaaaaugaguaugagggaacguacucccuuagauaaauaaccacucacaaguaugagcaccugcaaugaucauuccuggauucguuccuagaguugucgccuguacgguuccaguaguucuucucuuaagcuuuccagagauuuuaguauuaguagaccugaaaccugcuaagauuucuaaauuuugcugaucaaacuauaauuugaucaaggucauuguaaugcugaacuauggacauuuagaacaagucccacuuuuuuuuucuuuuuuuuugguuuuuugagacaggauuucucuguauagcccuggcuguccuggaacucacuuuguagaccaggcuggccuugaacucagaaauccaccugccucugccuccugagagcuggaauuaaaggugugugccaccaugcccugcuacaaguccaauuuuuaucacauguuuuccuccuaugucacaggggguuuuuguuuguuuguuuuauuucuguuuuuaaugagaauugauauauauauauauguacauacauacauacauauaugagguauuugaaguuaacagacuccuugccuggucuuucuaaucuguugaacugcuuucuaccagugugaugaaaugugugcuugaccucauauugcucuauuauaacuaauagagcuaccucaaaguuucaucauccuagauuaggauuugagucuguauaguugaacucucucuuuaaaacuuacuuacuugggauccacuucaaacuagcauacgucugguuauuucauguauccaaaauugccuguagguacuuauuguuuuuaguguauuucuuugaugauuauuguuguuacauguguauauauguauacguguguauguauguauguauguaucacacauguagauauaaucugcugagcccauuuagcuuugcuucuaugaacauguauccagggcugacaacuuggcauugagacugauucucccucuuucagcagacauugaccacuuguaguccuucaucuaaaguagguccaugguaauuuccccuuuccacguggacaugucaacugcuguugucaugcuggucuuauucaggcaaccauauuggugggcauucauggguacaguuuccccaucaugaucuuaacagcagacauccugggccuccuccucuuaaagucuuuccagccuuucucuaugauuuucccugacccuuagguauaggaguuggacuacagauguaucaguuggggucaggcaccucacagucacuuauucucugcauuuugaccaguuguggaucucuguaauagucccuaucuguuccaaaacgaagguuuuuaaaugagggaugacagcuacauuuaucugugaguaaaaggauaugguuuuagaaaacagaaauuauauuaauuuagguucucaggucuaugagcacucuagccauggguaguuggcuagguaguaauaucuugcuagucagaucauuguugugguucauggcucuacaguuggcuaggacuauuggauugauccucucccuuggcaucuugcauagcaccuaugauagccagucuccaaggaagaggcuucuagguuaguuccagcuugauuccuccuaagucuuaugacuaaggaaugugguauuugcagcaguggucuuaccuucagguucugggaggcaaccaagagcaacaucaauugccuauauuguuuugagagucucuugaauuacccugaccaacaacucugcaauaguccaggcagaaggaucuugaauuggaggccagcugagcuauuccugccacuggggguuuuguuaaauagucuauagcuuuuggagagagcauuaucaccccaaauaguauaacuucauuuaaauguguguguguguguguguauuuuauauguauuuuaaguaaacauauaauaguguuucccuauaaccuuucagucauccuugguauuuuuuauaccuccugucccucuuccucaguguuucuuuuccucuccacuccccagauaaaagccucccccacuuuuccaauuuccccaucacagcaccugugaccuacugucucauucuguacaguucauucucuucccacucucuggucccuuuuuacuuuacuagcuucugugguuauuccaacuuacauacucacaucuaaagauuugaagcuaggauccacaaauaagagaaaauuuucaguguuaaucuuucuggaucugaauuaccuuucaguguaauauguucuaguuccauccauuuaccuauaaauuuuuugauuucauuuuucuuuauaacugaacagaauuccauuuuguaaauguaccacaucuucaucauccauuuaucuaguggaugacauuuagguuguuuccauuuccuagcuauugugaaugaauaaaucaacgagguucauggcuaagaaaagguauucuuacucuccagcauccuauccuaaccauagccuuaaguauuuucuaaggauuuggaaccuuuugacuggaucagucuuuauucauucagcaucaguugggugcccacucuggaucacacacuguucuggcccucauuauacagcaaacaaacaaacagaaacagaacacagucuauucucacagcuaucauuucggucaaaggagacuuaaugaguaaggccaagauguaauguaauagaugcugacagugcuacaaacaguacauaauggagagcagaaguuuugcuugggauggagcaguugugguguuggauagaauggcugauuggaaaugaaaaacagagaagagcuuugaaacugggguacauguccauuaguaguagaguauauuacuagaaugugugaggcacuaaauucaaugcuauuccugcaaaaagaggaaauucuagauuuuugcuaagcauccagaaagaugguguuccuucuaucugagauggaagagcagaccaggacggaagagcuggaucucagugugggaccuauaaaguauaagaaacuuugacacugagauagguguuugaagauaguuggcaauauaaauuugaaagauaguaguauauagguagacucagacuguuuuuuuccaaccuaacuaucucaugcaguauuuaguuucauuuacccccccccacacacacacacacacacauacugaauccugcauuagcuaauagagcagcacaauuaaacuggauuuccuaucauguuaucaagccuugcacuguccagccccuccuggugcuuccacauuaucuuauauaaucuuucugaaugcuucacuuaacuucuaacacugaucgcuucucacagagcucuuuugugccucuuugucuuucugugcaaaagaccuuuuuacugcuuagcucucacuccaucuucaauucuucuuuuuuuauucuucagaacguauuuuuuugguccaauguauucauuuugacugauuguguacauaaagauucucuuagaugagaccugaugcaagcagauucggacagaaggaguugacugauuuauggaacucagcaguucagggcgagggugguuucaagcagcuccauuuucccggguguuuugugccuuagccucuuccuagaguccuuucucucauaccugacuguaauccuuuggcacugccuucaaaauacaccccaaaaugagucauuuaucauuacuucaacuaucuucccugugaccugagccuccauuguuuaccugcacuaucgcauuaugcucuucacuagacuugcugccuucacauuuggguuucuuguccugucagugcacugcccaacagccagguggauucuuuuaaacucuaauaaguuuauucucaaaucaguuugcaucuguccuccacucacaaccuuccccuuauuagcaccuuauuuaauguaaaagcuaagaucuuuaccaugguacuguagacuuuccacccucugccuccuuccucaccucucuugacuucacuucuuauucuuuagccacaauggcuucuuggcugugccuguaccauaccaagcauguuccuaccccagcaucuuuauauugguuucuccuugugguggagcacuuaucuuccacaucacccccacuaggugguaggguuacacaucuguaaucucagcagucgggacaggaggaucuugaauuagaagccaggcuguacuauauagucuuaaagggaaagcucuuagugaagccaaaccugagcauucuuugaaauugaaggcuccucuuccuaccacuucuucaguauuuaguuccuuauacuuagguagaucuaacacaucauaauaauuguguguguguauacuuugucucuuaguauuugaaauggcuuagugcuuaaguguacacacagcuguucagaguaacuugaguucaguucccagcacccaugucagguagcucacaaccaccugcaacuacagcuccagggaaucugauaucuucuucuaaccucugggaaccgacauucaugguguauuucccaugccuauaacagauagauaauaaaggagcuccaggagacaaagaauuuuguauaauuuacugcuguuucugcuauuauuuaaagcucccuggcauacagaaggcacucaauaaucuuuacuucuuaucaucagauagucauugugauggguuucgaguguaucccguaguuugaucauauuaauauacccauacccacuucccucauccccuuaauuguuuuuuaaaaauuguuacuacauuuuuuaugaguacaugugaagguuagagggcaacuauuugaagucaguuuucuccuccacuguguggguccuggguauugaacucaaguucucaggcuuggcagcaaucaaccuuugcaagcugaaccaccucacuggcccuauuucccucagucuuuaaguagggaaauuccaagugguagccagacaucucugcauaguggggccuaagugggcccauuuugcccuuuuuuguuccuuuuuuucuaggcucagcgacagccucaccaaggacuccaugaauaucaaggcccauauccacaugaugcuagaggugagagcagcucacuccacccuucaaauauauuuagggugauaaccugaagacaggagaaagccaaagaagggaggggucaucuuuccuucuaaauugaaaccaaagaagugaaaaacagagcaaaccugggacaggaccuggacccugccucgguucaguauacguuguccucuuuuuacagggacuuagagaacuacaaggccugcagaauuucccagagccaucuccccauugacugcaucuucccagccuccaauauuaaagcaccugaaugccuuggaaucacauaguccuuuuuucccuaauucucacuaauuuacuaagugcccuagagaccaaaauuacuggaagacccauccuuucuguagaaccucuaaaacguucuagaggucuugccuagaacuuguguuuuucuccugacuuuaugcuuuacucucuuuugucgccuuuagaaccuuggcccugcuccucacaauuccuuuuccuagauauuuguaucugugcccuuugucuuaccauaaagaauggacugaaugggcugaagaugagauucaauugguagcaugcuugccugucacacaugaaacuuaaaauucaguccccaguacuguguacauaagcuagguguguggcacaccugugacuucaagagauagaggcagaaggauuuaaguuuaagguaauccugggcuacaugagacacuugaaacaaauuuuuacaguuccaguucaaaguaauuuguuuccauggccgucagcuuuuuacuucagaucuuaagguuuauugucucucacaguccaguggucauccagguacccuaaauaacacuacugcccaacccuugacuuggucccuaaaucguaguucuaauaguucuacuuucaacaguaugcagagauccugcccucccugcuacagccccuacagucccuagguuuaaguccagucauagaucacuaagaaccuaaauccacccuuacaacugacuguggcuagacucugcccuuguagacaguuaauuuccaccucucauauacauuuccucuguauauccggcagccauuccggccuccaccuuuugcugaauucaaaguuaguuuuugccuagcuaauuacccauagcguuacccuaccccccuccacagaguugaguccuacccugcugcuauggcccuuucuaaauaaguccuguuucugcugaacgguaugguguacagcaccaccuacuuugguguuuuggccacugucugggagaauccuccaaucagcugaaaacagcccaucaccaccccuccauccucugggacugucugucugccaucaaucucacuuaagccaaucggugugaacugggcgaccuccccaucccuccucaaaccuuggcacuuggcaguccuccuugacccaaucggcgugaggcacuagcgccgcccaacaccucuauagauucaguuggccacccgcaguccaucaaucccuuuuaagccaauuguguuacagcucuguuaguauuccuccaccacccaggccccugugcuuaggauccuuggcauuuuguccaaucagcaagcaggaggacgcuuggcuccucccaugagagcccacgugagcgguggggaaacgcaggggcggcuucugguugcugcuucugcugucgccgccaccaccgccgccgccuuggaaccggggccuggggggcgguggggccucguauggagcccccgccccccggagcugccacugccaccgccgcgccacucgcaggugagcccaggcccacaagguggaggacccuguccaugaccccacguauccucacccccgcgcaagggaugugguuuggcccagccugcugguauuuggcuccacuaccaucaacugauugccccugugugugcauugccugcuccuuuugcccuuuauaguagaucugaacgugggcuaacauccugcugucuguauaauggaucugucugugagcuuaugauuuuccccaccccaacuuaauggacucguccguggucuugcccuccccaacccccacuuauuggaaaccagucuguugcauuguccagucccccuuuagucguagcugugucuaaaguguuuccauuuccccuagccucaaauuuaaggggaaccuucuguggcuuuguuuacugaaccccucauguuuauuguagugaaucaaucuguggcacuguucccacuuaagacaccccauuguuuguucaacagugaguccaccuaaguuuacauuauugccccccuugaguccccagugcauaagcccaugacuuuauccaccuccucccauugcccccaucuuacugugaauuaguuugcaugcuugcauucauauuccucuaguuaucaccgcccuaacuuuucucccuuauuuguagacuccagucuuugagcugcuuccuuuuaacagugggucaguuuggugcuuugcaauuuuuauuuucauuuucaacagcccagucuauggccuuguccuauccuucacuuuaauuaauuauuaugugauggcuuuucuucucugcgguuguauagguaucagcuuaaaccacaucucacuuuuguaaugaaugagucuguucagaagccuucugccaccccaguguuuacagucucucaaauccucagagcuugcaaucccuccccaaaggggauagauaggcuuuguacuuuauuucccuccuccuccuccuauguauugggucagucuucucugcccccaucuccuaggaaguccuguguacuuguaaaacccagggacuuuuaauauaugccauguuccucauaaacucucuuuuuguuuguuuguuuuuuguuuuguuuuuguuuuuuguuuuuuuuucaagacaggguuucucuguauagcccuggcuguccuggaacucacucuguagaccaagcuggccucgaacucagaaauccgccugccucugccacccaagcgcugggauuaaaggcgugugccaccacugcccagcccucauaaacacucuuagccacuaggcauuuuacuuugcuauaguucucaacuauaguagugguacuauugcuaaugacagucggaucuaacuuuauacuuuacacuugcuguguaccaggcaguauucuauagucuccagcuugcuuauagucuccagucuucaucauagcccugugagacagauaacugagaaaacuagggcauguggguucacagauggcccaauaacuacuuagauaggggaacacuuuugacaugccccucucucaccucauugcaucccauaugagggcacauuccuuaacagccaaauuaguuucaaucacccagcuuuuguuucugcuguucuuucugacaacagagcugucuccauucuacucuguucucaggacccaucagcucaaguccuagcaguggugugacuuuacaugaaugacuuaacuacuuucuuccuguacugggcuaaaaugggggagucagaacuauagccuuuccagugugaaaaaaauguguggguuaaacaagucaccucacugaccuuaucucuuucaucuccacauuucagauccaugcuauagccaugcuaaccucacugcuucucaaaaacagccgguacaggccagccucagggccuuugcauuagcucuucuuucuccauuaacacuacucccacaucucuguaugguaacuuucaagguacuguacacuugccauacccaaaggaauuuuuucacuacccugugcagggaacacacuaaagauauuuguaagaaugucauuugauuugugaauaaaaugagcguaaaggaaaugugauguuggugauaugaaaaggcacaaauagaaaagauguuucagagagugcuuucaugucuuugcaucuuggguaguguaauuuuaguaaaacauguauuugucacacuggugcuugggauauaauguauaaagguauauacauaaaaagguuucaaauaucauuuuuuguaucaaaguagucaacacccaccucucuuugacuaucugauuuuguauaccgagcaggguucagaucucuuuccugcuugcuuuggcccuuuauacucugucaugguuagacaugcuauauagcuuauauaaauagauaucugucuauccuccucagaauaaacauccuaugggaacuuacaggcuuuaucugcccuucauguaaaaauauaccucuguacaguaggugcuuggaauaaucugcugcacaaauuaacuugggggguguaguaucuagacgaugaaugauggcucacggcuauauauuuccagcauggaagaccaagagagaauuuacaggaaauaaaaacuagccugggugacauagcgaauuccagaccaaccugaacuacagagugagaugcugucacaaaacugacaaugaaaauuguaucccagacaucaccaaggggagugcagauaaaaaagggaauguaggaauuaauuaagaugucaguuacgacuuuuuaaauauuuaacagcuauuuacuaagcaccuagugaguaccaggcacuuauuguagaugcuggagauauagagaagcaaaacaggcagaaaucccuguacauagaaagcaggcaggcauuacuaaaagugagggagacagacuguauagauagguaaaaugaaauaccacauuauacaaaggcuaaggaacagacaugaaguggggcaaauaggacuagaguaucaagguauuugaacucuuagagacaaggcaugcuacacuuggaaaugugacucauaaguuaaggccugaaagaaacaaaggaguaagccauauuguguaaaggaagaauguaccagaaagaacacucaaugcaaagacccugaagcccagauuauggcuaccauguucaaaagccagugugacuggaaacaaguugagagggagggauagaagucaaggucauagaaauuauggaagccagauggugaagucguacagaaaguuaagggggagggagaaggaugccauacaaccuaagggcuaauguuuauugcauuucuagcaugugcuacagacaguuuucuaaguacuuuacauauauagagacacauugaguccucauuuuuaaaaaguauuuuuugauuugagaguaagauacccuauuuuacagauauagaacaaggcauagagagguugaacaacuugcucaaagucacacaggcagaacagggcagaguaugaggcugugaagaucagcacagaacaacuuugcaagaacaaacaaguuacuccaugcauuggaucgugcagaggaaaaacucuaccuggcaagaaacauuauggccucagguagacacuuuagagcuuuuauauaugcuuuucucuuuaucagaauuauccuucccauggacaucaauaugacuugcuaccuccccuccaccaaacaucgcuucuucagggaaguguccuacuugucacucugggaucuugccuguuuauguuuucuuugagaacuggccuugauuggcuaggggugcucaguuugacugccagcauccagcagcuccuccaagggugagaccuuaggcagguuacuuaacaucuuucuccacacuucacucacuugucugcaaaaugggaagcauaauacaguccaccuuuuggaggguauuauuauuuuguuuucuuccuuuuuuuugagacauuucuuacugcccuaugaauguguggauuauaauaugcaagggcuccugucuguuguguccuaagcuguuuuaaggcacccagagaaugaggugaggaguggaaagaaagccuucugggaagggcagguaacuaggauuccugguaaggccugugugggaaaaaaaaaaagcagcaaucaaauucagccugucucuuugauaagcuaguaguugaucagauuucacucagcugcuggguucuggcauagcucagaggaggcggugaaauugccuguuuuugccacuaggggucacacugcacucuauaggccucugaaagaaucugguguugggaauauuuagucccuuagagcuggggggggcgggggcgggacucugauccacugucccucggcacucuaauuuggacagcugccuaacacuguuucugcuaaaagaaccuugaacuggcucagacauaugaggaucauacuauaauuucaugcagauuaaagaauaaagcuauaaaucuaaaucauagguucuucaaaaccuuaaaagguuuauucuuaauccuuaauccaacaauccgagccagguggacagcugguugauuaagucccauccuugcagggacuuaagcagguucaguguuaguuccaguuugguuauaggaaaggguaaugguaggauaacaggugaacagugaacauccuucuaaugaggugauaauuuguuuugcuuuuuuuauugaacauagauuucucucuauccccauaaacuguaagauaucuauagguauagauaucuaccuauagauaucuuacaguuugcccccaucuguauuccucccaguucuuucccaccuccccucccauuagaaaacaaacaggcagcaggguagucauggugugguacaggccuuuaauccagggcagccaagaggcccugucucaaaaaaacaacaacaaaaagccaggcagugguagcaagugccuuuaaucccaaaucucaggaggcagaggcagguggaucgcugaggccaaggccaucuugcuaguuucaggacauccaguacuauacagacccugucucaaaauaaaaacaggaaggaaagaaaggaaaggaacagaacaggcuucuaagagauaauaauaaaauauaauaaaagaaaagaaaaagagcccaagagaaggcccaagaaacagacccauucauuugaacacuagggaaucccauaaaacacuaaauuggaagccauaauauauacacaaaggaucugaugcaggugguuaaaugcucagacuccugaaacuggucauggugacccaugccaaguaucucaguacuagggaaguggaagcagguaaaacaggaguucaaggucauccucagcuggauggcaaguuugaggcuuuccugggcuaucuagacccugucucuaaaaauaaauaaauaacaaaaccacuuagaccccugaagggugauacuugggucaaaugcaggaacugucacaacagugaagucacuuggacaucuuuucccuuguguaaaauuagugauauuguaauaagaauaucuccuuuccaaaaggaaaaaaaugccuauuuuucugaguugggaugagagauaagugagucagugccuauaaaaauaacagcccaugccuuuaucuaaaaccccauagaccaguuauauuucagaauugugaauuuuucaguuuagaaagguagcauggugcacauaugacauguuacauaacaccuucaaccagcucugucaccagcugcuuuuagaucgcugcaccaaaauguaugaacagucauacuaagcaaagaucaauaaaaaccagaaugggccuugcuuucuuuccaaucauguuuuguugccaaaagaacuaaaaagaagccuucguucuuagacuguuuuggauuaaggaauagcagaaaaaaagauuugugaacaaauuagaaaauauuuauguaaaguuuauaacccaagcauguuaaauuuaaaauucacauaauaauaaugauacauggucucuauagauaaguauauuacuaucccuguuucacagaugagaagauuuguaauacaaaauaaguauaaugaauuggccaaaaucccacagcuaauaacuagcagauccaggauuuaaaccauaaaagucuaacaguuuagguugauugugcaguaggcaagauggcuuucugcuuagagcagugcuucacauaaagaguaaauacauacuuguuuuuaaaaaggcucauagccaaccauuggauugagcacaggguucucaauggaggagcuagagaaaggacugaaggagcugaagggguuugcagccccauaggaagaacaacaguaucaaccaaccagacccccccagagcucccagggacuaaaccaccaaccaaagaguacacauggagggacccaugguuccagcuacauauguagcaaaggauggccuugucgggcaucaaugggaggagagacccuugguccugagaaggcucaaugucccaguguaggguggagaggcggggugggggguggggaagcacccucauagaagcagggggagggaggaugggauggggguucccagagggaaaacuggaaauggggauaacauuugaaguguaaauauauaaaauauccaauaaaaauaaaaagaaauuaaaaggcauggguuccgggugaagcucugugauaaaucuuguacuuaacaugcauaagucccuggauuugaucucuagcacuacagaaagaaguagcugccuuguuugcugggguguguguaaucucagcacuugggaaauggaaacaauagcaucaggaacuugaggacagcuugaacuacauaauacccuaucacaaugcagcagcaacaauggcaaaaagagagagagagagagagagagagagagagagagagaagauucauguggccucauccuuuccuguggaucuaaaggccuuuaaugguuacuucagugaugcaggguccauguuccugaaaacaaaccuucaccauggccuuguaagcaacucuacuaaaauucauuggaucacaaaaaagucauaauauacaaagaagccuaguugggaagaggaagauaaucagugggaagggaggggaacgggauagguuaauggagggaaauuuaaucaaagucauuauauuagaaaugguauaaugauggcgcacgccuuuaaucccagcacuugggagacagacacaaguugauuucugaguucgaggccagccuggucuacaaagugaguuccaggacagccaggacuacacagagaaacccugucucgaaaaaaacaaaaacaaaaaaaaaaagaaagaaaaagaaauguuauaaugaaacccauuauguauaaauaauagaaacccacuauguauaauuaauauaugcucaucaaaaagaaaaaaauuuaaacgcuuaaaccguacaggaacaaucccagguuagaaaaauugggggaucaaggaacagagaagaguacguauucagauucaggaaggcuucauaacgcaaaggacuuuucaguggguccucuucgucguuuuuagaggacgacugcucaaagaggaaaggagcuccauguacagugaacaguacuugcaaagggcuaccaaaaggcacauccuagaaaaguugauaggaaaggggagagagagagagagagagaguuaaugugaguuaaguuauggauauuacacuaguuuucuagucccgcuauauaauuuauucucauugaaacuauacauuucuguagaugcauugguacauaccuguauucccaguacucaggaagcugaggcaagaguucaagaccagcccgggcuacauaguaagacucugucauuuaaaaaaauauauaauuuaucaucugacagaagcccaacacugaucuugccaggcuagcauuaaagucuagcaggacuuuuaguccuuucuagaagagguuuguuuccugcucauucagguugucccuuuaguuguaaugcugauuuccuuacuggcuuuaagcugagggucauuccagauuuguggagcugcccaauuuuccugucuuagagccuucuccagaaucaagaaauagcagagaaaguccuucugccauucugcccuaaacucuguuuuagccucauuucucugcuuugaaaagagcucauacagugguugaccucaaauaaagccagagugauugcuauaucuuaaggucuguaaucuuaauuucaucucagaauucauuuaugcuauguagccuaaccuggucacagacuccaauaacuaggauauggaacucuuuggggcucggguuguauucugucuucccucuggcuccuaaagauucacaugcaucaaggcuggacugagggcucaauauaaagaaugcuugcugcucucacagagaagcagaguccaguucccagcacccauguugggcaguuuauaacugccugaacucuagcuccagggaauccauugcccucuucugaucucucuuggcaccagcacacauguguacauauagucacauggacauacucacauauuuuuuccuuuaauucuuuuuugucacacauguaaaauacaaggggcauccaaagcuacaugaagaaguuuaggagacuguuuagggaauaguagugagauuugggaacagauguggaggcaagguaacaagaaacgaaucauuuuugcucucuuccagguacuccuggaauggcgugagugcuucccuagugauggacccaucugugacgcuguggcaguuucugcugcagcuucugagagaacaagguaauggccacaucaucuccuggaccucacgggaugguggugaguucaaguugguggaugcagaggagguggcccggcuauggggacugcgcaagaacaagaccaacaugaauuacgacaagcuuagccgggccuugcgguacuacuaugauaagguauggccucaaagaccaggacugcaaacccuugaaauuacugucggaaaaacucuguuuuuuuuuuuuuccuuuugagacaaggucuuauaauguagucuagauuugucuggaacuuaacuauguagccuaagcuggccucaguuucacuguccugucucuacccccaauuucuggaauuacacuucaggccuagaaauuucauuuuguugucucaauuaguauagcuauaacuuugaagacaguauuaaaacuuacuaauuuuggcccuauacucuaguucccugcaugccuggagauaauagguguguuuuucagaauccucagaccaauguuagauuccccuaguuacuuuaucuucucuuacuaccgaaaaauccauguucuuauuccuagacucagaaucaucccgacauuguaauacuaaguuuccuuacuccauuuucuagaacccccaauaucuuuaaucacuuguuuuguuuuguuuuuauuuuugaggcaggcucucuuuguguugcugaagauggccucaaacuugcauuucucuugcuuagucuccugagugcuaagauuacaaaucuuugccuuuaaguaaaugcuccagaaaaauguuuguagugccagcucauacccaccccucuuagaucccuagagcagcgccucaguaucuauaucacuugcuuuaguucaucaucuuacagggacucaauuuuuagauuuuucucaucuuacucucucaagcucccagaucugcauuguauucccaccaauaugugcacuaauuauuucauauuucuucaggguaaaccuucaaaacaauauuaauaauuacccauuuuccuucauuuucuguaaaauacaaggauccccuauggccagcauuaagacauucaccaaaaugccuagugccccauauucuucaugccaccaccccaaauaguucucaccugugcuuucuguccucgguaguuuauggcauauauuccaguuucauacauuacucuuucaguucaaaucuccaaaauaaugccucguuuugucccgagaccaccaagacaucccugaaaccguccaaaccauguuuucugacccacccaaacaaaccuugcuaucccccucaugguuacaccagcuucuuacucucuucucuaauuccugccaguuaccucauuuucuuaguacuuuagcuuaaauauccagaaugguacuaauaauaaaacaucaccuguccucuuuugugauauuucuguccuaauguauucucuuguuagcagaagcaugaugaucaaaaggaaaggguuuguuucucuucuacuuccaugucacaguccaucauugagggaagccaagggaagaacucaaggcaggaaccuggaggcagaagcuaaagcagaggccauagaggaaggcugcauacuggcuugcuaccccaugggucacucagugugcuuuuuuuuuauacuacccuugaccacauucccaagggugguaccacccuaaguaugcuggccccuaccacaucaaucacuaaucaguaaaaugucccacagacuugccuacaggcagucugauggcaguacuuucuuaauugaaggucuuucuuccuagauaacuguaguuuguaucaaguugacaaaaagcuaaccaggacauuugucucuuuuugucaucuugacacuguuaaaguauaauuguuaacuuuguauuuauccccaagaucucauguuaauaucaguaucacaaaauaaaacauaguauaacuuugaaaguccuuuuaaaacuucaaagauucaaugucucuaaaauaucuaguaucucucaacugucagcuccuauaaaauaaaaaauaagcacuuauuuacucuuacuccaagaggaaagagccaguuacaaucagaucaaaacaugaccaaacuguagcagugucaagaucugcagaugaagaucuggcaccugggacucacucaugaucuuuuaggcuccagagagcuugggcagcuccacugcuacagcugcaccaacugcaucuccuggccugagucuagcuccauaucauacuuucaccauucuaaguggugucccacagucuuugcuucuccaauaggcuggggucuucacugcaacugaggaugcacccucaccacuggccucuuagccucucuacagggauuccaacccuauuauaugguaccaagccccagcuucucuccaugacccuuucaauccuggagcaucuauugcaacugagguuucaucuucaccagugacuucuccuagccuuucaaaguaccaggccucagcugcucuccacaaccccuuggcaugaggcuuuuaugccaaauaccauguggaagacucuucuuacacauugccaaguucaagcuaccagcauaauaugcauucuuggcuccucuggaccacagguucuguguacugacccugagaaaauacuuccugaaagauuucaccucagugaugcugaucucuacucacagcugauuuuuugucagccucugcuaauuacucucgguugucccaguaaagucaagauuucacuucagggaugcuggucucuuguuaaucacagcugauccuucugguucugugguaaccagaaaccagagucuuaauacaaaauaucacauaaaugaccccuauagagacugaggggcucucagacuucccucugaaccuucacaagccagcccuccaccaucugcacugcuaucagaauuaucuuccaaguucccuuggcaucucucaucuaaagcucugaacaaacguucagaugcuagcaaaaguuccagaugcugccacagcucuuuccaaaacaacacgcucaggucugucaccgcaguaagcccugugugguacuaauuucugucauagugugcuuucugcugcuguaauaaacaccaugaccaaaaguuacuugaggaggaaaggcuuuacuucaucuugaaaaauccacucucucuuuccagugagauggcuuagcaagguccaucauugagggaggucaagauaggaaccuggaaacaggaacugaagccaaguccauggaggaauacugcuuacuggcuuguuuuucauagcuuguucagcuaccucuuuuacacagcccaggaccaccuucccagggaaagcaccaccuacagcaggaaaaugccuacugacuugccuaaagacaaucugaaagaggcauuuuuuuuucucuucuuaaaugacucuggcuugugucaaguuaacaaaaacaaauaaccaacaugcuuuuucugcuccaugucagcaucgcuagcuuuuaaaaauccacuagcucuggccaaggcgauggcuuagcagguaaaggcucuuguugccaagccugagaaccugaguucaaucccugggacccacauacuagaagggacaaccaucuucugcaauuuguccuccucugaccugucuaugugcuaugguacacuuauaccccacaaucagucagucacccucaguuccccuucccacaacagucagcccucuguaucaaucuugguauuucucucccuauucaucuauacuaguuuagucucuuccaacauguaucaguuacuucauuuuauuacugcaguccuguuaacauuuccaaaacaaaccugacucuguuaaacccagguucauagaucucacccauucccuuaaauuggucccugaugaaauguagucaguggaaaaaggggaauuagacugaugaagaugaauaacagaaaaagacuugaagggaaaugggugggagggacacuaaagaaagaauugguaaaggaagcccagagaaggaguugaaacugcagagggaugcagagaguggggaagaaaggaaagcauagacagauggaaagacuccacaagccuaaaagagaggagugaaauaggagcaaguggaaagaaagacaucaggagaagagaaacagcccucaagacccuccauucacccuguucuucacuucucagaauaucauccgcaaggugagcggccagaaguuugucuacaaguuuguguccuacccagagguugcagggugcuccacugaagacugcccaccccagccugaggugucuguaaccucggccauagccauggccccugcuacuguccaugcaggcccaggggacacugccacuggaaagccaggaacaccaaagggugcaggaaugacaggccaagguggcuuagcacgaagcagccggaaugaauacaugcgcucgggccucuauucuaccuucacaauacaaucccugcagccacagccacagccacccauuccuccucggccugccucagugcuucccaacacuaccccugcaggaguaccagcacccgccucagggagcaggagcaccaguccaaaccccuuagaagccuguuuggaagcagaagaggcuggucugccccugcaggugaguacuggaacuuggaaauuuaggaaagggcuuggagaaggaugcaucauucugaaaugaagcacagaacucauagaauagagauagguguccugguauaggacauagaggcggaagaggggauacaaguucucucagagaaauagauaggaaaguuaugccucuccuuguacauuagucccuuacagggucacaucuaauguguacauuagucccuuacagggucacaucuaaugugcugauugucaugcuuuagcacucaucauagucacgagaguggccuuaaaguugcuugggcccauuuccaaaguuucugauuaauguggguaugaagauggaugacacugauacucuagagucucacccagagacauucuuggaugacccacagagaaagguuuuacacaugaacaauccuaugcauucccuuugcacacaccccuuuuccagguuauccuaaccccaccagaggccccaaaccagaaauccgaagaguugagucuggacccaaguuuuggccauccacagcccccagaagucaaaguggaggggccuaaggaagaauuggaagcugcaagggcuggaggcuucaguucagaagcugucaaagcugaaccagaagucucagccucagaaggccugcuggcucggcucccagccauccuaacagagaacacagcccagguguguggccucuccacuuccaccacugagaucacccaaccgcagaagggccgaaagccucgggaccuggaacuuccacuuagcccaagccugcuggguggccagggaccugaacggacuccaggaucaggaacaagcucuggucuucaggcaccggggccagcgcuaacgccaucccugcuccccacacauaccuuggugagugccuugcagaggagcaagggcuggcagccuagaugaguggcauugguacugguaacuuacaagcuguucuugggcuuacgcugaagugauggggcuaauuaagaagagcaggucuuaggucuuuguggcagccugacucccuaaugcuuuccacgggguuugcauaguggguucccuagugagguauauugguggaaucuaagacugggaaguugaguucuuccgguggucacaagguuugagagcagugcauggauagaaucugguggauagucuuaccgaagucucaguaacaggaacugagcuccuagguguaaugauugagggaugucauaggcauggucauaguaguuauacucuagguuuaugaacuuuugaggaguaacuguagaacucugaaggagauccaugaagaggugcugaaaguagguucuuuccaucuucucauacuugucaccuguucacuugaguuccugccacuccgucucuacagaccccggugcugcugacacccagcucgcugcccccuagcauccauuucuggagcacucugaguccaauugcaccccguaguccagccaagcucuccuuccagguaggauugccucccgcucuguuggaagcuuaagaguuacuagcacgguucacccauaaccucuccuugucucuucccccaguuuccguccaguggcagcgcacaggugcacaucccuuccaucaguguggauggccucucgacccccguggugcucuccccagggccccagaagccaugacuaccaccaccaccccuuuuuuggaguccauccaucuaugcuccugaacucuccaguuagccaucucaaggagaaacauaguuaaacugacagacuuaagcucugauuguggugggguggauauuccuggaaaagugaauauuucacuaacuccuccacccaaaacagacaacuucuuucuucuuugccagccucccaguggcugcccuuacacgucuccuacuucaaugguggggcgguuuauuuauuuauuuuuugaaggccacugggaagaaucuggcccaaccuuuuuaggggaguggguaagacaucucacccauuuccuccccauuuuuuccuaaaacaagacaaucagggcauggcuugagaggaaccuuuauuuauuuauuucucagccugcccuuggggaguugagggugcccugucuucauuuugcgacauggguugaagaacuagcuuguuuuguuuuauuauuccuggcuguaucugaguccagggagcccuuguacgauuuaaugguuugggagugguagccagggaaucaacacuguuaaaauaggaauugcuaccucccuaaccuucuucucagucagcuuguucuuuucucaaguaaccuuuuggccagggaggacuauuccuuuuguuguucuuccccccugagaagccauuccuuugucugccaaauuuccuggggcccugccuauuaccucccaauggaggguuuuuuuggguggugguccccgucuggggggccccuccagcuaguacuccaggucucugucucccacccccuuccauuuugauaguauaaucuauuuuuaaauggggcuuuucaauaggggagagggaaacaucucuuccuauaucagauggguggguaggcgggugggugggaaguaagggauuuggaggcggucuuccugccacccccaaguguuuauuuuuuauaccaaacauguauuuuuggcucccucccagccccccaauuuccugcaggcggguacaaaggacccuuuuaagugucccuggaguugggagggaggaaugggggacauggagccugucuuauaucaaucuaggcuggaggagguggaucaaaagacucccaggcucaccuccugucagcacuggcccagaccaggccugaagaccuggggguuggugauuugggggacggugcuauacucgucuccacuacuuguuuugcuuccccaaaauggaccuuuuuuucuaagagucccagagaauggggaauuguuccuguaaauauauauuuuuaaagguguugcugaaagcuguugguauuuuuuuuucuccugugucaccaaaauaagccaugacagccacgaauaugaagaacaauaagggcgaggcaaagauugacugugagagaggcaaaaugauggcauaugucagagacugauacagacugcugauugguaaccagugugaugagagaaaccgaaagauuuuaaauaugugugucgcaggucagaagugugaccgcaaacauuuuuguacauguguaugcauggucuuaugugugguguguugucuacuggaacacuguccccuccuuugagacagggucucaucuuugccuaaacuuaccaguugggauacacuugcuggccaucaagucucaaggaucuaccugguucuaccuugggauuacaagcauguacuucuaugccuggaauuuuuaccuguauuguagggaucaaacggucaccuuuuaccacguugacuccuuuauucacaggguugugcaaagcaaguguuuuauugacugggccauuucuccagucccaaccauuuguagaugaaaagucacacuguuaguagagaaaugguuuugagaaaugguuugugugugaaauuaagucauggagguauauguuuaagaagcugauugugugagccaggugguagaggcacacgucuuuaaucccagcacuggggaaggagaagcaaguaggucucagaguucaaggucagccuggucuacagagcaaguuccaggacagccagggcuacacagagaaacccugucucaaaaaaagaagagggaaaugaaggaggaagaacaagaaguuacugauugugugaaagaaaaugaucaugaggcccaagugacugauaagacauaggugugaaacuaaaauguuucauagaaaccauaggaaagauggagaaauggauugguuguggcugcuaaagucuaaaaggcugguguguguguguguguguguguguguguguguguguguguguguguaggagagagacugaaaauguuacccgcuacuaguggguagcagcugguuaacaagucucagcuuugggcuggagagauggcucugguuaagagcacugacugcucuuucgaagguccugaguucaaaucccagcaaacacauggugacucaaccaucuguaaugggaucugacaccuucuucuggugcaucugaagacagcuacaguguacuuagauauaacaauaaaucuuuaggccagagugaacagggccggagcgagcaggcucgaccaaagcaagcaaccuucauucccagcaaccacaggauggcucacaaucauguacagccacaguguacccauauacauaaaauaaauaaaauaaguaaaucuuaaaacaacaaaacaguugcagcuuccauagguucuggugagacugaggagcugaggagaaaagaaggacucacagucagcaguugugagaaacuugacaaccaaauggugucugagaaguaugugugucugaaaaacuggaggcccacacuacaccugcugaaugagaaauagguaggauccagcaaugugcaguuggaucaagaagcccugugggugauucuuguguguccuaaggcuagagaguaaugacauccaagaagggucacaggagaagaccuuucugaaagauuuuuauugcuagucucccuuuguagaguguuuaaguccuuuagagacagugauuuuuuuuccugucuuguuuucuauuccauuuaaugcugagaacuacugaugcucaguaggugcucaauaauuguugaacaaaccaauuuaguaaacacagccaggcacuauucugaguauuuucauugucgggcugugacagaucuaagcuguguccagugcuguaaauuuguacugcauacagaccuaaagcugcucacaugcuaggcaaauggcauaccacugagccccuccccccaccuugggcaguggguaugccugaacauccccucuucugaaucacuucccacacaaugccacuucccuuuuucacuucccuugcauugaccucacacacauacaugcugaccacaggaaccucacuuuuaggaaagggcuaaguuuucaagaugguagauaaaguagcugccaugaugccuucuucacaaaugaggccuucccucaucucacccuucuccaguacccccaugaaauuggucaccauagucaagauuaugcauuuuacagguaagaaaaugagccagccaugguguuacuugccuguucaagaccagccugguguuuaaagcaaauuucagguauggcuauguuguaaaaccuugcaaaaaaaaaaaaaaaaaaaaggaaaacuaaagcugagaauuuaaagugacuugccaacguucacacgccuaggugguucuuguuuucagaccccagugcccuucagugagaauuugucuccuaagcauugagugaaaaacuaagugauuucuggguaaggugggguauuaggugguaaagauugacuaacaaagcagcaucaagggugacaaagcagcuacaaggaaauggagaagggagaaaagaggaggggcagagugcacaagggagacuucacaguuaaugaggccauacccucccaguuccuccugcccuggguuccucuuucuggagcaggucaguccagacaaaaccaaggccuccucucugugaggagugcagaaacauaguguucaaaaugccugcugaaaugcaagccccucaguggcuccugcugcuacugguuauccugccagccacagguaaguggaugagcgcccacauguccuccaagggaugcccaggccaaccacacuccugauuugccauuccucuccccugaucuuacaggcucagacccugugcucugcuucacccaguaugaggaguccucuggcaggugcaaaggccuacuugggagagacaucaggguagaagacugcugucucaacgcugccuaugccuuccaggagcaugaugguggccucugucaggcaugcagguuuggaggaaccugggcugaacccuguaaccuagaacuguacucguugcccuggagcuucuaagagugccaccuccuccacaagcccuccuuaugaccauagcucaggguuucaaaaucuuggcacuguugccauuuggagcucuuuguuaaggguaugaguucuuagcugugcauuguuugguaguuuauaacauaucugaccuaccccuaaauguuuuuaacaacucucugcacugauuauuaguggguguggggugucucugacucuuucaucugugcuuaggaccccuuuucuccuccugaguugccucauccagccuugauauaagaauuugugccuagucuuauugcaucuucuuaugacacguuugguuaauauuccuggaaggccugauuuuuuucugaaggggaacuggaggaggaggaucuggggaagagaggagguuguaggaggugggggcugaaagaaacgaggggaaaggaaacuauaguuaggcugucuuguaugagagaagaguuuuuaaaaaagcugaauccagauacugccaaaugucccuuaggagagacaaaauuaacccuaauuuuaaaaugcuuuaaaagucagggcuuccuguaaacauugcagguggggugcaauuuggauauuuucuaugguagcucuauucuccuaacuuacaauagaucauaauugagugcuuauuauauauagaaccauuauagaaauggaggacuuuaaggaaauucugaggacaaugccaaaucuuuaauugugaugacacauucauugugcaacucuuuuguggcaguuuggucucugaaggcacuucaaagcuccuaaucaugacuuccaguuuacauauguugagucuuacuauacuguagauauaguuuaugacugcuuacuauguauuucagauaacauuguaaagaugauaggcuugaagaucuuggaaagcagcucugagcugccagucaugcuaacaguucaugucucuuuagcacuggcaugcauacccauauuaucaugcaaacccaguucugugcagaagcaauguguuucucuaggauguugugaagggaccgcagagcuucuguuuaguaaggacuuccucucugugugguacuguacaggguagugaccuauugaguuccuggcagaaguucugguuuuuuagucuguaaauuugcuuauuguacaucuggcuaugacccugggggguuuccagaggaaaaugaagggaaaugaaauuuauuagauauuuccuguauauucacuucuuccuguucaaucacccaccaucccuaagugguaaguaggcucucagugaucuauccugucacuucauaccaggauagaacaucggcuccucucuacaggucuccacaauggucagcaugguccuuaugggggcccugcucaguuacauguucugaggggucccagcugcgacacaggcgcugugugggcagagguggucagugcucugagaauguggcuccuggaacucuugaguggcagcuacaggccugugaggaccagccaugcuguccagguaaggaagaucaacaaugcggacauggaaccagcccacaacacuagaagaaucagugcagagguccugaggacagaccuuuguauggcuuuaaggagaauggaggaggcuaggaucgcugaaggauguucgaaaguaaaaacauuggcuugaggcugaaugauuuggauuauuggaaggggagagauuuacuuugacuugcuuugggaagaggacaggccaaaucuggaguaugaaagcugcugcuauaguccacaugagcaguacugcuaggucagguauagggacaagagauaggacaggcuaagaugaugugggacacacaugaaagaaagggauccuugguuuuuauuagguuuucuuuacauuucaaauguaauccccuuuccucguuuucccuucgaaaauccccuauccccuccccucccccugcucaccaacccacccacuccuucuuccuggcccuggcauuccccuauaccagggcauagaacauucacaggaccaagggccucuccuccuauugaugaccgacuaggccauccucugcuacauaugcagcuggagccacgaguccuaccauguguacucuuugguuagugauuuagucccagggagcucugggaguacugguuaguucauauuguuguuccuccuagggggaugcagaccccuucagcuccuuggguccuuucucuagcuccuucauuggggacccuguggaaagaaaggaauccuaaguugccacacacacccccacuucuucucuuuuucucccacagagauggguggcuggucugaguggggacccugggggccuugcucugucacaugcuccaaaggaacccagauccgucaacgaguaugugauaauccugcuccuaagugugggggccacugcccaggagaggcccagcaaucacaggccugugacacccagaagaccugccccagugaguaagaguagucacaggacauggaagggauaauguuggguuacagcaagaaacugugagggagaaaaaaaaacuuuuaugcuugcuugacuacaguucauccuuccauuucuaccacagcacauggggccugggcauccuggggccccuggagccccugcucaggauccugccuugguggugcucaagaaccuaaggagacacgaagccgcucauguucugcaccagcaccuucacaccagcccccugggaaacccugcucaggaccagccuaugagcauaaggccugcaguggccuaccaccuugcccagguaugcagggaugaggccaucgucaugcagcuaguggggcuuuagauuucuggcaaagaugaauggaauucuuguaccacgugaucagaagccuaucaucugaggaguuugccucagaugucuagaggugauagggagggaagcuggggagagugcaugauuaagguggucuuuauugucacuuucucuccauuccaacaguggcugguggcugggggccauggagcccuuugagccccugcucugugacuuguggccugggccagacccuagagcaacggacaugugaucacccugcaccccgucaugggggccccuuuugugcuggugaugccacucggaaccaaauguguaacaaagccguaccuugcccugguuagcaagucaaaaggcaccaugcccaugccuaacccccugcccaagcccuaugcccaucacugcugcccacuugcuaccaaaaccuuguuccugccuucauacccugguucaccucuccuccuucauccccacaucuguucacucccacucccucucaaagccuucuucauuccuuccccugaggcccuuuacuggccccaaacccucuugcuccuugucucuacaguaaacggggagugggaggccuggggaaaauggagugacugcagccggcugagaauguccaucaacugugaaggaaccccaggccagcagucacguucaaggagcuguggcggccgcaaauuuaaugggaagccaugugcuggaaaacuccaggauauucgacacugcuauaacauccauaacuguaucagugagugacccacaggcagcacuguaagggugggcaaccaugcuguagcuaugcuggguacccaaugcccuugcggucuccuuuuuccauugagaccuccaguuuugacuaugugacacuguauuacccccuccuauugcagugaaagguucauggucacaguggaguaccuggagucugugcacaccaccauguagucccaacgccacccguguccgccagcgccucugcacaccuuugcuccccaaguacccgugaguugaaggacauuguguuucuaggaggggcucaugaugcugaaggaugagaagggaauugguuacauugaacuggagcuucaccccuggaucaaaggugccugccuugccagugccaucuccuagcuuagagaagaggagagaaagaaaagaggaggaggagcaauuagggaagacuucccagccucugugugccucaguuucuaaugcagucacauagcuguacucccaugcauauaguccuucaugcagccuucucacugagcucuuagcguacuuuugaguuacucagucauccaugccuccauuuauccacuccacauuucacuaccuugagguacuccaaggcauuuuuuagcaacagucucuaaaaaagaacccagaucuauggguagaagguacccagaugaguugugauagauacaaucuaaaaaugacagguaaguagcaaugagacuaucacuacccucugggccuagagagcuaaauuaggcccuucuggagaagcauuccugacauccagauugugagcauguucuugacagagcugauuagccagccaccuugaguguuuacuggacaccacaguggcccaggaguuagaaugggauaaguuaccuaucccuucuuacaccacauacaucaugguuaaauggccuuuucccagcuguuaaauagccugucacugggauaggauuuugcaaaugugggggggugggggcgaggagucagacugguuccugaaguuaggaaccaguuccuaauuuccuaaguuuuccacauagaggcuggguaaaaaugaauagagugcuugccuacuaggagaaaucuaucuggcaaaaaccuuccuggacauaaaguucuauuuggguaaaguggggaggaacaaagaaaagagagauggaaaucaaggggagaggagaaauaauggcuuaggauagggauuuaaggugaguaugagaaaagagaaaggguuuggugguaaauauuauuccucuuacuuccauuuuguagaugagggaaacugaugcacagggaaucaucuuuccuauuucuuuaucagaaauacuccaguaucacaguuagacauagaguuaaauguacagugagauguuaauucagguguaguagggcaaaccuauaauccuaacugcuugaaacgcuggaaccaaaaggaccacauguucaagacauuccuaggcuacagaaugaguucaggguuagccuggguaaaagagagggaauaggucaguaggaccuaaacaaacaaacagacaaaaagaaugcugggcuauuagggauauaguggagcacuuuccuagcaaauacaaaguccuagguuuaaucucuaauaccacaaaaaauugauaugacacuugccuauaauucccacauuugggaagcugaggcagggguaucauugauuuugagauaagauacucucaaaaaacaaaguuguuucaaugcauucuugucuuaccugagcugcucuccuccauugcuuccccaauacuccaggccuacaguuucaaugguugaaggucagggugagaagaauguuaccuucugggggacuccacggccacugugugaagcgcuacaggggcagaagcuggugguggaagagaaacggucaugucuacaugugccugucugcaaagacccagaagagaagaaacccuaaaaucccuugcuuccauucugacccccugacuuucuagaccacaauaaaccagccuuucuagacucuuucuaagauucuguaaugacgaagggggaaccugcccccaauauuggaaguggggcaauagaauuuucuagagca

SEQ ID NO: 9431 - RNA, 25676 nt, Mus musculus
cucacugcaagucucgcugcaguacgucacugauaaaggucucguaccgcagcacuuucucccccaccguauccaaggcccgccguuucgggggcgucgccaugacgggcaccugggggaguaaaggggggggcacguugagcgcucuauuuaaacuucacaaaauucucuccagccacucaacguuggggaugacuucuuucggcucgagcuacggaguugcuucugcccaacccgauuuuggaacucguucacucaccgguacaggaguacggcguuuaccguagggccaccggcaauaacuguuaguaugagccgcggcuuccggguggcgcggauggaugauguaauuuccagcaagggagccaaccaaaucgaugggaggggcgguccggcgugugggaagaugcacuuaggggaagggcugcaggcggggccugagugaauccuuggagguagcaggauccuauggaucuagaugggccuggcacgccgcggucugccagcaggcggaucgucgcgagcuggcgggagacugguuugggugacguucaaugagauuuggcggguucugagggaggguggacuuacaggaagguagggagagggaguuaaguguuuauaauuaguaauuugaagugugugugugugugcgcgcgcgcguugguacugaacuuauaggcaguugugagcuaccaugaugugggugcugauaauggaguuuacauucucugcaaguuuuauguguuuuuaacugaugagccauuucuguauuccccccuccuuacucuuacauuuguuuuccuauuuuauguguuuugucugcauguuuauggacuacaugcgugcauugcccacaaaggccagaagaaguugugggauucccuggaacuggagcaaccaacaguuugugugcaccauguggguaaugggaaucgaaccuggguccucuauaagacuggccagugcucuuaacuacugagguaucuauauagucccuauuuuuuucuuuuagaaacauuucuauucuuugagaguuucauagauguaugcaauauauuuucaucaucuccacucccuuuucccuccaacuccuccuagacuccuccuaccacauuuuccuccaauuucauauucucuuuaaaacaaacaaaccaaaucaaaaccaaaagaacucacugagaccacuuaagcauuuaauaauuuuaaaagcacaagagugccuauagaccagcaaggauuaugguacuaaucuauaaggaaggcaguauauccuguggggaucuguuugaaaaaaauauauguugcacacauuguuugguuuucacccuccauaaagggaaugaauaagagcacauaaaaauguuuaaauggagacaaauuuuaagaaauuuaucuugaaugaauuucugcuugguggcaugcaguccaugaugagggcuacagagaaaccuugucccccaaaccaaaaccaaaauuugauguuacauguauuuaaaaguaaauuugaugugcuuaaagcagauauuaggaagcuauauaauauuaguuaaucuuuauuugcuaaggagaacaguuuagauagacuagaguugggucuguuaaguuuauuaacauauuucauguaauuuuucuuuaauuuaaaagauacuuuuagguuauccaaauggcucacugguuaaacggugcuaaccagucugacagccugaguucacucugcacggcggcuuguagguuacugcuguuccugacauagagauagcaaacuucuuuuuuacaaugggagguaguuacuaaagaagauucauaacugguucaacugcaaggaaugugucuguugcugugguagagcugcucaaggugguagaaaguaauaaucaccuauauuauucuaagucuuagagaauagaaggcaaagugggaagaaugugaaagcugcaggaagggagcauugucucacgauuuacacuguugggcaugaccauugcuauuuugaauaagagcagaugugaucacuauucaucaaacauuuaccccuuccauacauaguucugagcauuuuacauauaucaacucauuguguuccucugaggugucugacuguguagcacaguuacacauagucuggacugcuuuccccauguccagacuagaaagaaauauaaccaggguuucauuuucacacuucaaucuugguccaucuagaguauggauauauguaauaagguaugggcccaauuuaauauuuaucuacagcuuuauuuuucaguuagagucuugucauauagccaggcuggcauugaauucacugucuaguccaugcuggccuugaacuuaaaaucuuuuacccuagccuuucaacuucuggcauugcagauguaaggcaccaagucaaacuuaaucuguuugcaaacgucuguguuuaacggguagaaugaugucuagauauauagccacagaauauguuugaaaaaauuuuacauauauaauuaaggaucuugagguggggggucauucugaguuaaacaaauggccccaaaccaaugagaauuuuuuuuuuuuuuugguuuuucgagacaggguuucucuguguaguccuggcuguccuggaacucacuuuguagaccaggcuggccuugaacuuagaaauccgccugccucugccucccaagggcugggauuaaaggcaugugccaccacugcccagcgagaaauauucuuauaaaacaaagagaaagacauaggagauggugugaaaacugaaaacuggcagacauuagggucauuguuauuauuuauauacgagaugucuucucuaaaggcucauaugcguuaugguugauccaucgcaggugacaauauugagaagugauugaucaugaugacuucuucaauggauuaauucauugauaaguuuauagcugaauugcucauaagaaauggagccuacuuggaugaaguaacaccccaagggcauguguguguguguguguuuauaaacaaacacacacacacacacacacacacacacacacacauauauuccuauauccauuuuuuucuguuuuuuggcugccaugagauaaguggcuuuucuccaugauguccuucugccauuacuuucugcccugcuaagaggccuaaaaggggggaaaaaaaaagaccccaaccaagcugaucuuggaaaugcgauaucugaaauuuuuuuuuuuuuuuuugguuuucugagacaggauuucucuguauagcccuggcuguccuggaacucaacuuuguagaccaggcuggccucgaacucacaaaucugucugccucagucucccgagucuaggauuaaagguguacgccaccacacccggcuaggaugucuaaaacuuugugaucauaaaaaaguccuuccucauuuguucuuuuguuaagucuagucacagcgaugaaaaugauacuagcaugguaauauguuuauaaauuaaaggguugaggccauaacuuagugguagaauguuuaccuagcuugcaugaugcccuggacuugauuuuuggaacuucaaaaauacaaacugaggcauaucaaugauugcugcuguccuuagagaagguaggaaagaggcauagaauagauuuugaguagaaagggaauagaauacauuuucuucaaaaaggcuuggcucuaugaucucaugaguuuggacuuacagucuccagaacuauaacagaauagaauuuauugguuuaaaccagccagucugugguaacuuuuuacugcucucuuaggaaaugagcauauuuauuugaaaauucaccuuuguccaucaugauuugagauggcauuuuaguuagacacagacuucuuuacugacauuuuacacgguuucaauggcuuauauauucaugggucaugagugcauggucuuacuguuuugguugguuuuguuuuugaaauauaguauugcuauuuaguauauauaggcuauuuuugaacuuaauauguaguugagguuuugaacuagcuacccuccuuugccuuuuuaaaaaaaaaauuuuguuuuguuuuguuuuccuuuuuuauuagauauucauucacauuucaaaugcuauccccuuuaauuguuuaguccccuguacccuucccccucccccugcuccccaacccacucacucccagcuuccuggcccuggcauucccuuaacuguggcauauaauauuugcaagaccaagggccucuccucccauugauagccgacuaggucauccucugcuacauaugcagcuagagacacgagcucuggggguacugguuaguucacauuguuguuccuucuauggguugcagaccccuuuagcuccuuagguacuuucucuaacuccuucauuggggacccuguguuccauccaauagaugacugugagcauccacuucuguguuugccaggcacuggcauagucucacaagcgacagcuauaucaggguccugucagcaaaaucuugcuggcaucugcaauagugucuggguuuggugguuguucaugggauggauucccaugggggcagucucuggaugguccuuccuuccaucucagcuccaaacuuugucucuguaacuccuucuauggauauuuuguugccccuucuaagaaggaaugaaauauccacacuuuggucuuccuucuugaguuucuuguguuuugcaaauuguaucuuggguauucuaaguuucugggcuaauauccacuuaucagugagugcauaucauguguguucuuuugugauuggguuaccucacuuaggaugauauccuccagauacauccauuugccuaagaauuucauaaauucauucuuuuuaauagcugaguaguacuccauuguguaaauguaccagauuuucuguauccacuccucuguugaggggcaucuggguucuuucuagcuucuggcuauuauaaauuagacugcuaugaacauagugagcauguuacuacaaguuggaauaucuucuggguauaugcccaggagugauauugcuggaucuuccaguaguacuauguucaauuuucugaggaacugccaaacugauuuccagagugguuguacaagccugcaaucccaccagcaaugggggagugucccucuuucuccacauccucaccagcaucugcugucaccuaaguuuuugaucuuagccauucugacuggugugagauggaaucucaggguuguuuugauuugcauuucucuggugauuaaggauguugaacauuuuuuucaggugcuucucuucucagccauucaguauucuucaguugagaauucuuugcuuagcucuguaccccaauuuuuuuuuuuuguuuuuuugagacaggguuucucuguguagcccuggcuguccuggaacucaacuuuguagaccuggcuggccucaaacucagaaauccgccugccucugccuccccagugcugggauuaaaggcgugcaccaccacacccggcuuuguaacccaauuuuuaauagguuauuugguuuucuugaauccaccuucuugaguuuuuuauauauauuggauauuaguccccuaucggauuuaggauugguaaagaucuuuuccuaaucuguugguagccuucuuuucuuacugacaguguccuuugccuuacagaagauuugcaauuuuaugaggucccauuugucgcuucuugaucuuacagcacaagccauugcuguucuauucaggaauuuucccccugugcccauaucuucaaagcuuuccccacuuucuccucuauaaguuucacugucucugguuuuauguggcguuccuugauccacuuagacuugagcuuuguggcccaugccuaaacauauuaagguccuuugccuuuugaauggugaaauuucaaguauaugucaccauacccagcuuccaaacuacuuaaauuauagaagcuuuauagaauguucauauauuucaugaaguuaaucucugccauugaucuucaucuuuuuuagggguucauaguuauucucuuguguuuauuuuucuuuugcauuuuaggugcauuucuuucggaauugauucacauaacuauuaugcuauacuguuugaaguauuuauuagaaaaacaucagaaagaggugaguaaccaucuguugggcugugggagauugcucucaauuuuucacuuuucucuguagccauaccuuuugcccuuaauguuuugauuuuggggugauuugcuuuauuaauagcaaaguuauuaaaaaaggaguagaggagauacgguauuuuugagucuacuccuuggauuuguugucuggcuugcccucaaucucuuugcaucauuagaagaagacaugugucacugauauguaccaccaugccuugcuugaagcauauucucuugaauuaaagaguaugucuguggggucaaugcaggcaguaauccacaaagagaugagaaugaaagcuucguucugauugacuucaucaaccuggauuagauuuggggaaucuaauggcagguggcucauuguaagcauauuucaaacacugcaauuuggaaaaagguuuccaggcaacaaucagcccaauccagaugcacaguaaagcuuaaggugugacuauauggaaacucauuugcaaaguauuugugaucaugagagugaguucuauagcuaaaaggccuagaaucuauuguggucucugaccaagauagcauagaggucagcaggguauaaaauucauguggcauccuccuuaaggauagguucuaguaucugggaacuagagaagaagucugggauaaacauucuggggguuagggugaggucagccuccauagauagcaaaagcucacuacaucauuaacaguauccacucccaggcuucugggcaggaaaacagguguuuuaucuucucaguugagaagagcccguauguguuuaacauuccuagucucccuagugaucugugggcauaaagacauuuguaccccuaacaucuugucccuuuuuuuuuuuuuuuuuucgagacaggguuucucuguauagcccuggcuguccuggaacucacuuuguagaccaggcuggccuugaacucagaaauccaccugccucugccucccgagugcugggauuaaaggcgugugccaccaugcucggcucccuucuaauuuuuaaauagaaaaauagccaagauagaggccaugauagaauccauugccuccauggcuggucuaaacaguauagguaaaccuaagagaauuauaagaagaccuaacugagcaugugcccuucuuaccaguuggggcaucuucuggauauaugcccaggacgcugacaccauugcauacacuagcaagauuuuaucgaaaggacccagauguagcugucucuugugagacuaugccggguccuagcaaacacagaaguggaugcucacagucagcuaauggauggaucacagggcucccaguggaggagcuagagaaaguacccaaggagcuaaagggaucugcaacccuauaggcggaacaacauaaugaacuaaccaguaucccggagcucuugacucuagcugcauauguaucaaaagauggccuagucgaccaucacuggaaagagaggcccauuggacaugcaaacuuuauaugccccaguacaggggaacgccagggccaaaaagggggagugggugggucggggaguggggguggguggguaugggggacuuuugguauagcauuggaaauguaaaugagauaaauaccuaauaaaaaauggaaaaaaaaaagaccuaacugagaaucaagaaaagaggaaagacauccucacuucacccaucucuuaauucauuucugcuaauaauuuuguugugaacaaaugaguaaauauggucuauuccacauaaacuuuuaugaacaacccuuagcaugaggagacaguaucauaaacacagguguguuuuuuaucuccccugacaaaaggcauuuggauuauguauugacaagaguuaacaugcaauacaguuaauuaaauauaacagcaucaguguuuccucauccuguugacucaaaguccugauguccucccagguuaucaguauacucucccucuugggacauggccucuugauggguuugucaucugccuuuagauguuuuauuaucugguggccccuugcugucuuagugucuuaguuagaugcaucagaucaggagccaucugggacuucauucauuuugugaaaagacacaagcauaaucuugcuugauguuaacauugggucucuucauugauucguuucuagauuguuuaauguauaauuuagguugucuccuuuagggcaaaaugcuuuggggcaguaaacaaagcauuauccuuuaguaugugaugauuuaagugggugcauagaauauccucuguuuauuagaauuugccaguuuaguauuuaauggugucauuccacaagagcuugacccuguggauacuaaggguuuucaugauuaauauuaaaaaauuuucaaauaauuugcuagcauaaguaggacaauuacuauaauuuaguugcaauggauuuuagaaaggauaugccuaaagggcuauuuguuaaaguuaagguccagaugugauagagugguguuuuuggagcuuucaaggccuuaugccauaccuagggcuguguucugcagccaguuuguuagggagaggcauugugcaugcauguacuguacuuugaggacauaccugauagcagagaauguccaagacacagacagacacccauauucucagaugucaagcugauauccauucacuacuaauuaugcguuagaaguuuggaauacuauauaaaauuugucuuuaagcuguacaaaauaaugcuuuuaauagaggauaggcuccugugagccucuuuuagcuauuuuucuaggcaaauucugaucuuuuaucagacaaacaaacaaacaaacuucacuuaauuaacaguggucauuaacuuuuuuguuguuguuguuguuuuucgagacaggguuucucuauauaucccuugcuguccuggaacucacucuguagaccaggcuggccuugaacucagaaauccgccugccucugccucccaagugcugggaucaaaggcgugcgccaccacgcccagcggucauuaacuuuuaaagauuuaaaguuaaggcuuuuuauuuaagauuuuggaucuuuaaaauuuaggacaauuuuaauuaugagcuucuuuuaagaagucuauuuuauuagguaacuuaaaaguaccugagaaauaauagaaaauccugaaguagaaaacaauuggauuuucccauauaagcaugaaaauuuauauugaguagauauuguauaugaagcaaaauugugaacaauaccaaaaaauaacaguuucauggauggagaaguugcuggaaggcucuaguuuuuacuauauuucauaugcaguuugauauaacagauucucaggcuauaaccaagaauaauuuuaggugaaaaacuucaaaauuauuuaguucuuacugagugcauuuuuugguuuuauuucucuuuggccuccaaggaaauuagagaaacauguaauuauguuugcaguuuuuggucacuaaauuaccuagaagaaauauuuuugaaccauuucuugauuccaauuuacuuguauuuuguuauuuuguaaaucuaucccaauccuguuuacauuguuauuuuuuaaauuugguuuuguuuauguuguauaaaauauaaaaaaauggauucuuaguaaucacaaauauaaaggaaucagggugguuuggguuuuuagugaccaaaacaccuaaauugaggaaaaaaaauucauuuuugucuuguuuuauguuugagacaaggacucuuuauguaguccugacuguuguggaacuugcucuguagauaguuuauuuauauuucaaauguuuucuccuuuccagguuuccccuucacaaacucuccaucccauccccccucccccugucucuaugagggugcucuccuacccacccacccacuccugucuuccugccuuggcauuccccacacuggggcaucaaacacacucaggccugagggccucuccucccacugaugucugacaaggccauccucugccacauaugcauccagagccauggguccuuccauguguauucuuugguuugugguccagucccaggagcucuaggaggucuggccuguugauacuguugcuuccuccuuggggcugcaaacccccucagcuccuucaguccuucuccaacuucuccaucugagacccuccguguuaagucuguugguuggcuuugagcaucgccucuuuauuugucagacucuggcagccucucaggagacagccauaucaggcuuccaucaguaagcucuucccagcauccacaauagcuuccagguuugguagcuguauaugggauggaucugcagguggggcagucccuggauggccuuuccuucagucucugcuccauacuuugucuccauauuuccuccugugaauauuuuguucccccuucuaagaagcacugaagcauucacacuuuggucuuccuucuucuuaggcuucauauggucugugaauugaaucuuggguauuccgaacuuuugggcuaauauccacuuaucagugaguacguaucauguguguucuuuugugacugaguuuccucacucaggaugauauuuucaaguuccauccauuugccugccaauuucauaaagucauuauuuuuaauagcugaguaguacuccauuguguaaauguaccacauuuucuguauccauuccuuuguugagggacaucuggguucuuuccagcuucuggcuauuauaaauauggcugcuaugaccauaguggagcaugugcccuuauuacauguuggaucaucuuuuggguauaggcccagagugguauagcuggguccucagguuguacuguguucaguuuucugaggaaccaccagauugauuuccagagugguuguaccagcuugcaaaugccaccaacaauggaggaguguuccucuuucuccacauccucaccagcaucugcugucaccugaguuuuugaucuuagccauucugacugguaugagguggaaucucaggguuguuuugauuugcauuucccugaugacuaaagauguugaauauuucuuuaggugcaucuuggauauucgauauccaucaguugaaaauucucuguuugcuucauccuuuccucucagcuccaaauauugugucuaacuccauccauggguauuuuguucccaauucuaagaaggagcaagguauccacacuuuggucuuccuuuugaguuucauguguuuugcaaauuguaucuuggguauccuaaguuucugggcuaauauccacuuaucagugaguacauaucauguguguucuuuugugauuggguuaccucacuuaggaugauauccuccagauccauccauuugccuaggaauuccauaaauucauuguuuuuaauagcuccauaaauucauuguuuuuaaccagcaucugcuaucaccugaauuuuugaucuuagccauucugacuggugugagguagaaucucaggguuguuuugacuugcauuucccugaugauuaaggauguugaacauuauuucaguugcuucucagccauuugauauuuaucagucaagaauucuuuguuuagcaccgugccccauuuuuaaaugggguuauuugauuuucuggaguccaucuucuugaguucuuuauauauuuuggauauuaguccccugucugauuuaggauugguaaagauccuuuccuaaucuguugguggccuuuuugucuuauugacagugucuuuugccaccaaacgcagacacuauugcacacgcaagcaagauuuugcugaaaggacccugauauagcugucucucaugaggcuaugccagugccuggcaaacacagaaguggaugcucacagucagcuauuggauggaacacaggguccccaauggaggagcuagagaaaguacccaaggagcugaaggggucugcaacuguauagguggaacuacaauacgaacuaaccaguuaccccagagcucaugucucuagcugcauauguaguagaagaugacuuagucgaccaucauuggcagagaggcccuuuggucucgcaaacuuuauaugucccaguacaggggaacaccagagccaagaagugggaguggguggguaggggagcaggguggggggaggguauaggggaauuucaggauagcauuugaaauguaaaugaagaaaauaccuaauaaaaaauuggaaaaaaagagaauauucucuguuuagcucuguucuccauuuuaaaauaggguuauuugguucucuggaaucuaacuucuugaguuuuuuaaauauauauuggauauuagcccucuaucggauguaggauugguaaagaucuuuccccaaucuguugguugcuguuuuguccuauugacaguguccuuugccuuacagaagcuuugcaauuuuaugaggucccguuugucaauucuugaucuuagagcauaagcuauugauguucucuguucaggaagucuucccuugugcacaugugcgggagguucuucccuacuuucucuucuguuagauucagugucucugguuuuauguggagguucuugauccacuugaacuugagcuuuguacaaggagauaagaauagaucauuuugcauuuuucuacauguuaaacgccaguugaaccagcaccauuuguugaaaaugcugucuuuuuuccacuggaugguuuuagcuccuuugucaaagaucaagugaccaucgguguguggguucauuucugggucuucaauuuuauuccauugaucuaccugccugucacuguaccaguaccauacaguuuuuaucgaaauuacucuguaguacagcuugaggucagggauggugauucccuuagaaguucguuuauuguugagaauaguuuucacuauccuggguuuuuuguuauuccaaaugaauuugagaaaugcucuuucuaacucuauaaagaauugaguuggaauuuugauggggauuccauugaaucuguagauugcuuucaacaggauagccauuuuuacuauauuaauccugccaauccuugagcaugggagaucucuccaucuuuugaggucuucuucaauuucuuucuucagagacuugaaguuccugucauacagaucuuucauauguuugguuagagugacaccaaaauaguucauauuauuugugacuauuguaaaggguguuguuucccuaauuucuuucucaguucguuuaucauuuguguagagaaaggccauugauuuauucgaguucauuuuauauccagccagugcacugaagcuguuuaucagguuuaggaguucucugguggaauuuuuggggucacuuaaguauauuaucauaucaucugcaaauagugauaguuugacuucuuccuuuccaauuuguaucccuuugaccuccuuuuguuaucuaauugcucuggcuagaacuucauuuucuauauugaauagauagggagagggggcagccuugucuagucccugauuuuagugggauugcuucaaguuucucuccauuuaguuugauguuggcuacugguuugcuguagauugcuuuuacuguguuuagguaugggccuugaauuccugaucuuuccaacacuuuuaucaugaauggguguuggaucuugucaaaugcuuuuucugcaucuaacgagaugaucaugugguuuuugucuuugaguuuguauauauaauggauuacguugauggauauccguauauugaaccaucccuacaucccuuggaugaaaccuacuugaucgugaugaacgaucguuuugauuuguuuuugaauuggguuugugagaauuuuguugaguaguuuugcauugauauucauaagggaaauuggucugaaguucuuuuuuuggugggucuuuuugugguuuagaugucagaauuacuguggcuucauagaaugaauuggguaguguucauucuguuucuacuuuguggaauaguuugaagaguuuugguauuaggucuacuuugaaggucugauaauauuccacacuaaacccaucugguccuaggcuuuuuagguuaggagacuuuuaaugacugcuuuuauuucuuuaggggcuaugagacaguuuagaugguuaaucuuauccuuauuuaacuuugguauuucauaucuuucuagaaaauuguccauuucaucuagauuuuccaguuuuguugaguagguuuaaaguaggaucugaugauuuuuuugaauuuccuaaguuucuguuguuauaucucccuuuucauuucugauuuuguuaauuuggauacugucucugugcccucugguuaguguuuaucuaucucaaagaaccagcuccugguuuuguuaauucuuuuuuuuuuuuuuguuuuuuuuuuguuaauucuuuguacaguucuuuuuguuucuacuugguugguuucagcccugaguuugauuauuuccugucaucuacgccucuuggguguauuugcuucuuuuuguucuagagcuuucaggugugcugucaagcugcuaguguaagcucucuccaguuucuuuuggaggcacuuagagccaugcguuuuccucuuagcacugcuuuuauuuugucaaauaaauuuggguauguuuuaccuucauuuucauuaaauucuaaaaagucuuuaauuucuuuguuuauuucuuccuugaccaaguuaucauugaguagaguguuguucagcuuccaugugugugugugcuuucuguugcuuuuguugcuuugaagaccagccuuaauccuuaguggucugauaggaugcaugggaucauuucaauuuucuuauaucuaauuaggucuguuuagugacugauuauauggucaauuuucgagaaggugccaugaggugcugagaagaagauguauucuuuugauuuaguaugaaguguucuauagguauuuguuaaauccauuugggccauaacuucuauuaguuucacugugucucuguuaguuucuauuuccaugaucugccauugaugagagugggguguugaagucuuccacuauuauuaugugcaguucaaugugugcuuugagcuuuaguaaaguuucuuuuauuaacguggaugccauugcauuuagagcauagauguucaaaauugaaaguucuugguagguuuuuuccuuugaggaguaugaaauguccuuccuuauccuuuuugauaacuuuugguugaaagucaauuuuauccgauuuuagaauggcuacuccagcuuguuucuugggaccauuugcuuggaacauuguuuuccagcccuuuacucuaagguaguguuugucucugacacugaggugcauuuccuguauucagcaaaauacuggguccuguuuacauauucagucuguuagccuacaucuuuuuauuggggaauugaguccauugauguuaagagauguuaaggaauagugauucuuguuuccuguuauuuuugauaugauuuuuauguuuguauggcuaucuucuuuuggguuuguugaaaggauauuacuuucuugcuuuuucuaggauguaguuucccuccuuguauuggcauuuuccaucuauuauuuuuuauagggcuggauuuuuggaaagaugguguguaaauuugguuuuguuauggaauaucuugcuuucuccggcuaugauaauugagaguuuugcuggguauaguagucuggguugguauguuuguucuuuuagagucuguauaacaucuguccaggaucaucuaguuuucauagucucuggugagaagucugguguaauucuuauaggucugccuuuauauguuauuggaccuuuuuccucuaacugcuuuuaagauacuuuuuuuguuuuauguauuugguguuuugacuacuaugugaugggaggaauuucuuuucugguccaaucuauuugggguucuauaggcuucuucuauauucauggucaucucuuucuuuagguuaggggacuuuucuucuauaauuuuguugaagauauuuacugguccuuuaaguugggaaucuucacugacuucuauaccuauuauccuuaaguuuggucuucucauuguguccuggauuuccuggauguuuuggguuuaggagcuuuuugcauuuugcauuuucuuuaacuguugugucagugucuucuaugguaccaucuaugccugagauucucucuucuaucucuuguauucuguuggugauacuuggaccuauguuuccugaucucuuuccuaggguuucuaacuccaggguugucucccuuugugauuuuuuuugguuauuguuucuauuuccauuuuuagauccuagaugguuuuguucaguuccuucaccuguuuggguauguuuucaugcaauucuuaagggauuuuuguguuuccucuuuacgagcuucuuccuguuuaccuguguuuuccuccuguauuucuuuaagggaguuauuuauguccuuccuaaagucuucuaucaucaucaugagaugugauuuuaaaucagauucuugcuuuggcucgcuguggugggugaacuggguuuugaugaugcccaguguugugauuauagaaagauauagaaauauauggauauguucugugggguugugguuagguauuggggaagagggugccucugggggcccaugcugagacaucccuucccuuugagggaccagcuacacaacaguauaauauagaauagaguuuauucagggccuggggaggggaguuaagaggguaguagaggcagagaaaggcagagagagggagagaguagagaaguagaggccagcuaugaucaucgcauggagagaagggggaagggaaggagguagggaagagcccaagaaugcaagagagaagcaagugggaagcaggaguaagagagagaggaggggcaagcagccccuuuuuauagugggccagaccuaccuggcuguugucugauaacccuggggagagcauacuugccuguugcgagguaacugugggguggaguuuagacagaaagcuaacaucaaauagccuugauuucuuuugcuuauuuucuuguccuugccucucaccuucugguuaucucugguguuagcuggccuugcugucacugacugcagcuugucccuccugcaaggcuguguguccguacuccugggaggccaguucucuccaggaggaauuugagcauggagagcuguggcacagggucagcucuggggugcagacagaaaccagaaggauccugucucuggcuguuccuugguuccuguguccugauggcagacgcugggugacagcaguuucugguucacugccagcgggccucauggugccuugguggugucugugguggcuguagaugcacagcucggccagaggacuuguggccccuggggccggugugucugggcagaaccguguaugugggccagccucaggcaugcgugucuacgcuacuguagggcgggacuuccuaccaguagcggagucguggcccagaguacacggugggcaggaaaaguaagggcccaauguagccuguggcacuggcagagcaugagugggcugagggagcucagcgagaaggggaggagggcagcagaauccaggccuggccuggaauucucagccaccagaaauaaacugucucugggaccaugcagguggucacucugaccagugggaacggggacuugccagaucugggcuagcgagcgugguuguggcugagaugggaugcaaaccuguagaguuuuuggauccaagucacaccaauguugugaucauaaaaugauaaagagggccgggcgugguggcgaacaccuuuaaucccagcucucgggaggcagaggcaggcagauuucugaguucgaggccagccuggucuacaaagugaguuccaggacagcaagggcuauacagaaaaaccacacacacacacacacacacacacacacacacacacacacacacacacacaaagauaaagagguauuaauguauguucuaaggugguaugaugaggcgugggggaaggggaugccucugcgggcccaugccaaggcaucccuucccccugagggaccagccacaggacgguauagcauagaauagaguuuauuuagggcauggggaggggaguuaagagaguaguagagacagagaaagaggcaagagagaaggagaguguagagaaguagaggccggccaugaccauguggagagagggggggagggaauagggagagaggcaggagcaagggggcaagagguaagaauaugagaguaaacauccauuuuacuacuguauaauuuuuuauucuuuaauaacauuaaaaucacuugcaugcugucuuaguuuucccucuauuauugugauaaacacuuuaagcaaaaagggaggaaaggguuuauuuuagcuuauagguaagcuugucuuucaaaggaaggagcgauuuacuuguguuuuacccagauuucugggaaaggauguaguuuaugaccuggugaucuuuuacucucuguagggccaggcuucacccagcucccccagacuguuauguuuguuuauucccgaugcacccccauauuaagccauagaucccauccuuaugagagaugccagguuuacuuuacaacagccugagggauuucuguguuuuuagggccauggcagucuugaaucccacaggcaucuuuaccucauucucuuucgacccuuuguguuuuccucauucucccuagacccuuuucuugagcauuguuucuaaguaaacaaagccuauuuuuauggaagaagccauauguacuuuuuaaagaauuucaauguaaacaugucuucagcuuuguuguauacacuggaaggacugacuucaucaucaucggggaccuuuuuccaaaauugugcuaugcuuaaauauggauaaaauaaaccaauuggaguaagacuccauaaauuugaaccacugacugcuaacuaaaguuguacugaaccaaugaccaagccagcucagucagucaacagagucucaagggagggagugaggauugaaaauaaaaagauaauuagagcuaaaguggguuuauuuuuucccagucagcuuuuauaccauucuagguacauccaaagaauacagucaguuuucagaucaaagacaaagugaucaagcaaggcagugaacaaagagaucacaccagguaguagucaaauaaggcaauaaacaaagccccccagaaucccuggcucugggggcuuaucaggauuaucaagacaaaagggaagucacacauaucuuggcuggguuuaccuugauccuugcauuagcccaaaugcaguacucuugucugguccuacuuccuccuuugagcccagugacaaguacucgucaaauuucuauuaguggccccccagagcucugcacaaaccaaguuucauucuugccaguccuuggauuguuucacagcuggcugugaugcuuucagggacccccacaagauuugaagucuugaagagguaacagcccacauggaagaugauauuucaguggcuccuguacuguuuauaugaaaacuguagauguaaaacagauuauuauuucaugaauuuaaaaccaccaguuucagccuaaaaacuucugaacuggcagccauuggaggucagaguuuagcaucucaccaccuacagcauagguugaagugcucaagauuuucagguuauuaugaagaugacaauguucaguugauuaggcauaaagauauguaagaaucauuaacuguuucuaaugaauuccaaacugccauagaguagauuacguucauauaguacauaaaauaucagacaguagcuagugaaaacuuaacaauguuagauaccacauccaaggccuuacacugacaguuuguaguuaucuucaccaaaauuaacuggaacaagauacucaacccaagauuggcagagaaauacaaaaugcuuaaaggcugacuauaggcaucuuaaaugcacaagaaaaagggauucaguaugcuguggucauaugauaaauaagugauuuauaaacauaagcaaaagagauauuuugcuaguuaacaaaguuaacagauuucuagcuuauaauauuguuuugauuuuugggggggacugcauucucugccuuguaauuuuuuguuauuucuauuuguaaaucuuuaaaaacuucuguuauauuuaauaucagagagaucuaucuuaaagucauuuuacuguuuagaaaauguucccaguacugaaaucuaauuucuaaaaaaaacuuuauucuauguguaugaguuuugccuacaugcaccacauguaugccuugugcccacugaggccagaaggugucacaucaccuugaacuugaguugcuuguguugugagccuccauguagguguuggaaacugaacccagguccucgacaagaucaguaagugcucuuucugcugaggcauuucuuuugccccaaccuguuuaauauaugcagauaacucuuaaguuccuuuuuccuaccacccuacauauguuucaaaacacuucaauaguuuuuacugcuucaccaacuguugugacacucuagcuaaguagaagucgcguuucuuuuccuuuucauuguuuugaucauuucuagcaucucauaacuaguuuccaaaguuuuaguuuaggauuugguuccauuuugggagacaaaguuuucuggaaauuccaugauagcagaauuccuggggaacuuauuuuuuuuaaaagauuuauuuauuuauuuuauguauaugagaacaccauugcucucuuuagacacaccagaggagggcaucagaccacauuacagauggcugugagccaccaugugguugcucggaauugaacucaggaccucuggaagaacagucagugcucuuaacugcugagccauaucucuccagcccuagggagcuuauuuuuaaauacaaagucuugagccacaaucccuccgugccaaugaauauuuucaucuuuuuuguuuuuucucauugugucuucccugucuaguaccauuguaguuauagauaccugcauuuuuggaagagguuuuccauauuauguuucuguucuuuuuaagauuuauuuacuuauuucauguaugugaguacacuguagcaguuuucagacacaccagaagagggcauuggaucccauuacagaugguugugagccaccaggugguugcugggaauugaacucaggaccucuggaagaacagucagugcucuuaacugcugagccauaucucuccagcccuagggagcuuauuuuuaaauacaaagucuugagccacaaucccuccgugccaaugaauauuuucaucuuuuuuguuuuuuucucauugugucuucccugucuaguaccauuguaguuauagauaccugcauuuuuggaagagguuuuccaaauuauguuucuguucuuuuuaagauuuauuuacuuauuucauguaugugaguacacuguagcaguuuucagacacaccagaagagggcauuggaucccauuacagaugguugugagccaccaggugguugcugggaauugaacucaggaucucuggaaggacaguugguguuuuuaaccucugagccaucccuccagcccuauguuucuguuuaauauugaagaaguggugauguacuauggauaugguauaaaauuugaaaaugcaaauguugaaaaaguaguaggaaucuggcuuuauuaauaaaaugauaauaaucuuuaaucuuuuucacugcaaauuaugaauagagggaaaauuuaucuauuuaacaaauaucaccuauuagaaaggcaaaauaaaaaaaucuuuacagcuaauagaguaauaauugugagaagcucaauguuuucucucuaagacuggaauaaugcaaaacugucuguugcuuaugguuauuauuauacacauuauagguuaaggagccuucaccugaaaaaccuaaaauccacagugaucugaaaucagaagcaacuugaguagcaacauaguacuuucaacaaauaucggaacguuuaccagcugucuuagucaggguuucuauuccugcacaaacaucaugaccaagaagcacuuggggaggaaaggguuuauucagcuuacacuuccacauugucauucaucaucaaaggaagucaggacuggaacucaagcaggucaggaagcaggagcugaugcagaggccauggagggauguucuuuacuggcuugcuucccuggcuugcucagccugcucucuuauagaaccaagacuaccagcccagggauggcaccacccacaagggaaccuccccgauugaucacuaauugagaaaaugccuugcaucuggaucucguggaggcauuuucccaacugaagcuccuuucucugugauaacuccagccugugucaaguugacacaaaaccagccaguacaccagcauaauaaaucaagaaaaggaaaaaaguguagagauuagagaauaaauaaaacuaucuuuuauaggacauaaauauaccaaaaccccacggaaucuaccaaaauauauguaaaaauugacuagauuuagcaaggcaagaacagaaacugcuaaaggaguaucaaguugaaaggucuuguuccccaaauauaguaauacauaaaauaauaaaauggcucagcagauaauagcacuaacuguccuuccagagguccugaguucaauucauagcaacaacguguuggcucaggaucaucuauaaagugaucuaaugccgucuucuugcaggcagguguacauguagacaguuuacucauuucuuuuuuuacuguuuuuguuuucuuuguauguuuuuguugacgauucuguguacauuucuccaguaucuucagaucauauuuggaaaugaaaaagaauauucauagaagucacaaauguuacuucuuauguuguuucuaaauuauuuaccauuucugucuaccuuuuagaagcuguuuguucuugcuguguuaugucacucccuacccuaccuuggugucuuuuugaacucaguuauuucuguuuucuauucucucuuuuuuuugagauuuauuuuuaauuuaugugugaacccacacuaucauguaaaugcugggaacuaaaccuggguccucuggaaguguuuuuacugucuccgucccuuugucuuuuuucuucucucuuucuuuuuuaucuucuaccaccuuuuucuuuguguuuugauuuuucaagacaggguuucucuguauauacagcacuggcuguccuggaacuugcuauguagaucaggcuagccuccagagauaugccugccucugccuccugaguucuggaauuaaaggcaugcaccaccacacccagcugugaacaugaacuuugaagucagauagacugggucuaacuuguaaucacuaauauucuguuucuucauauauaaaaugaaaacacaaaaauuauuaauauguaggugaaagguuuugugcacauuauacaauauauuuaugugcuuuuuguauaauauuauacaggacaauuauuucuuaucuggaguacuugugaucagaaaugauuugaauuuuguguuucuuuuucagauuuggaccacuuucauuuacaugaagaaauaucuuaggggugagauccguaucuauaauugugcuucuuacacauuucacccuacauuaaauuuuaacuugaggauaauuuauauaguauuuuuggcaaccuuauuuugaugaugauucuuaacagucacauguagaauuuugaaucucugugucauggcaguguucaaaaaguuuucaauuuuagugacuuugggacuuugagauuugaguaccugcugcuaugugaucuauuuucauugugccagucuuaggcuaaauccuguauaaacauaaucucauuuucauuuucacaaccacuugagauaucuuugacucauuuaaaagugaaacucaagaaacguuuuuguucaaucacaccuaaauuuuggcagagcuaaaauuuuaauuuguauuaaucuuaauucaaaucucacauacuuucucauauuucucuugucuacuguacaguauccaguagguugaacuguacuuugacacuaccauaaaauguuuaguugcaaauguuguaugauucugacaguuucuuuucagguaucuuugaguaucuucugacacuagaagauccuguaaacucuacagacuucaacagaauugaagaaccuggacagagcagaguuaccaacaagagagcccagggauagcauuaacauggugguuacucaagaccuaacucagccagggagacauaccaaggccuaugaggugaagggaaaagaagggugacccaaagggcaggaauuuuuuauccugaacuuuugagccuuauagaaaaacauaauuuguugggcauguuuucugacccucauacaguuuuuacaaccauuugaagauauaguucuagcucuaguaggcucuacaggaagguauaucaaacuuuuuaacagaacacuuuauuauuuuaaauauaugaguauuucaccugcauaggcgcacaguacccacagagacuagaagaggguggcagaucuccugagacuggaguuaaugcuugugagcugccauguggaugcuggaaaucaaacccagguccuuuggaaggcaggcaggugcucuuaaucauggaagcaucucuucagcuccuacccuaguucuuuaauuuuguuuuaaauuuuugagguaggguuuugcuaaguuacuugggcuggccuuggacuaguaaccauucugugucagccuucugggauuagagguaugugcuagcaugucuagcaucuuucuauuucuuugguuuuccuucuaauuaauuaaaaaauacauuaucuucuaaaucuuuuauuguacaucaugaaugcuauuucaguuuuuguuuaaauaagcuuaaauguaaacaucacuauaaguacaccacuauuucuauugugcaguuucagugauacaauaucuuaucacuuacagaguauuaguaauaguuuaauuuaaaaaaaaucauuuauuguuguuuuuugucucaccccccuccccucccccaaucucuggagcugaggaccaaacccagggccuugugcuugcuaagcaaaugcucuaccgcugagcuaaaucuccaaccccuaguuuaauuuuguuuuagaaagacucuuacuuaauguacuugcugugugugaugguuuguauauucuuggaccagggaguggcaacauuuggagguguggccuuguuggaauaggugugaccugguuggaguaggugugucacuguggguguggguaugagacccucacccuaguugccuggaagucagucuuccacuagcagccuuuggaugaagacauagaacucucagcucuuccugugccaugccugccuggauacugccaugcucccaccgugaugguaauggacugaaccucugaaccuguaagccagccccaauuaaauguuguuuuuuauaagau

SEQ ID NO: 9432 - RNA, 961 nt, Mus musculus
ucggcgcagucggcucuaguggucuccuaacgaagaguuguucccggccgugccguccuccgcuguugucgcugggcugcaccaccgccaggacacgcuggcgagccccucgacgccuccagccccgcggccuccguucaccucgacuuccacacgcccaucaugacgaagacugagaagaaauccuuccaccagagccuggccgaguggaagcuguucaucuacaacccgagcagcggagaguuucuggggcgcaccuccaagagcuggggucugaucuugcucuucuaccuaguuuuuuauggguucuugacugcacucuucacauucacaaugugggccaugcuccagacucugaaugaugaaguucugaaauaucgagaccagauuccuaguccaggacuuacgguuuuucccaaaccacagacugccuuggaauauacauucagcaugucugagccacagacuuacgaaaaguugguugaagaccugaagaguuuccuaaagccauauucuguggaagaacagaagaaccucacaaauuguccugauggagcgccuuuuauucagcgugguccugacuauagggcaugucaguuuccagucuccuugcuugaagaauguaguggugugacugaugcuaauuuuggcuauuuuggccuugcauccuugugaaaaugaacagaauaaucgauuuaaucccagacggauauccacaaauaucguguuugccaaaggaagaaaacgcaacuauagcaacuuauccugaacuuggaguuuuagacuuaaaguauuuuccauauuaugggaaaaaacagcauguuggauaucgacagccccuaguugccguacaggucaaauuugacucuggucuuaacaagaaagaaguaacaauuaagugccauauugcuggaaccaggaaccuaaaaacaaaaaugagcgugacaaguucuugggacga

SEQ ID NO: 9433 - RNA, 3765 nt, Mus musculus
uggucgugcuuuggaguuccuaagucgugccgugcugugagcgagcgcaaagguagugacgcguuuuacggggaguauggcggauacgggcuugcgccgcgugguacccagcgaccuuuauccccuugugcucggcuuucugcgagacaaccaacucucggagguggccaguaaauuugcaaaagcgacaggcgcuacgcagcaagacgccaaugccucuucccucuuggacaucuauagcuucuggcucaaguccaccaaagccccaacggugaaauuacagucaaauagaccagugaccaagaagguuaagaaagagacuucuuccagugacagcagugaggauagcagugaggaagaggacaaagcccaaggacuuuccacacagaaggcugcugcaccugccaagcgagccggugugccucagcgugcugggaaggcagcagccaaagcuucagagagcagcaguagugaagaguccagugaugacgaggaggaagaggacaaaacgaaaaagccuguccagcagaaagcaguuaagccccaagccaaggcagccagaccuccuccgaagaaagcagagagcugugaguccgagucugacucaagcucagaggaugaagcaccacagacucagaagccaaagacagcuguggcagcuaaagcuccgacuaaagccgcagccaaacaagcuacaccagcgaaagcacagccuaaaguagccaaugacaaagcagccagaagccacagccgccgccgcugccacagcagcagcagcagcagcaacagcagugauggcucgcaggaagagaaggcagccgcaccucccaagaaaacugcaccuaaaaagcaagucguggccaaggcaccagugaaaguagcugccgccccuacccagaagaguucuagcagugaagauucguccagugaagagggagaggaacggaaaaaacccaugaagaaaaaagcaggucccuacaguucacuuccaccgccuucuguuccuuuaccaaagaaguccuccucgggaacccaggcuccaaagaaagcugcugcacagacaaggccugcagacagcagugaugagucagauucaaguucugaggaagagaaaaaaccuccagcuaagacgguggucuccaagacaccugccaaaccagcuccggugaagaagaaagcagagagcucuucggacagcucagauucugacaguucugaggaugaagcuccugccaagccagccaguaccaccaagagucccuuaagcaagccagcugucacucccaagccaucugcagcaaaggccguggcaacuccuaagcagccugcaggagguggccagaaagcucagagcaggaaggccaacagcagcuccagugaggaggaggccaccaagaaaagugugacagcccccaaggccaaggugaccgcgaaagcugcaccggccaaacaggcuccucaggcugcuggggacagcagcucugacucagacaguuccagcagugaagaggaagaagagacaccuaagccuccagcuaagaagaagacagccguucccaaaccagccccuggaaagagagcggagagcagcugcagcagcuccucagaagacuccagcgaagaagagaaaaagaagcccaagggcaaggcuacuccuaaaucacaggcaagcaaggccggugucacuccagcuucucagaauagaaaagcaggcaaggaaagugaggaggaggaggaggaggaggaggaagaagaagaagaagaaacagaagagaagaaaaaggcagccuggaccaagccagguucaggcaagaaacggaagcagaaugagacagcgguugaagcagcaacuccucaagcgaagaaaguuaagcuccagauacccaaugcguuuccaaaaaggaagaagggagaaaaaagggcaucuuccccuuucccaagggucagggagaaggagauugaggugggcucucgaguagcagacaauuccuuugaugccaagcgaggugcagcuggagacuggggcgagcgcgccaaucagguucugaaguucaccaaaggcaaguccuuccggcuugaaaaaaugaagaagaagcagcagcagcgaggcagaggcuccaucuccguccaggucaauuccgucaaguuugacagugagugaccuguggucaucuuuggcagaggaagggugguguugggagguuggcacucaccuccaauggauccagaaacucaguguuauuaggagagaauuguggcaaggacaguguggagcagguccugaggcauuccagucugcagucaucucaugucccuacuucuggacagguuuguuuuugagcauugauugucaaggauaaucaaggauuuuauuuauuuauuuuuaaagaaauuuauuugcuugucaauugccuuccuguucugugggucuucauacugagaaaucuguauauuuuauauuaaaucaugucauacagauuuuuguugugauuuuccgagaugaguuccacagauuacaaccuuagcuauugccuaaagcaaagcaaaaugucaggugguaguaaguuucccuacuggagaauucuauuuaugugagugcacagacccacauuugaucccuccucccuucaagugguaccgaugucagucagucuugugauauuugucugcuaagcaugcccugugcucaucuuccucaauugggccugacacagaagcuuccagaagccucguggaucuaccaacuucaggggauacaauugcaguucuugguacaguauccuacuaagugacaggcaggauucuccagugugugagugccaugcaacugucuucguuuuguucucaguagcuauuacugcuacauguuuacaguacuuuuuaguuuuaauuucaaaguaagcuuuucugacauugagaggcauuugcaacaacuugacuguuacuugacuguuggauauuaaguuccugaauguauuugauucuuuuuaaacaucaagagcagaaugguaaauuccugcaugguugugucauggucaaggaaguggaacugacuaaccucugagucuuggugugaaauagguauaguggauacauccugugaacccguggugguggugguggugguggugguaguggugguggugguaaggaggaggaggaggaggaggaggaggaggaggaggaggagaggagggagaaggggagggggaaggggaggggcaggagacagaacagugagguugggaggggucugagcaggacuguuuugucuugaaguugguacauggaaguaauuauguccuguuuaaauugguccacugaaaugauuauuaguaucuuaacuaugaugauacugguauagacgagccagggggcugggaggcauagcugggugacagugugcucccuuggcauucauagaccaagugugaucuccaucacggcaggaagugaaugagcagagaaauuccugggcaaagggaguagaugauaaagccauaggaugugaccacuggcagagcucagauagagugagggaagggguaggggagagcacccuaguuggccggugagaacagacaccagguuucauguaugaaauaugaaggcaccacaugucgccucccuuguuugguuuccauggucaccugguaaccugcuaaaagcugucugucuguggcagguccuugaggaagucugcauggucaaaucucugugucuuaauacaaaaaaauaaaauaaaauaaaugguucaugaaaaaa

SEQ ID NO: 9434 - RNA, 3765 nt, Mus musculus
uuuuuucaugaaccauuuauuuuauuuuauuuuuuuguauuaagacacagagauuugaccaugcagacuuccucaaggaccugccacagacagacagcuuuuagcagguuaccaggugaccauggaaaccaaacaagggaggcgacauguggugccuucauauuucauacaugaaaccuggugucuguucucaccggccaacuagggugcucuccccuaccccuucccucacucuaucugagcucugccaguggucacauccuauggcuuuaucaucuacucccuuugcccaggaauuucucugcucauucacuuccugccgugauggagaucacacuuggucuaugaaugccaagggagcacacugucacccagcuaugccucccagcccccuggcucgucuauaccaguaucaucauaguuaagauacuaauaaucauuucaguggaccaauuuaaacaggacauaauuacuuccauguaccaacuucaagacaaaacaguccugcucagaccccucccaaccucacuguucugucuccugccccuccccuucccccuccccuucucccuccucuccuccuccuccuccuccuccuccuccuccuccuccuccuuaccaccaccaccacuaccaccaccaccaccaccaccaccacggguucacaggauguauccacuauaccuauuucacaccaagacucagagguuagucaguuccacuuccuugaccaugacacaaccaugcaggaauuuaccauucugcucuugauguuuaaaaagaaucaaauacauucaggaacuuaauauccaacagucaaguaacagucaaguuguugcaaaugccucucaaugucagaaaagcuuacuuugaaauuaaaacuaaaaaguacuguaaacauguagcaguaauagcuacugagaacaaaacgaagacaguugcauggcacucacacacuggagaauccugccugucacuuaguaggauacuguaccaagaacugcaauuguauccccugaaguugguagauccacgaggcuucuggaagcuucugugucaggcccaauugaggaagaugagcacagggcaugcuuagcagacaaauaucacaagacugacugacaucgguaccacuugaagggaggagggaucaaaugugggucugugcacucacauaaauagaauucuccaguagggaaacuuacuaccaccugacauuuugcuuugcuuuaggcaauagcuaagguuguaaucuguggaacucaucucggaaaaucacaacaaaaaucuguaugacaugauuuaauauaaaauauacagauuucucaguaugaagacccacagaacaggaaggcaauugacaagcaaauaaauuucuuuaaaaauaaauaaauaaaauccuugauuauccuugacaaucaaugcucaaaaacaaaccuguccagaaguagggacaugagaugacugcagacuggaaugccucaggaccugcuccacacuguccuugccacaauucucuccuaauaacacugaguuucuggauccauuggaggugagugccaaccucccaacaccacccuuccucugccaaagaugaccacaggucacucacugucaaacuugacggaauugaccuggacggagauggagccucugccucgcugcugcugcuucuucuucauuuuuucaagccggaaggacuugccuuuggugaacuucagaaccugauuggcgcgcucgccccagucuccagcugcaccucgcuuggcaucaaaggaauugucugcuacucgagagcccaccucaaucuccuucucccugacccuugggaaaggggaagaugcccuuuuuucucccuucuuccuuuuuggaaacgcauuggguaucuggagcuuaacuuucuucgcuugaggaguugcugcuucaaccgcugucucauucugcuuccguuucuugccugaaccuggcuugguccaggcugccuuuuucuucucuucuguuucuucuucuucuucuuccuccuccuccuccuccuccuccucacuuuccuugccugcuuuucuauucugagaagcuggagugacaccggccuugcuugccugugauuuaggaguagccuugcccuugggcuucuuuuucucuucuucgcuggagucuucugaggagcugcugcagcugcucuccgcucucuuuccaggggcugguuugggaacggcugucuucuucuuagcuggaggcuuaggugucucuucuuccucuucacugcuggaacugucugagucagagcugcuguccccagcagccugaggagccuguuuggccggugcagcuuucgcggucaccuuggccuugggggcugucacacuuuucuugguggccuccuccucacuggagcugcuguuggccuuccugcucugagcuuucuggccaccuccugcaggcugcuuaggaguugccacggccuuugcugcagauggcuugggagugacagcuggcuugcuuaagggacucuuggugguacuggcuggcuuggcaggagcuucauccucagaacugucagaaucugagcuguccgaagagcucucugcuuucuucuucaccggagcugguuuggcaggugucuuggagaccaccgucuuagcuggagguuuuuucucuuccucagaacuugaaucugacucaucacugcugucugcaggccuugucugugcagcagcuuucuuuggagccuggguucccgaggaggacuucuuugguaaaggaacagaaggcgguggaagugaacuguagggaccugcuuuuuucuucauggguuuuuuccguuccucucccucuucacuggacgaaucuucacugcuagaacucuucuggguaggggcggcagcuacuuucacuggugccuuggccacgacuugcuuuuuaggugcaguuuucuugggaggugcggcugccuucucuuccugcgagccaucacugcuguugcugcugcugcugcugcuguggcagcggcggcggcuguggcuucuggcugcuuugucauuggcuacuuuaggcugugcuuucgcugguguagcuuguuuggcugcggcuuuagucggagcuuuagcugccacagcugucuuuggcuucugagucuguggugcuucauccucugagcuugagucagacucggacucacagcucucugcuuucuucggaggaggucuggcugccuuggcuuggggcuuaacugcuuucugcuggacaggcuuuuucguuuuguccucuuccuccucgucaucacuggacucuucacuacugcugcucucugaagcuuuggcugcugccuucccagcacgcugaggcacaccggcucgcuuggcaggugcagcagccuucuguguggaaaguccuugggcuuuguccucuuccucacugcuauccucacugcugucacuggaagaagucucuuucuuaaccuucuuggucacuggucuauuugacuguaauuucaccguuggggcuuugguggacuugagccagaagcuauagauguccaagagggaagaggcauuggcgucuugcugcguagcgccugucgcuuuugcaaauuuacuggccaccuccgagaguugguugucucgcagaaagccgagcacaaggggauaaaggucgcuggguaccacgcggcgcaagcccguauccgccauacuccccguaaaacgcgucacuaccuuugcgcucgcucacagcacggcacgacuuaggaacuccaaagcacgacca

SEQ ID NO: 9435 - RNA, 4623 nt, Mus musculus
uaagucagcuccagaauucuguagguugaaggcuccccaguggacagagcgaauauauaagaaggaaaccagagaucuggugcaguuacaucucagaggcuggcgauggagggagcucggaacugaaagcuuacuucagccugcauuuuaagguaaggcagaacaauuuacacaugcuugacuagggaaggggaacauacagcaguaaaaauguuucugugugugcguguaugaauguuuucuuuuuccuguauuuuaacugcauuuugcagaaugccuuaauucuuuaacugccauuucucuugcaggagugcaugcgggagcugaguaagcugauuuaugauaacugcuuuaaacacuggcaacuaguaagucuguagugggauuuauuuuuuauucuugcauguuaauuuggaaggucauagaaaagaaugggccuuugacagaaaugguaguuugccguuucugaggaaguucucuagugguuacauuuuaaauugaauaugugauuguauguacuuugaaaugaucugguguaauaguuuugcucucuguguguuuaucuuuaguuuucuuuuguuucaaaguaauguugcuaguugaaagaaaacagcagccuucccaccugaacgcuguuguuaaugcuggaaaguaaugacuauucaguucuguuaaauugaaaagauagcaaagaaaaagcaguaaaacuauaucauaauuagucacuaaugucuaauucugauuuaauugagccuccaaacccaucucugucugcccuugacucggguuuaguguuuuuguuuucuuuaucuucuauuuaaacugaaaauagauguuucuuaugaaacagaucagauucaaauauccauauugaaaacuggcauugacuauuaaaauuuuuagguaaaagcuuuaagaaauucaucuauaucuuuuuguuguuguuaaagcaaagggaaaauaaauacauuauuuuuaauuagcaaaacccaacccugacucuauccuaauaugcaccuucugcauauuuuuuccagcucucaguacacuuaccuauuuuucccuauggcuuauguuacuuauauuuuccauagcugcaacaauuuguauauaguuacuucaagaaagcauuucucuaugaagcagcgggcagcagugagauuucuagaaagcacacagauggaaaacuagccuuguuuuuuugagcuaucacauugucuuugggcuccuuauuugucucaugacuccuacccugauuaacuuuuaaacuauuaauuugucucuugacuuuucaaagacaugagagaagaaaaaaacacaaaauguuuuguucagaauuuucagucuaaugcuacugaggaaauguuguuuuucuccucucuagauguauuaguaauuccagccaguaaugccagccaggcaugguguuguuuuguuuucuacaaccacuuagguuauuuuggccucugacagauuuucaagaugcuuaugacucaaauaccccuuaggcuuuggguaugcauuaagccuuuucuuuuuuuuuucccuagaaaagguguaagaauuuggaguugcugcaguucaauaugaaggacaacuucaguuuugcugccaccagcagaaacauuaccagcagccguccuuuugauaaucucaacgcaacuggcaccaaugaguccgccuuuaauugcucacacaaaccaucagauaagcauuuggaagcaauuccuguucucuacuacaugauuuuugugauuggguuugcuguuaauauuguuguggucucacuguuuuguugucaaaagggcccuaaaaagguguccagcauuuacaucuucaaucuggccuuggcugacuuacuccuuuuggcuacccucccucucugggcaaccuauuacucuuauagauaugauuggcuuuuuggaccugugaugugcaaaguguuugguucuuuucugacucugaacauguuugcaagcauuuuuuuuauuaccugcaugagugucgauagguaccaaucggucaucuacccuuuucugucucaaagaaggaaucccuggcaagcaucuuauguaguuccccuuguuugguguauggcuugucuauccucauugccaacauuuuauuuccgggaugucagaaccauugaauacuuaggugugaaugcuuguauuauggcuuucccacccgagaaauaugcucaguggucugcugggauugccuuaaugaaaaauauucuuggcuuuauuauuccuuuaauauucauagcaacguguuacuuuggaaucagaaaacaucugcugaagacuaauagcuaugggaagaacagaauuacccgugaccaaguccugaagauggcagcugcuguuguguuggcauucaucauuugcuggcuucccuuccauguucugaccuucuuggaugcucugaccuggauggguaucauuaauagcugugaaguuauagcagucauugaccuggcacuuccuuuugccauccuccugggauucaccaacagcuguguuaaucccuuccuguauuguuuuguuggaaaccgcuuccaacagaagcuccgcaguguguuuagaguucccauuacuuggcuccaaggcaagagagagacuaugucuugcagaaaaggcaguucucuuagagaaauggacaccuuugugucuuaaaucuguuagugggaugcauguaaucagccuagccauugguuuggaggcccacacaaaugaucuuuaaguggcaucaguauaauacaguucuuugcuuuaucuaaucuuuacuuacucccccgagaacaggaagucaaguagaacuguaaaucuuuauacuccaccagcuuucagugauagugccuucuuuugcugguccuuuggcaugagauugucauaugugagcuagaucuauaaucuagaaguaucugggggaauuaucccaacuuauaauuaacaacaaauuaugaguggugauuugacaucucagacuucucccuggaaaaugcuggcauuucuuaguggaguuuuuuguccauuuucaucagauuucuuuuuucuugaacaaaggccaauuuaaacuucuuauacuauccaaccauaugauauagcaugagaggugagcacuaaguuuagcaugauauacucuucuauauaugccauagguugguaguggcuuauucagucucuagguauagaguuucuccuuuuaaagaaauuguaaguuguguuccuuuuccauuucacucaaguauagcuuuuguacuuauucuacagcuacacacugagcagaucuagaauguagauuaaaucacacaucugucuuagcuuauucuugcaguuauagaaaguacacuauuuaguaaaacagaacugcaaugaaaaguauuuuaguauccacaaaacugaauauacacuuugaaaauuuuucauccauuuugacucuuguuuauucuauucucuucugaugauuuuugaauacaacaacaaaacacuguauuaugacacuacguaaaggucacuuuuuaaauuuuuaaccuuuugaacauggugcuuugauauauucaaugaugacuugaguuuaauuauucaugcuuuuguucugggcuucgucccaaaauaucucuuugacccugaaaaagagagcauucuuuaauucuuuaacuuuguaauaaagugcaaacuggcaugggaaaagguuaugucagacuggaaguuugaugccuucuuggggguaaacagacccagcaaauggcaaguuugguguccaacaaggaacuugucagaacaaagacucccuggggaguaguuugaaucugcauuucugggcacaguuccagaauguauaagagucugugaaggugauuuaaagcaagcccagguccacagaacucauucuuaacacgaguacaucucuuacauuagaggaauauaauaccugaagcuguguuaccuaaaguuuacucaaacuucucaauaaauauuaauucagaaguuaaagaugucauucucugccugucccauauuauaccaggucaccuaagaccuuccuggauugaugcugaccuaugagguagauucaaaguucugggaacuuaacauuucugucagauuccaggcguuuuagguugaagaauccucucauaccccuuccuuggaaaacccugauuucauguauucauguuaauuuuuaguaaaaacaaauagcuaaauauguaaucaguuaugacuuuguguuuuaagcaauuuuacacaaaaucucguaaaaauaaaaucauuacugggagaccaugugugcuucuuauuuuuuaacugucuccagguuuagacugcugccuucucuuagucagucuccuccagcaaauccccauucauaauucucaguuucagccuacaugauuacucauucaggucaauaagaaacaggcauaugaaaagcauaugucggaaaugaauucugauaccuccuggggguucaaaugacaaacucggugucaaccaagcaagcugucaggcacagcagugaaucgugggcuuucgaauguagacuauuucuuguucauguuauuuucucuaccacaaucauaacuauuaaauccuucccacccccugggacuucucuuca

SEQ ID NO: 9436 - RNA, 145814 nt, Mus musculus
cuuaucccccacccccuggugaggucaggcggaggcucugccgcugcggccgcagcagcucagcucccauucccaggcagcuuggaacagggacuuuggcaaauaacuggagcggcguucggguuaggguaagcaaucucccacugccugaagacugggccaaguggcuaggguguccaggggagcaguggugcgggcgcccgugccucgcagcaggaggggacccgggcugcgcugcgcgccucccucuuuggccucugagcgcagcugcucucggaggagcggcugggugcagggaaucggcaaacaaggugaggcaggauccugaagucacgggggcuccacgaucuuccccgccuucugcgcgauuaggaguugggaucugcaccaaaacggcgaggcggggaacccgcuucgcucuuugccuaccgggcuucucuccacgcuuugcacuugcaggucccuuuggcuccaccagaagcuuggguaccucuaggcucuuagucagaacuccguuuuccugugcuucuuugucaucccuccaagaucuucucuggguuucccucucgcuucccugauccugugggguuccucugucaaccucagccucacgaucucuuggccucuaacacuuucuacuuugugcuuccuaauccaucccguuuucagaguccuaacuugagagacuccgcugcuuucuccccagucaagaacacuuuuucuccccuuccuuccgagcuuuuaacuuuaguucugagugucuucggcucugaauuucuggacuuuuuuuuuuuuuuaaaucacaguugaagaaugguuuucuuggagacuuacaggguuuaacccuaucauuuacagaagaaaaagacugaacaauuucuuuauuaaauaccauuuaauaagcaucuguugagggauuuuaagauuucuuucuagguuuuaauagccuagucuaaaagccagucacuuaaaaugcguguauguauggcuguuugcaguauucuuuuucaguccuaacguccuggcaguggaacaggcuggacugaaggaggucuagugggguuugaaaaccuggcuucauuucucuaucuauaaauuaggguguucaucauuuaaacauacuuaaaggaugaccuuagauuuuuggagcaagccacccaacuuaguuucuaggcugguuacuaagcacacugagugggaacugagaggccuugggguuuaaaacuaccucuguuugguaggguaccugccuuuuaaacagaagccacaguuucuuauaguacauuuuagaaccucauaauucuuuagaaaacaaaccaaaccaagcccacuaguuuucgccguuucacuuucuugcccaugcaguugccauguuaguuccugcacugggcuucauucgcucauuuccacgcuguaauuagugugaggaaaauugaauggagaagcugaaaguggcggcagauaccagugaaugagcacaugcugacguaugcagcuguguuuuuagaaauaggcuuuaucuauugcucaaaguugaaagcugagaaaaaugaguuaaaacaguuaugacaucauuuuauaucuaaaaauauuagcuccuuuaaccacaaguccuuauacuuaacagugauagauuuguuugcuuaaugcguggccaggugcugccuuugacacaacaguuccuuaauuggcagcagucugggaagcaauuacauugagaauaaagauggugacuacauuucacucuccugguagcaauuuuaaggucugguaguguggcaaugggaagaguuucugcugcaauauuaaauuauacauuuguaaauagacaagaccuucaaaugcucgguauuuuuaagcugccauuuuuauaagcaaauuuuaaacuguguggugugguucuauagguuuuagucaauguuuugaagaaaguaguuuucauaagaacaguaaagaauaucaauuauuuuaguuagguaacuugccccugauacuuccuuuuccaaugaauuucuagaguucacuuuaguucuaucuuuuuuuuuaaaaaaggaagaugggcagugguggugguggccugcuuuuaauccccaacacucaggagguggacgcaggcagaucuccaggaguucaaggccacccugugcuacagaucgaguuccaggacagcuacagcuacacagagaaacccugccccucaccaaaacccaaaaacaaacaaaaaagauagaugauagggaaaguaguagacccaccauuuuuauuuuggggcaaccuauuuuugagacauguaugcuauuugcuuuccuuuuaagauuauuauuauuaagccugagcuaacauugccacugaucugacuuuauaccaaaaagcuauuuauuuuuugccuggaagauuuaaaaaaaaaaaaaaaguaaguuagccauaagcauuuuucucugcauuuucaacauuugaaaauuauggauuaugugauacacuuagagauuugauaccauacugaauauuucuuuuucauuaaaaaauuauaaauggggcucacacagcccaugcuggccucagauuugguauguagcugauggaggauaaccuugaagacaugauucucugaucuuagugcuugggucacaccacagagccagcucagaaggaugguacuaaaucuuacuucauugucugcucguauuucugcuuucuuuuauguucauuaauuugauuugcaguccugaaaugagauuaacguaaauauucaaauuguuugguuugugauauucaauauauuauuaaaaucuuuucagcaucuuguuuuugguguaauucucuuguuuauuucucuaaaaugauaacaacucgguagaaaucauauuuaaaaaacccauaaaaaccguguaaaaaaaaaaacaacagccuagaguaaacuuuucaaaaguagagaaaaugguuuucucagaguuacagauauuuauaguaaggagguuauuaaguauuaccaaauaaguuaauauuucuuggcauaaaaucuguugaaagccucccaucuuccaaggcucuguauauuauuagccacaguauaaaaccuuguaagucaguauucauauagaguguaaaaagaacaauaaagaaaauacacagaauauagaaaacucgaaaacaccuagcuccacacggguggugcaugguggugaagguuuguuguuaacuucucucuggauuaagaaauauccagagaguccguaaaacauugcuuugggcgugucggugaagaguguucuagaacaguguuugaaucugggaggaauagguagggaaggccugcccucagagugggugguuaccguccaauuggcugcagagaacagauaaaaggcagugaagagcgccacuucaucccuuuugcugccuugagcuuuggaccuaggcuccgcucuuaccaguggcccuuaggcucuuaggcuuuuggccuuccuuaaacugagagcuucacucuugguuucccuaguucugaggccuucagacugggacugagcuccaccgccagcaucuccgacagcuuucagacugccgugggccuucucuguugccgcgacucuguaagucaauuaauucccuucuguaucuccccuuuuagauguacucgaaucuccuauucuguaucuccccuuuuagauggacucgaaucuccuauucuguaucucucucuggaagacuggcaacuauauaacuuauugaaggggugauguuggagcacagccuaaaagaaagagggagaaugcguaucuauacguuuuuuuuuuuuuuuuuuuuuuuuuuaauucugggaacacaccuggccuggccacaugggccuuuaucuauaaucuccacacucuggagacagggcgucggaucgccgcgaguuugaagccagccuagucuaccuaguuccaggcaaccagagcucaaccagagcuacacaguaacuuaaaaaaaaaaaaaagucugggaacacauucuccaucgaacauucaggcauaggguucaugaagaacagaaagcugguggucugagaggucucagaaaguauuagagauaauagauacauaggauuuggaaguccucagaaaggauuugaauuugauggucggaacaaccggaagccauuagggaauuuggaacuuaaaacauguuuuacagagcauaaaauugaauaccuggcucaguuauuuacauuaauaccuaagaaugaaaacuuuaaaaaaguuuguuaaauagcuaagugauucaguucuacucuguuuagauuagggacuggggacauagaaacucuaggguguguucaaagcaguccaagcagcccuagcaguccccuugccucuggcaaauuguccuuugugcugcaagguaaguugucaacaagagagcuuugccagaccugguggcggagccuagaauuucagcccugcggaggcagagacaggcagaugucuguucuaaggcagagagauguugucucaaggcgaaacaaaagcucaaaaaccagaaaccccaccaaccacauuccaaugggccauugugcuauuuuaagaauuuguuuguccaggacugagcuguuaguuucuuagaaauauauuuauuuuggaaggcuggaaauuuuauuuguacacaaaggaauuguuugggcuuuuuaaaauaucauuuggacuuuuaagagauauuuguuauaucguuuuagcuguugcuaaaaaguauuucuuguaaaaugaccucuagcgccuccuguagguucaaguuccagugagcaagcccagauucuucaugacuuggcucucuagauuuuuuuuuaacauuuuuauucuugugauuuauaaagaaaagaaaaggaagccaggaauauguuugguagacgcacuguauggugcagaggggaagggugugccuuugcaggcccauucuaaagcaucccucuccaccccccccacccccccagggacaagccacacgaugcauauaguuauagcauggaguagaguuuagggcaucaggaggggaguugagggguagagauagagaaaaucagaaaaagaggagagggagggagagagagagagagagagagagagagagagagagagagaggagagagagaaaccgccaugaacauguggagagagggggaggggaauggguugagaaaggacagagauggagguagauaagaagguaagagaguaagagagagagaagagggcaaacagcuccuuuauacugaguugccagguaacuguggggcagagccuagaagaaauacuaacauuuauuauucucauauagauuuauuuugguuuccagggggcuuuccaauaugggacuucuauguuuauaauccauuuuuacaauuauuuuucucugucauuucaaaucuuagcacuguucaaggaacacuuuaaauaucagguaaguagcagucaucaacuugcccuauugagucaucauuaaaccuauuugauaccugagcgucucuacacuugcugcugcugcugcuucugugaaagugaccuggaccucaucuguuugcccauugugguaucccaagcaccaagcccaugauuuauucuuucugguuacuuaagaaugaauaaugccuuguaauggaucuccucuuauauuugcauaccauaucauuuaauauugcuuugccuuuuacauaucucucugguauucuaaagcaguggaagggagacuuuauuuaugaagcauaaucuuugagaacauaaacacuguagcuaggcagcuuggguucuaacucuuucuaggacacuuaguagcugggggcccuggagugagggaguaccauaaauacaccuugcuucaucauuaaaauaagggaaacuaaacauaccccuuuugauauuuuaaagcuuaaauaaauuggcuagacucacgauugauuugaauauuucagauuuccaaagcuguaaaaguugauaaaacuuucauuugauaaguuaggugcuaaaaugcaagugguaacaaaauauuacuuuuaaauaguaaggucuuucuucuccuuaguguuagacugcauauuuacuguagaauuaguaauaugcugaggaaauaguacuauagacucuaguggaauauuauauuuuauacagugaucccgguuauuaccuaucugaaaggcuggacauuucugaauugggguucuaucuggcacugagguuuuuagauaagagacuguagaccuugucuccucacaguaaagugcuuaaagcagggcuuugcacauauuaauaguaagcgguugcugugagugguggugauuagggagguaaauaaauuauuucaucuucucagcaccuugcucauaaugguuaccauguaaauuguuaccauauaaauacaugccgaucuacucacgcaacucucaacagagaggacugucucucugccccuuagaccagaagaaagcagauuuagcaggguuacacaauugaaauuagccaaaacccugcucugucaguacugggacuugguacuuugugcucaaucgucuaggaccauguuuauagaguauuuuuguguuucuuuuguuauuuaaauaucccauagauuuuuaaaacaagggagucuuguuugggugaucagaauucaguuaagauguauuuauucucauuauauacucauuuuugcaauuucuaaacauuuuuaaaauucauaauauauauuaagaaccuguacuuaaagcagaagaaagguaccagacaauugaaacauaaucucuagcccagaacuauggcuacauaggaccaugaguguucaauauaauucuugauuuuucucuuuaaucuuuaaauauuaaaaacauacacaaaaagaccuaacugaccuuaguaucuacuaugugaaucuuuauuuaucacaacccucucuuaacuaccuaauaucuuugcagccauuucacucuaacuugacuuaauauggggcucccccuucucugaggaaaagggaaagcuauaaugggggggggauuuguaaggacaguauugagaggagagggaggugauaugauugagauguaaaaugaauaaaaauaaauuauugggaaaaaacucaagugaaaagcagaagagaauuuguuucuuaauagccaaaauaugugcugaucaauaugauagauaauuacuuauaugaaguaucaaauaauuauaaaacauaacuaaugaagacugcauauuuuuauauauauuuuuaauuagguauuuuccucauuuacauuuccaaugcuaucccaaaagucccccauacccuccccucaacuccccuacccacccacucccacuuuuuggcccuggaguuccccuguacuggggcauauaaaauuugcaaguccaaugggccucuauuuccagugauggccgacuaggccaucuuuugauacauauucagcuagagucaagagcucugggguacugguuaguucauauuguuguuccaccuauaggguugcagaucccuuuagcuccuggguacuuucucuagcuucuccauugggggcccugugauccauccaauagcugacugugagcauccaguuauguguuugacugcauauuuuauuaaaguuauauuaaaaaacuaguuuuaaggaucauccuuaucuauauuugacaaucauuaauggcauauuuuauuaauccuuuuacuuuuggugaugcuguuuauaauuuuaugccucagugaauauuuuucuggaauguucuuucaauugaaauccagcccuuaauucaacucauguauaugaaguguaugcaauguaucucaggcuuucuuucuugcuuuaucucucucucucucucucucucucucucucucucucucucucucuuuauuuauucacuuuacaucuuguucacugcccucuccugguuaccuucuccuacaauccuucuaucauccucccaccccuuuuucucugagaaggugaguaucccuucaacccccacccccaaguauccccccaccagacccuggcacuucaucucugaaaggcuaggugcuuccuuucccacuguggccagacaaggcagcccagcuagaagaacauaucucauagacuggaaacagcuuuugggauagcgccugcucuaguuguuugggagcaacaugaagaccaagcugcacaucugcuauacaugugcaggaaggccuagguccagcucuuuguauguucuuugguuggugguucagucucugagagccccaaggguccagguuaguugaaucuguaggucuuccuguggaguuccuaugaccuuaaggcccacauuccuuccuccuauucuuccauagguccucaagcuccaccuacuguuuggcugugggugucuguaucugucugagucagcugcugggaggagccucucagaggacagccauacuaggcuccugucugcaagcauaauagauuaucauuaauagcgucagaaauuucugcuugcacauggaaugggucaguuauugguugggacaguuauugguugucuguccccucagccucugcucuauucccaaucacuacauuucuuguagacacgauaaguuugggguugaaaguuuuguggguggguugggauuccugccuggccacaggagacaaccucuccaggcuccauaucuccaguguugugagucacagcuaaggucacccccauugauucuuaggcuccucccuuaucccaggacucugucuuguccuggagacgccuucuacucucaccccccaucacuugcagauuuccauucauucucauuuccaucuggccaugucuccugucccuccccacaucugauucugaaccacccauuccccuuccuaucuccucucccacccaguuccuucccucucugccucuucugacuguuuuauuccuccuucuaagugagauucaagcauccuugcuuguaccuuccuucauguuuagcuucuuuguaucuguggaguguagcauggguauccuguauuuuaugcuuaauauuaacuuauaagugaguccauaccaugcauguccuuuugggacuggguuaccucacucaggaugauauucucacauuccauucauuugcccacaaauuucauaucuuuguuuuuaauaacugaauaccauucuguuguguagauguaccacauuuucuuuucuuucuuucuuuuucuuucucucucuuuuuuuuuuuuuuuuuuugguuuuuugagacgcgguuucucuguauagcccuggcuguccuggaacucacucuguagaccaggcuggccucaaacucagaaauccccugccucugccucccgagugcuagauuaaagggguaugcuaccacgcccugcuuguaccacauuuucuuuaugcauucuucaguugagggacaucuagguuguuuccaguuucuggcuauuaugucuaaggcugcuaugaacauaguggagcaaguguccuugugauaugguggaguaucuuuuggguacauggccaggaguucuauaacuugagauagaacuauucccaguuuucugagaaacaaucucaggcauuauucuaacucaauaguucucaaccuguggaccacaacccucugggggaucacuuaccagguauccuucauauaagauguuuacauuaugauucauaacaguggccagauuacaguugaaguaucagugaaaauaauuuaauaguugggagucaucacaauaugaggaacuauauuaaagaguagcagcaucucuuaggaagguugagagccacugcagucugaccuaaacacacagaaucuguauucauuguucuuucccauacucuagcguucucagacuagaggacagaacaaacagggcauuggagaagccaaaagagggcuuuggaagauuagaagaggacauugaaucccuuguaacuccaguuacaggugauuaugagcugccacgugugugcugugaauugaaucuugguccucuagaagaguauucugugauuuuuaaccagugagccuucuaucuagccaaguuuauauuucaugaaccacauauuuuuuuauaaagauucaagagaagauuaacuauuuuuuuaaauuuacauacgugaaaauacuuacacaaacucagauaaacauuguaccuugaaauguaauauucacaugacaauuuaagguaaaccccaauauuucauaguaagucucuccagggacaguuugaagugugcgguuacccugcaaagguuaucauggccaaacuagauguguuagaaucuguucuuuuaaguuaaauacucauguaguucauuaaauuuccaucaugaccugucaaaacaucacugauacuuuucucgguugcccaaaaggguuacaugcuguuuucuugauaauggccaaaauguuaacauguuuugaauuccuaacauugguggguaagaacuaagacugacagugagugauuagccaaggaacugauaucuucacaagagagauuauuagaacacagugagcauaaacuuaaacuacacaguugacgggucagagcugugcccuauagugugagcacuugcugauuugaaguuaucuuugcuaaguuuaaauugucuuuuguuuacaacacauuaaguauacaacguauuaauugcugacuacuggcauguuugaagcuagaucaaaguuaagggucgcagaugguuugggaaguaggacagaagugccuguuacagugcaguaguuuaauuuacuacaaaugaaaaagauuuuuaaaaaaugaaaaaaaaaacaaguuuuaaagaagaggguugaaaguaaaugugacaagucagacagcaaaucuuucaacuguuuuucaacauuccuaucccacuuuuaguguuuucucaugucagauacaguuccugggacuugacaucacugugguguuguguuagugcugaaacaguauaaaaaacaugggcauagaggauuauuauuaaagcaaggacuuuguaaucuacaagggaggggcuuuauagucuauuucaguaaaaguggguaagaaacuugugcuuuuuggaucugcuuuagaaaaauauaagcaaacauugcuaaagauuuuagucauuuauuguucuaauccuagguaauacuaagugugaagacaguggaaagugguaauagcugaagagguuaggugcuaaaaucacaggcuuggguucaaaucuugacucuucauguucaaauugugauuugggguaaauuguuucaucucugugaaccuuaauuuuccuuuguagaguaucugacuuacuugaaguauuaaauaagaaaugcagugguggcacacaucuuuaaucccagcacuugggaggcagagacagguggaucucugaguuugaggccagccuggucuacagagcgaguuccagaacagccaggacuacacagagaaacccugucucaaaaauccccaaaacaaaacaaaacagcaacaaaaagcacaaagcacaaagaaaugcucauaaagcacccagcacagcucacaucauacacugcaaagggcuacucuuuuuguuugguuuguuuuucuuuucacaaauagguuuucacucuguaguauauacuggccacaaauucuugauguaguucuugcugcccuugaacuugugcaguccucuugccucugcauccugaauucuuuggcuuuagagauguacuacucuuacacgcguucacgagaccggccaggaagaacacagcaaaccagaaucuucugcggcaaagcuuuauugcuuacaucuucaggagccagagagcaagagagcaagagcacaagagugcaagagcaaaagcaagagcaagagcaagagcucuauugcuuacaucuuuaggagccagagcgcaagagcgcuagaguacaagagccagagcaagagagagaauggcgaaaccccgucccuuuuuaaggagaauuauucuccgccuaggacguauuacucccugauuggcugcagcccaucggccgaguugucaucacggggaaggcagagcacaugggguggagaacuacccuuggcacaugcgcagauuauuuguuuaccacuuagaacacaggaugucagcgccaucuugcaacggcgaaugugagggcggcuccccacauacuaccaugccugguuagcuauucuuagugauagcucuuccaagauuaggggcugaauuaguugaaaauauagccaaacacacaagcacugcccuuuacacauggaacagaaaugugagagauaauugugucuuuuguguuuaugauagccuaauccuaacuaaacaacaauuuuaauauauuuaugacacuuuauuccaguauauguuacuuuuuacuuuuuuauuucuuauaauuaguugucauuacucguuuguguuuuucaguuuuugaaaguuacauuuuuugucuuuuagucuuucauugauauuuuuauuaagcuugcaaaauaauguguuucauuauauuuuucuacaucuauaucauuguauugugauuggauuguguucauauuuaccuucuauugaccuaguuuaucuccucgcccccuucuugcugcucuccuuccucuucccaaauaguccauacuuggauuuuaugauauauuaaaucuaagccucaucugagacagaacaugugacauuuauuuucuuaauucuuugcucuugcucccacuucucuuccuuuguaacacucccucucccuuuacaaucuuguguguguguguguguguguguuccuauauaugagacuaaaugagaaauuuugucugguuuaugguuuauuucucuguaugccuauauaugaaaguauauguaugugagugcuaaagaggucagaagaaugcccaggcucuuggagcuggaguuacgggaaguucugacuuuuccaauuugggugcuaggcguggaacuccagucuuuuugaaaaguagcaaaugcuuuuaaccacuaagcaaucuuucuaguucccguagcuuauuucacuuaagauuaccaucucuaguuccaacuagucucuuauagauggugcaauuucauguguaaauacgcuaccauuucuucauuuuaaaaagauuuauuuuaacugugugugugcauguauguauguguguguguguaugugugugucuauccugcacucuggaguuacagguugcugugagccaccaaauguugauucugagaaaugaacuuggauccucuguaagaguuguaugugcucuuaaccauugugccaucucuccagccuccagugccccccccaccuuuuagauucaauuuuuauuggcauauucauugcauauaguuauucaugauguccuagguuuuuauuuccugcauugcaaaaaucaaaaaaguaauuuuggaaaaauuauuacacccuuagagaaguaguuagcuguuaaaaaaucauaaugccuuuuaucauugaacauguuuucuuucugccaaagauaguuuauugauacugcaagggguccaugagcuaggcaguagaaagaauauuaccugcaacagagcauucuuuaaguauaaaauauuaaauauauaaaguauuaaaguauaauuaucuuugugacacacacacacacacacauauauauauacauauauauauauauuuagauagauagauagagagaguuugaguuacuugcuaugaggaacagcuaggaguugaauauguuucauuucuaacuuagagcuaaugcacuaaucauauaagaagcuguuguagggugguaguggaacacuccuuuaaucacagcacucaggaggcagaggcaaguagaucucugugaguuuaaguucagccuggucuacagugcaaguucuaggacaguuagggacagacagagaaacucuauuucaaaaaaaaaaaaaaaggccagaaaagaauaagaauaaaauaaucagaaucagaauaagaauaagaggaggaagagagagaggaggaggaggaagaagaagcagcagcaacucuuuagcccaaggaucuuuuacuagcuuuagucuuuuaauuaacaaauugaaaauaaaaaaguagcaauagaaauaccagccacuauucuauaucuguacacuuucuuacaaaauuugguauuuauuaaaaugaguuuugcauagacuaagauuuuucuuuuuuuucggacuuuuuuuuuuaauuaauauuuuuauuacagauuuuuccaagugcuuuuuggcaucacacgggugcaguauccauuuaaacauuaaugaacaggcauuugcuuaacaaugacuuauaaagcacuguacuuuaaaauaaaauauacucacuaucuggaaauagcuuacagucuggccagggaccauugagaacauaaaauauuucaguguccaccagugcuuaugauagugcaaaucgcugaauuguucuaauaugcauuaugauccuggcauuauuccaaguacuuccaauguguuuacacauuuaauuuaaaacgugacagugucaugagguuauuggucccauguauagaagaggaagcugaggcauuauaaaguuuagauauauuuuugaaaguaucauagcuaauaaauagaauaguuaugagugaaauccauguugucuaauuuuuauccucauuucuuuucuguuugugaaaaauaacacauaagagaauaugauagauagaaagcauauaaaauauauuuuguaaaaauguugagaaaugaucagaagagagugguagcaagaauguuuuucuauacuuaugaauauuuugcaugcuggugcacuuggaagccagaagagggcaucagauucccuauagacaauuguaagcugccaucuaaguuuugagacuugaaaauggauccuuuggaagagaaguaaagugcuagaauuugcagagacauccuuguagaucugugacaagauauuuuuaagaaguugcuucugaacggggacuuacugaaaaugaggaaaaccacauaaucaacuaggccugauaaugcacacauuuaauccuagcacuagggaggcagaggcacacggaucucuaugaguuugaggcaggccuggucuacauagugaauucuggaauagccaggacuuuguagagagacccugucucaaaacaagcaagcaagcaagcaaacaaacaaacaaacaaacagaauauguaauugauacaccauauacauuuaaucuauuugaaguauaaaauuuggugguuuuaguguauacacugugggguuuugcuuugaaacaagguucucacuauguaguucuguccgcucuggagucacuauguccagcaggcuggccucaaagucacaaagaucuuccugccuccuaaauguuucgccucucccuggugaaaggagauuguccauuuauucugcuaguuugccuauaaaaauaucuggagguuuccuuucaauguaucucagaagcuacaaccccccacccccacacacacacacagucuaguuccaauuugcuguuaaacuacuuuuaauuucauuuggaacacuuauccauuguucaguggauuaugaguuuuuguuuacacggauuguacaauuguauuugucauagaaguuugauauuaguacuaaacaaauguaagucagacuugucuuuaaaaaccaaacugcuaaacccacucgugugaauagcuguuuuuugcgguguggauucuuuauaauaaaccauaacuagaaauagcugagaaauauuauggguacaugcugguguuuuuagaguauuuuuuaauguuaugccuggcauagguuaauuuguucaguuuauugacauaaaauaauccuaugccuaauuuuggcugaagaauuggaguguuggaguccugugucauggaaaaugucuacuguaguggauacuguguuauuguauucagcuacuaugaaaugauugccauuuuaaauuuuuuuggcuacuugcuuuucagccauucagccuuuagaaaaacccuaguuggugcuagaauugaggacugccuuucagucaagcuguaguuacccuuccauuuaucugugugauuaucugaggagaaagucuguucccagcucuucauucaacgaauaagaguguuacuuuucagggagggaauugcuguucaauuuuuuuuaaauugaaaauguaucuccauaaugaggugucaacaaauuuugaguuaauuuuaguugguucccuuugcuuuguuuuguuuuaccuacuuuugauuuuauugacuuugacuuucaaaaugauuuugaaauguuauuauacuugcuuaguuugugcuuacuguuuauguggaguuucuaaggaccacuucacauuaaagucaccagauuuucucaacaggauuugcuguaaaugucaaggguaguuuuuaguuucuuagguggauugucugcuuugcuaugugcagcagaagcacaugugcuugcaguugguggggaaaauagacucaagcaaggugguacugcuuuuucuaggagaaggaaaccauggguacuaugucacuagaucagagguucuuagcuuguggguccccaccccuuuggggguguuguugacugguuuucauaagggucaccuauagaccaucagaaaacacagauauuuaugugacaguucauaacaacagcaaaauuacacuuaugaaguagcaaugaaguaauuucaugguuagaggucaccacacuaugaggaaccauauuaaagggucgcagcauuaggaagggugagaaccacugaucuagauagucuuauugccaaggaacuugauaucacauggggugagggaaucaagguauugaguagauugugagaaaaaagauucuugauuuagaaugguugccauguauauaauguuacuguguuuauuauggagagauuuuauuuauuaagccuuuauaguuucgauuauauggaaauauguuagaaagcuacucauuuaaagcaagcaaaauugaggcuuucugaaugagaaaguaucauacuuacuguuuagcaacaacaauuuagagucaugugaauguugaauucauauggcuuuaaauauuuauugauuaaaaaaaaacccauuacauuauucucacuaaccauugguucaaaauggucugauauuuuugcuuauaguagugcuuaaaaugguuuggaguauuaaauaguugagaaggacucuucauguagcuuaaaucuaucuacuauacuucagauagauuugcuuuaucuucagauaaugacucucuggcuuuaauaagccuucacauguuuuauaggcagcacuuuauuucucuggaagaaaaugaaauauuuuauaugaauuuacuugagauauauuaguuaguucccuggcggagguguugggaugcaguagugacuaauaccaagguccuuguucaucuucugagccaaucacaauuucccucuuuguucuuuuuuuuuucuuucaaacacuguaucuaaaggaaugcagagacggcagagaauccacauuccuuucaaugauauuacuuggugcuugcacacaucacguucacagauaugucacuagcuauuuuagaccuauggugacauauaguuauaagggaagcagaaacaaugcugcccuuuccuaaugguccuguguaaaagcuuuucuuaaugauaagggaagaacauauauuggaggauaaccaguggugucuccuauacaauuuccuaaugcaaacucugaauuauuggucaauuccaugaauuuuuugaagauggcaucucuauaacauuggcuaccuguuuguuuguuuguuucagagauacugcuuuguuguuggguaucuccauugcuuugaggagccugaagcaaggcuagccaggcagcugaaguguguuguagcagagguggcauaacuuauggcagccaggaagcaaaaggagacagaaaggggcaugauauagcccccagcagcauguuagaauagccccuuuccuucaucucuuuuacuuccuagguuuccaucacuucccaauagcccacuagauuaugaacucaucaguggauuagccucgugguaaaaucagaguucucacaauccaguuaauucuuaaaagccaaacaucugaaauguggcuguaucccaaagcaagcauuggaccaugagcauuugagggcucaaacuguaauagacuuaagauuugucuucugcuugucccuuuagcucuuccuucaagccuacuaauauugcaaucuaucugggagccuuacccagccuucuuguacuuccccaaacuggccaugcucucuuagccucaaagauuugcacuugcuucucuucuggaaugcuaacuauuuccugucauuuaaaguucacuuuagaugacaucuuuucugggaagauuuucuugaaucucuucaacuucauaauuccacucucggguaucuuuuacauguuuauauaguaucauuugcuccucucuuuagcaauguuuauuauuguuuuuacuucucucuuguucauacuggcuugugaguucauugacgggaaauaaaaucggguauuuuuauugcuugguaugauaccuggcuuagauuuaaguuuaguacuugcugacugagaaaaugaaugaaugaauguuuuacuuacuagugacaucuguugagucaaagcugacaguuuauuccuuuguccucuugaaauuguaacuaguauuagcugucuaguagcuagaacuagauaauuuuaugcuagguaugguuaaagucagcuauuuuaaaacaaugccauguuauaaaaaguauaagagauauguguauaaaauuuuagaauuaggagcaucucuaggguucccuuaauauagccccuccaauuuuagaagaauguauacugcauggagagagagagagagagagagagagagagagagagagagagagagagaaaauuaaaaucauucuuuacuuucaggaaugugcagugucauagaacagaugauauuuauaaucaugaaaaacacaauuaaaaauuaggugccaagggaauagaaggggcuugaauagaaaagauagauuuaaccaaggaauuaggcugugaaaugacccuagauagguaguuaugauuuugaaaugagagaaucuuccaagugugggaagcguauaccauuagguagguguacagagaauuggagaacauguuuaucugauugguuuagaguuguaagaggaauagcagaaaauuggaaccagaaaguauaggcguuuggcuaagaugcuacuugaggaaaccauguacaguuucuaauuagaugauugauuuaaugaaaauaacuuuuauauuuuagcugacugauacggggucaggguuuaagauaaaugagucaugaaacuggcaugaugccuaauaugccaauuuaaacauuaggggauuauucauggguuuuuguuuuuguuuuuguuguuguugguggugguuuugauuaaagggaaaaacgugauauauaucaccaaguuacaauauaauuaacauaacaaugucagaauuuuuuccuaauggcaaaauaagcccaagaagaaaacuuguacuaucugaaauguacguguauuagucaugaaauacuauagauaauugcguaaacucuaauguuacgccaaucaaguguaaacauuccugaaguaacugagaacaugguggcagcugcugcaucagccugugauaguuaaccucucaucuagaauagacaaauuaacaugaagcaugcacccuuucuaugcauuuggaagccauuuuguuuaagaaugguuuucuagcaagcuaauacacucuauuauaagagcugaguucugcaaguauuacaguuccucugaaccugaaaagcaugaaagagaaccuugaauucugaccuuaugcaaugcagauauauugugaaaggaacaucuauaaauauuauacccaauuuuuauuguuaguagugaguacauuuauuuguaugggguuauguaguucagacuggucuugaacuugcuauauagugaaagaugacuaaacuguugguuuuucuucuuuagccuccgcaauguuagagucaagagugagccauuaugccuugccauaauaauaaagaaaguauauacuucuuuaagggaacaaauacaugcuucuuggagaggagagacuuggauuauuuuagcuuugguuugugaaagucuguaaguuuacagcacauuuuccauuuuuacucuuuuuugaggauuaaagaaaaauuaauacucauuuuuuguaaagaaccuacaugugaacaauuuguaucauuucuuuuucaccuaagaauuaugaagagcauuugaguuaaaugaauguucauuuauauauugauuugagucuaucauauuuuuaaggguuuaauuaauuaauuuauuuauugugcacgcgugugccugaguuugggugugugugcuuagcacaugcaugugcccacagagccagaaaagggagcuggaucaccuggagcaggaguuguaggucacuaagagcugccauggcaguacuggaaaccgaagcgagguucuuuguaagagaagucagugcucuuaaucucuaaaccagugucuggcauauuuuaaaagcuucuuuguggaaaccugugucaaaaauauuaaauaugacacagauaaaucuaugcuaaccuauucuauacuaucuuugaacuucaaugcaacuuagucaacucuguguaugcuuuugaaaguuaaaugcaguuuuaccuuaaaggcguauauuguuucuucuuugauuuuuccuuucaccuacuguaagauguggucaucuuuagcccauaauguacuuuuuacucuugcacaauaacauuauguguguauauaugcacuauauguacauguuuagggggcagugcaugugcacuaaauguacauugcaugugugugcauauguggaagccagaggucaacaucagaugucuucuuucuuuuacauaugaguacauuuucuuuuuaugcauuguauaugguagugauuauaaauauaguguugugcuguaguuuuaguuaagugguccugcuacuugcuauuugaaucaguacauuucauugagucaugauuuacccuucucaaauauagaaaaacauaaaugucucaggaaguagaugaaugucgcauguguuuaagugcagaaccccgaauacaguaaguuucacugaauguuaguuauuauaauuccuccauacaaguaccauuuauccaacuacugaaagaucuuuuuuccuuacaaauaaacuuuuucgguuguuuuauuuaaaauaagcaucuauagaagaaacaaucuaguaagaauuagguaagggaaaaacaaguaauuuagucauuaucaaauaguagucauuaucaaauaugaaugaguaaauuauucauuuucauuucuuuuuuggaagguaauguauuuauuuauuuuccuucaguugaaaauauaauuucucacauaauauauccugauuacaguuuucccucucccuuccccaccugcccucuuauccggaucugccuccuuucugucuuucuuuagaaaaccaacagucuucuaagggggauauaauauaagauaauauaauaugccaagacaaaaaaaaaccagaauuggacaaaacaaaccaauagaagcaaaagagccuaagaaaagcaacaagaaucggagacccaaucauuuauauacucaggaaucugauaaaaaauucacuaaacugaacgaaagucauaauuuaaaagcagaagaccccguacuucagucucuguaaguucauaugagcuuugcucaugcugauuuacagggccuuguuuuccugguguccucccuucccucuggcuguuacacucugucuccuuuuccagagaguucuaugaagggcaggaaaugauggagacaucccuucuagggcugaauuucccaagaugucucauucucuacaaagugucuggccgcagcuuucucuauuucuucugauuugaugcaggcaaagcuucucugaugauggcugaacaaggcagucauccuauuuuucuuucugccucugagaugucucacucaggaugauguuuuuuuuucuucuuguucaaucauauuacauguggauuguacuuaaaaaaaaauaaccuaguaguauuccauuguguagauguaccacauuuucuuuauccauucuucauuugacagauaucuagguuguuucugguuucuggcuauuaugaauaaagcuucuaugaacauaguggaacauguauccaugugggauguuggagcauccuuuggguauaugcccaggaaccguaaagcuaauucuugagguagaacuauuccuaauuuucugagaaacugccaaauugguguccuuuacuguacagaagcuuuucaguuucaugaauucucauuuaguguagaucuuagugccuguguucuguucaggaaguauuauuuuucuugugccaaugaguucaaggcuauuccccucuucuuucagauugucauuuugucuuuccaccuugcugcugggguuucggauuggugccaauauacugcucagggaagccaaaacucagggcccuuaggcugcacuucuuccuugucccugaggugcuggacacccacucagaguggaaaggcaaaaugcugucuaagauaggggguuccagccaguguuuauuugaauaaaaacagccggugacggguuggagacugugguucucaaacuccuguguacucagacgcugcuaggaaccacaaggaguugagaaagguaggucacauucuccuguguacccagaugccucuggggaccuggaggaauugagaaaggugguuuguggcccaugaugagccuggacagggcgguggggaauaaggcuuagcuccaaaugcgugucaagaguacagaggacauuuugugggaaaccuaggugugccugugaaugaagugggccuccaacuugcccccucccccugcauguggucuuuaaugaaggaaacagccccuguuuguccaaacuguuuuguuuaugguagaugaagauguauaugucuuacucaggguaaacuagaaauuaguaccuuuuguaggaaaagaugcccaggaagggaagcucauuggcucauuggcuaaacacuuggagccuauuuagauacuucauuagcauggagaacucuagguucuaugcuacaugaccaguuguuguggcccucuuagugggguguugugguuaaguucuccaggagagaaucugguugggagcuaguucaaacuccugcuuuucucaauuaugagauuugcugagguucugagcuugcuccagccuuaccaguuguucugucuguuggcugauccacugucccauaucagauuuaguguaucuggccugaguuuuguucagugugagagguaaauagaucuauuuagauucuucaacaugcugcuguacaauuuuucccagauucuauuucuagcuucacaaucaaaaaucagguguucauagguauggacguguagcugggucuucaauucgauuucauugaucaauaugucuguuucugugucaauaccaugcuguuuuuaaucacgauagcucaguaguucaauuugaaacuggggauggugaaacauuaagcaguucuuuuccuaugcaggauugagcacaggagaucuuuacaucuuuugauaucuucuucaauuuauuucuucaaugucuuaaagguuuuauuuuauaagucuuuacuugauugguuagaauuacucccagacauuuuuauauuauuuuagccuauugugaaaaauguuguuuccuugauuuauuucucaguccauuugccuuuuguauauaggagggcuccugauuuuugugagucaauuuuguacucagcuacuuugaugaaaguauuaaauuuucaaaaauaauuuauuuuaucagugguaggagauuuccaguggaauuuuaaggucacuuguuuauauucucauaucaucugcaaauaaagauacuuuuacuuauuccuuuccaauuuuuauauccuuaaucuccacuaguuaucuuauugcuuaagauaugacuucaaauauaucagagaguggacaaccuugucuuauuucugauuuuaauggaauuguuuugaguuucucuccauuuaacuggcuguuggcuauaggaauccuguaaacuuccuuuauuauguuuaaguaugccccuucagucccuaaucuugccaggacuuuuaucaugacaggguguuggauuuugucgaagucuccuucugcaucuaaugagaugcucaugggguuuuuguccuuuaguuugcuuauaggguggaugacauuuauuggcuuacuuaugaugaaccaucccugaaugucuggggugaagucuacuugauuauggugggugaucuuugauauggucuuggauuugguuugcaaguauuuuuauugauauuuuuacauuuauauucauaagagaaauuuguguguauguuuucuuuuuauuguuuuuuuuuuugugugguaucaguauaacugugaccuuguauaaugacuugggcaguguuccuucuguuucucuguuguggaauaauuuaaguaugggcauuaacgcuucuuugaaagucugguagaauucugugcugaaaccaucuggcccugggguuuucuugguuggaauauuucuaaugagugguucuacuucacuaaggguuauauuucuguuuaaauugcuuauuugaucuugacuuaacuuugguaggugguauguauagagaaaauuauauauuucuuugacauuuuccaauuugguagaguauagguuuuuaaaguaugucaugauugucuggauuuccuuaguauauauuguuaugcuuccuucuccauucuaauuuuauaaauuuggauauucucucucuggcuuuuaguuaacuugaagaaggaugugcuaaucuuauugauuuuuuuuucaaagaacuaacucuuugcuucauuguuucuuuguauuuuuuucuguguuaucaacucaacccuaaguuugauuauuucuugccaucuacuccuuuuuggauuuuauuucuuccccacaccuuuucuguuguuguucucgaacuuucagguguacuguucaguugcuagcaugagauugaaggauauacaugaccacuucucaaaauauauuacaguaacuuuuguaaggcuagagaugucgccaguugguagacugcugaauuaucaugcacgaacccuaagaggccuguggaugauucuaucacuugacaaguagaggcaggaggaucauaaauucaaguuuauccuugguuaugaaguaaauuagagccuagccugggauaaauuaaauuuaucucauauauauauauauauauauauauauauauauauauauauauauauauauauauauauauauuaaauaucuacuacaaauauggugauuuccuagcuagggagguaaguauaaagcaauuccuauuaauacaaguuagcagggcacaguaguguaaucccaacauucauaaacagaguuaugagaauuucaagucugaagccacccuuggcuaccauacaaguucaagacuggaauacauguaagauugauuuaaaauauaaguaaaugagcagaaaauagaauuaaaggcaauaaaucuuaguuuucuagucauuuuuucuuauuugucuuaauuuuauucaacaaaaaggaaauaaucucugaucagggaggcagggaggcuaacugaugaucuuucaaugcacaaauccaauugcccaguuauugguucuguggguguaugugcuugcauccacauaugugcacacaugcaugcaagcaugcauaguuuuguuuaauuuuacugugauguaguucauauagccauuuccacaaugaaaauguaaaacuagcuaguuacuauaaacguaauuuuaagaacuuaaggaaggaaagaaacugguauuuuuaauccuucuuauuuuucuuuucuucuauguuccaagauucuuuuaucauuuccuuucagacuagaaaacuuccuuuacuacuucuuauaggguagauguguuaaugacagaauguucauucccucauucaaaaauuccuugcuccaccccugccccccauuuauuccugaagggcauuuuaauugguuucagggaucuugcuuggcaguuccuuuuuuaaaaguacuuuaaaaaaaucuccuuuuccauuuccuuauggccuuaacaauuuucugaggauaaucugucacaugaauugcuuuugccacauaaguaagguacuauuucgcaucgguucagcuuugugacuauggauuucuuauuucuuuaaguuuaauauucuccccuugugcacauucaguugccuuucuuuuacuaacuuguaguuaaauucaaccugaaaauguuccauggcaagguugagaaauaaacaauucauguuuuaaaauauagccuguuuugagcagugugcuauucucuccaggauguuaacuauuccugcuuguguuaucauuguuuugauaguaaauuccuuucuuuuuagagauguauuuacuuguuuuuauuucuguguaugugugcaugaggacucauguacuacauaugcucuggugcccacagagagcagaagaggguauucaauccccuaaaaacgugugauauacauaguuuugagcuguucugagggaacucaaaccuagguccuuugcaagagcaaucaauacccauuuugucaauaauuuauuuuuuauuccuguuacauuccgaucacaacccccccucccauccauacaaaucccuccuccaacuaccccuuccuaccuugggauaucaaaucccagcagaacuaagcauauccucucucacuaaacugcugagccauuucccuggccccuaauuaguuccuuuuauuuguucaauuuauaaacuauauuuuaagcauacaaauauguauugcaaaccagcacaguauauauagaguuuauacuaugggacuaaucaguuucagggauccacuggaauguagcucccgaugaaaagggaggggugcucuaaugagcuucccuuuugucuucccuccucuuggaaccuguuggccuggagguuugauguuuuguuaucccuuuccagaaguuucugacauuuuuuuuaacucacugcauuuuuuuguuguuauuguucaaauuugguaauaaauaagguucugugucucccaguucacucauuucuuuuccuguugcugccauugugguacugagccugucuuuucagugaguguuuuuaacuugaugacuguaaguguuuugacuuuaaaucuuuuauguuguuuuacuuuguaucuucuauucuuguucuuuccuuuguaggacaggaaaucacuauguagucuaggcugaguuuaaacuugugcagugcugggauuauaggucuaugucaagagauaaggcuuugucuucuauugcauuacuaaagcauucuguugcuuuaaaaaaauuuuuuuuauuuaauguaugagugcuuugcugcauauacaucugccugccugaagagggcauuagaucccccuauagaugguugugagccaccauaugguugcugggaauugaacucaggaccucuagaagagcauccagugcucuuacccacugagacaucucuccagcccugcuucuuuuuuuaaauaaggcuuuuuugagaagauugcccaucauugcuuauucaagugcuuuuaagauugcucuuuuagaacuuugucaguuugaacaucucugccauuuugaaauucacaauuauugguguguguguguguguguguguguguguguguguguguagcuuaaucuccuaguuagguaaaugauuuugcaugagaaccuagacauuuugcacauuaggccaugugaugcugaaucugacugaguugucuucucuaucauccucugauaucucucugccuccagaaagagauucagucuuugcuaccaaacaggucuggacuuucagguuccucaggggaccucuguugauaaccaaaaugcuacccuccuuacugauaagaugacagugcagugauauuuaucuccuugccugggaggacugagaaaaccuuaucauuucccucaagguggucuggacugccaccauaagaaagguaauaauagcuguguaaagguaauaacugcccuauagggcaguguuggaagagaaacucuuuacuucgcugcaugugccaccaucccaguagccuuguagauauggagucuaggcucccuuauagccagcuauaucacugggcauauacccugggcauauacccagaagacgauccaacauguaauaaggacucaugcuccacuaugcucauagcaaccuuauuuauaauagccagaaguuggaaagaacccagaugucccucaacagaagaauggauacagaaaaugugguacauuuacacaauggagugcuacucagcuauuaaaaacaacggauuuaugaaauucuuaggcaaauggauguaucugcaggauaucauccugagugagguaacccaaucacaaaagaacucacaugauaugcacucacugauaaguggauauuagcccugaaacuuagaauacccaagauacaauuugcaaaacaaaugaaacucaagaagaaggaagaccaaaguguggauacuucaauccuucuuagaagggggaacaaaauacccauggaaggaguuacagagauaaaguguagagcagacacugaaggaaugaccauccagagacugccccaccuggggauccaccccuuaaacaaccaccaaacccagacacuauggcagaugccaacaagugcuugcugagaggagccugauaucgcugucuucugagaggcucugccagugccugacauauacagaaguggaggcuagagaaaguccccaaggagcugaagggguuugcagcccuauaggaggaacaacaauaggaaauaaccaguaccuccagagcucccuggaacuaaaccaccaaccaaagaaaacagauggugggaccuguggcucuagcuucauauguagcagagaaugaccuaguuggucaucagugggaggagaggcccuagguucugugaagguucuaugccccaguguaggggaaugccagggccaggaaucaggagugguuagguuggugagcaggaggagugggaggggauaggggauuuucggagcggaaaccaggaaaggguauaacauuugaaauguaaauaaagaaaauaucuaaaaaaaaaaaaguuauuacuuacaguaacugcaagaaaucccacacuguguaauauuaauguccccacccuuuguccagcauggacacugugcuuuugauuccuuguuccagucugcuuccugcuucuuaauaacuucgccugcuuuguuggcuacuagaaaauaaacaauuguauagcauaucuagauagucuuugaccaauagaugcuaaauuugucuagacuuugcaguugcucucauaaacagcaguguacauaauuucuguguaugggagaggacagucuagagguacaauugcugcagcauacagaugggcaguuggauccacauugaccucuaagaagcuuuucucaauucauacauaucucccuacaaccuaacggaaaagguuauccuuucagucucuggaacuaaugugucucagcucuuguucuuuuguuuacucucucauuuauuuguauauuuccuaugcugcuagaaagacaguuuuuccaugugcuggggaggagggaggggguagguacucuaccacugagcuacucucaaucccauuuucaaacuuuaauuuuguuuuaaauuuuaaggcaguagcuugcuacguuaccagcuggcacugauuuugugauucaccucaauucugccccucauuaucuguguuuauguuuuaucuagcuuagcuuuguacugugauccuguguucuuucucaagcuuaugaagcauccauuuuuagccuugaaaacuuaaguauuuaaggcucuaagcuuucuuuuaaccuuuucuuagauauuagucagauaguuagauauuuuaacuucuaaaauuauauguguguguguguguguguguguguguguaaggucauguguggcuaucagaagacaacuuuuuuauuuucuuucaugaucugguucuuaagagauugaacucagauuaauagguuugcuggcaggugcccuuaccugcucaagcaucuugccagccccacagacuuuucuauauauguuguuuaaauuucuuugaguauaauuucuguuuugauuuguuuggcacagugauuguuauucagaagauuaauauguuuaauauagagacaugaguguuuuaauuuauuauugacuuuuagcaaaauugcuugaucaaaaaauaccacuuucaaggcugaauagauagcccaggcaaaaaacuguaaguaugugggaucugaguuugaucccagguuucaaaaaaaaaaaaaaaaacccucaaggguaguggcacauaauuauacucucaguauuaggugagugggcauggggagauggagaaaugagaugaggcuggaauuccugaggcuucuuggcuagcuagccuaguauaccugguugauaccacuugagggauaacacuucagguuguccucuagucuccaacaugcaucauauguggacauacauccacaauagacacugauguacaugaagacucgcucucugugucucugucucuaucucucucacauaaacacaugcacaugcaugcaugacauacacugaauauacuuuaaaacacacagguuuuuguuuuguuuugauuuuugcauuuuauggaggguuuuuuguuuguuuguuuguuuguuuguuuguauguuuuuugagacaggguuucucuguguagcccugacuguccuggaacucacuuuuguagaccaggcuggccucgaacucagaaauuugccuuuuuaaagccugguccuccugcauguuccuuuuaagugcuugguaguugugugccaucaugcaugguuuguguggugcgggagguggaauccagggauuuauacaugcuaagcaaacauuuuaccaacuaaacuauaucuucuggcccuuaauaaauugaaauuuuuauaauguauagucacagggagagaaaaaugccuauaucuccucuguugcucuuuuuccuccaguaauacccauggaauacagaauuggcuauggaaacaacaggaauguaaauugucuaggaaugugaaucuaucuggaaccagagacacaauauuuaugauucuauuuuccccacauacugcauuuaacaauaaaauagucagcaaagaaugaagaaaauauuucugaaauuaauuuugagaaaucugaaguuagaaaaugacugaugcuuucuaacaaucccaauuugcuccucagauauuuuacccuacguuucuguauauuauuggcuccuaauaauuucuauguuuuccuaacucuauuuuguucucaauguauuggucaagcaggucacucuggguuaaaguguacuuucuuaagacugugaagaaccuugaaaaguuuuuagugguccuuucucaccccuaauauacuuuagacuaaaaaauaaaucugaaaucuuaauaaauauauuuaaaauuucacuuacaaccuuuaugacagaguaaaaauuucucccuuuggcucucauaucccauuuuucuuguuuuuuuuuuuuaauugggguucucauuacacccauugauagaccuugguauuuucagacaacuagaguguucuauguguauaaaucugcauguaaaacuguuccuccuuaggagucuccuuaguauaaaggggcacuaugaccucaguugaaauggugguucuaaugguuuguuugugaaguaaaugccugaacauaaaucugucagcccuuguagguugaggaaaaaaacugguucucaaaggaucccgaaucucuuugaaugcauauuuaugagucuguuuuggcagacuaguguuaacaauugcuagccuuauccaguaaauaaucuccucuuaucacacaaacuucuagaggauuuaaugugacaguucuaggauggugccacuguuuguugugugaccuggguggggcauauuacugauauggaaaaauaacaguuuuuuuuuaagugagucaauggguuuaugaacacggaaagcauguuccauuggugauuguuaaggagcucauuaucaaauuuaaauccauacaguaucaacacacacacacacacacacacacacacacacacacacacacucuauugagaauaguccgcugugugugcccauguguacgggucccuaugacacucacacagggcauugcaucccucagagcuggaguuuuuggaguucagugguuuugacccuccuuguauggaugguagcaagugaaauaggguucuuugaaagagcaccagcccuugaagugauuuuuuucuuuuuuuuuuuaaauuagguauuuucuucauuuacauuuccaaugcuaucccaaaagucccccaugcccgcccccucacuuuccuccccgcucucccacucccacuucuuggcccuggcauuccccuguacuuaggaauauaaaguuugcaagaccaaugggccucucuuuccacugauggccgacuaggucaucuucugauacauaugcagcuagagucacaagguccaggggguacugguuaguucauauuguugguccuguuauuuuuguuguugguguucagauucuguuauuguggcuguucggauucuguucuuguggcugucuucuuuuagguuuguuaaaggauuacuuucuugcuuuuucuaggacuugguuuccaucauuguauuuuuuuuucuguuauuauccuuugaugggcuggauucauggaaagauaaugugugaauuugguuuugucguggaauacuuagguuucuccaucuaugguaauugaaaguuugacuggguauaguaggcugggcuggcguuuguguucucuuacugucuguauaacaucuguccagucucugaugaaaagucugguguaauucugauaggccugccuuuauauguuacaugacccuuuucccuuucugcucuuaauauuuuauuuuuauuuagugcauuucuuguucugauucuuauguguugggaggaauuucuuuucugguccagucuauuuggaguucuauaggcuucuuguauguucaugggcaucucuuucuuuagguuugggaaguuuucuucuauaauuuuguugaagauauuugcuggcccuuuaaguugaaaaucuucauucucaucaacuccuauuauccuuagguuuggucuucucauuguguccugaauuuccuggauguuuugaguuaggaucuuuuugcauuuugaauuuacuuugauugcugugccaauguucucuauggaaucuucugagauucucucuuucaucucuuguauucuguugcugaugcucacaucuauaguuccagauuucuuuccuaggguuucuaucuccagcauugccucacuuuggguuuucuuuauugugucuacuucccuuuuuaggccuaguaugguuuuguucauuuccaucaccuguuuggauguguuuuccuguuuuucuuuauauuuuauauauauuuaauuagguauuuuccucauuugaauuuccaaugcuauaccaaaagucccccauacccuccccccccacucccccauccacccacucccaccuuuuggugcuggcauuccccuguacuggggcauauaaaguuugcaaguccaaugggccucucuuuccacugauggcugacuaggccaucuuuugauacauaugcagcuagagucaaaagcuccgggguacuggugaguucauaauguuguuccaccuauaggguugcagaucccuuuagcuccuuggguacuuucucuagcuccuccauugggggcccugugauucauccaauagcugacugugagcauucacuucuguguuugcuaggcuccggcauagucucacaagagacagaucuaucuggguccuuucagcaaaaucuugcuaguguauguaauggugucagcguaucaugugaguucuuuugugauuggguuaacucacucaggaugaugcccuccagguccauccauuugccuaggaauuucauaaauucauucuuuuuaauaccugaguaguacuccauuguguaaauguaccacauuuucuauauacauuccucuguugagggucaucuggguuuuuuccagcuucuggcuauuauaaauaaggcugcugugaacauaguggaacauguguccuucuuaccgguugggacaucuucuggauauaugcccaggagagguauugugggauccuccaguaguacuauguccaauuuucugaggaaccgccagacugacuuccagagugguuguacaagcuugcaaucccacuaacaguggaggaguguuccucuuucuccacauccucgccugcaucugcugucaccugaauuuuuaaucuuagccguucuggcuggugugagguagaaucuuaggguuuuuuugauuugcauuucccugaugauuaaggauguugaacauuuuuuucaggugcuucucugccauuugguauuccuuaggugagaauuuuuguucaucucugagcccuauuuuuuaaugggguuauuuguuuuucuggaguccagcuucuugaguucuguauauauauuggauauuagucuccuaucugauuuuaggauagguaaagauccuuucccaaucuguugguggucuuuuugucuuauucauggugucuuuugccuugcagaagcuuugcaacuuuaugaggucccauuuauagauucuugaucuuacagcacaagccauugcuguucuauucaggaauuuuuucccuguacccauaucuucgugguuuuucucuacuuucuccucuauaaguuucagugucucugguuuuacguggaguuccuuaauccacuuagauuugaccuuaguacaaggagauaggaauggaucaauucagauucuucuacaugauaaccgccauuugugccagcaccauuuguugaaaaugaugucuuuuuuuccacuuuuccuguuuuucuuuaaggacuucuaccuguuugguuguguuuuccuguuuuacuuuaaggacuuguaacucuuuagcaguguucuccuguauuucuuuaagugagcuauuaaaguccuucuugauguccucuaccauuaucaugagauaugcuuuuaaaucugggucuagcuuuucagguauguuggggugcccaggacugucugaggugggagugccggguucugaugauggugaguggucuugguuucuguuaguaagauucuuucguuugccuuucgccaucugguaaucucuggaguugguuguuauuguugucucugguuagagcuuguuccucucaugauucuguuagccucuaucagcagaccugggagacuuucucucuccugaguuucaguggucagauaacucucugcagguaagcuguucuauugcagggaagguguacagauaucuggcauuccaaccugccuccugucagaagaugaaggcccgaaauagggccugaccagaagcuguuagcuucuguaguccacacucucaccugagcagacuagucuuggagggauccgggaaccaaguuggcucccccaggugcucuggcaaagcucuccuggguggggccaacaccucuccucuggcagggaagaugccuggaugucuggagcucaaaauggggucugucuuagaagcuguccucuagggaccuuggggguguccgccgacucagcgcccaggugaucuggugcuggcacugacaggaagggauuugugacccugguuaggcaggcuuuucugcuucuuuaaugcugucucagguccugcuagagauuggauuggaacagaaguuguguuccacucacuggcgguucuaaaauuguguggagaguccacuagggggccuuggggguguccgcuaacucccuugaagugaguuuuaaacaaaagacugacuugagaauagaauuauagcaauuaaaaaaaaucagagugcaguuugcagaauuaauuaaaaggaaagaagccuugaggcuagggguuuagcagacuaauacaaauuaagaucuaauaaagaaaagagagagggggacagaugaacuugacuggcaaucaaagauuucagaccuugugauggaugagggagugagaaauuagagaggaguaaaggcuugagcucguguguuccuugguaugagaaguguuuuguuucuagugccagagaaugcaggagccugagagggaaaauuaaauuguuuagcuaaugugaguaguuaaaauuugggcaucauacaauuaagaauuugggcauguaccucagcaagagucgcuuggcaugucagaggcccugggaucaguuuuacaguaagacaaaaaaaaaaaauuaauuaguuucaguugugugugcugugugacuuaccuaguaaacaguugaaugguccuggugcuggagcgauggaucagugguuaaagucacuuguugcucucucagaagacccaaguucaguucccagaaguuuucaagguagcucauaacuaucuauaacuacaguuucaggggaucuggugcccucuucuggccacuuuugggcacugcauauuuauggugcacuuuccauacauucaggcaaaacagaagaggaagaaaaaaauguuauaaaacuagcuuugaggguagcuugaugaccuugguugauaaagcaguucaucuagggcauuguuuuguacugacuggauugccagucauuuucaugaggcuucacugcuauaaaacuagcagucauaauagauacucaguugacauuguugcauucauguuucaaugugcuuuuuuuaaacuucccuaagaaaucuaacuucuuauaucuccuuaugccuugccaaaguguuuuuguuuuuguuuaauuauuuuuuauuuuuugccggcuacagcagucugcuagguucuguuuauauguauauuuauugggaaaggcuuauuaaaauaguuaggaguuucuaauuuuguuuuuauuugggcaauauggauuuuagcaucaguaauuaugguaguuuuauaacauuuuuuuccucuucuguuucuucuuucaugguguguugaaauuucacuuuuaguuuagguuacuuguaacugguuuagaaagaagauaccacacauacaaaucacauacacauggacacauaugccacacacaccacacaauuuaagaaaauugauauauaaaauauuaaaaaauauuacaaacuuacuucuuaaugaguuuuaauuuaaauacauuaaaauuuaguuacccauggauagggaaggagaggcauauaggagacucauauuacuaaauuuuuguuuagguagcuacuuaaucuaugucauuuuauuccaccuuuauuuccacccuuuaagaaguauuauuauuauucuagaaacaaggaagagaaauuaaagugcaggaaaaauauccaguaaauauaugacaagacuaagaauuggucucccuuucccaaauuuuuccaauuuuuuauuagauauuuuccucauuuacauuucaaaugcuaucccaaaaguccccuauacucacccuccgcccugcucccuacccacccacucccacuucuuggcccugguguuacucuguacuggggcauauaaaguuuacaagaccaaggggccucucuucccaaugauggccgacuacgcuagcuucugcuacauaugcagcuagagacacgagcucuggggcuacugguuagcucauauuguuguuccaccuauaggauugcagauuccuuuagcuccuuggguacuuucucuagcucuuccauugggagucccguguuccauccaauagcugacugugagcauccacuucuguguuugccaggcauuggcauagccucacaagagacagcuauaucaggguccuuucagcaacaucuugcuggcauaugcaauagugucuguguuugguggcugauuaugggauggauccccgguuggggcagucucuggaugguccauccuuuugucucaucuccaaacuuugucucuuuaacuccuuccauggguauuuuguucccaauucuaaggaaggaugaaauauccacacuuuggucuuccuucuucuugaguuucauguguuuugcaaauuguaucuuggguauucuaaguuucugggcuaauauucacuuaucugugagugcauaucauguguguuuuuuugugauuggguuaccucacucaggaugauauccuccaggugcauccauuugccuaagaauuuuauaaauucauuguuuuuaguagcugaguaguacuccauuguauccauuccucuguugagggacauccggguucuuuccagcuucugacuauuauaaauaaggcugcuaugaacauaguggagcauguguucuucuuaccaguuggaacaucuucuggauauaugcccaggagagauauuccuggauccuccaguaguacuauguccacuuuucugaggaacugcuggacugauucccagagugguuguacaagcuugcaaucccaccaacaauggaggaguauuccucuuuccccauauccucgccaucaucugcugucacuugaauuuuugaucuuagccguucugacuagugugagguggaaucuccacucgaauuuuugaucuuagccauucugauuagugugagguggaaucucaggguuguuuugauuugcauuucccugaugauuaaggauguugaacauuauuucaggugcuucucggccauucaguauuccucaguugagaauucuuuguuuagcucugugccccauuuuuaaugggguuauuuguuuuucuggaguccagcuucuugaguucuuuguagauauugaaaauuaguccccuaucagauuuaggguugguaaaaagccuuucacaaucuguugguggccuuuuugucuuauugacagugucuuuugccuuacagaagaguuacaaauuuaugaugucccauuugucgauucucggucuuauagcacaagccauugcaguuccauucaggaauuuuuccccugugcccauaucuucgaggauuuuccccacuuucuccucuauaaguuucagugucucugguuuuauguggaguuccuugauucacuuagacuuaagcuuuguacaaggagauaaggauggaucaauucgaauucuucuacaggauaacugccaguuaagcuagugccauuuguugaaaaugcugucuuuuuuccacuggaugguuuuagauccuuugucaaagaucaagugaccauagguguguggguucauuucugggucuucaauucuauuccauuggucuaccugucugucacuguaccaguaccaugcaguuuuuaucauaauugcucuguaguacaguuugaggucaggcauggugauuccccuacaaggcugagauuuaaggucauguuugcauauuuaugaauccuuccugccuaaucuacuauuaggaagcauuuugaguauuuuaaaauguuuaauuagucagucgauuaaguaauugaugaugaugaugaugaugaugaugguguguguguguguguguuuauacaaugagccugaagagauguuuucugguaacugaauugaugaaagaacacuguggucuaguaacccccugaaccuccugcccuuccaagcuuaugaauaaaacccucucagaagagcuuauagccuggagggcaucauccugagugagguaacccaaucacaaaggaacucacacaauauguacucacuaauaaguggauauuagcucagaaacuuaggguacccaagacauaagauacaauuugcuaaacgcaugaaacucaagaagaacgaagaccaaaguuuggacacuuugccccuucuuagaauugggaacaaaacacccauggaaggaguuacagagacaaaguuuggaucugugucgaaaggauggaccaucuagaaccugccauauccaggguuccaucccauaaucagcuuccaaaugcugacaccauugcauacacuagcaagauuuugcugaaaggacccagauagagcuuucucuugugagacuaugcuggggccuagcaaacacagaaguggaugcucauagucagcuauuggauggaucacagggcccccaauggaggagcuagagaaaguacccaaggagcuaaagggaucugcaacucuauagggggaacaacaauaugaacuaaccaguaccccggagcuguugacucuagcugcauauguaucaaaagauggccuagucggccaucacuggaaagagaagcccauuggacuuguaaacuuuauaugccccaguacaguggaauuccagggccaaaaagugggaguggguggguaggggagugggugggaggguaugggggacuuuugggauagcauuggaaauguaaaugaggaauauaccuaguaaaaaguauuaaaaaaaaaagaagaagagcuuauaggcaaggaucuacagaagcugcucugcuuguuuucuugucuguguacuugacacuauuguaaaugugugguaacaauuucaccauaucuggaacagaaugagagacuugcaguagcugucuaauguuagucacuaagcaccuggauuuuucaggggucauuaaagugaugaaucaauacuuaaaaauagcugaagcuucugcauuugggaaagagacguuuuuuguccauauauucuaaacauuaaugcuaccuaaauuuaggauugagggaauagaggaaugcugaccuuucuuuuuuuaggcuaaacaaacagaacgaagaaagcaaagacugucuaaacuuuauggagaaguauuuuaagcuuuucauguuuauauacuugaaacuugguauuucuaauuccauauuuuuaaugugaaaauaagguauacuuuagaaauuuuuguugaagaccacuguuuauagugugaauuaguuuucacagcuacaaaaacaaauuuaaguuaucuacuguugauguuauagaagcaaaacuauccuucaauguacauuuuuaucuucauuaauuauagaucaaccuaaauagccuugcccaauaaaaagaguaauuugccugugcauuucagacuuaaucugaaaauauuaaacccaccaccacaugauuuguuauauaaaucauaaaauuacugauuuugugguaaagaauaugagugaaaguccuuacaaaauauuauauugugccuuuaaauuuuuuaaagaguauuuauuuauuuauuuagggcauaggagugggugaaaauguaugcuugccacauugaacacauugaacauauguaggucagaggacagcuugagagagucaguucucaccaccaugugcgcuuuguaaucagucuguucagggaugugucaaguaaguagcgaaugaagaaauauuaguagggcuaaaaaagauaacagccucaccagggcucgaucucccacacugaggacacaggugacuuucucacaugugauaaaaugucccucugucucaugaguuaacuuauuugauuuaaauuaaaauuugauaauuuauuaagaauucucacacaguagauagagccuggggacucuuauggaagaacaggaggaaggauuguggccuauaagggaauaggaacuccacaggaagaccagcagagucaaguauccuggacccuuggcaagcaccuucauccauugagucaucucucugguucuaaaccauuuucuuuauugcaucucuguuuugugucagaccuuagaaagacauuguauccacuaaauuguauucuugauuuucuacuuuuauaauucuacuuacuuguacucacauacuuaaucuguauuuaauauacaugugugaugucaguaggauuugcacugacuauagccauuuuuccaaccacugguuuuguuuuuguuuguuuuuguuuuuguuucuguuucuguuuuuguuuuuuaggaggauggccuuggaugggguuuagacaaagucuugaacucacaauuuggauuaggcagauuuccaacuaaugauuuccuugccuuccuuuaccuuuaccaaguguuggauaaucuuauccucacaaacuuuuuggaaauauucauauuuauucuugaguucaacugucacaaucucaauauagcuaauagauaauuaucuaucugucugucugucugucugucugucugucugucugccugccugccugccugccuauuacauuuuaucaagauacuucucugaucucauacuaguacuauguauuagaguuaauguuauuuuucaaugcauuuuaauggcaaaugggaaagcuuuccccuguuuauuuuuccuaauauauagauucuauaaauagaaccuaauuauagauucaaccuuuaaaauaucaaugcucucuuuauuuauuauuuuucuauuguugugaugaaauaccaugacuaaagcaacuuagagaagaguuuauuugggcuuacggauccagaagguuagggucugugaugguauaguggaggcaggagucaacaagagcuggauguuuagagcaauagcuaagggcuuacaucuuguacugcaaacacaaaguagagaaagggaauaaaaaaugguaugcaaguuuaaguucucaaagccuuucuccaggggcaggagagauggcucagcaguuaagagcacugacugcucuuccagagguccugaguucaauucccaguaaccacauggaagcucacaaccaucugaagugguaucuuaugcccucuucuggugugucugaagacacaauagaauaauacacacacacacacacacacacacacacacacacacacacacacacauaaucucuuuaaaaaaaaacaagccugccuccaauaauacuuccuucaacaaggccacaucuccuuaucuuccccaaacaguuccagcaacuggaaacuuagcauuuagaugccaaaacuacagagacaacuccuuuaacuccccucauucuuuucucuaaggaauuuauugaaauuauauugaggaaaaaauaacuucuauaugaauuuuagccugucugucccuagacaaguugugcuuacauccaauauucauuuucucagguccuuuuuccuuuauguacuuuaguaaaaaugugaaacuauauaccuugaggcuuucuacaugcauacuacaaauuuuguuauuuaugaguaagugaucuuuuuccauggcauuuagaauauggcauugauggaauaaaaccaguccuucucuuuauaggaucaacauuuuuacagugagccucaacucugccagauuuucagauuauccuuuuacacaaugcauaagaaauauuguguuagcuguaaaucauuaggccuuagucuguuauccaugauuguguagcaguagcaucccuugggaccuuguuaaaaaugcagguccucuggacucauuccauccuaaaugaaugagaaacuguauguagcacucuguauuuaacaugucucuaggggcuucuuaugcucaaguuuguagaacacugauacaaagaauauuuccuuuuauuuauauauuuccuuguaagauauuguagcagaauucaguggaaacaaauuacuaauuucuaagaguaagagggaggaagagauuaugggauaugcauacucuuuuucauuuucaguuccuuaauuagaguaaacaggaaggggugauauuuuggugauuagcagaaguuuguuucaaauugagacaugauaggcaaucaaaauuucaaagaguggaagugcaagacauugaguuagcuaugccuggcauuugacacucaauagauguuuguuaaaagaaaauuagccccuuuaauaauagaagaauagccccaauaaccucuugaaaaacagaugauuuucuuaauuggagugcaauauaaucaucaacaaaaaugaucaguuguagaaugacaaaugauuuuauaaacaacaauaaacuccuaggcauuccuauaucaauuaugaguaacaaaacuacagacuauaaaggaaagaguggugcuacuguaacugaauguauauggcauguaauggacagcaagauaguagugacugcguggugauaacaugagcguauugccucagugacuagagaaaauuauuugaauauuuuuaagaagagugugccauccacucugucauuccaccaaagaaaacaagaauuagauggaauuguagaagugucauucaagugggaguuuggaucuagaaauacuuguaguguacuuuucuggacccaagaaguucaaugaaguugacaaugagcuaacaucauugaaacaucccuaaauuuaugauaagaggaaagaguauugggauaugaccucuuccauguugcagguaggguuuagcuaugagcuuauaugaugguuuaucauucugacuuuaaagaaagaaacaaaaacuagagauagaacuuagugcuucauauaugguacacagugauguaccucuggaauacauccccagcccacucucugacauuuuaaaaucuacccuuuguguauacauuauggcuucugguuuuagguuuuuaugggauugcuguguaugugcaugugcaugucucuauauuuauauguguuuccugugcuccuuuuuggcuuuuuucuuugcuuauuuugucguauuuuauuuguuuuuuauuuauauuaacguaucuuauuuuauuuuauuauuaucccuuaagagucuuuugauuucuaaugagagucagugagggaguagaucuggauuggauaagaauugggaggaguagaaggaggagaaauuauaaucagaaugagaaguuuuugcuuuuguuuuuguuuuuccccucuugucuuuuuuucucuuuuguuuuuuuuggagcgauugaagaaguucaagacauggucucauaaugucacucaaacuggccucaaacucauaauccuuuacucucuggguucuaggaucauaggcauguaccaacauuuaggacagcucaagugcaucuguuuauuuacugugcccgucccucucucugaugucuuuaauuuuuuucccuuuuuucuucccugaucuaauugucacugagaguuguucaguuuccaugaauguguaagcuuucuguugguucuguuguuguuaaaguccaccuuuaauccauagugguagauaagauacaggaguuauuucaaucuucuuauaucuguugauacuugcuuugugacugacuauaugaucaguuuucaagaaggucccaugagaugcugagaaguauauuauuuugcguuugagugaaguguucuguagauaucuguuagauccauuuugauucauaacaucuuuuagugucauuauuucucuguuuagugucugucuagaugaccuguucauuggugagagugugguauugaagucucccacuauuaaugugugguguuuaauaugugcuuuaagguuuaguaauguuucuuuuguggaugugggaauacuugcauuugggguauagcuauucagaauugagauguccucuuggagaaguuuuuccuuugaguauaaaguguucuuuccaaucucuuuugauuaauuuugguugaaagucuauuuuguuaaauauuagaauuacuauucuagcuugguucuugggucuguuuccuugaacaaucuguuuccaguccuuuacugugagguaauaucuguuuuguguuucuugcauguaaaagaaugauggauccuuuguuugccucuuucuguuggccugugucuuuuuauuggagaauuaaguucauugacauugagagguguuguagaugggccuggugcuguuuguauuuugaugcuaauucuccucuucugggaggggcuuuggacaaggaguagucaaguacucaggugacuucuugugaaccaaucuccuaaugaauaaaggagccaaccacuggccaaguaggcaggacauagaagagaagaggacuuaguagagaaugaggagaggguuagaggcuuugggaauagggauagcauauagggauagcauaaaagcaagauguaguugcuagagauuccugguaucauugcagauccaccagaauuugccacuggaagaauaagauuuaauauggcggggcuggcgagauggcucagugguuaagagcgcugacugcucuuccaaagauccugaguucaaaucccagcaaccacaugguggcucacaaccauccauaacgaaaucugaugcccucuucuggagugucugacgacagguacaguguauuuacauauaauaaauaaauuuuaaaaauauuaaaaaaaagauuuaauauggcuuacaagauuagguuuuagauguugcacccagugauuguguuaccauuguuucugagcuaaguuuguguguguguguguguguguguguuguguuguguguguguguguguguguguguuuucuucucauggcaauucaacuggguucuagagagaaagguauggcagcaaaucguguguuugccugaugugcaucaaaaaugccaugagggcuuuaaagcauggggcuggugugguagugaccugccaaugggaaccuugugagcuggguagagauuuuggaguucugagucagagucuacaugagacaaaaacaggucggccauugccugccagugcauggccguccagccacauagggcagagaauugccagcaguagcgcaggaagccugccugucaacaagaguuuuguuucuacuggguugcuagguguuauggcagcugacuacagggugaugcguggagcuggcauggcagugauccaccaagagaacuugggagcuccggcccagauagaccaccaaauugagaucaccaagcuggagacauguggcaugcugggccaguagagugggaagccugccagucauuuucuaauauuaacugcaacagagagauauuaaugacuaaugauuguaaauuucuguuauuucgauguuggugcuaguuguaugugugugugcauguaugcgugccggcgugcucgcacacacacacuucccaucuuuugguuuugcugcugugaaauuauuuacaccaagaaggacaauucaugcagaaaauaaaauuauuccucacuauucuguagaguagauucuaaaaucaaggcucuaggaucuucuugacuuaucauccugugggaggugucuuaguuucaauucuguugcugugaagagacaacaggaccaaggcaacuauuaugaaggaaaacauuuaauuggggcuagcuuacaguuucagauguuaugucgauugucauuauggagggaaguauggcagcaugcaggaagacauaguacuggaggagccaagaguucuacaucuugauccacagguagcagaaaaggaagaagcucugauuucacacugaacaguuucaacauaggagaccucaaagcccaccuaaccagugacacacuuccuuccacaaagcuaaaucuacuccaaaaaagcaacaccuccuaauagugccacuucuuauagccaaagauucaaacacaugagucuaugagggccauaucuauucaaaccacuaccgugaugaaaaggagaggggagaguuaaguaagaguuuauuuaaaaggacaccaaagcugaugugcuagcacagcagaaagguacuugcugccaaguugguuguguugaguugaaucaugggugcuacaagguaggagagcaguuacucccacaauuugaccccugccugacuucuuugugcaugccaugcauguacuuccuuugcaacuaaaauuaaaacaacaacaaaaaauaaaauaaaauaaaauaaauaaaacccacaaaaccaaaagaaccaaaccaaaaaagacauacaagugaaacguaucauuuuaugaggaauccacuccaugaaauuaucacuaauaauugugguguccccaugagucaaaccuauaacaaacccaaacaccucccaguacuaccacauguggguuaaaguuuuccaacauaaugcuuucagaggggaauacaccuaaaugacagcaaggaguuugaauaaguuugcaugcuuagcuucauaacuuuaugguuuauaucuauuuauuagugaaaaggggacuguauugcucaucuuauuuaucuauguuucuaguagcaaucugcguacauuugcuuuuuugaugcuuuaucauuauuuccuuuaaaaauaccccauagagccuaagcaaaauucaaaccuuacaacaucucaaaauucucucacuauuugaaacuuuuuuuuccauuuuuauuagguauuuucuucauuugcauuucaaaugcuaucccaaaaguucccuauauccucccccuacccucugcuccccuacccacccccuccuacuucuuggcccugguguuccccuguacagggguauauaaaguuugcaagaccaaggggccucucuucccauugaugaccgacuaggccaucuucugcuacauaugcagcuagagacacgagcucuggggguacugguuaguucauauuguuguuccaccuauaggguugcagaccccuucagcuccuuggguacuuucucuagcuccuccauuggggguuuuaaagaaaggguaaaaccuaagucauuucauuuugagauuacuugcaacaauguaagcagaaaauaugaugugaaaaaaguacaugcuauaugguguuuugauuuguuuccuauuucaaguuuauuagaaacaugucuaagcagaguauauucuuccuuuucuccuguuucuuaaaaaaaaaaaaaaaaaaaaaaaacaacugaagagggcuugggaagagccuaucucccauuuccuauuuaauuauuuugucuguaaaccuucagagcaggcacuuuuacaaaaaauaaaugaauaaacuguaugugacgcaucauacuuauauugugauaaguugacuuuauuaacaaggaacauuaaaauaaaauaugcauuuuggaucccaacauacucaaaauaaagagaauaaauaaauauggaauauauauuccauuuuuaaauugacauuacuguugaaaaauagauuuaagguuagaucaauuuccuaaaguaaacaacuaaaccaaaacaaccaugaaaccaauuccauucauuucaagaaaaacaaaauugcaaccuuguguuuaauauuuaagauuuuaagauguuguaaauuuaugcccuguauuuagugcaacugcuucuaaaagcuuugugggcuucucagacucugaguucccacauuaauaugggaacuagugcuguguuuuguauaacaaauauuugcaguaacccuaugcauuucauuucuuugucuuaccuaacuuucuacagacuccuuaagccuacugauucuguuuuaccuaaauuccucuauauaugguugacugucuauaugcacauguuaucuaacgguuucacaugaauuaucaauaauauuauuagugcuauuuagugauucaccauuguguuuacaauauauuuaauuguaaaaugauucaauaauuuucauaagaugcaucauggacaguagauacauguauuuauaucuuaaaucuuucauaacuuuuaaagacagcacaauuuuuaaaagucuuuguacugaucuuuauaaugaauuuuggcuuuuuuucuuccugaauaggucugcucaacccugagaagugauggauauucuucacagaggagaauugguugcugcaauacuccgcaaccgguauuuauagaaacaauuuacuuuauaaguuauauaaucucuccuauuuuauauacuuaacauagaagguagauacuauucuacaccuagguaaaaauagaaauuauuucuuaaguaaauaagagaagaacugucuaaucagauaaaaauauuagugauacuguguucugagcuagugaaaaaaaaacagagacuauaccaagaaaacaauggauauaaaaugugaagagcuguuauguagucacugaagauuaugauuuaaaaucuuaauuccaguaguauuaucugugaguaaauauaaucauggcuuaagaguaaaagucccaauaagauuuucaaguaguacuuccugugauuauguacauauuucugucauuaaaaauccaguuauaugcuugcgaaggaauuaaugugagccauuuagaggucccugaggcagauuaagaauuuaaauuaaugguuuaaagaaaaauagccuuacuaugguuugcaugguaaguuccagauuagccagaccuguggaagacccccaucucaaaaggccauaaaauaaaauauaacuaaaagaaaaaauagaaauaaauaaccuuguuuaugcagguguggaagaauaucucuccuaguuguuugauugcacaguuugggggaggcaugggaauagcauauuccacagaauucucuauauccugguuauuauucaugguaggaguauaguucuugagaaauguuaacugcucuaaaugucaguuucaucauuuguaaagugggggccauaauacuaauguuacaacugauuguggagaugaaauacauguaauaugguauguguuugcuuguaauguguaugaggauagagaguuagcagguugggcaaauaguaaaugcuguacaagugcuaguauuaucaaaauguuaauuauuaaauuauuuuaauuauuaaaauguagcacaaacaccacacaacauuuccauuaauaauagaagcauauacaucugcuguccuauaauauuauaaugcaaguaaaaagcccuaugaauucauccuaaugacauaggauagcucauuacuuauguuuuguggagauauugguaguaauguauacauuuuucuguuuuguauaaauuucccuuauugcaguuguguguuagauauaauuaguaaugauaauaaauaacuacauuauaugguuguauguccauuauacuauauuuucaauauuauuuaggaauuuauuucuauuuauauauaaaauauuggcuaaaaaauaguacguuguguuacacugacaguaacaucauguggaaagucuuuccuaacaaugucucuuugauuagugacugaccaucuaaguuuguaggaauguauagaugcauugugugcuaugcacacacugguaaaauuaaugaucuauuucacaaggaugcauugucaucauugagucacgauguauuugugauucugaauucugagauauuuuaaaauacaguugaauugagagacaaaaauuggaaagguuaagguagaaagagaacauauacaaagucaugacuauuuuauauauagcauauaaaagguuuugcauaguaaucccaaaguaauuggaauguacacuaucauauuuggaagggugugauacugauccauacaucuguaagauguauuugcuuauuaauaacacugaauuuagcaaaauaauaaaaauaauuugugggcauguuggguaaaaugacagaggacacuccaguccagaaagcagguagguuaacugcagaucuucaccucucuccugucuccuucaaauucaaugccccagucacaucccauucuguagcagaccaucuacugcaaucugcccuacccucaucucuuaucuccagugaaccaaacauauuuucuucacaaaaaaauucccucuacucugggacucuaugaaaaggccaaaucugagaagacuaggaauaauuuuuuuuuaccugaucuugauuuaacuuugguaagugcuaucuauauagaaaauaauucauuucauuuagauauuuuuccaauuuugugaaguacaggauuuugaaguaagaccuaauuuuuuuuuuaauuuccucagggucugcuauuaugucucccuuuucauuucugauuuuguuaaauugaguacugucuuucugucuuuuaguuagcuugucuaucuuguugauuuucacaaagaacuggcucuuaguuuuguugauccucuguauaguucuguuuguaauugauugauuucggcucugaguuugauuauuuccuguagucuacuucccuugcauguguuugcuuccuuccagguguacuuuuaaauuguuaguaugagaacucugcaauuucuuuuugaaggcaccgcuuucucuuggcacuuucauugugucucauaauuuuggauauguugugacuuuauuuucauugaauucuagaaagucuuuguuuucuuucuuuauuucuucuuuaucagaguauucauagauuagggagugguucaauuucuaugaguuuguagacuuuauauuguuucuauuguuuuugaagugcagcuuuaacccauagagguaugauaagauacaaaguguucuuucaaucuucuuguaucuguugaggguugcuuuuugaccaaguauaugauuaauuuaggagaagguuccaugaggugcugagaagaaagaauauucuuuaguguuuuggugaaauauauauauauauuuccauuugaaucauaaccucuguuacuuuaauuaucuuucuguuuaguuuuugucugcaugaccugcaaauuggugauauuuugguggugaauauaauuuagucuguagcaauguuucuuuuacaaaugugggugcacuuguguuugaggccuagauguucagaauugaaacuucaucuuggugaguuuuuccuucaauaaguaugaaguauccucuucaucucuguugauaacuuuugguugaaagucuaguuuauuagauauuaaaauggcuacuccagcuuguuucuugggaccacuugcuugaaaaaccuuucuccagccuuuauucugagguaguaacuaucuuuguugcugagguguguuucuucuaugcagcaaaaugauggauccuguuuacauauuuacuguguuagccugugucuuuuuauuggugaauugguugaaagcuauuaaugaccaaugauuguuaguuccaauguuggugguuuuaguuaguguguauguguguguguuucuuuuauuuugguguugcuaugaaauuguuaauuucuuguguuuucuuggaaguauuuauccucuuuggaguggaguuuuccuucuaguauuuuauguauggguggauuuguggauaaauauuguuugaauuuggauuuuucuugaaauaucuuguuuucucccucuuugaugauugaaaguuuuacugcauauagcugucuagguuggcaucugugguuuuuuagcuuuugucucucuguugagaaguuggguguaauucugaugucugccuuuguaugucaccuaccauuucccccuugcugcuuuuaauguucuuucuuugugauguacauuuuguuuuuguguuuugauuauuaugugacaggaggauuuucuuuucuuauauguucauaugcaucucuuuuuuauguuaggaaagcuuucuucuaugauuugguugaaaauaucaucugggccuuggagcuaggacucuuuaucuucuucuauuauuauuauucuuagguuaaguauuuucauggugucucagauuuucuggauguuuuaugucaggaauuuuucagauuuaacauggucuuugauugauguaugaguuucuucuauuguuucuucuacaccucagauucucucucucuuuuuuuuuuuuuuuuuuuuuuuuuguccuguauucuuuucgugaugcuugcuuuuuuguuccuguuuucuucccagguauucgaucucuaggauaauacaggauuuuucuauguauccuuggcuauccugaaacucacucuguaguccagucuggccucuuccuccagaguguugauauuaaaggcuaaaggcaugcaccacaacugacuggcuuaaacaacucuauuuaaggaacaacaaaaaaggucaucaccaccauuauuuaauaauaccuauacauucugucuaggguuaaaaaaaagugacaaaauauccuauuuuugaaugcuaaauaaucucgaaaaacuagauguauacaaaagaaugaaccugcaaucuuauaccaaucauaaaaauaauccccaaaugaauaaaacacuuaagcauaaaaucugaggcaauacaauuccuagauggaaauguugauaaaacccucuuugauauuggugacauuagcauugauuuugauguaacauuaaaagcuaggcaacugaauaaaaauaugaacuaguucagacuacacaacaaaauuuugugugggagcuagagagaugacucagugguuaaaagcacuuacugaucuugcagaagagccagauuccauuuccaguauccauaugguagcuuacaagcauauguaacuccaguuccagggguucugaggcuuuguucauaucuacaacgacacuaaacauucaugugguacauauacaugcauacaagcaaaauccacauaaaaggaaaauaaauaaguuauuucacaaaaaaauaggacaaagaaaacaaucaacaaaaaauggaaagacagauugacagaaagucuuagaaaaacaaaggauauguuuuagaaaggauguagggauuauuauaaggaagccuauauauuauauuaguagggauauauauauauauauauauauauauauauauauucaugccauuauggaaaagaguauauguagguuuuucaaaaagcaacacagaaguacuucuaugugaaucagauauccuccuguuuagcauaugugaugagaaaaugaaguauacaacuuuuugagagguaucuuuauauccauguuaauuguagcaucauucacaauugccaagagguagaaaacuacuuuuauuauaguaauggacuguuaucuuuaauauaaugaauuuuuucuauguaaaguuacagucgagaagucuccauucucuuuuuaaaggggcauagccauugucaacaacauggauaaaucaggagacauuucacuuagugaaaugacacaguuaccagucuuacugugggaucuaagaaaacaaaaauaaacaaacucagagauguagaaugguaaugauggacagggaguaggaagaaauggggauaaaugagucauagaguacaaauuuauccuuagguaauuuuuagaguuuuggaggugugaaguacagcuuuagcauaauaguugauacugcaguauuugaugaaaauuugacaggaguguagaucuuagaagcuuucaccaaagaugacagauauggacaaugaaggaaauuuucuuaguuaggguuuuauugcugauaagagaagccaugaccaaagcaucucuuuaaaaguaaaacauuuaauuggggcuggguuauaguuucagagauuuaauccauuaucaucaugguggaaaacauggcagcaugcagguggacaugauaaaagagaaggagcugagaauucuacauugugacccacaggcaaccacguggagacugucuucuacagacagccagaagcagauuguguaucacacuggguguagcuugagcauaggagacaucaaagccuaguccuacagugacacacuuucuucaacaaggacacaccuauuccaaaaaggacacaccuccuaagagugccacucccuauggccaagcauugaaacacaugagucuaugggagccguaccucgucaaaacaaccaaagaaauauuaauuuauuuggguauuaauaauuauuucacugugaaugggaccauguauauuaaaacaccaugauauauaccuuaaauguauaccauaaaugauauaaauagaugaugggaagauguauucauauaccuaugaauguuacacaagauuuuaaaauaauccauaaaggacuauaaaaagcacuuugauguaaauaaaaaauaaaauaucaguauuuuuuauuugucuuaguaguggcuacuucaaauuuccaaggaaaaacuuuuuacuaaaauagccaucaagcauaaauauuuggaaaaaucucaaauauaguucucagaaguaaagcagaauacuuauauaacacaccagcaucuaauuauaagacuaaaacugcuagucaaagauagaugucucccuagaucauuguguggauucuaugacauucucuuaaagcuuaagaagaugccugauguugacucucaugugcaguaggggaugcaaaauuugaaccauaucuguggaacuguaagggggcaaaguuaaugauuuaugcugucaagggaaaaauaaagaggauuggaagaagugggagaaggccaaauuaagaagcuuuugaugugugaaggaacugcugcaugugcuguguugcaugcacucuguuuuguuguaugaaugugaacuaaccaaaaccuguaggacuuacugacacuuucaaaaggagagaugauagcugugugaaauauucguggaaggaaggcuggaaauaguuuuugagaccagguaccuauuguagcagucaaagugagauguggaagaacccaaugguugacagugaaaaugaaggaauggccuuguggaauauuuagguuauauuuggaagcauucuguggugaccuggagucaccuacuuagacuuacuuacuuacuuagaccuacuuagaauaauuuugaaauuuagaacaugacugugccaacaagguaguccucuuguuuuggucccaaugcaaccuauuuuucaguacucuggucaaaucccaugcccugugaucagccagaugguccaagagggucucuuggcuucggacucauuuaauacauuuauuuucacauugaagcaauuuuuaccuuguugauaccuauggcguuguucacugaacuguuucagagcaugauuaacuuacuaaauucauuugaugucauuuacacuaugauauugcacaguggauucucaauaaauacacaaauugaaucacugaugacaaaucauucaaugcugguaacuuugguuagaggguauaagggcauuugcaucuauuucuuccagucagccaucuuguuacaauuaaggaacuggauguuggcagucuuuaaaagugagguaaaguaauugaguuuagauucuagaaauggcucagauuuguuuucaguucuuuuucacauauuuuuccuuuguggcucagauauuuuaacugguauaauauguaaucacgucuuucccauucuguuucugugguagaaacuagacuguuuuugcuaauuagaccugcuuccaggaugccugccucgcucaguuugauuaugugaauugccuuacauaaucuauaaauauaauuuuacuuauacauuucucaaaaauuuuagucuauuagugaaauuuauguuuuuauauuaauuuuuuauuuuuucagguuccugacuuuuuguucugauugagcuuaugagcuuaauugccuuauauauaagacuugaauuaauuuuuguaucaucccguuaaggagcaguuauuaguucuucuacuuuaauuuagagcccuguuuuguuauuuuuuuccuauguuuauagaccuuuuucacaaggcuaguauauuguaacaucuuuguaugcuuuucucauuucuucuauuuucauaugagaaguucccuaaugagugaaacaacuacacuaauaauaauuucauaauaauauaggaugucagaugaacacagggcagggcugaagccagaugauguuuuaaaauauucagcacuuauuaguuucaagguguacacuccuauaaaauaugaagguuagaguuauuagccuuucaucuugaguuaaaaucuauaaucauaccuauauaguauauauaauuuugcuauauacauguaauuuuguuauauauauauauauauauauauauauauauauauauauauauauauauauauauaaaaccuauacaguacccacauagugguuacagaguaaaaauauauuuguuuaacuuuauagacaauaaacuuaaaaaaauuauuacuugccaaagaucuggcuuuuuacuuuuucauguuuuauguuuguaaaaugauuugaagauacuugugugcuuuuguuuuuaaggcaaacaagcuuccagaauaugaaugaugaauaauggggauuagacaggguaaaacuuaaaauucugaggccaugugcuuuuuuaugcaguuggcucauuuugcuucagaaaucaugugaauuuugguuaucugcuauuuuugcuauaagauuuuauacuacauccaacauguugucauauuuuccugucacugaaaggcuguauaucuuuauacaaaugacauauagauuuuaguaauguucuauguuuuauaaucuuaaggaauuuuccagaccacacaaaguuuucucuauuccuaagaaggaaaaaauacuauuagauuucucuuuuucuacaugucuuguuauucauaauuuuuauugaauucuacaccuuccucuuauacggucucaucugcagccauccuguuaaucuuugcccauggguugaugacuuccugucucaaaucuuaaaacuuuuucauggaucauaggcuaaagguuuauuauuuucacuuucugucauuugggaagguagacugcauugcauaacacauuuauuguagaaugcauggaaaaaggagagagcauauaugcaagguaacaaccuagccuaagauaauguauguucauucuggucuuuuggugcacuuuugaauguuaccagauuauaaugguagaauggaauagguguacaggagugcuuaccacauuccauucgagcccucuuuuuuuauuuuuuauuuuucuuauacauugcaucccgagggcaguuucucugccuuccauuucucccagucccucucacauucucuccccccucccccaguucauacuagcuguguaaaauauagaagguuccuuuacaucucugauucuguuuuauaucuaaauuaaugucaugcuguguaggauauauacagauauguguguguacacgcauguacacacacacacacguguguguguguguguauuaaaugaaauauaucugaguuaaauuucugucauguagugaauguuaaauaauagaaaugaaacacugcuuuguuauacuguauauuguaccuuuaucucuauccuaguuauaucaugaaaaauuucauaugccaauaaaaacuuguaguacacaaaauagcugcauguuaucaacuauuacaugguauaaauaauuucuuaauacuaauguuuagguugauucuguuuugaaguguuacaaguuuuagcugucauaauuuuuccuuuugauuuuuucccugucauugauuuuguuauguacugugauaccaauagcuauaguuugcacagaauuagcugcucaauaaguauuugccaaauguaaauguauuuggucuuggacacuggcccuaucccugucuuagaauuagccacuagugaauauucaaaugcguaauuagauaaaaguggaaaaaguguuugaaugaauaccaugcuucuuaauuugugacugucucacauaauuuuuauuguggugguauuuuauguaaaauaaaaacucuuaagaguuuuauugauguaaagagacaccaugaucauagcaauucuuauaaaggaaaauauuuaguugagauuggcauacaguacagagguuuagucuauuauuauagcagugagcgugguggcuugcaggcagacaugguauuggaaaaggagcugagauuucuauaucuugauauauagucagcaggggacugugagccacagugggcauagcuucagcauaugagacuucaaagcuuguccccauagugacacacuuugucuaaaaaggccacaccuacuccaacaaggucacaacuucuaauaaugccacacucaaugggccaagcauuuaaacauaugaaucuaugggcauuucuauucaaacuaccacaaugcuuuuuuuuuuuuccuuauuuacuuuauauccuacuuagugccucccaccuggucacccucuuccucauuccuuucccuuaucccccccccccccacacacacacacuucccuucuccucuaugcagguagaugcuuucuugguaucucuccacccuggcacaccaagucucugcaaggcuuggcacaucuuccuccacugaugccagucugcacggaggccuagguccagaccaugugugcucuuugguucuaugagagcuuccagggguucagguuaguugacucuguugguuuuccuguagaguuccuauccccucuugggccugcaauccuuccuucuauucuuccauaaaagcucacaagcuuuauccacuguuuggcugugggucucugcaucuguuucagucagcuguuguauggagccucucagagggcagccgugcuagacuucugucuacaagcauaucacaguauuauuaauaaugucacggauuggugcuugccuaugggaugggucuugaguugugccaguuauuccucuauuucaaauuuauggccucuuuguuguuacacauaugaauauauauguauguaugcaugcauguauguauguauguauguauauaagcauguauaucuguauagguggucuguguauuccacaggauacuuguagaggucaaagggcaaccucuaggagucaguucucuuuuuauacaauguggauuucagugauguauuucagguuauuagauuggcugcagggcucuuuacccacugagccccaguuucuugauuucuacggucuuuuaaagccccucugugcugcuuaacauucuugaaauagcaccccaguuaauauugccaagguuagaggagucauucuccuaguucagcuggcuuuagucccucagggcaaaagcucuuugcuauuugaagagacuugauugaacuaauucacaccaaugugugaauaacugguugcucccucauccuggaagccauaguuaauauaauuucaacaggcuucuuguuagcucacaugaaccuguaauugcuauaauuucuggcagcacuacaaagcaaacagugggguaggaugaaggagguuggagggagagggaguuucacaacaggaggagauauuuugagacugcaaaagccaugcuuaaaaccuuuuuucuuaauuucccuuuuugaccucucccccuuacaguguuccuguguauucucaugcacagauuuacuauaagcagcaaguugugucauuuuuuuuuccuaauagcuagaugguaguucuugauaaggugguauuucugguaguuguagugggaaauugaacuggaucuaaaaagagguucuggaaaauuacaagcaucaaaacucagcuuugguuugugauuugucaaugcauggucccaaccuuuggcuacuauauuucauuguucaggaccuucuuccuuuaacucuuagugucuguauuccuggguagcugacuguuuccuguggcuccuggggcagucuaucuucgggaucagauuccuaacauguugccuuuaugcuuuugauacucucaacuaggccauaaaaucuugugugcuauguuucuguguccucagauuagaguccaauguuaguaaaauucacauuauaagacuacagugaaagccaacaggccuuccagugguugcauaguagagacaguggcugaugaucugucaguuaucauagcugcuggagcuucugcccccauuccuucuacuccauauguuuaucgaguuugcaaacagucuuuuucucuugggaaguucauuuguauuuuauuuuauuuuuguauuguucauugugcuaauacccuugauacuuuuucucuaccggucaguaugaaaggagaggcaaggaaauuuggagagaaauuuuaaagacaaacuuuuaaacccgaauaagucucuaauagggugggguuucauaugucucuaaucaaaauaugucuguuuauauuuugaaaguaagggucaugguugcauuaugucuucccauguuucaguugcauacuuaaccauguuuugguuacugggguguauucacuauauauacugcuggguuucauaaaacaacagauuccuuuggguauaugaugugcuuugacuguauacaccucuauagucucccucccccccccccccgcuucauuccucuuacucaucaucaucaucaucauuaugaugguuacuuuuauuuccugggucucccauuuguuuguauaguuucacucaaggcugcucccuauaucauuugugucccuggguauuagugauaugcaguggcuugcuugguugaacuuacuguuucauauuuuugcuccaucuaguggaacauugauugucaguauuggauuucaaaauguguuauuucaucaccucugguugaaauaagaauuuaauagacgcuaacaauccacagaauagucuauauaauuuuuaauuacuagccuauagaaaugacuagcuuuaggagacacaacuucauuuuaucaauguucacagacgagguggugagaaaccuaugaaacacauuucuuugcucuacauauuagccauuuuaucuuuacuuagaaaauugacaagagcauugcuuuuauucuagcuaaccauuucucuugcucaguacaguucccuaguaauuuacugagucacccccacauccaucuacucuguaguuacuuaccuacugagcugaucauucugcuagucagagucuaucaugcaagcaucgaaaggaaccacuuuuaguauacugcuugcuauuaugucuuuauuucuaucuugugaguuauauuuuaguuugaguaagauaaaacuccuuuaaugaauccuuauuuaaccaauaaaaauuaaauuuagagaggaaaaaacaaaccuaccucugauggcaugguuuucaccaaauuuauccuuuuuauuugguuguuauuuguaagauacuguuagguauuauaaaagcauauaaaauuuuaaccucaguucucagauuauaugaguagcuuggugugcauacauguaugugugccugugugcaugugcgugugcgugugcgugugcguguguguguguguguguguguguguguguguguguagaaagauggggauggaaacaaacagguauaauccaaagagauagaggguauacuauucaguaggcuagaacccagcaucuugucugguaaggaaugugugugaggguuuuguggaagggcuaucuauccaugaacacuuaaguauaacuagauuuuuuuucuuuuaguugacagaguauggaauuccaaguggaagcaucuaugaaacuaauuauacacaauagaguaggauagaauauguaugucaagaaauugcugauugauagaugaaagguaaccccaacuugacuuugagaagauauuucuggcauagguauagauugacuuuuaauauaacuugcagcuucuuuaggcagggcagugcauuuaggacucucuccuccuccuccuccuccuccuccuccuccuccuccuccuccuccuccuccucuuccuccuccucuuccuccucuucuucuucuucuccuucuucucucucucucucucucucucucucucucucucucccacccucccucccucucucuuuccccuuuccaucucucuguuucucugucacugucucugucuuucucugucuuugucuuucucugagugucucugucuuucugucucucugucucucucucucucucccucccucucucucucuuucccucucucuguuucucugucacugucucugucuuucucugucuuugucuuucucucugugucucugucuuucugucucucucucucugucucucucccucucucucucccucucucucugucacugucucugucuuucucuguauuugucuuucucucucuaucucucugucucucucucucuuugugugugugugugugugugugugugcaagccccuaauagacauugaauuugaugucgcaggccuggauucuuguuuccauuuaucucagcagcuguuaccaagcugaaucguuuaacaacuuuguuuucucauuggugaaaugaaugggaacauuaacaccuacagugccuacaugaggaccagguaaacaugaaaauggagaugagguacuucaaaauuaagagguggaauaaaacccuaaaacuucugcugguuggacuuaaacuaagacguaaaacaacuaaauaccuaguaucuguauaggaaaaucaggcugacagguauugacagauggggcuuguguuugggagggguuagauuuuuuguuuuuuuguuuuuguuuguuuuuuuccuuuuuucaaacugacaugauaaaaauguaaacuuaaauccuaaccccuuucaaguucuuucuuuagguuaauaaacuauguauauuucauggucaaauuugaauaaucaauauugguuaaguagugugaauaucugucaaauguauggcuaugcaguuggacgauaugaguguuguuccauccuaguuucuuaaagagauuuauuuacuuauauguaugaguguuuccacugaauguauguguauacccuguguuguguuuuauaaaaagauaagaagagaugguauauguuuugguggagguauagucagaucugggggauuggggugacucugugggcccaugcugaggcaucccuuccccuaguauagaaaagaguuuauuuagggccuugggaggggaguugagaggauaguagaaacagagaaaaggagagagagagagagagagagagagagagagagagagagagagagcaagcacaaagagcagaggaguagagaagaggccugcaugagcacauggagaaauggugggggagggaauggggagagaggggaagggaugagaggacagagugggagcaggaagacaagaacaagagagaggaggguaagaagccccuguuauagucaaucaggcauacuuggcuguugccagaugacuguggggugaaucauaccuggcuguugacaggaaacugugggguggagcuuagacaaaaugcuaacacuguauguauaugguuuaccaguggagggcagaagaaaguguugccccagaccuccugggauugaaguuacugauaggugugagucaucauuuggguucugggaacugaucugguccucuaaaagagcagcaagugcccuuaaccacugagccauuucuacugcccugaaguaugucugagaaauuucugauuuguuucauuaggauugggauguuaggugucuguuugguuuuuauuugcuauaaagagacgacgugaucauggcaucuauuaugaaggaaaacauuuaauuuggggcugguuuacaguuugagagguuuaguccauuaucaucaugggguaaagcauggagguauacaggaagacaugcuauaguaggagaugagaguucuacaucuugaucugcaagcagcaggagaaggugccauugggaauagcucaagcauaagagacuucaaaggcugcucccacagugguguacuuucuccagcaaggccacaccuauuccaauaaggccacaucuuauagcagugucacucccuaugagccaagcauucaaacccaugagccugugugggccauaccuguucaaaccaccacauuaugaaacccuggaugcugccuccuucccauuuuguccuaauccuuuaacugcacaggcagccauuauuaguaucagcaaaaagcauucuuagacacucucuuuccucugcccucaucucugcaauuguauugaguggcaauaguaugaaauucugguaauacaccuggaauaugaacuucugaucucuagaaauacgaaugauuacuuugaauauaaauauccuggcuaagccuuuuuauaccagugguuuucuaaauaugucauccauagauuuaagaaggacugaaaacucuacaagugaccaaacucaacuauguucugagcuaacuuaaauauuaucagcagauggaauguugucaugaauguaguaagaugaugguguuuuaaauggaguguaaguuaauuauauuagaugaauacaugcuugucacagucccaaauauaugauacugauuaauagacuuguucuggucauucuuguacugaccccucucugccauucccucuauaaccuugaacuaaucuaacuucgugaauuugaaugaaauaaauacccauucuaaugaaagcauaauguaaauggauugcuuucuuuccuuucaagccuaaagagagcucuguaguaguuacuuuguuuucuacaaaacuaaacaugugaauggccuggauuauuuugucuuuucaauucaugaggucauuaaaauacaguuuuaaaaguuccucugaagacaagugaaaugauuuuuauguccccuaccuaccagcccuuccugaagauuacuugagaagaugugguacauuuccaacguucaugcucccuuuuuuccucuggauuauauauuuuuuucauacacauuaguugaaagguaacuggugggguuuugcucucaauaaaaugaaggguauguagacagcuuuugucuuggauaucuuaagucagagagcauacacuugcaagcauuaccuacuuuuugaaauuauuagcugccuccccuuacuucacuggaacaaaaaaauauauauauaauaugauaaaaaaauuuuuuucucauuguugacacaaaugaaaauauuguaguuuaugcauuguugaauaaaugguaagauauuuugcauccauaaacaggaugaaacaaagcugaauaccaacaauagcuuaaauacuuacugaauauuuggcacuggguauaaugggaugugauuccauagggugagaauacugauauucacaugccuaaggauauuuucuugcccuagauuagucuccuagcaaaacaguuaacccuuuaaaaaugccacugucuucugauucuuugauuucuuuuuuaaugggccauccuugaagauuuugagccuagauaaaaaugauucauccuguuuccccaucucuuccugugguccucaugaauuccucuaguuuauuguaucccuucaaggugaauucuuuugcuuuacugcaaaugauaaaacacagucacaguuuucuccaacuucacagcuguuuuuaaaggcuacuucuacagcuuucagcuauucuguuggcaucuuuaucucaucuguccucuguaauuuuugaacuagauagacaaugcaacuagugaugcugcaaagcuccugacuaacaaggguccauccaucucccucucaauucacauauucuccuuuggagcuuuaaauauggcuuaggaaguuauuaaaaguagugugcucuuugauaucugggaaauugggucucuuuaguccuaauugucaccuuuuuaaucauucuguuucauauaaugaacauaggauuaaaguuauuucuuauacauuaucuucuaaacauuagguauuuugcacaguuccucuuaagaaaaacgagaugauaccauagaaaagagugcaauuugagguaaaucuauaaguaugcauuucauucagaaagggggcugagagaaaaauaugcaugccaggagaaccuguggagcaaaagcaagaaagaacaaagagaacuggguaugauggaguauguuaggcugggauuucuaggcugcuacagcagaaagcuaaaaaagcccugucagccacgguguaguggauccuugaugcugugcuuuccugcuugauuaauucugagguugauccagccacucucucaacaaauguuuacucauaacacaaagggugaaaugcaaauauuuuugcuguagugcacugucaucuacuaugcggucuuuugcaugccuuuugcauaugucucucaacacuguugccuucuuugcagccauugagccacugccggcuauauuaagucaguauuuagccucaguugcaauacaauuuucauuuuucuucugcuuuugcuucuaugcuacugaagcuuuugcaccacgguuugauuuuuuuuguggcuguuucccucacucaggugcuucuugacaucaaaagaagugugucucauucacuuuuauaucaguaucaguaaucacuuuagcacugaacccagcuaauuccaaaaauaaaugaaguuugaguauucacugaaugcuacauuuuuaucacauguagcuuuauuuaaaggugauccagaaauaaugugauuggagaauagaaguggaagauggagggagaacaguuacaugucucucuuuugaaguagcauauguguuuagcugaaccauuaggagguagauuucuagaaaauugguguaagggaaaaauccaggauuuaaaugacuggcuacgauguauuacugucugacacaaacagagagaagugggaaugguaauaaagauuuaaaaccauauugcaaauaauaagacagcgaugcuugcaaaacuaggguuacuuuuaaguaaacauguuuugccugagucagagcuccuggugcuagccuuugucucacacugccucugcuguaggaggagcauguggcuccuguucgguuugcuggaacuaagcuugggauuuauuuggcuuucauuuucauaucugaucaggaguuuagauaugaaauagaaauaguucaaccacacugacuguaauuuuuuuaucaaggcaaagugugcaggacauaggcuuuugaauauaaaaggcuuguuuccguuucugggagcuacagcugaaguguuauaccaggcagaggcacuggggugcgcuacuguguaguagcagagccuagcugugcaucacagcucuuaacuuuaaaacuccagagaauuugaugagagagggauccacaagaacaugacaaaugaugagaguucaaaccuuaagagaaaaaugggcuuauugguaagagaccuuucuuuuccuuuauuuacuacuguuacuuauucauuaaaauagcaagccuguuguuuugagauguggcugugaagcgguauauaaaaaucaauuuuauauguauuguagaauucaggagacauauuuguaaccauguagaaaucacagggaacguguguaaagcuugguuucuucuuaaaaagccucuaaggaauuuuuauuguaguucaggcuguggaauggauuuauuuauauggcauaaauauaaugcauguugagaaauauguauuuuauaaaguuaaaauaaagaauagugacuuguguagaaauaaauaauuucacuuaguugccagaagguggcacaccagauuguucuuaaauacacaaagaaaaggaauaauauuaauaagaauauaaaauauccuguauuuaaaaauauuucaguauauuuguaaucacagaaguaauacaauugcuauuugcuugacaaagcuuaauaagaaaauaaugacaaaugugaauuuaacauauuguacuuauuuauuauucaaccacaauauuuauguguauagaauuuuaaaaguaagcuuugaaauaguauuaacauuuaagagauguuaucuugaauauauaauuuucacacagaaaucaaauucucuauaauugucauauuuuguugggugccuuuggacuucaaaggcauuuggauaauaucuuugucaaggucuuucuaaagauucucguagacuuugauguaguucugacuuuaauaaugcacuagugcuugugaaaugacccauaaaaagaucugagcugguuuauuuugacaaaaauauuaggugaggcuaauguuuguuuugcauaaggugauagcaacaucaaugcaauaaaugcaaauaaauuaugcauuguguuggagcgccucaaacaucugccagcaaauuguaauuuuuuucggggggggggggagaguugacugucagcggcauauacugcaggguuucuguaguagucucuauuuuuaaaacugccuucccaaggcaguucaagaguaugccuauccaguguugggagauuuuauauguuuaucuccaaaaggagcuaguuacaugagaaaacuucacaaaaauaauuccacaaauuuucuguaaaggagauuguauauccauuucccuucuuaaaauuaauuacaagcaguaugaaaauaauaacaaaaaagaaaugauaguaaaugaagcuagaagaacauuagccauauguucucugaaaccuuagaaugucugucauuugcuuucaggucuuuauugcaaagcaguauaucagaaaagaacagaccuuuaggcuucaaaaacuuuaaaaaaugauaaagcaucccaaaggcuaaggggguaucacgugaaaaaaaaauguuucuuucuaggauaauuugauuagcuuggucuuguagaucagcugcaaaucaaugguuuacuuaaugccaaucugcacucuaugguuucugaaacauugagaaagcuucuaaaaacaaaugcaaucuuaugauuuucuguguuauauuuuguaaaacuacuuuauauaguauuauauuguucuguguggccuuaaauguucagaauuuuuaaaauaugacauauuaaauuacauuaaauauuuucaggguauguauugaaaaauuugaaccaaauacaauaaagccacaauuaaccagauuuuuuuuuuuuuuuuugcacuccacuuucaggagacggaggcaauugucuuuaaaacaagccgauuucaaggauauauucaaaaaggcagcugcaggguauguccaagggucuauauuuuccuguaccuguuuuuuuuuuuuuuuuuuuuuugugaugagaguuuauuuucauaaaagacccugagguauuugaagacauucaguuaucaaauaaacuucaauuaaugccuaggucuguguugauugagaaaugugcuaauaauauuugcaucauuguuuuggcuuuguacuucucauuguauauucacaaaccuaacuucauuuagcuuucuuaucauugcugugagauaaacaaggacaguagcauuuuucucuaauuuacagaagagaaaaauagcacuuggggucauucagcuaauuagugucagaguuacaaccaguccgcaggucucuuguucuguccucuuuugcuaaugaaugaaguugaaaacaaguuuuuaacuuuaauacagguuucuguauugcauaaucagucuaauuuguacuauauuucuuuccuuauuccuguacaucccacuuucuucccauugugcaucugucugucugauucugucagauggacaccuugcuuucagacucucccugacuggaaaggaccuuaaguuugggagggcaacauaagagcuguggauacugguuugacaguugguggugagcagccaaugcugaugugcuaaggaaggccagugacugagagagacaacugacuauuuauuauaguaucuuggguaucuugggcagggguucauuaccuacuuuuaaggcagucuuuuccccaggccugguagaccuggugugauaaugaaucugaauaauuguuuaaaaugcagaguaugcaucccacccccagacuuugacauuuucuucaccccaggugauucuucacacacuaauguuugagagcauuuugccuuaaagguauaagaguucucagugccucacgauugacucuugaagagccaaggaaagaacaucuuucucucagcagaaucuaugcuuuaugucaaagcauaucaacuaagacagucgggcagacaagggugaggcaugaaagccaccauuugcgcacauuucuaugucuggauuugaagcauauuacaauggcuuuuuuaugaauuuugaagaccgugagguauuuuagaaaggcuugugucuguuugaaacuugaagaaaguaaaagguaaagaaaagaugucacuaaaagaugaaaaguacauuuuggcauuucaguagcucaauucugccagauuucuuuuacuugaaaauauuuuuaaggaaugucuaaaacauuaggcugucaaacgugaaagcuuuacaacaucacuauauuucuugccauuuggaugugucggcugagacauguggccaggucacaugugcuuuucuguguauuuguaacaccuagcaaaguugucagugcuuaccuagccaacucauuuaucaugcagauucucucaagggaguuuugaccaaauagaauaaauuuguugguuuugauauuuguaauauaugagaaguuuauauggcacuaucgagagugacuaauauauuaaagaggccuugguagaaagaugcacuuacuuuacaggaaugcuugcucuuuauuuaauaaauaauuuugcuaauguuuuuugcugaucaucuuacaugaacaguuuaagcucagucugguucuucuucagguguuguuauuuauaaguuuuuuuauacuuuacaaaccuggaucguaaaaauuuguauuucugaaaauuuccaagcauaauauuuugcuuuaguaucuugcaauuuuauaagaacaaaguguucagacccuugaauagaaggcugauaaaauguauauuucugacuuagaucaaucucaagaaggaaugcuguuauucuugacacacacacauacacacacacacauacacacacauggacaccaacagagaaauguacuucauugaaguuuuauagagcuucugaauguuguaagaaauaacugauuaaggcagguauuugguuuggaagacgugaaguaguaguucugaguguauuagcaguuguagacagauuuacaaaugcaaguagaaaauucaaauuuagguuaccuuuagcauaaaugaauggucaaccuagaggguacauucuauuuuuauucaaaaguacauuuaaugaauaauagaacaugaaauaaaggacaagaaaugacuuaugcaauauuuaaaacuacuucuauaguucagaccaaacaccauacauaugucauauuuaaguacauuuuggcaucuuuacuuauuuuggagcucucagaaucaccaaagagaagaacacuaaauuuaaaaaugaaaagucucuagaaacagucauguaaaauacagguauugaauaaguuacuaagccuuugggguguuuccauagaagacaauaaugggaaccaacccuuuaacauaacuguucgaauacauguuauagcaaugggucaauagguucaaguuugagacggaguuauuaaagauuuuuuuucuuuauacaauugaaucuuuuacuuuuuauuagcuaccugguuuuguuacucuguauccuagcuagccucaauucuccugacucaagguguaggacuagaggcauaugccacucauacccaaaucaacuuuuuuuaaacaauuuuuuauuagauauuuucuucauuuacaauucaaaugcuauccugaaaguaccuuauacccucucccccaaccugcucuccaacccacccacucccgcuuccaggcccugguauuccccuauauuggggcguauaaucuuugcaagaccaagggccucuccucccaaugauggccgacuaggccaucuucugcuacauaugcagcuagagacaggagcucuggggguacugguuacuucauauuguuguuccaccuauacaguugcagaccccuucagcuccuuggguacuuuuucuagcuccuccacugggggcccuguguuccauccuuuagaugacugugagcauccacuucuauauuugucaggcacuggcauaaccucgcuggagucaauuauaucaggguccuguuggcaaaaucuugcuagcauaugcaauugugucugugcacgguguuaggugguugauuaugguauggaucccugaaugggacagucucugcaugguccuuccuucugucucaucuccaaacuuugucucuguauguaacuccuuacauggguauuuuguuccccauacuaaggagggaugaaguauccacacuuugguauuccuucuucuugaguuucaugaguuuugcaaauuuuaucuuggguauucuaaguuucugggcuaauaucaucuuaucagugagugcauuucauguguguucuuuugugauuggguuaccucacuuaggaugauacccuccagaucuaucuauuugccuaagaauuuggcgcacgcuuuuagucccaacacauugggaggcagaggcaggcggauuucugaguucgaggccagccuggucuacagagugaguuccaggacagccagagcuacacagagaaacccugucucagaaaacaacaacaacaacaaaaagaaaaagugcaaggccaaaucaacuuuaauguuuugauauuaguacgguuuuuauuugauuugggguguauuuguuuauuugguuuuuuuuuuguuucuucauuuggucugcuuuguuuuguuuuguuuuguuuuguuuuguuuuguuuuguuuuguuuucaagacgggguuucucuguguaguacuggcuacccuggaacuuaaucuguagaucaggcuggccucaacauuagauauacgacugccucugccucccaagugcuaggacuaaaggcauuugcuaccaacaaauaguagugguuuuaaugaauauauuuguaggaaauuuaaaguuuuaaugaaaagucuagaaaauaauaaaagaaaaucacgacauuucauauagcaauuccauuuaguauuguauaauuuuaaugcaucauuaagauuaguuuuccaugaaaccugcuucugggaacccccucccaaauguuguaaauuucuaaacagggagaggaagggaugaaguaauuggguaaucuuccaaacucagcuuuagccaaaacaauaauauucucaugggaauauaauagauauuugcauauaagcauuuauuuuuaaaaaugcuagaauuaucaauuaaacuugaaauguugaagcaaauuuacuauuugaaaggccuuuuauaucccuggguuuuauuaaugaugaaauauuucuaaaauaguauagaaaguauugauuuucuuuaauuggcacacuuuuuguguaguaugcauugugcuuauuauuuucuuucuuuuuuaauuagguauuuuccucauuuacauuuccaaugcuaucccaaaaguuccccauacccucccccccccacuccccuacccacccacucccacuuuuuggauaacaacuggacuuuuguucauugcuuaauauagucccugggcaucuucguccacccacuacuacuccugacuuagccccauagccuuugcaggcucuaccaauaaauuaguaagacuguguagguggcaaucaaguaagacuuccaacuauaaauguuuaaccaacuauaaauauuugacguaaaaaucagaaguucuuucuguucccauuccagucauuacucccuugcuauuccuuaaacaauuucauccuugauuccuuauaucacaugcucugcuuuuucaguacaccagcucuuuacauugcuaccacugcauaacuaauuauucuuagccauuggggcuauucaagaguucuguccuuuguauuacuuaugcuacaauugaguaaggaauuucaauuucugcacuugcauaugaacauaagauagugguauucugucaugaguagucuuagcuauaauuucauaugucuccauagaucuguugugggaccauauauaucuguguaguucuauuaggaaauuuucaaaauagaauuauccaauaugguguucuguggaaacuuuugagauugauuguaacaaggcuaugaauaagaguaucuaugaagaaaauuguuguauauuuuauauucaaguucacagaaacaaauuaaggagacagacaagauuauaaucuuacuguauaugaaagauauacauacauguauaugugaagaguauuucccaaaagaauuuugaugugcuguucacuuuuguuguucuuauuguuguuguuguugcauacuugguaagaauuacaaguccugguugccauguauauaguuuauuaauugguagaacauaacauaaaugaguaugcagcuuguaugaucuguaacaaucuugucaggacaauauuauuguagauuggucugaagagauagugucacgauugcuaauuacaagauaaauagauucucagacuacaccaggcuguaccagccagucagauaauucacuucuacaaguuauuugauaacuacugagaaaaaagagucaagaaaaauagcuuuauugucucgauuuucccuauacuaacacugccuuaaguuguacuuacauuauuuuccaccugaccauucuauacauuguacaauuaaaauuucagguauaguucuguaguguaccuuuucauuugggugauucugucccauuucuguguuucaguugacauccaauagaaggaugaaaugucucuuauuuguccuuguuucuuuagaaaaugcuaagauaauuagcagaaugugguucacuucagauagaagcauacaucgaauggauagucugaaugaaaaacuuuaggaaugcuauagaaguaacucuggacuaggaaauugaaaaccaucuuuuagcuagucagcacuaugacagaagacaaauuaacuucucugagcucagaauuuuaaucucuacaaaugagaauacugaaaaauauguuuuuuuuagggaaucuaucaguucuaaaucuuugccuacuuuggaagccauaggguucugugguguaggaacuguccaaaaaugaucuuucuuucuauggccuugacuaagaaccaucauugucuucuggcuauuuuaucucugagacgcauguugcacagguacuuaagacauuaauguuuauaaaauacuuagaauauccuucugucuucuguggugcuauaugacagccuccaaguguucuguauaugaaaucaguguucccuaugcuaugcuuaggggacaguagcaaaguaguguuucacugagugaguaaaauuacauuuuaaauguauaauuaaccaucuuauauagaugcaaauauuuuggguucugggauugaugguaguuaugauuacauucaauauuugcuauuagguucucugguaagagaaugacaucugguuaauuuugauacugcuaguuuuuaauguggcaauuugaccuggguagaguuuauuucuaaacaauguaugaagaaugcuauuguuaagcaaauuuaaauugaugacaauucauggaccauauuucuacuuaaaguaauuauuuuuaugcccguggcauaaugauuauuugaaggugacagauaauuacaaagcauauagcaguuuauuaagcccaaaaccuagacuugaauauaaauaaaugauuaaaauugagucuaauaguauuugcauuuuaugucuuuaaggaugcuaaauaugggauguaaggaagcaguuucuguuucuuaucacuuugagcaauuauuaaaaucauuuuacuuaacacuaaaucucucagaaaucuagacugaaaauugacaacugaaaauggcuuugauuaguuucuuugguucuuaaugauaguagacaaauauuugguugguugguuguuguuugcuucagucaguuauuaacagacgaaugauaccuaaaggguauuuguaagagaaaggaccaucaacuauauacuuuagaaaguuguaaagcucucacccuguuuucuguucagcaauuuugaggugucucucuggauagauagcuacuagaaacacuuguuacugugguuugguucaagucuggguucugacaaggugaagucacauuuacaauugcugcuuuguagaauugccauaagucuaaaagccuagaccucuucuuccuaaaauauacuuuucuugcugcaaacagcuaacauauugcuauuuuauguuuaauauuuucaaaugucugcaugugcuuuagacauugaaauuuaauuagaaacucauuuuggaaugaggcaucgcaagauggauguauacauacauuugugucucuguacaugcuuguguguguauauguuuaugcauauauuuuuccuuuggguuucaaacagcucacuguuucugaggucuuuccuagacaacauaaaaucccccaauaugaaauaguaucuaugguguauuuguauuuguaguuuauuguuaaucaaguauguuuucacugcuaagauauugauaaauauucuuuucuuugauccauuuaagauuucucugacauaguuuuggguugaguauuaaaaggaguuggaaauuuuuuggcguuuucuuuucucgagaaguaguuaguguaugauagaauaaaaauuaugugugagguaaugauggcuaaugcuaguuuaauauuuauaagguuuauggauuacugauaagugcuucaaaauaaacauugucuuuccagacaugaaugugcauguaaauacaacuccuacaucucuauuuauaacucauaagaaguggcuuuuugcuucgauaaugaacuaaauuugaaaaagaaguugugauaaucacaguugauuucaugcuuuguuucugguguauuaagugaugugguuuugggauuuuugaaaguuauuucuuauuaaagaaacauucaucuguaagauuuuuuaauacaaaaaaaacuuuuuuaagggacugaaucucuuuagaaaacaagauaauuugaaaagacuauuuggcuggagguaaaagguuauugucuagauaugaauauaagaauaaguaugagcucuuuguuguggcaguuauagucuuuaaaagguagugacuuuucuguuauugguggucuguauuaaguugguguugauggagacaagauaauuuuguuuuuauuagaauagagagguguuaggaagguaaguuuuuauuuuuuagcagcaacuugcccauuuaagaaguaguauuuuucagcuuguaaagaguuuugaauaguauuaauuuaguuuaaccuaauuuuacuuucaauguugcauagaaaauuugugaauuuguuuugcuguuuuaaacaaaaguguaaaacacccaaucacuuugggauuauuuacaacacuauuuucaggcaguauuuuaaaacaauguagaugaacccuuuauuugacauugcuuucauggaauaccucaagcugauuuaaccgcagcuucaauuuuuggaaccucuuugacaaucgcuaaucccaagagguuacuggaccgcugcugagcuguggaguggucccugcuggacaccugcuuggcuagcagugucggucuuuccucuagacaauuugugagcuguuuggggggcgggggaggaguaagggggugaacgggaggagaaaaggggaagaaggggagggcaguauugaauuagauuguugauagcgucccucugaggacugcuauuaagagcacgcuauucuguacuucucugcugcagaagacagagagguagucguguugccacagcauguuguaaauguacgagguuuugcucaucccggcuuggaaauaaaaauaggggaaggagugcaacuugaaucagaagcuacuagaggagcgcgcagaguucugcagcaguuuauauuugcucugacauuuugcuuucuucuaacuggaaaacagaggaccuggcauuuuuuaaaugggcuuuucucauaauggcauucuuguauuguguggccagagcuuucacaggaggaaagcgggcugcugaauuuagucacugaucucuauuagcuguggccuaaggcuaugcugagguuuauaucccauuuguacuguugcagcucaaaagaagaauguucagaggaugacaaauguauucugaguagguauguuguuucauuuuuauaugaaacccaucuauuuuuuucuguuacuauugguuagaaaucagguuaauaggugcagaacauaguacaaugcugcaguaucccuguuaagguaaaacaaugguauugcaagcuuuaaaaaaaaaaaaaagcacccuagcugcuuuuauuaaguaaagcugcauuguguacaaugcauaguacaguguacacacacacacacacacacacacacugcagucaacacuuuccuaacgagguggcacuauuguugaguuggaaggauagaaucaucuuauugcuuuaggggacaggacgauuuaaaggagguaccuugcauuccuauuguacagauuggaagcaucgguuuuuagggcacuggcagaaucuuuugcuuguucuccgcggcugcugugucaguacacuguggaauggaaguguuaguugguagucuguuauggaaacgcuguuuacuguuauuguaguaccguggugacaacaugccauugaaauggaaaacgagcucuccugcuaucuggaaauucccaguuccugugcuuaaaacauccaggucaacuccacuuucuccagcauacauguaagugagagaaaauaggauauuaaagugggguuucauucaugaaucugccguguggcaaacugugggagggggaucucaaauaggaacaucccccgacugacaagaucgagaaacaaacaaacagccagccaaacaaacaaaaacccucaagcuugcuuacauuuagacauacuggcaugcccaaguuaacauugguuuuguuuuccuagaguuuauuucagcuuaaaguguugaaugcaaaucuagucauuacuaugaagauauagccaaaggauuuuauaaggaaacuuuaacauuuaacaugagcuucuuggaauuuuuauguaucugaaacagugauuucuuuuguguauuagcuuaaaaucugcugauucuugauguucaugauaugcuaaauauggggauguuuuguauauuuuuugcaugaauuugaaacauucauaguucaucaaacgagucaagaccuuuacacucuaguucuguauaaauauuaaugaaugaaugauaugucuuucuuaguguucauucaaguugugaaguacaaguucaaauuuagguggcauguuacuucucugggcaauuacuuauauauucagagguggaaaagaguauucuaacaaacagcuguuuagaaauguguuuuuaaauaaagagcuauagaaauacauugggcaaccuguuuggaauuuuaaaaaaauauauauuuuaaauauauaaaauaauagcauuaaaaauaaaaucucggagcuaugcugaaauguucuuuugaaguauuguucuaaaucuuccucuggaggaagaaugagugcaggaaagcugaaccuuuuaagaaaacgacauuagcacaaggaaaucuuuugaguauuaaaggugcuugaacucugaauguucccuugaaauuauuuuugguggacagucauaauguggaaauuguuuuugcuuuaggugauacauguauuuagaaguccauuguguguugucauuuuuaaacuuaguuguauaugauauacaauagucaggucuuuugaaagguacucaguuguuuuuacuguaauugaagugauucccuggaaagcauugaaaaaugagcauauuucagagucauuuugagaucauuuuucauggugguccuuguguucuggguuauuuuaucuaaauggcuaguggaaucuuuuuuuuuuaagugaaauaauuuaguugauguuugugaaaauagaacagcuauguuuggguugcagaugcuguauuuaggaaaagcacaaauuaaugggagguaccaauuaguggaacuccuuccaauuauuugagaaaaacaggauagcuucccaacuuuaugaaucuuggcuaaugaggaauggugaaauauauacaaaaagcaacuuaacuauaaacaaaacaaaacccugcaaagaucacuugguuaccaugaauaauaguaauuaauguuuaugguauuuuuacuauguuucucuguucaaaugauccaacuuauacucccuuuugagguuccuuugcccuuuuuagagauauuuaaauauaugcccauauuuuaauaauucuuuuuuuuuugauucuuacuagccacaaagcucagaugcaagguaacacaacauuuuuaauaaaugacuuuucuucccucgaauucaucuguuuagaagguaaaagguagaaaauacugugcucuuacaauggugaauacuauuuacugguaauaugcauagguaggauggaaagauguuugaagagcuaaagauuaggcuagacuauuuugacuggcaccaggcaauaauauuaaauuggucccaguguguuuucuuuauaaacauauuacuaccaaacauuaaaugaauauacauguagauaaaaaaauguuugauauggaaaaagcucacuuggggaguauguaaguugauugccuguuaccuuuuagaucacaaugcauugagucauuugaccaccaaucauaaagcguguugcugucaucaguacuuuacacucuacuuacucuauuuaagauuaacauaaaauucaagucucagaugaucaaaccuaaguuagauuacuagguuagguaccaauauuuggccuuagaauuguuuggcuuaucugccaaaaucuugggguuuguugcuguugcucuuuaaacucuuuacauugcaauggaagaauuaaauucagacuccuuggcauacugugaucuguuggacauugaucuaucaugucuuagaauuucaagccauauuuugaauaaucuagacucacucacaguuuaggugcaaucuucuuguacgugugccuguguaacacaaagaaugcuuuacaggguuuuaugauuauguacugcaauuugucaaaugcacauuacaugacugugauuggaagcaaguauuuucucaaagacugaacugccaaaacaaguuuuccuuaguuauagcacaacuguacuguaggaauucagcacguacaacaaaauauaaagggucuuacauuaucuuucuaagcccagugucagugcuguuuggcucgagcuuugcuuugaugcucuagacaggucagggaugcuaugcuaacaucugcuacaguacagaacauugaauucauuuucaacaucaaacaaauauguuguguuugcuccuuugggauuuauagcucgaguuuguuuucucuuuuuagauaguugaaaugucucaauauuuucaagaguggugacaauagugacuauggcaccuuuaaggaaagcuguuuuauguagcauacauuucaauuaugauguaaugcauuagggaagauagaagaauuaggguaauuuuggcccuguuuacugaguagacauagucuucauccaguuucagguuugaacacgugcagagugguaugccauccaucuggauuucggaagggauucucuuaauagaaacagaguccuuggugacauguuugugcuaccgucuguucaacacuagguugaaguucagccuuagccucagggagguuuuccuggucagugaaaacugcauuaguagagacucugcucuugacagguggaaaccauauaaauuccccugucauuuggcuuaaauuaauaaagcugaaagggcaaccgcauugaagugcuuugccaguguuuugguauucguuguuuuaaaacagcaaauggcucauucagaccaauguuauaggauuaaugcauuguuacauucugaacacacacuggaacaguguuaguacuagagagguuuucuucuuuucuucacaaacacaaaguuuuaucaguaauagaaguguggaaagaagguggaaaauaacuagguuaagaauuguauggugcaucauaacagugaauuuuagcaagaugggcuaagagaugacugauauuagugaacuaauuugaaccagaaugagucucauccuccuuuagccccuacgauuguaauuaguuagcuuucuguuuaaaauuuguuguauauguaaacuauauuuuauaguuaaugccaacaguaucauauuucauagcaauuuuuuaaucaauaaaauucaguccuuagauuuccacagaaaaacauuuugcaugcuaugcuaauuuuccccauuucuggaugauucaaaauacagauauaaaacaaaacgcauauuuuuauccuuuuugauauuuucuuucccuuuguuucccuaagaauauccucuacuaauucauuguacaaaucaaaacuuguaguuugaaaaaucucucuuaacuacugcaauauuucaguagucucaaauuuagaaagagugaucucuucuacuuuuaguacauaaacuuuuaauuuugugucuguuugauuugucuuugcuacauaaaaaauuaugucaauaaaucauauagcuaaugcauuagacuaauuuguguugcucugucacuuuuguggcauggugguuaguaauuugcauugucuuggcuuacagaaggguuaccuuaucauuuauuaauagaaaaucacagugaccuuugaggcgauucugagagcucauauacuuccuuuaauuagugcagggaccccuucugugauacuuuucaaggauucugauccaugaccuccuugaacacugucaggaaaagagaauugacuaccuccccagaauagcacccuucuucauucauggacagguuuuuguacugugcaaaaucaguuccuccucuuuuauuuccaaguagagucucauggagcuaguauauuuaaaaguauuucuugaauagagccaagcuuggaaacuguccugugugucaugguucccagacacuucaugcuuaaguuguuuucacucaguacuucuaugcaauguauguggucccauuaggggaagacagccuuucauuuuugcaaacuuuucuuguuagagacuuaugacuagacuguaccuucucuucgucaacauuuauucuuuuagcuauuuaagauacuuuagucgggcauguucaaguuaacuuaaaauuuccuggucaaucccauuguguauuuuuaaaaaccauuuaauaauucuacacaccauccauguauaaaacaacagcuaguguuucuuuuacuuucagauauuucaaaaaauuuuacuugccaaucauuuaucuggcuucauucuuuuuauccuuaaugagaugcugcuacccagaaucccucccugcaaagcaacugcccauagugggcaagaaguaaaauugcaaaucuugauauugugagaaguccacaguuacuagggauuccucccauucagcuugacagaaugugcaggccagauguauguagaaccaaauuugagaggaaagagugagagagcaaugucuguguaaauaacuuuauugcaguuaaagaguuaagcaauaagcacugcagaagauauuuuacauugaaauggcacucgcaguguauuccuguguguuucuucaagucuauaccaaagaggacagauacgugcaugcuagguauucacagugcaugcuacuuucucagucaucuuguaaguugaaaauaucacaggaaaaaaaaaaaaccaaugaauucacuacaccuaacuuacuuccuaucccugacuaccaucacagcauacuguaaggugguaguuuauguuuaucaucauaaugugugacugugaccuagagugacacagucuugugauaauauaagaaaagguuugcuucugaaugcauauuuuauagcaaauaaaaaaguaagugugugugugugugugugugugugugagacuauuguaaaucaggaacugccauauucuaaaucaguaacauucagcagugcucgauauugcaugccaaguguaauggcugaguguuaggcaaaugcagugcuuacagucagucaguaacuauucuccaucuuccauucuguuuuuaauccuguuuuccuucuaugaaaauucuaaagcaagauagguauuaaacacuuucaauuuugauaacugauucaaagacaaugaaaacauuacagaagaaaaauggaucuuaagccuaaugaggcacaaauuggagauaggugccagauuuuaaaacguauacugcauaguauucaaaauaauuuguacuuaauccugaugguaacucucuaaacaacaaaauggagggccacucuuacguuagacaggaaauaacuuauuggucagaugcuuuuuaucacauaaugguacuuaccuagcuuuccaagcagcaaucauucucucuaaacuauuuaauggaauucuggguuaaagugacauaauaucauuuucaauuacaguaaauuuuuuuuacugacaucacuaacuaugauaaagggaucuguuguuuuuacucagcuguucacauuuauggcuugcuaaagugagagcaugcacaccuuguuucagagcacaucuuaaaaugggguucaguggagaagugaaaucaaauccugcaauaagaaaauaauaagagcuuaaaaguuuaccaugcauaucauacucuaaauuucauaugagaauguauccuauuuuuuaauguccuuguuuggcaugguuaauauuauuuacugagggcuacuaugaaacuguuaagcaccuucuaugaaacugcauacauaaauguacucucccauucuuacaaucacagacacagaguuucagguaaauuaauuagcuuguucaguaugauaagugaugccauaauuuaaacccaggguuaccugauuucaaagccuuugcuaccucuaauaccuuuuucauuuguguagauguuugugucuucuaaauuaaguuuaaugucauguguggugcuugguaugggaccccgguuuuguggaugcuaggcaaggucuauaucacugaacuauaaccccccaaaaaaaacuuuugcuaauuuuuauuucauauuuuaauuagagauaggcagucugguagcugagguuuuuguuuuguuuuguuuuuuguuuuuuggguuuuuuuguagugaguagugguauagaaaaagagacucaucugcauauugucagcuggaaaaguuguucagaaauauuggguuaacuuuguucacuugcuguucucaucuacugucuccugauaugaguauaauuucuuuucuggaauaauuuuuguguggauuuuguuguuuuugagacagggucucacaauauggcccugguuagccuguaacuugcuguguagaacagacuagucuggaacucacagaauucugccucccaggcauggaccaccacacuuggccuguggaauucuuaaugcaguauucuacuuugguucccuguggaaacuggauaccauggacagugcuauagcugguauguucuuuuuagcacugucaaggacaccuuucuagucaguuuguuuaauauuuucuugaggacaauaauacccuauauacuugcacucaauacaaauuuaaaugccccauuucuuagcuuucuauugcuuuaguauugaguuaauguggacugguagccuaaagcuucacaaauguauuauuuuacaguuuaguagaucauaaguuugauacuggacucagcaggcaaaaauucaaguuucagcagggcagaggcucuaggggaaaucuguuuccugcucauuuccugucagugauuaaaugaaguucucugugaggguaggauuaagguccccauugucuagcuggcuauagcugaaggagaaucuuagcuucuggaggguaacuucauuccuugacuuuugacucucuuccaucuucaaagccaacaagcugaauccuuuuuuuuuuuuuaaauugcucucugacccacucuauuucuucauauaaggaguuaugugacuagauucggccaccugaauaauauaaaacauuuugacauaucaacguccauaaucuuaguuacuuuugccuuggacaugugcaccacaugcauuugccuuuaccaugcucacaagauucugggaugugaauaauuaugcucucaugcaucuagaucaacaaagucguccacgacuuucauaagaaauggaaaaaaucuuuuccaaugaaccaaacugauauuauaaacuuugaauucuuacaacuaagcuauauuaauuucugggucaauaauuuucuucuugcaaauuguaguaauuuaaauguuagauaggcagcucuaaaacucuugcaacaaaauuuaauuaaaaucuuauuaaaaguagaauuguccauugaaaaccuuauuaccuggguuuuuguugaaagcaucauuagaguacuauagaagaacaauuuuguguuccaauucuuguaaauagauauugacgacaucaauuuuguaaggagacauaaucacauuaaaugaugauaaaaugugaacuaaaaugcuagccauuaaauuuguauuaguuauuggauuucauaaaacaaagacuaugggaacaagauuuccacacguuaaggcucuuugaaaauuaaguaagaacuaaugcuaucuuuuggaugaaauaaugaaacccauuuucuuuucuuauuuuuuuuguaacuguuuuuuuuuucuuuuuuuugaauaauauuuuuuuauuacguauuuuccucaauuacauuuccaaugcuaucccaaaagucccccacacccccccccccacuucccuacccacccauucccauuuuuuggcccuggcguuccccuguacuggggcauauaaaguuugccugaccaaugggccucucuuuccauugauggccgacuaggccaucuuuugauacauauuccauuguuaauagugcuguuuggaaauuacucagguaagugcauggugcaaguugguugauacaacugcaucauauuucauugaaaaccuaaauuguuccauauuucuuucugcccucucccagcaauuguuuguucaaagaaugagaagauucucacacgucucugcaaagugaaauagacacagguuuccgagaaccuuuuaagcaagcuucacaugcuucaguuagaaacacacacauacuguggguuaagaaucaauaaaauucaaggcaauuaaaauuuuaauguauuuuagaauuaucacaccauggcauauaauuaugugauugauaaccuuucuuaugcccuucagugcaagguuucugguaggaaaaugagagcguauuggaauuugaguguuccuuaauuaccaauuauucaguaaagucauagcagcaggugaguacuguuuguguuucuacuacugaguuuuaaaucugauucuucaaguuacgaaggccugaaaagcacuauuucuaaacuuggaguccaauuuaggguagguuuuaacucagaucugguuacccagcucucuagacauaaucuucuuacuaguaagcuacagaggcuugauaguauuuugucuuucuuuuuauucaauauacuuauggugcauguauguacauauaucaugcuguguguguagauuaaaggacaacuugcaggaguugguucucuucuuuuagcaugguuugaaugaggauggcccccaugggcucauagauuugagugaugaguucuuaauuaguacaacuguuugugaaugauuaagguuaguggccuuggugaaggagccauaucacuagagguuucaaaagcccauaccaggcucucuuucuuuuugccaacuuccuucaggucaggauguaaagcucccagguacugcuccagugccaugccuauuuguuagcugccaugaugauaaugaacuaacccgcuaaaacuaucagcaugccuccaauguaguguuuucuucuuagaaauuuccauggucaugaugguucuuuacagcaaucgagcaaaacguaagauaccuuccgacauguggaugccaugcuucaaauucagguugucaggacugaggccauacaccuuuaccuagugagccacgucauaagccacauauuagcuuuaaauuuuugaauacuauauuauuagguauauguuuuugaaauugaaacauuaggaaaaugauaaguuaggguaucaaguucaggccagcgugugcauguuauucuucggcccaugcucucccuuccuucccuuccuuuguuccuuucacauucauguuucucacuguaggugguuuaaaaaaaucuaaaauuauguuuaacaaccauugcaaagucaacuagcuucaccuuuucuuuuguuucugguuucaaaaguguuacaguuaauguuaaaggccaguucacaacaaagccucaacuagaucgcucuucauagauaaguucacucauuuucucuugugcuggggugaaauguggucccaauuaaguugcuguaccuuauuugaguggaaauucaagauaauugaaauagaaguuuggagaauauauguauauucuaaguuauaaacagauuauccaauucaugaucuuugagcacagcucuuuacaaguguguguaugcauaaucauuucuaaaagauuguaaagauauuuguggaauuguaaccaaaguuuccuuuuaaguagacuggagaucuggcucauauuuucugcagguaugcugucagaguauuuuaauagaugcagcuagauaaugcagccuuggaaauguguuauacugucacaucauuauaaacuuuggcuuuguuugauauaauuaaaauaucagguuaccuuuuuuuaguaguuaauauuauuuacuuaucaaucuagcuuuggauauagccaaauauagagaaauaucauuuuaaaauugaucauuauauguuaaauaugaagggauacccauagggcuggaaaaaugacucaugaaugaagaucauuuguaccucuuccagaggaccuggguuagaugucuaguacuuaaaugguagcucacagccuucucuagcuccaguucaaggacuucuuauacccucuucugaccucugcacaaguggagcauagacauacauguaguuaaaacaccaguacaugcuucuugaaggaaggaaggaaggaaggaaggaaggaaggaaggaaggaaggaaggaaagagggagggagggagggagggagggagggagggagggagggagggaaggagggaaggaggaaggaaggaagcccuuagggaucagggaacaaauuucuacuaaaugugggugcugguuuacaugaaugauacaugaaauucacugguagaugaugguaagcaucuacuaaauucuauuuaauuuaaucacuuaguaauugcuuuucugacuauggugacuuaacaagaaacuacucugccugauguuuauauucuuauuucuuaagguagugucuagcauauaagaaaugccccauaaaugcuggacguaugaccuuagagaaaguugcuuuuuggacuauaacccuguauaguuaguuccucuucacaucauaguauugaucaauuuaauuggaaauagguaguagcacuucauuuucuuguuagauguuaaguuauagcuuucuugucuaggaaagaaacuacccuaaaacccagauucugugcaucauugcucauaaagcccauggugcugagaaaagacugacaguauucucacuacaaacaauuagccagggaccaaaauauauuugccauagaguauaucagcuuguaauuugauaaagaaaauaaaguuuuagucauuuuaagauuucaaguacucuuaacuuuaaaggauauuuuaucuauuacaugucuuuugucuuaacagggaaaaaacuucaggaagauuuauaauuuuuaaaauaguuuauauacacuuaauuaauguauuuuauaugugaggucuaguaaaaagagugucugaccacaagacaaaaugaaucuaaauaaugcuuaagagaaaaaaaauuaugcucagaaaucaaccacauuuccuuauguuaugaauuuuauacccagacgagcuuuguaguaauuauagaggcuuagcagauagcacauugaaauuccaugauuuucuuuuuugaauauuuucauucuuacaaaacuucauauuauguacauaaugugucuugaucugaagaacccaucaccccucacugauccccuccgauauccuauggccuauucucaacacaucuuccucucaacuuccugucuucuuuuuuuaauugauagauauuuuuauaacccaauuaauacuaucuauacgcauguugguguaggauccuccacgggaauauggaaaaccuaucuaguuacacauucaaagaaaagugacugucccuccucuagcagguaucaacugccaguagcuccucaacuaugggugaagccuugcuagcccauccccuauccugccuagauguuuuuacuuagcuugaucuuaggaagguaacaauagugggugcagcaaacaugucauguacagaugaaagcauuucaaaacacucaacccuaucccuuggcuuucuauccucucucguauaauguucccugcgccuuggguugagagauugauggguggccuguaauaaaucucugcauuaacaacugccuacugugauaaaaagcuucucugaccaaagcugagaucaaggcaaaucuguaugaugagucuaaacauaaauacauuuaaaaaaaaaauaguuugaccgccaggugugguggcucacgccuuuaaucccagcacucgggaggcagaagcagguggauuucugaguucgaggucagccuggucuacagagugaguuccuggacagccagggauauacagagaaacccugucucgaaaaaacaaaacaaaacaaaacaaaacaaaaaguuugacaauagcacuguuuaaaacaacaguaguaaguugccuuguaggaucuaugcuuucuauagccaugaacuugucaccaaguuuauaguaccaggcaugaaaucccucuuguggaauagaugucucaaauucaaucaagagaaaaauugguuauccuauaauagucaugcuaccacgucaccaauggguacauauguccuagcagucgguauuguaguuugugcauuccagcauuaaguagggccacugauaucccccuaucuacccgucaaccucaauaguaccuuauggcacuauaaaagcuagccagcaaaaaagaaguuuccuaguuaguuugaaauugauuuuuguaugccccauagccgaaguaugcaguaucuuuagcaguagucguucuacagggcagaaaagacgaaauacccuguguugauuuaggggucuucuggugucucuguaaccaauaauaauucaaaggguagaaaacuguuuuuggcaaugagauuuuuauuuaacaccgcccccccccccaugccaucugggaacauuaucuacuccugaaguguacuucugaauaugccuuuuuaaacauaaauaaauauauaaacaucauuauacauauuuaaaaaccaguagguuuucagaauuuggagugugauucauuggcuaggacacgcugacuccucguccagaaggucaagguuuaauuaguagcacccgcauuguggcccacaaucaucucuaaugucuacuucuggccucuauagccauuagacaugucugugacauauagauauauagggagacaaaacacucauguauauauuuuaaaaauuacugaguuuucauaagacuucuucauaccucuuucauaguuaacucaucuucuaccaccuccuuucucucauuucccugaacaugugaugugaaagaccagccagaaauacuggagauuauaaauuaagugaauuacuuccuaaauaugcuuaaauaagauuguuuuuccauacuaguuaacugaagguagacaaaaggcauagcagugacugauaaaaguaaccuaaaucaagacagcugcuaauuuauaaguuuuauauucucuaaucaagaaucuauugugaauuaauugggguauucaguuaguuaaggcaggcuagccccaguuaucugggagccaaaaauguaggucuaauuuuuucuuuuuguuuagucuauaguacauaaccaaauaccuuugaacaaggagauaguuuucugagauauaagaucaguauuuaugaaaaugcuaaaacauaaugcauaugaaauuagucaucauaaauacaguguaugaggguggcaaaaauguucuggugauggcaguugccuuuuagaaucugaaauauuucaucuauggcucguuuggauggauaacaggauauauaugagauuccugaaauuuguucugauuggcuagguuucugucauuaaggaccaucaagacauaaguagucaaauucacuuuuacauaggauauugcagacaugugaaaagaucacauuuugaagauuuaaaacuguuacuuuuaaagaauggcucgugagcauauaguaaagguugguagguaccauuuucuaaccagugggcaaacuuguaacaccucauuaguauucucgcuucccugaugacucauuucuuucuaugugcuucucaccuacucugauugucauaaguuauaauuugcaugugagacacuguuuaauguucuguauagaaaggaaagaaagaaggauucuguuccauuaucucaaauuaaggugauauuuuauuacuacuuuacagcauggaggcaaaacacugauauacauaaauaauaaaauaauaaacauaaguugaauauaacuggaaaaucuaggaagugguugaacuguucacuccccccccacccccacuggccuaaugcuucucuuuuucccaguagauuugucucuguaguugcuaauuugccuuugguuuaugggaucugccuucuaaauaaauauuaaauuugucuaacuucaauguuuggauacuuaguaaaguagaauucuaggcauuuagaacccaguuuguucauaguauggauaucuuauuaaaauaugccacuagaggugaacaauccucuuuaaggaaaaaaagggggggggggguuaaagcaaguuggcuugauauugaaggagcuggagaguauaauccaauuucuuuauugaggauugaaaggagggaagccaaagucaaugcugcagguauacugaggcuucucgauagccaggucugauugauuaauggcuggagguuagaacauucugccaaaagguuuguguguuacuagaggacagauucgguguccucuacuuaacuaauaguaauuagaguauuugcuauuucuuucaacugacuucuacauauugaagucccccgcuguuaguguuucuauugcugugaagagauauccagaccacaagaacucuuuuaauggaguuaaauauaacuagggaugacuuauagguucagagguuuagucuguugucaucauggcaggaagcaugguggcauacagacagacagacaugguucuggagagguagcugagaguucuacaaccaaauccauagacagcaggaagagagauacacuuggccuggcuuggacauuugaaaccucaaagcucacccugaggacauacuuuuuuucagcaagaccguauuaccccaacauugccauaacuucuaaugccacuccacaagcauucaaauauaugaguuuaugggggccauucuuauucaaacuaccacaaccuccaugugcaaucugucauauuuuguagcugucuaaaggcaaaggacucuuuggaugagauauuuucuauaugccaggaauggaaugaacauucauuaauuuauuucuucacuuacuguuuuauuucuacuuccaaauauauaguggauucuauuuguucuuuauaaucuacaguucauccauccaucuuuucuuccaucuauucacccacuacugaccuauaugcucucuguuugcuaccaaaauauuauuuaaaaaugugaauaauaauaauaguuauuauuauuauuauaucuaaaccaagcuucuuaaauagaauaaauuuucaucaagguaugugaaacuugauguaauuuaauuaguaucaguguauuaaaugaggagagcagaacagagucuuaaaauauggcagggugaaagcaaaaucauuaauuuuagaguuguucaaggacaggauugaaauauucagugcaaaugcuuuuugguucggauaauuaacuuucauccuguuacaguuaucuaauggaguaucauuugucauuccauuugucuagcccaauucccucaucugugucauagugcuauuuuugugaucaugauagucagcauuggaauuuaaaaucuguucuuuuaaaugcugguaacaguaauguaaaauccuuccuaaauuuaaucugaauuauggccaaagaaguacuaccccuucuucccauguuaguacauaauuuuaccuuugguguuguuguguuuuuguuuuuuaugaaaguagagugauaaaaaggaguacuuuuauuuuuuaaauauuuacuaauuuuuaaaaaagauuuaucuuauuuucuuauucacguguuaguaccucucucucucucucuuucuguguguguguguguguguguguguguguguguguguguguguguguuuugaacuuccccauguggaugcugggaaucaaacucagguuuucuggaagagcaagaaauacucuuuacuacuaagcuaucuuuaguccuauuuauuaucaguuuucaugauguggggacaaggucuugauguguugcccaggcuacucucaaacacauaggcucaagagguccuccuguuucagcaucccaacuaggcuugcaucacuaaaaauagauuuuauuuuuaauuuuguaaauggcauguuaguaaucacacauauucauaagauccacugugauaucucuauacacacauauaauguauaauaaucagaacaaugaaauugguauaucuaucuaacccuagacauuugauauuuuuuguuuagagaauauuaaaaaucuuuacuaauagcuacuuuuaagucuucagcuaauuauugucaacuauaguuguccuauaucauagauaauuagaagucaucacacugaaccaucugaaccuuguaccuguuaauuuuugccucagcaucauccuuuuccauacucaaagcaggggauuugggaugcaauuaauuaaaucagaaaauuacuugcuuccaacagaauauauuuuuaugguauuuccuaguauuuauaaaauaagcuuuucaaagugaaucauuguacagucuccacuugcugcuauuuuuaacuuuuagcccucauguaauggaaacaauguuggcucuagguuuagacauggguuuggauucauaguuaugauauguaugugaggcauuaaacuccccgggcuucaguucccagucuugaaaguaggauugucaugaggauuaaguaccauaugagaaugugccuggcauagugccuaguacacagcaggugcugagugaaugaucuuauuccuauguuauuaugaacaucagcuacuuauuaauguaauucuauuuugaauaugguagauaugagcauuugagaaaugugcauacuaguuuuugcacuuggaaaugccauuuugacauauucuuaucaccuugguuauuuuucuuuuucuggauguuuguauuaucacagcagaaauagaauauugaaaacagcagcuauugauaaaaauaaaaauauuguuuaugauaaauguugcuaauacuauagccauuucagaucaaugauaauagacuuaacauauauguuauaaaauuacagauaacucccccaaaacuuuguuuuucugauucuuuucaacucuaauuuuauuaaggggauuuguugucuauuuuuuuuaaaccaguacuuaauuuaugucuuacaaauacaggccaucaugguauuuguaauuuccucauguaauaaugcugugaauuuuguugguaaacugauacuucaauacuuuucauauuuuuaaaacaacugauuuaaaauagauuuuuauuguuauauagacugauuucuuuuauaaauguuaacuucagaaguuggaaauuuuguuccugauuuuuauuuuguaguucccuaauuuuucauaguggagagagauaaaaugaaugaguaugaauaugcaaauaugucugauuuaucauucaguuuuuguuugggauggauggaagagaagaaaaacaucuauuaauaucuuuaacauucaauucauacuuugaaucuaucugaaaacuaaugggaaauugcuuccaucaucuuaaguuuuugauucauuucucaaggguggaaggaaauaccuugacagauuuagcacucaaauucaaaugacuaugagaacagguggcaaaauuuuuccuccaccugccaugcaacuuuaucacaagaaauguuucauuuagcaaaugcugcugcuagcacacacuucucuacuucagagcaggcaaacaaauggagggagaguacuucuuugaagaaaaccccuuucuugaauuccuuuuaaaacugugaguuugaaaucugacuuuucuuuuccugggggcugaguuguggaaaggaugagucauugacuugauuaacuggccugcuuuauguuacugccaaucccucuacggcugucgcguguguugucuucuuaguguugcuguuccucugugcgcacccacuggcaggaacauuugguuacgauaauauuauuaaucuuggaacuugaaaauauuugucuuauacuuuaaaugguaacuuaagagagacuuguguuuuguuguagugaagcuguguuauuacaguauaaguuagauugaauauguaugaggaaauuauagcaagccaaaagugaaauuuugugaacuuaacuaguaacugaauggagagaagcaauaaagcuguucguauacuuuagaauuuauucugauucauguaaguaacgcaagaauguuuaagacagacuauuuccuugcaaaaucacugugcuguucuuuauuugauauaaagcuaaaaguuaaucuaccaaugaauaaguuggcauacaaaacuucccucccaaggaaagucaugagguuuuaauguauucucaugauaauaauuucaaaaaguacuaaacuguuccccuuuuccuugacagugaaaugucaccuucccuggcuuuugcauuuaagguguauuuguagauugaggugauaaaagccaagaaaaugaaaugugcauuuuauaacuuaccucgauuuccaacacaauagcugcuuuuaauaaacuuaggcuuuuggauguagagaucuaggacuauuuaguggaagcuugugaauuuggacucaaugcaaauuagaugugcccucccauuaagcauaccaaccaaugugauuggcauaguaauuuauaagacuauucaguucuuccuagaaccuugaacaaaugaacuuaccuaucacuguucuguauugcaaauguuuuaacaagauucacagagcacuccuuuugugacagucuccuaggauauagaugcaaugcacaauccuucauuaucauaaaagaaagaaagaaaaaagacuggucuaguaauuuuuagaagucuuuuugucaaguauccauuuggaugaacagcuccacguagacuccagggauuucaugcaugucugcacuaguaauuuugaaaguaugucuuguguucuaugcuuugauaauuuauagguuuacagauagaaacuuuguguugauuugcauacucauggauaguaaagaaauugaacauuuugauuugucaaguauuuguacaucugucuauaugaauugugcacuuguauucacuuacauuuguuuuccuugagguuuuugugaaauacggaaauuuugagauuaugauuacaauguuagcauugccuuguuaacaaaaaacaauugcuuagacuuuuuuuuuccuucaaacaacaguguaaguaaauacacuacuguguguucaguuuuuuucauguuugcauuuguuuuaguaaaaugaauugagaggccucuaccucuaaauuaauucucuccaaaaaacacugauuauuuucuugaguaaacaccauuggcugguucaugcacauuuuaugaaagauugguuuuguguucauugguuguuuguuuugaaaauaaaauguguucauuguagaggauuaguuuggcaaccauauguagacacggauguagcagaaagauuuaaguuuuagaaaagcuaauaaagacauugucuccucuaaauaaccuuugaguauuuauguaaucacaguuuguucaugauuuguaagguuguaacuuauuauauauaaauaaauccaguuaacaauuguuuuaaguagaauuaagaaauuguuauucuuacaugaaauauaaaaaaaaaaccucuuuucuauauaauuauuuuauaaaccucagcacuauuaucuacugaucuguuguaaacacuugaguuuucaaaauguuaggacugaggagagaugaaguauucuguuagauggcuuagaagauguggugguaauuaauaaucccugcuguguuuuuguacugcuaacauuacuuuuuggagucaagccaaggguugggaaauauuuaaaacaugaaauuacuaaaacacuucauguggaagucaaccccucuauagcaggauuucgcaaccuuagcaacguugacauauuuugcuggagaacaucuuugacauauagaacuguccugugugcucuaguauucuccagcagcaucucaggagaugacaguaauugccuaccccucccucaguugcuacagugaaaaauguccacagccauugucaaagaauaugugcauggcaaagggcaggaguuggaagcaaaauucuguccuuuccucuaccuuuugagaaccauuggcaugcauauuuuuuuaacuaaaugacuugaaaaaaauuuuaagacaaaaaauuucaucugauaaacaaucccuuaauagaacaugauauaauuguugccugggcuuuacaaaaagagggagauauuacuuccuuucaguguugaagaucaaugcucuuccuugcagucaauaaacucgguuuccuaagaaguuugacaugacguguacuguuacuggugcagaaauaauaaggagugucuugaaugguaaagagucagucuccucaguauuccagaagucaaguaugagaccuucuucagcuuuugaaguaauuaauuagaaagcuaguuaucucccguugccaugauaggguucuauuuucauagaagccuucucaauuuugagagcaagggacgacugacaaacaaacaaguuguuaucuauaguuuauugaaaguaacaacuucuaggauaugucauaaggacagagcagcuccagcuuuaccccuauccuuguugcaaagcgguaauugauggucauuuaaacacugagugauaaagaaaugucuuuggagugauucaccgaaaugagauuccauauucaguugcaggacauaaauuaagccucucaugccaggcuguguguagggaauauagaaauuaauagcacagucugcuugaauuugcuauuaaaauacuuuuagauggacagauuuuuuuuguguagagacaugccucaccaucuaucuauuugugacuuuuccaauugauucuauaaauuccagugccugucuacaaacauguauaugaguauuuuguaugcuauguaaguuacauauauauauauguguguguauguagauagauagauagauagauagauagauagauagauagauagauagauagauagcauaucauucuuuuuaaagcuauuucugaaacuuuaauggaaggcuguguucauuuucuuuuaugcuugucaaaaucuuauuugaacuauucucuauuaaauaucaaugagagaugaauaaaacauaguuauguaugauuaauucauuuucauuauauuauggcucuaaugucauuaagaagaguuaaugugacccuuaaggcaagaauuucugcuaauuauuacaggauuuaaaagcacuagaucggugucaguauucaaaaugcaacaucuuuguguauaaaguaacuacaguauuacagucuuucuaauuaaaacugagcagcucagguuauagauauuacaggaaagggguaaaaucuuugauaauggaugguccaauuaagaaaucaaauaauuuaagauucuggaaguuauauagauaaguagaaaauucauguugacauuuuuuucuuuuucuaauaucuacuuagcagugucuaucaugaauauacaaaccaaaccaauucagagccaaggacuccuuguucuuagguacaugaucuagaaacgauguuagcuaucuagagguaaugauauaaacggccucuuguaagaaauaaugacaggucauuucaggguagucauuuuuaguauagaugugggaaaucccuuuaacuaucaaagauuucacuauauuuuugguaauuaaguaaauguacauucugcaauccuuucuaugggagauagauagauagauagauagauagauagauagauagauagauagauaauauuaaacagccuuacacuuauguuauccauuucuuugaaaaauggaaauguuaguacaauauaguuauuucuauaaucagucucaaauugagaaaagagagcaaaaguuuuuauuuuaugcguggaauuuuauuuuuguuagaguugacuagaaccauuacuaauagcagcaacaugaaguacugcaguaauauauugagggugauuuuuuaaaaacuuuuauuaguguggguugauaggaauuggaauaaugcuagauuuaaaucaaaaucuugacucaauuacuugaauaaccuggguaaauuauuuuuaacacuuccuuugcuuuccuuaagaacaaaggagauaggaacuauagagauaguucagcaguucuucucucagaggacccaaauucaguuccuagcucccacaugguaccucacaaccauguagaauuccaguucuagggaauccgaauccuucugaccucugagggcacuaggcacccuugugggugcacagaccuacaugaagguggauauucaugcacaauaaaugagaaaagaaaaagagagaagagagaagaaaaaagaaaagaaaagaaaagaaaagaaaggaaaagaaggggcuaauaauaggauauuuuauauuggguuguauuaaaguaaaagagcucauggguguaaaauucuuagcaaguacucgauagagaauauacuucauuugcaaaauuuucuuccuaaauuuggguacgugaaauuaaaccuaaccaugaaguacauaauuugaugauauugcuauccaaauaguagaauacauaaaucaaacacugucacccuaaaaguugcuugaggcugcagcuuaaaacucuuuuagaugauuucucaguucuucucuacgauuucuguccuuugaacguauguguauuucuucuaugcuguggauugcuaugagauuagaauacaggaaaagaauccucagcauauuccauaguuagacuuucagcagcagcugacaauuuucuaaauauuucacuauugugaauuauauacauuuuaauuuuucccugucuuuugauuuaaaauauuucagaucacuuguggaagaggaagaccagcacuugaaacugugccuuggaagugaaaugggccucucuucccauuugcagucuugcaaggcaggaaguacacgcaucuuuaccagcaacagccacaguucugugguguuacagguaaucuugacugcucuuuuggcaggauuuguacagauacaaaaccuucuggguuuggguguuguuguuuuagggugcaggauaucagaaauugugaaggcuguuaauggugggauggcaagagaagguacauggggauuuucuguugucagcucaucccuuguuuacauaaaauuucucagaaauagaaucuauuacuuagaaaaacaaauaaaacccuaccacuguaaaaaucuugauuuaaagaaaaucauguuuucuuggguuuaaaauaauugcuacaguucaguuucucuuuuauuuguguaaagagugucuugguaguaugucacauucuuuuuuaaauuuauuuuuuuaaauuucauucaugcccaaacacacacacacacacacauacacacacacacacacacacacacacaauuuuuacaucauuuccucucacuucuccauccucccuagagaauaucauguucgccaacauugacucucuaauuucuuuugaucucuauuguauaagccaaaguaaaaaucacagguuuccuauucuaaauaaucuaguuucuuaucucuccuacaguuaucauugucauaguccuaaauaucauguuuauuagauaacucaguucucauugacaagaguagguacaggaguagggauggaaacuacugaauguaaucccauucauagguguaagaguuaauagcuaacaugaaaggaaggggcagaaaaaaaaaaggaacacaagacacagagauuuggaacuauuuuggauggacauugaccuuacugaccuuuguggagauuuaugaauuagagaacaguagaguccuugauggacauaaauaccuuccagauagaacuaaaaucagccagucuuuucugcuacguaagaauauauaucauuuuaaauaauacuuauaauaaauuauauauacacacauauauauauguauauguauauauaacuuucuaaauguaucuuaaaauuaaaucuuucuagguggauuuuaugaauauauuugcucaugaucaacuacacugaaguagucauaauauaaugaaagaugaugcuaauacuuauugcaagaucuguuuaguguaaugucucuagaaucaauuuuuuuuaucucuaaaguauaaguucugagcagggcauuucuauauuaccuuuuuuucugaucuuuaaaaucuuuaaaaucuuggcaguaaguuuuaaaguuuguuguccuuuggauguucucaacagaaauaugagggucagggaggaaggugguucagucuuauagcaccuugauacuguauacauacauagaguauaaauguugggguuuucuggcccagguaagggaaaacuaaggaguuaagaagauaucaaggacauaagugaaaacauuugugcuacuuuaauggccuuguacuaaaaaaaaaaaaaaaaaaaaaaaaaaccuuuuaaagcaauauaaaaagccugaguuaucuguacaaugcuuaugagggauauauacucauauucaugucuuuaggccacucauuguaacccugcuaauuuuaauguguuaaauuuaguagugaucacuacuauaguucauagcuauggcucccaaauuuuagugcauguuaggaucauuagaaggacuuauuaaaacacugaguacugacucucaacccaaagauacugaaucaaaagucuuggguguggccuaguaguuccuauuucuagcaacuucccaggugguacuuuaacccagagaauauacaguguucacccaguauccacaggaaauuauuuccagaacugaccgcagggaccaaaaucuucucaaguuuauuacaugaacuagcauaguguuucccuauauccugaguauaucuucuguauacuuaaaaucaucucuagacuauugacuuaauaacaguuuaaacuuuauguaaauagguacuguauugaauuguuuagggacagaugaaaugaacaaaguacugaaauaccauauucaguauauaugcaaacauacuaggguggacuuuacuauacaguucauucccuguuguugaauuuucagauaaggaaaccacagaauauauugagggucaaauuacaguagcaccauuguauagaggcaagaaucuuccucugccaagaaaaguggaaucuuuucucuauggaugaauagauaagaugauagagagauagacuauaaguuauuguuauagcagaggaacauuaaaaauagcuuaaauguuuuccuacuaagguuuuauguuuuugccauuuagucauauauucuuucaauucaguacacagauacauucuacuuuuuuguuuauuuauuuuaagacaagaucuuguucuguacccuggaauguccugaagcucacuauguaggcuaagcuggccuugaacugaagcagucuuccaaucucaguccccuaaacagaauaacuaaagauacguacaaaugucugaggaacacuuaaaaauauucaccauccuuagccaugaggcaaaugcaaauuaaaacuacuuugauauuucaucuuaacccagucauaauagcugggauuacagacugguacagucacucuggaaaucaguguagagauuucucaagaagcugaaaaucaaucuagcauucaauccagcuauacucuuggacacucaaaggauucuacaucuuaccauugaaaugcuugcucauccauguucacugaugcuauauucauaauaggcaggaaaugggaugggcaaccaaaaaugugcauuuacacaauggaauauuauugaacuuuuaugaaaaauaaaacugugacauacacagauaaauaaaugagugaaacuggaaacagucauccugugugauauaacccagccccagauaggcaaacaccacauuuucucucauauguagauguuaguuaugaguuuuuacauaugugugcuuauuuugcaauacucacagaaauuaaauaguaaggagccauauggaaggagggaaucuuucugggaaaggcagauagaauauagugauacagagguacaaagaggaauaaugaaauaaggaggauuaaaugguauggugaauaggaggucaaaguggaggagggaaucuagggagggaaaacaaauacuagaggucuuuugaaaaagccauauggaaaccuacuacuguagaagcauccucaaauauauacauaauacauacacaaaaagaacuuaaguggcauuauccuaaaauuggugaacaauaguccaacuagacacugugugcaagcaaauauaaacacuaguaccaggaucugcuuaucuuuuugaguuuggggauagugauauuccaaagauccuuaaguauuguagguuauugccuuuacucuugguuaaccuccagaaauugauugcaagaccuaauugaugaaaacacuacacacuugagucauaaaacauaagaaauuaaagcaaguacagacauggaagcuuugccccugcuggcuagaaggggcuguguagucuacugaaagagaauaacaauccucaauguuacucaguugugaccucugugagguacaguaaugacuuuucuggcaugacaauguuaggaauaguaauguuuacuuggauauaaaacccacuccaggagauagagcccauacuuaaaucuguuauucgagcaauauccucugccuauccuggucuuggucauaggagagaauguacuauuuauuugcuaaaaugacauaguauuaaaacaacuccuaaugaccuguugcucuacccacagaucaguguaaaucucaacccucaccagaaaagcuacuucuuucaguauucagagagacuagcaacuguucagugugcagauaaaaacagaauaaagaaaauguuuagaccuaaauggaaaaucugugucacaccccucccacaaaguuucaagaaucaucaauaguguaagagccagagguagaaguggaugaguaugaagaaauaguguuuuccagacucgauagaacaaaugcacauuugaacuuacaguaauuaugccagcaugugcaagaccagugcaaacucaagacagacaaaaauccuagcuugcaggggaacugggaucaguacaaagucccaccccuagcugaggggcuauuggcauuugauaacuucagaaagagcuuuguuuucuuuagaaaaaaacaaaaaguuugcuuucuuuaauagugugacccauaaguaaaugagcuacacucuagggcaggucuugcacaugggcuaugcaaauugaaaaugaugacuuaaaggaggaggaagaggaggaagcagcagcagaggcagcaaaguugggugcuuagagagguaugugcauagaucugggaagagguuggagaggaaauauauuaaaauuguaugaaauccucaaagcauuaauuaaauauuuuugaguauguucccacaaacagauuuuuaagaccaagcacuaacagggaaccuuuuucuaucuaauuuuggaugggugguugucaagggaauaagccagagaaguguuuaauauauaaauauuaucauuguguuaaaauuagcaacaauacaaacuccagcuugagaggggugauuguuccauggggagcaacuguuuuuaggaauucuugcccuuaaugauuacccauuuccaaacaguagugagaauauccugcuucguagagugcagcccaaacuagaaguccaauuauaguauuacuagcuaguuaucugacuuugagaaaaaucacuuaucucccuggaccaguuuccuuauuuguaaucuaggugaaauauaugaaaauuaaauauuacacauuauauauuauauauauauacauauauauauacauauauauacacacacacacaaauauauauacauuuccuugacauguaguauaguaaagaaagcauguaguauauucuucuugacaguuuuucauuuuguuuuugcaucaugucccucugagcaggugugaaguucuacuuguggcuuugauuugcauuuccccaauuacuaauuauguugaacagcuuuucauuugugcuuauggucauuuuuaugccaucuuuggggaaauaucuguuuagaauuuaggcucaguucugaauugggacacuuaucuuucuagcauucaauaauaaauacugucuuuuauaacauagauacaaaaacuuaucugauaaaugguuugccaacauuucucacaauagcuucagucuuauauuuguucauuguuuuguuauagcuaugucauuuuuaaugcauaauccaccaccuaucccuuucuuugucauuagcauagaagagugugaauuuagcauagaagaauuugaauuuuucacugcccucaaaguuuacaccauucuuucauauauugugguucuuauuccucuuucuucucccuagaauguccuuuccuuucuuuauucuguuuacuuauuucuauucauucauaaugacucaucuuaaaugguacauuuuggcaacaugcuucuacuuuugcuuuuggggguauuuuuuacauauauuuaucagacacauaaaacaugaaauuauacauaguaauuagugguauuauugcuacaugauagguuuauaauguuuaaauaaaauuaauuaugucucuucaaauauuuaccauuucuuucugguaaaaagguuuuuaaauccuuccuucuagcuuuucaaacuuugucauaaaugcuuguuaucuauacauacccugcuaggcaauagcacaccaaaacucuuuauuucuaucuaacugcagcuuaacaaccauugauauguuucuccuauuuaaguuauuguaugacuaaagcaacuaccagcuucuacuauauccauauaauucagcccuugaggaaugucagcucuugggaggauuuuccagaccuuguauuuaaauguucuuuuuguaugccuuguguuguagugcugguguacaugaguauucuccaucaauauccagcuuugauuuuuuuuuuuuaguguucucuaucauuaaauaaggcaaugcaaauaaagagcuuagcuucguacuuggcauagaggauccacucagugccuguuuugcuguucuuaugaguauuauuuaugggaugaauaaauuuagauggcaguuugagauguauuuauguauagccuugccucauugaugccugaaaauagaucaugagacagaaauggcaagcauugucauaaccaccuuguaugaagggauacugaaugucacagaaguuaggaggccugccaagauucaaauacccauuuagaugacacauaauugagccagguuuucugaaucuauacacauauuuauagucuaauuuuguuguaaaccauuuuaccuuuugaaauucaaucucuuacaauuaauuggugaucauuagccaugauuuuaaaaacauaucaguagaagcuaacaauuuauacaaugauauaguaaauuuuauucuucauagaaauaguaauauuacacagauuauuuccuucuuugccuguucuucucuuccucuaccaaaaaaaaaauaugauuugguauuuggaagcccuguucuuaggacaaggaaggcauaacaaggguaccaugcucuagcugguagcuauacaugcuuguugcugaacacuucuuuuauugaauagaaacaacuuucuggauauugucuauaguuacuuaaacccauaaaaaaauuaaaaaugccucucuguucugaccauugagccucccauccuagugacuauuauacugaucuucccauguuuuuguccacuuuagcuauuuucuccacuuaguuuuagugcuaaagucacuguaauauauuaucuuauaaccuuccauuauuaccuagcuaguagaauguuuaaaguaggguuguuuaaaaagauuaggcaaaguaaugugucuugcuuucuacugguuuagugucaugguauguuuaguuuaaaguaaauguuuggguuguugaucauggcaguuuuauuuuuuauuacaagccuuaggcauagagguugcauuguaaguguaucauuugggggagcacauccauggucaguuguuguaugccuuuugaccacuucuggaucucugcaauaauaaugaguaagagcuacacuuaacugaauacaauuagaaauuauauugguuuagaaaauaaccauaguugucuuugcucuaagaucuguaaccacaccagccauggguaguuggcuggguuucuggcaccaggcgugaauuuccuccuauugagucgguuguaaguccagguagacagcuauuguuuacccaaugaaauaagugccauuauugcaccaauguugagccagucucugggucuagcuacuugaccuuagcuagaucagguugacugauaugguuauaucaucuauacccuuacugguuucuaucauaguuuaaggccaacaagggagucagaaucgaaaucuauaacuacaagggugaaccucuuuuguucucucucucucucucucucucucucucucugguuauucuaguuugggccucauguauauugaaacucugcacuuacaaaacagaaacauuuaaugauaucuauauacucuuguuuaauuaaugucuguaucauaaaaugauucacauucucccuugcaaauuagucuuuguucugaagucuguuugauacuauauugaugccagcuguguuuuaguuacuaucaacucaguguauuuuacuaucuucuuacuuuuuacuuuauaaauuagaacacacagugaaugugaauuuuuuuuaccuuaauguacuuguguaagcauuguaaauaugucauuucauuuaaucuuuacaauuaugcugacauagaaugauuacaugacuacaccuuguuuuucauuaccucuaggugguuccaucuccucacucuugggaacuacaaucuauuuucuguuacuuuguuuaugcaaaagaacccccaaauauaauauaaccuguaagauacugagauugacuucuuuuauauagucuagucuuuuugacccauguacuuugucauguauauuaauaaucuguuccuuuuuaaauucuugaacaauuuuucacaguacgacacuuugugguaucucuugguuguacaacuucauauugaccauuuucccaguaguuuccacuuaucaggacugucuccaugaucuaaaagcuggggcuuuauucucuccugugauacauauacauacaacaacuacacccaugucuugauccugauauagaggauaaaaaaagugagcacuuaccacaugggcuagcaugcaaaucaucauacaaaaagacagcugcuucuuccuugguauuuuaggcacugccaugaaacacuagaugacuacuugcaggaagcaugauugcucaaguccuugccuugccuuggucuacuagcugguggaguuuggggaagaaggggcaugagaaggcaucucuccaaggauaucucccuaaucaucuuggucuuuccaaauugaguuuuguugggguuccuaugcugucccucuuuccaggcagcauguuguaacaauuaaagauccaucuaauuuguuuccuaaauuuuuacagauacugcccuuuuggucuauuuuucauauauguugucuugguuuaagguguuucuaaagguaacaugaagaaaaaugcagcuaguuugccuucucuggaaacaaaaauuuauaagcuaaacuugaaugcuaaauauugagagccagaacaagguugucuaauuauuuuagaggagauuugauugcuaauaguuuguaucucaagagggucaaauuuaaauuaggcuuugaaggagggaagccauccaugugaagaauaauggcagaaauaaaaggucauaugauugguugcaguacauagggucauaaaaguuauggguguauaguuggguuaaagccaaacuugagaagucuuugaaaagcaguaguuggacacauaauaauagagagccauuagauguuuugaaaguacaagccauguuacauaauggcaauagcguuuaguacuaauauaaacuuuuauuauuuccagccuauguaucucuuuuaacuuaagugcaucucuucuuuucuguccucugaaucacaugaggggcagccucauaaaagugaagcucauuuuguuuugaucaaaucugugacaucuccuuaaacucauuacuuaaccuuuccuucuucgguucuuaaaaucuuccauccuuguuuggacaauacauuuuccaucaauaacuuuuauuguucuuguaaagaugagcuuccuguuuuugcgcauucuucuugggaaauuauagucaucacauuaguuaugcuacuaaauucuuuguaaugcauaaauaaguagaaauauuugcuuaucucauuaucuuuaauaccauacuauacaucagaguugccuuuugcaugaugaucauacauuuuauuugagugcuguugcuauccaaccaacuuuuaaauguuauuguugcuuauuuugauauuauaauuucauaggaucaacucauccuucccuuuuauacaauaauuaugacauuuguuagaugaauauaucuaauucuuuuaggguauuuauguaugugccucuuuuucauaauauuugaaccuuugcuacauugauuaaauuuaaugucaggaagguaaaaacaucauaguccuuucuugccccaaaagaauauagaagauauauagaaauauauagggagauuuauaggagaaaaaguaaauauguagaaguugaagacaaagauguuucucuuacaugagaaccaagacccagcagaaaugcacuaacagagaagagaagugcugagacagaaaagagaauugaaaucaaggaagcaaguuugaggacacccuuaaaaguuagcuagagguuaaacaauguccaucaaacugaacuuuuuauguguagagggaaaccuaaguucauagaaauuauauaaaggaaaugaguauaaagucggugagagaaaauuauuuuuguaaugaaaggguacucuuuguacaugaucucuaauaucuuuucuagaguuaaugagaagaaaagauagugagauaauugugauagaaugcagagaacagauuauuccauuccaacacccaauugguacaguugcaugaccaccccuaaaaggcucagggaaaaauaacaaaagagaggauaggaagguuguaagagcuacagaacuuaggcgucugcuucaagauagugucuucucucucaaagggacagaaguuacacccaugaaucucaacaauacagcugccuaaacaagaccugcauaauaacagcaucaguugacauuccaguguaggugggggaauucucacaaggucucaugucuagaugaauaaauauaagcaaucacuggaugcugggagagagagacuuagucuuuccacagacaggcccucugauagauacaaacccaagugguacagccccaaacaccaggauuguucuaaauguacucaguagugugagugugugugugugugugugugugugugugugugugugaguguauguguguguguuaagagaaagcggguaggggaaaaacaagggaggaaauggguuaaccaugaugcaaauccagcacuuggauaugaaauccucaaaauugagaguuaaaaagaaaagagugagaaugagaacaaaaaauagauguauugaaggcagauucaaaggccuuuuacgauacuaacuuguacuaagaaaggguugaguuuuucaugguagugugagugaaugccaaaugauuuacuuugugaugaggaugaggucucuugauaucuuagcuaagcugagcuguccagauauuaaggaaugugaccuuccuuccauaggaaguucauuguugcaucaauuguaauuucaaauguuguaagaccaucaaagugccgugguauguacugaaaugggauagaauauaguuugucuuugcacacugagauacaaagcucuucauuguuauauaggcaugugccacuacaccaggauuuauccuuaugugucuugacuuuuaaaaaauguacauuuauaaccuuuuuucuucaaauuuauuugaugaagaaaggguaagcauuggauccaaacuuuucuccuuaaacacuggauuaauucuauuuuuuuuucuaauuuucaaccuuuacaauucuuucacaagcaaggacuuuaaacacauucuaauuguuuucuuaagaaaagcuagguuucuaguuccugguuaauaggacaaaaagcuaguguucuccccaccacgcuuacaugauguuaaaguacuauuuguuagcuucugaaugaaguagggcuguccuaacuugaacauuuugaccaaggauaugcaaaaaccuuggugaauucaaaaguacuguuccccaaacuuccugggcugcuucucagcugagugacagucuuaucacuacagcaguagugauaagcauucagugcuuauggaugggcacucacugaauuuuaaaggcauaugccauagacuuacugcacauuuuacuccuuaaacaaauaguaagugucaguuccugucuuaagaauuagaauacuuucuccaaguggacauugcuuuggcaaaaugcauugcuauucuuuuauaucugcauuucugaauaagaaaggcaaggaaugaguugcagauguuugguuuaauaguguuuauauuggcaaaggacagggcuguuuaugaaaaguuuuguaacugugagcaaaaacaugcaauucauuuguggagauacacaaauauguccuucuguucuaaaguauacauauaacaugugaauauuuuucucucccuagaggagcaaugauuggaucagauaaccucucugaaguuucaauucuauuaaaccacauauuuacuuucaaaaguaacuuuaaaauuauaaugggaaguuuauauugugguuuauauuauaccuauggguagaaucaauauuuucagaauuguauucuuaguaaauuauaccuuuuuugguucuuaaguuguuucuuaaaucucugaaacaugacuuuauuugaggcuuugaaaucaaguaaucauuuauaucuguucguacuguuauuuauaucuguuagcuuacuauaaucuuagagcgugauuuauaucacuuucuaucacccguuuuguuuuauaaugaaacguuucuuugaaaguacagauugagccugucacagucuuucuuuuugcuucauuaucuacuuccauaucccuuuuagcaguuguuuaugacucuguucauuauuuuuaauaaaguaaguuauuucauucaucuuguaaaacaugugugauacacauacauuguggaaauugacuauugaaaucaaagcauuucauucuccuaagaguagagacagggaguagaggcaacugcccugguugcagggcaccugaaggaguuaaccaacaauacucuucucccuggggccuguccuuccuaugcacuguaggggccagccuguucauucugugcuaauccuuuaagccuuuggagacaaugaagucuccuauugaaacucccuacacuccuuuuaucaaagauaauuaaaucuuugacuugaaagauaauuggccaaacagcagcagcaguaagcugaguauuggaauauuuaaaguauaauccuuaauucucugagaggguaaacaauucagaugauaaaaugaaccccagucuugcacuugauacagauaaauacccucucccuuucugucucaaggggggaaaagucaucaaaaugcaaaauaaucuauuaaaguucuacagcacuacuauccaugugauuauggaaagcaauucuggaaggucgaaguuuuuuauuucaugugugggaaaaauagaaguguaaauggucaucuuuuuuuccuccaauuagggaaaauaaaugucccaguaagugauuucaacaugcuuacccuauuuguuccuaauguaaauuagccuuaguagucuauuguuucauguaguuaaaucuauagauaaauaaacaaagcaguguuuuuuuuguuucuuucuuucuuuuugagaacucuuuuggcucuguuuucaaaauacccuagauguaugagcuuguaagcauaaguuuagcacagagagauuguacacguuuucuccauuccuuacucaacuuguaugcuuguuacagggcuuugaccagcuucggcuugauggauugcuuugugaugugacacugaugccaggugauacagaugaugcuuacccugugcacagagucaugauggcaucugcuagugacuacuucaaagcuauguucacagguagguuggcuuuugacacucuguguucacauuaauaaacugggggacaucuguguguguacguaugcauauaucuaauauauaacacacauacaauauauauguaauauauaauuccaaacacaaaauccaguauuuugcuuuuugucauucuaaaaaaacacuuucaaaagaaauagucacuaaucuguguaguuguguguggugcuauuuaaaucauguuuucuaccaucuguucuacuucauagacuuuuaaaaaauaucugaguggacaaucacagacucugugcuucuauaauauggucuuuaauccaucaaacgauaugaaaugacagaccauuugaaagcgcuuguauuauauaugaucuccauuaguauggauagaauugcuucaaguguccuuuuagcuguaaaaauguacaaaagcaaaaguguggaauggaugcuuacuuggaauaagacuuucccuugguuuugcugcaucuaauuacuggcagaaccaagccugaccuuaaugauccaccuccacuuaauugacuaacuuuucacuuaagguggaaugaaagaacaagagcugaugugcauuaagcuucauggcgugagcagagugggucuacggaaaauuauugauuucaucuauacugcaaagcuuucucuuaacauggacacccuucaggauacgcuggaagccgccagcuuucuucagauucuuccgguuuuagacuucugcaaaguguuucucauaucugggguaagauguuguuauauuuuauuuuucuugucauacauguucauuuagaguuagagaccggcuuaauuguauagucauguaauacucaucaucagaaaaagaugcuguauaacacgugguguagaaauuaaugggaaauaaaaccagugaauuuuauaaaguggaaucauucaacaaaauccuuuucuauagucagaugauguggaauacuaauuauauuugauaaauguauguaccuuaacuuguuaaauaauucauauacuuuaacuuagauuuaguucauugauuuuauacacuugacuuaauuuuauauaguagacuucuuguauagaauugcauagaaaaguaauuugagcuucuagcguucuguuuaaacaggcuuggcuguuuuuuuuuuuuuucccuucuuugaauauggggacucaaucuuaagaacuagcaguuaagugcaaacuugcaaagaugugaaucuuuagucuuuagaacauauuacgcugaagagugguuagcucuauaucaacuaaucaaugaacuggauaacaguuacucuguuccuacagauacugauuuauuuuagucaagacccuuaguuuuacuucagaaaacucucuggcucauucagagauaacaagauuucuauaguuccuggggccugauuuugugauuacaauuaaaauaauagugaaguguuauguacuagcuaguucacucuuugauagauaauauauuuuccuauaguugguuauaacugucaacuuuaauauuaguaauuugcuccuuggccucuuaagacuuuugaacaugaacucuuccuuaaaacacuaaauuuugggaaaacaucaccuaauuucuauauuaauaagaugcuccuuaucaacaagugaaucaauaacaaaaauguaaguacacaauagaaugaugaaaagaauguauuccuaucauuuacaguuaacaaggauaagcuuagaguauauuauauugagugaaauaagucauacacauaggaaaauuuguucacacuuauaugaggaauauagugguuaccagacuccagggaaugucguguuaaauaagguuuauggagaaacugguuaguagguacaaaaauagaguuacauaggaguauucugguauucuauaauagcaaagcagaaugacuauuucuaauaauguuucauauauuucaaaauagcuauaaaagaauauuuuaaauguuguuauaaugaagaaauuaugaaugguuaagaucaugcauaugcuaauuaaucuaauuauuaugcagcauacauauacauauauacauauacauauauaaacaucacuauguaccaguaaauuuguauaaguaauauaugagucaauucaaauuaaaauaaaaauuuaagcauauuaaaaaggaacaauuaaaauuacaagcuuuauaagucugccaaugcucauuuaauuauacuauugaaaucuguuuuuaauauauuucuuaccauuuuagaguacucaaaugauuaucauaauuacuuguaaaauuuucaguuaauugcuauuuuauaagguuuuaugacaauauggagauauauuauugacuuguaucauuacuaccaaauaguguaaaugaaguuuauuaaucucucaugggacuguuugccaacauuacuaaaucuguauacuaaauuucauuuuaaucuuuuuaugccaaucccauaguguuaacaacuauuuucccguagcuucuuguuacuaacaccaugugacagcuucaaguaaacugcgauuguauugaauguauuuucacaauuucacaaguucaagaauuaauuuuguaguagccuuuacaucuuauguuugcagacccuuuuauaucacuucccgcugagcuuagcaacacauacucaccuugaagccaacuagggaaagugcuaugauuucuucagagauagugcuuaacaagaagcauauugaccuauuaucuaacaaaaguuucauguuuauaacuucagauauuuucaucaauuacuuuuucugaaagaagauggccaaauuuagugugugugugugugugugugugugugugugugugugcacgugugagagacagagagagacagacagacagacggagacagagagacagagagagagagagacagagacagacagagacagacacagagacacagagauaauguguauauauuuuuauauguacauacauuuuugagacagggucucacuuggcugaccuauaaggcucaguuuagaccaggcuaggcuggcuucacaugcaacagagaucugccucugccuccuaagugcugggauuaaaagcaugaacuaccacauucaacuauauuuaacauuacuauauuccuauaagauuaguacagaugaauuuuucaaaauaacuauuuaaaaacagcuuuauuuagagauggaaugauagugauuuuauauguuugaacauuuccaguaauucagaaguuauguguuugaaauacuuacuguaccuaaggcuuauaacauugagaugccuucauuaucaugaacacuuaauauucuuuccaagauuauguuacucauuccuuuuuuuguuuuguuuuguuuuuugcuuuuucaagacaggguuucucuguauagcccuggcuguccuggaacucacucuguagaccaggcuggccucgaacucagaaaucggccugccacugccucccgagugcugggauuaaaggcgugcgccaccacgccuggcucauguuauucauucuuuuuuuuaaauuaauauauuuuuauuacauauuuuccucaauuacauuuccaaugcuaucccaaaagucccccauacccucccccccacuucccuacccacucauucccauuuuuuuuggcccuggcguuccccuggggcauauacaguuugcauguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugauccauccaauagcuggcugugaucauccacuucuguguuugcuaggccccggcauagucucacaagagacagcuacaucuggguccuuucgauaaaaucuugcuaguguaugcaauggugucagcguuuggaagcugauuaugggguggaucccuggauauggcagucucuacaugguccauccuuucgucacagcuccaaacuuugucucuguaacuccuuccauggguguuuuguucccaauagcuucagcagacaagcugccuccuauguacugaggaagcuucauauuagccauauuuacuugugcuacaguucauucuuuggccacuucgcagauuuucuugccugugaacuucuaguaaaugcaacuuuuucugaacaucauucuaccuuguuuauaauuccucuugcuuacucugaugugucugugugcuuuuuugguaggaaucuccucccucgcauucuuugaacuuauauauuagaaaauuaguagauuguuagucccaggaucuuuguuuuuuugguuuuguuuuguuuuguuuuccugauguuucuuaguggaaccacuauuuagcuuuaaauuauuucucgcuucucagcaaguaaaagugaaauaagaaaaacaauauucugguggggcuuuucuacuuagaacuucaaguuucaagauacuaugacuauuuuacauaggaggguauuuuucuuuucccuauuuccugagcuaagcuauuauagguaauauuuuuauuaaaaugauccuauauuuuaaaaacugugcugaaacaaaaugcuuaggcugaaauauugaaguuauugcucaaauaacugaagcacuaaucaaauuggagcuucgaaaagaaacauugcuucuaauucuuuuuuuuuaauuuauuuuuauuagguauuuuccucguuuacauuuucagugcuaucccaaaagucccccauacccaccguccccaauccccuacccacccacuuccccuuuuuggcccuggcguuccccuguacuagggcauauaaaguuugcaaguccaaugggccucucuuugcagugauggccgacuaggccaucuuuugauacauaugcagcuagagacaagagcuccaggguacugguuaguucauauuguuccaccucuaggguugcagaucccuuuagcuccuuggguacuuucucuagcucuuccauuaggggccgugugauccauccaauagcugacugugagcugcuucuaauucuuaaucaugcaaguagaugaagaaugguggcuaguaaaaugugaauuggcaaaacgagauccagaaagaauuuaugcagcaguuuuaaaugauagcuuuaaauauaacaaauucacuuucguguuagaauuccaccuuugcguaacagagccuggggcucaauagaagaaaaucaaccucugucuaauuucaucauccuuuaagauuauuguuuuucucuuaggguaauaauuaggauuauauuuuaugggaucuggcaauuuuguuauuguuguaucauuuucuuuguuguuauaggaaagagaacacugaaaugaacauaaacuacugaugauuaagucuauaaaucagaauaguuaaaauuauuuauaaaguuaaaaaacauaucuuuauauguugaaaagguaaugggaaauugucuuguuuuuaauuacauacuuuaaagauauuacguuagggcuuuugagccuacuccugucccaggccucuagcauacucuuguucucuucuuuaauaagcugucuucauuucuaucacuaaaaaauaaaaguaaagggcuggagaaauagcuuacugguuaagagccccagcuggucuuccagcacaaccaauguaacugcaguuccaggggauuucuucuggccucaacaggaacaacacaugcauacagugugcauacauacauucauguaaaacacacacauuuguguaacacacacacgacacaaaucuuuugaauaaaacaauuuaauuaguucuuugucucuaugacaucauaucacuauaauauuuuguagcaauuccucaauuuacaaacagacuuagaucaagauuuucauucauuuaauuuuuuuaguuugaaauauuugucauguacuauuuucucugcaaaguuaauuaugaauaauaauaauaauaagcuuauccacaauauaaaccuguucaauacuagguugcugaaauaggauacuuggaauugaugaaaauauauaguguauaaauguugggaauauacagugcagaauaaauaauuuucuuuauuuuauauaugcauauuaaguacaauauguuucaauuucaccucccacauauaauaggaaacaaauauuugucuuucuuuggcuuguuucacuuuacacaauauucuccaggaucauugcuuucuucaucuguccaucuguugauguacauauaugcugauucccuaucauggcuauuguguauagugcuguaguacaaaaaaaugaccaugcaucucugugguauguaacauagauugccuuggguauauaguuggucuuuaaagaaacuuccaucuuuagauucugaaacauaucuacagugacuucugggguaguggaacuaguuacuguauacucccaccaguagucuucgaguuccuguccucaucccaccccauccuugccaacauuuguugucauuuguuuuccuguuugcuauccugaguagguugagauagaaucuugagguaguuuuguuauugaacuugggguuacaucuugugcccaaaacuagguauggccacaggucuucaaucguuaaacuaaaaugaaaaggagauuuauucaauguagccacauugggaaugagacaaagagaucccucaagucuccccaccccaagucucacuuaaauagagggcacauuuauguagucccaaucaauguagccuuuugauccaugguuaucuggucuucagucuuuuuccuggacuuaaauuccccuuccuucucaggcuuuuguuuucucccagcaugagauuccaggagaaauuuccauuuggggaggggggcggggucuguuguuucaaaaaucugauagauugagaaacauaaauggcucuuuagaguaucuuguuuucucuuggaccuguaacaguuuuauuugcauuccucugauggcuaaaaauguuguuggauauauuuauugauuucagcuaagaauguugaaaauugcuugauauauuuauccaucauuuguacaucuuuagaccuuuugucuauaauuggauuuguucuuuaguuguuuuauacauauuuuaauuaucccuuuguucuuacccgaauguucuuuaacuuuugucuucaaauguguucugugccuaugcagggauucuggcuagaaauguguguuacaucuucugcucccauuuuuaauugcuugauugcauaugcuucuauuuuucaaguugguugaacucgucuuugggcuggguuucauauaaacuagaaagcacuaagucgaauuuaauguguggagugggugauguagaagaagcugaagugauagaauugguauuauaaaagacuuacuaauacauuugcucaggaaacauuaagucacacaaguggaauuuagccuccaaaauaccccaaagauaaauggcaugcuuaacgggcauguuagagaguuacaaaauuuaggaugcugggauguguauguuuacucauuggaauugauaggccuugaucagccauuaggcuuugguucuuauaacaaaagagauagcacugacuugaaaccagccauuagaaagacauaccucuaagggacagcuggggcagacaggcaggauaagguuaaaccaccauuaaguaaguccaggucugccauuaauccuuuguucucuuaccaggaaaauacuauucuuccugguaaguaagaugauuccccaguaacaauuguuucuaaaagaauaacacuggaauacuuaaaauaauuuuggcaguauucaaaaucuugguuguguauaucugcuaagggcccagacuuauaguaucuauuuaaauuguucgaguuccaucugggauuagaacccaaaaagagauuuaagaaugacagcaucauauauaaaacacauaagccuaagguguuuaaaaucuaaugaaaucuuuugggugucaacucuuauuuggauauuagccacagucaaccagaaguuuucuuuaguaaagagcuuuacuucaucucuaaguguguggagcaaauucucacugagcagguauauuauuucuauaaugugguugagggcuaguugaaauuuucagauuuguuuuuguuuguuuguuuguuuguuuguuuguuuguuuuagucucugcuuuuucccuugcaaguauaaaagcaggcauuuguuuguuuaaucuguuccaggaucucuuuguauauaacacuauuucuuuaaaaaaauaauaccagagauuucuaaucaaauguuccauugaaucauuaaauuauauuuaugaagguauuugggugcaggcaaaauucauuugaaucugcagcagcaauaaggacuaacauguuaaugaaaacacaaguagcaaaauuauagcgugugaacuggcuuucaaauggcuugaaaguuugaauuaaaaaaauaauaauauaugucaaagaaauaaaaguaaaauuuugaagaacaauuuuagaaaugccucgaugugggugaugaauuucucuuguuuuauuguucagucuuuuuaaaauguagaagauuuauaugaucuaaagagaagccacaguguuugcagaccuuuuaaaugaaguaauacugucuggacucacuucuguuguaaaucuguucucauauguaauuacuuggggauucuagccagacuuucagaugaaauuugauagauugggaugaaauuagaauuauuucuacuugaagacuucuuaagauaaucuuuaaguauaauugaaaguauaaagugcucucucauauguaaauuauauaacauggcauugccuguauucaguucuaacauacuaccugauauaaacaucugaagauugucuaccugagacguuacuaggaauugggacugagcagugaacgagaauaaagguguccugaaauuugguaaaauuauuuccuguuugccaucagcuuuagucgguuuaauuugucaacuguucucugagacuucaacuuuuaacccuguauucuaaaauuaccugaugaaaauuaauuucccaauacacacuuccccuguguuccauguauuauuuauaagguccuaguaauuuucugcccuaauaaguacuacauucuguuacugcaucuugaauauuuguaauacugauuuuaguagaucuuaacuuugcuuguaugcccacaguguagugucuguaguauagaggcuauagaaaauaguccuuuuauaaagaagaugacaauuuaaaagauaaucaaaaacucucuagcguuauuuucaaggugggaguuauuuguauugaguagguguuccauccaagucuuuuccagcccuuugcaucuguguauauggauuacugauagcuagaagauaaucuccaaaugcccauauguaaaagguaguuguuuuuuuucuccugacauauuaguaauguuuaucuaauuggauauuauugaagacaggggcaggguaguggaagagaauaaaauauccuaaucuuguuucuuuauuaucauuauuagcauuauagucaucaucauuaguuuuugagacauggucuaacuccacccuaggcuggccucaaacucauggcaauccuacuagucgacagauaugcauguaguaggauuauaguugcauacugggaugccaggcucugcuaaccacuuauguuagcaucuuguuuuuuaaaucuugauuguugggccauuuuauuucuauucagauguuuucauuucauccuuguucaggagauggggaucucacuuuguagcucaggcuaaccaugagcuugugagcaaccuacuucuauuucucagaugcuagaaucacaggcauauaccaucacacuccacaugcaauaaauuuagauuuaauuuguaucuaacuaauuuguaauagcuggugaucuuaauugcccauucuuuguugcuuuugcuaguagucauauaauaaugacagaaauggucaucuuugacaguuuugugcuaucauaaauacucgcuuaucccuacuaguaaauauuuccaacagcaaaauuaccuuuacuuuuuacuugcuaggaaagcagacucaucacccuaaauaauaaugccuuccaacuaguaccaucuggguaaucaaauauggcuaugacucuauucuaugugacugaagguuuuuugacacaucaaucugccaguucuaaaauaggauuaaaauacauuuaguauuaaaaaucaaagguauugguacauuauuaguccgugcauuucuagagaaccagaauuuauuuuccuuauuuucugcuaguuuauuuuagguguuuuaaauauauaacuaucaaauaaaguaagcagugagacauuuugaugauuuuuuuuuuuuuauaaucagcaaaucaguuuucuuaggggaaacauugccaucaguucucuacacacugcugaacacucuaggcucaaauagauagcucaaaacccaugcucacacagaagccccugguaaaccccaggccuuuguuaaacuccacaagccacaaaaagauuuguggagagacagcaggaguugacagggguaacaagaagauaagagagguuggaaggagaguuaucaaugugaauugaguacauguaggaaacuugagugacaacagauuuuaauuaauuaaaaacaaguuauuaaaauuaaauagaacaaauaacagaaaaaagugcaaacuguuuuugagaaauauaucuauggacauauuuguuggccagucuuacaguuuuuacuguuauaauaucuaacugaguuguuauuuuaugcaaaggaauaaugcuuuuagcuuuuguuuucaauaguggggguggaacuaauggcuuuugcaugccagacaaacagccuaccagugagcuacaucucuagcccuucauuucaucuuucaagucaaacaucaauagaaggauuauucaguuuucucuuaaccauaaacacaugacuuagcauugcaguuauggaguuaacaaugcauugaugaauuuuauguuacacguuguuaauacacuaugacauaaguuaagaaacacacacauugagccuuuuuccugucuuuguguuguaugcacacauggaaguauuuguguggugggcuuguuuuaugguuuuaucuuguauuauguuugcugauuuuauuuuccuguuucucauuuugaccuaucuguuauuaaaacauugcaaagugcuccugccuaggaaggaagggccacuugaaucacuuccccccuuuguucacuuucuacuuuagggcauauuuaaguuuguucuaggaacguuauugugggcucauuucaauuaucacuagugcuagaguguguuaguacuaacagaaaaacuaaggaaaguuacacugccaagguaugaacaauagaucccccaaauucauccuguauggguuuuaauauagauacauucuucccgccaucaacacauucucuaacuuacauuucuggauaaauauauguaaaauaauuuuguacaagaaacaacuaugcuauuaacucauuucuuauaaacacuaacuuugagaagaauccauaugaagaauaguaacaaaugacaccucuauagaaaaauggaagucaaagaauuagauaguagacauuuuuucuguuuugugaccugcuaauuuuaugugcuauuuugaacaaccaagaagaagaaguugacuugacuguaauugaauaacauacaauuuuuccuaaauuuuucaucuagcaauuauuucauuaguauuuagguagguaauuuccgaggaagaaaaaauuauuuuggacauagucaauugaaauguugucuuagguuaagagcuuuuugguuuuguuuagccaucauuuuuugcugaaccaggugaagguuuuuuguaucgucuuuacacuuuuauacacuuaaauaagaauuuuuauucacacuucuauggauuuuacaaagcauucuuccucugaaauaagaguuuuugugaucaaaauguagauguccagaauuuucuuguuuucauguuugaauuuuuuuauuggauucguaggucacuuuggauaacuguguugaaguuggacggauugccaacaccuaccaucugacagaaguggauaaauaugucaacagcuucgucuuaaagaauuuugcugcauugcugagcacuggggaguuccugaagcuucccuucgagcgccuugccuuuguccuguccagcaacagccuuaagcgcugcaccgaacuugaccucuucaaagcuaccugucgcuggcuucgccuggaagaaccuagaauggacguugcugcaaaacuaaugaagaauauacgauuuccgcugaugacaccacaggagcucauuaauuaugugcaaaccguggauuucaugagaacugacaauacuugcgucaauuugcuucuggaagccagcaauuaccaaaugaugccguuuaugcagccaguuaugcagucagacaggacugccauucggucugacaccacucguuugguuacacucggaggaguccugagacagcagcuugucgucaguaaagaauugcgcauguaugaugaaaagacccacgaguggaaaucucuagcccccauggaugccccaagauaccagcauggcauugcugucaucggaaauuuucucuacguuguuggugggcagaguaauuaugacacaaaaggaaaaaccgccgucgauacaguguuuagauuugauccucgauacaacaaauggauccaaguugcaucuuuaaaugaaaagcgcaccuucuuccaccuaagugcccucaaaggauuucuguaugcaguugguggacgaaaugcagcuggagaacuccguaagucuuucuacuuauacuauauauaggauuuuuuuuaauucagaaauuuguuguugguaacaaaaaaaauuuagggauaaaaauaugccuagggcuuccuuuguaaacuauuuuucuaagaaaauaucaaagauaaucuguaugauuuauuucugcauaaaauauuagccaugauccaaacuauaacuaauauauaguuugcugaauuugaacagcuauauaauuuucauauugaaagaucaauuggaauauauauucaaguaauuuauauucuaauagagucugauagaaguuugacaucauucuucauucuccacuauuaaaaacccacaagcugccuggcagugauggcacaugccuuuaaucccagcacucgggaggcagauuccugagguccaggacagccagggauacacagagaaauccugucucgaaaaaaaaaaauccacaagcuaugcuacuuaaaauccuucuuuacaaaggcuugguucuucuuauuuccucauuuccagaauugauaucuaauagugaccacacaguaagaugauauucuucuuguagucaacguacaguucauccaguauuagacacaguuuguuaacuaugaaaauuaagaucucugacuauuagauuucaaaauuacucuuacugaaacaucagacagguuucaccaugguauacuucuuuugucuuccuaauuaaacauuggucaugaauguauuuuaacagaaauauuuugucucuacauaaaucaaucccauaaggucuauuuuagauuaagugugaauaauauauuuuuaauauaauggauguuagggauacuucauuuuauaucuaucaccacuauuauuguuuagucuuuuuaaauuaccaacaauacauucuuuauuuggaaagucaugacuagacuagaaagagucauuguugguuugaaguuguaugauugauuuuuuucuguuaguuguuguuguugccauaccagugugggaucucaaauucagagcauuguauguggaagacgagcacgguacuacugugaaguauucuccagucacuagccuuaauuuaacacuuugguucuacauagaauccuugagauggccagugucucaaacucuuuaucaucuaucaugguauuaaauaaauuuaggauauuucucagaaucuuuuucuccuaguauuguaagaaauuugagacuuuaguagucuauuagauccagcuauuuauuggagagaagaacgacuuccccacuuuuuacuuuccuauguauagaacacuuucuuggccuuaauguuacuuaauguuacucaucaauguuacucaucauguuacucaucaauggguuuuguguguguguguguguguguguguguguguguguguaacuuucucuaacuagggguacuacuagacuaucacuaggccuaaugguacauaccugaauucuuugcgcuugacaggcugaggcagaggaaucuaaguucaaggccaaucugggccauguagugauaacucugacuuuaaaaagguuucacaaagguuaaccuaaggauagauaacuacuuuaaaauuuaucaucaucaucaucugccugagaugcuauugacugauuuuaaucuuauuucacaaaccacauuuuuuuacaacuguuugucugauugccguaaugaggcugcucuaauucuaauuauagaucacuucaugauauuucauuccauuuuaagagaucucccuuagcugggcauguuagugcacacauuuaauaccagacagaggcaagcagaucucuuguguuugaggccagccugauauacagagcaaguuccaggacaaccacaugugcacaaaaacuuugucucaaaaaaacagauagaaagcaaaggagagagaacuuccaucauguauaaaucacaaaauuaaaaccauucauaaauuuuuguaagaguugauuccuuccuuaauaguaucaccgucaaaaacaugguuuuuuuuuuuuuuuguuguuuuuuuuuguuuguuuguuuuuggguuuuuuuuuuuuuuuuuuggcuuuuucgagacaggguuucucuguguagcccuggcugaccuggcacucacuuuguagaccagacuggcgucgaacucagaaauccuccugccucugccucccaagugcugggauuaaaggcgugcaccaccacgcccgacuaaaaacauguuuuauuaaauaguuuaagguacaauauauagaauuuuuuaaaauuacaugauugacauacuaagugacucaaauugagagucuugauuccaagaaagacuucaggcuagaaagaaucauuguacaagacuaaaaucaagagacuucauucauuuucugacccuaacacggguugagguggagaguaugccaccuuaucuuagcauguugcauuccauuuuguugaggcagcaaaacuuguaaccauccuugauuucucuucccagugaacacagugaauucuucugaaucuuauccauuaauaaaugauuuuuuauauaaauccaaacagauuuuguauugguugcacuguguaguuuucugcccacauuguuuuugccgaauaaaaagaggucuauagaaagucauauauauauauauauauauauauauaugaaugaaugaauaugacugggguuuauuguuugguuuuuaaauuccccuuauauagacuugcuagcaucucuuccuauaaagaagcauccuuuuuugcuuuauuuuuccagagcugaggacugaacccagggccuugugcuugguaggcaacgcucuaccacugagcuaaauccccaaacccaaaacauccucuuuuuaacucauuagauuuccaugcucacaugccuauugaaauagagaaggugauggauagagcauggcaagaaacagggauuugauagggaaaaucucuuaauaauuuaacaguuucauugauugguuccaguacaucaugaaaucuucauauauacaauauccauuacucuuacauaguuauaaaaggaaaacagugacaaccuuuguaagacaugauauauuaauuuaauauacuggaccuuuucaaauuuucucauggaguauaugagggccuuaagggggaguagguaagucugcagcacauuuaaaacaaaaagagacugaagaccugcaugccugacuuauuucugcaauguaauucuuugggcauuuugcucucccugauacggguugcaacaggaaaauaagaaaaguguauaggagcugccacauuuuugcauuuuucagaagugucuuuugguucuucugcuuaaccuuuugaaaauguaguaucauuaugaaaucagccuuccauuguggguuucuauuuugaagaagacuauaauggcucagauccuuccagugcaauuauauaucaaauaaacaaguuuucaaaugauggaauagcagaaaaauguucaaauaaauagacagcaaaauugcuaaaauguauuaaaugaacccccauaaccuuuaauagaauugggguuuuguugauuaguaaacagauucuagaucuagaguaaguaccacauuaucucuaucuuuuuuuaaauuuauuuuuuguaugugaguacacuauagcugucuucacacacaccagaugagggcacuggaucccauuacauaugguuguaagccaccauguggaugcugggaauugaacucaggaccucgggaagagcagccaucuuaacugcugagccaucucuccagaccuugauaaaauaaucugaaaaaugaggaucccuuggacagaugaaauaagcauccuaauuauaguuaugaaaucaaaguucuacaccagagccucagagcacugaaguugagucucuaguuuaguagucagggaaauucuguaaagccucaaaaauucuagucauagcuuuugagguauuaauucaccguugcagcuaaugagccccucucuuguagaagaaaaguacauaaaguauuguagauaguccauaaacaaauaauugggccucagcuccaauaaaacuuuauuuaugaccacugaaauuguaauuucauauaauuuuuaugaugcagaauaguccuuugguugauuuuuuccaggcuuuaaauaaugcuaugccauucaucuugcuguaucguggggcagagagaaaugggcauggguuugggacacuggauuugacagggucugaaguugccuggcaccugcccugcauuucaccugguucuuacagcuguaaccaucacuuuagggcccaagccccuugccuugcgcugccuuugcccuccccugcuugucagauguaucaauagcaaucuguauuugauuauugcacaaaugugaaaaacagaaacaagaauguacacaucagauuuugaaucagcugcauuuucuuuuccuaaugaaugccauugauuucucuaauaaaaacagugggacacagacaaacuuuaaagcuugacaauaaagcuaagggaagugaaaaguauaaaggugauugaugacccgggaugcucaggguugaggagcucucauauagguagugagaugaauuuccaucuugcacugccagguuccugcaugggaaacuauggauagaucuuacaauuccuauuagagaaaagaaggcaauuaauguacuaauucaagaaugguauuaucuuuucauacagggaaauguuaacaaccaccaugauuagcucuucaaucucuaacuccaucauaaaaagaauaagaggaaaaugauggaaacugcaucuagacagguagauuagauauagaaaaggacaguuuagaauggagaaauuucaaaguucaaggggaaaaauguugcauuaagagaagcauauagcuacucaggucucuuuuuggcuugaacuauaugaaaaaaaugauaccuggaagucuuuuuuguaauucccuuucuguuacaaugugagguuagauugcuuuuucauagaaaguuuguccauuucuuacuuucuaauaucacaugccacucaguacauuaagucccucuguguaugagacaaaaaugggggagaaggaauaguguacaaucugucaggugacagauuuugcuugucagaugauagucaugcuaaaagcaacuagaaaaaaguauuuuauaaagcauugcaaaauaaaagcaauaucuacuugaaaugauagauauauuaauuauacugauuuggccaucauauauguauacacauaucagaacaucauacuguaugcuauaaauacaucauuauuauguacccauuaaaaacuccauagccucauauaggucaucaagagaauaaaucagaaugagaauaguaaaagauuuugaaauuaaaaaauaaacaugaaguacauggaaaaggaaaggacuagaaggauguaaauugcuaaugcauaggcaugaugggaggagcaagaguacuuggcauaagugaaccgauggaauauacgaaauuacuccauagaacacaaacaaaauugcuucucuaucgccauauuugcuugugcuuaauaaguagagaauguaauucaaagguacacucucaguuaggauugccuuuaaagcugcuaaaccuuagacuuucugcuuuaugucacugccuagagcuguauccuaaaguaaaaacuauaucauaaagcagauuuuauuuugagguugccaccaugcuucccugcauaguguugugguuuugucaguugaaaagacaggguugagggaaacaaagaauuugauaugcuuuugcaguaucuguaguaaaucugaaucuuucgaguccauccagacuucaugcuuccugccagucuucaguauaucugcuucuuucuuuaugaaaagaaacauuuuuuuuaaucugugugaauugcuauuguucugauauuguaguuuccaacaggguagauugaaagauacuuaaguaacugaggucacuuguccaaaguacuuuauguggaaggugacaaauugauuacugauaucauguccacuuaauaaaguaauuaacacauuauugccaaucaucuuuggguuaagaauggugguauugguuguagcaguugccauggugaaauguguaugaaauaaaccagccaguaauuauacccucagauucagcuguacaauagguuuuacagauagugauguuuguuccuguacgcuaugucaaaaauagguacucagaauugauguguuauucuuccuuugugauuuuuuuaucuuuuccuguauuuuuagagcaaagaaauuggagaaaugucaaaauaaaaagugaaaaacagaugguagaaaaaauucuuagugauuuuuacauuuguuuaauauuuuagaaauuuauauaaucuagccuaauauaauaucucuuaauguuucauuuuaauagucucaaaaacuauaagaugcccucuaaggacucauauuaagcauuuucagagauuaauuuaguaguauuauuauucuacuaaaauaaaauaaaacuugaaauuaaaauaugauugcauuucuuuucuuuuuguuuuucaacagcuacuguggaauguuacaauccgagaacaaaugaauggaccuauguugccaaaaugaaugaaccucacuauggccaugcuggaacuguguauggaggagugauguauauuucagguagacaaauacccugugaacuuaucauaauaauguuuauucauuuuuaauugauuuauguauucacuuuacauccucaucaaugccccuccuuccgaaugcuuucccauacccuacccuuuccucugagagaguggaggccuccccuagguaucucccacccugguacaucaagucccuguagagcuagaugcuucuucuccuacugaaugagaucuuuccauauagugccaguaauaauaacaauuccugggaaaauuguaaaaauauauuuauauuuucaggagacuuuuauguguguauuugugugugaauaauuugaguauucuguaaguuuacaaucuagcaccaaaccaauucaguuauagauguauaauguaugagaaguuagaaagcauuuaucuccaguuaauuuuuaauguaagucccaauacucuguauucuaguaaacacuauuuauacgaaguaaucauuuguuugacuuaaaauuuggcuaagccauauuaggaacuaaaacauacauacaaaucucuuuauguguaauucauuguauauaauguacauaacaaaacacgcauauuauuccuuuaguauuauaauauggauucaacuguggugccauuauaugcagagauauuuuauaugaaaauucuaggacagaucuuggaaacagaaacuacacagagacacagucaaacuaaagaacuuaugaaacaaauggauuuaacagauaucuauaaaacauuuuauccuaauacaaaaggauauaccuuuuucucagcaccucaugguaccuucuccaaaauuaaccauauaaucggucaccaaacaagacucaacagauaaaaaaacuauugaaauaaucccauggacccuaucagaucacaauggacuaagacugaucuucaauaacaacauaaauaaaagaaaccccacauacacuuggaagcugaacaacuaucuacucaauaauaacuugauaaaggaagaaauacagaaagaaauugaagacuuuuuagaguuuaauaaaaauaaagccacaacauacccaaacuuauggaacacaaugaaagcagucuuaagaggaaaauucauagcucugagugccaccaaaaagaaacuagagagagcacacacuagcagcuugacagcauaccuaaaagcucuagaacaaaaggaagcaaauucacccaagaggaguagacagcaggaaauaaucaaacucagggcugaaucaaccaaguggaaacaaaaagaacuauacaaagaaucaaccaaaccagaagcugauucuuugagaaaaucaacuagauagauaaacccuuagcuagacuaacuagagggcacagggccaguuuccuaauuaacaaaaucagaaaugaaaagggagacauaacaacagaacaauuagauccuacuauaaaaggcuauacucaacaaaacuggaaaaccuggaugaaauggaaaauuuucuagacagauaccagcuaccaaaguuaaaucaggaacagauuaaugaucuaaacagucccauauccccuaaagaaauagaaacaguaguuuguagucucccaaacaaaaaagucgaggaccagauggguuuagugcaaauuucuaucagaccuucaaaggagaccuaauuccaauacuccuuaaauuauuccacaaaauaauuauggaacuccacguaaaaccagagacacugaaacuuauagaagagaaaguggggaaaagccucgaagauaugggcacaggggaaaaauuccugauuggaacagcaauggcuugugcuguaagaucgagaaucgacaaaugggacuucauaaaauugcaaagcuucuguaaggcaaaagacaucgucaauaagacaaaaaggcaaccaacagauugggaaaggaucuuuaccuauccuaaaucagauaggggacuaauauacaauauauauaaagaaugcaagaaguggacuccagaaaaucaaauagccccauuaaaaaaauggggcucagagcuaaacaaagaauucucaccugaggaauaccaaauggcuuagaagcaccugaaaaaauguucagcauccuuaaucaucagggaaaugcaaaucaaaacaacccugagauuccaccucacaccaaucagaauggcuaagaucaaacauucaggugacagcagaugcuggugaggauguggagaaagaggaacacuccuccauuguuggugggauuguaagcuuguacaaccacucuggaaaucagucuggcaguuccuaaaaaaauuggacauaguacuacaggagaaucccgcaauaccucuccugggcauauauccagauguuccaaccgguaagaaggacacaugcuccucuauguucauagcagccuuauuuauaauagccagaaacuggaaagaacccagaugccccucaacagaggaauggauauagaaaaugugguacauuuacacaauggaguacuacucagcuauuaaaauaaugaauuuaugaaauuccuaggcaaauggagggaccuggagagcaucauccugagugugguaacucaaucacaaaagaacucaaaugacauguacucacugauaaguggauauuagcccagaaacuuagaauacccaagacauaagauacaauuugcuaagcacaugaagcucggaagaacgaagaccaagguguggauacuuugccacuucuuggaauugggagcaagacacccauggaaggagcuacagagacagaguuuggagcugagacgaaaggcuggaccaucuagagacugccauaccuggggauccaucccauaaucagccuccaaacgcugacaccauugcauacacuagcaagauuuugcugaaaggacccugauauagcugugucuugugagauugugcuggggccuagcaaacacagaaguggaugcucacacugagcauggaucauauggaucauagggcccccaauggaggagcugguggaaguacccagggagcuggggugaucugcaacccuauagguggaacaaaaauaugaacuaaccaguaccccccccccccccagagcucgugucucuagcuacauauguaucagaagauggccuggucagccaucaguggaaagagaggcccauuggucaugcagaccuuauaugccucaguacagccagggccaagaggugggaguggguggguaggggagugugggggggaggguaugggggacuuuugggauaacauuggaaauguaaaugaggaaaauaccuaauaauaaaaaaaacuaaauuaaagaaaaaauuauuccacaaaauacaaacagaagguacucuacccaauucguuuuaugaugccacaguuacucugauaccuauaccacagaaacacucaacaaagaaagagauauuuaggccaaauucccuuaugauuauccaugcaaaaauacucaauaaaauucucucaaaccaaauccaagaacacaucaaaaugaucaucuaucaaguagguuucaucccaaggaugcagggaugcuuuuauauauggacguauccacuauuuaaacuaagucaaagacaaaauccacaugaucauuucauuagaugcugagaaagcauucaacaaagucuaacaccccuucaugauaaaagucuuagaaagaucaggaauucaaggcccacaccuaaacauaauaaaagcaguauacaacaaaccaguagccaacaucaaacuaaauggugagaaacuugaagcauucccacuaaaaucggggacuagacaaggcugcccacuuucucccuaucuauucaacauuguacuugaaguccaagccagagcaauucgacaacaaaaggaaaucaaaggaauacaaauuggaaaggaagaaaucaaaauaucauuauuugcagaugauaugguaguauauauaagugaccccaaaaauucuaccagagaacuccuauaccugauaaacaacuucagugaaguagcuggauauaaacuuaacugaaacgaaucaguggccuuucucuacacaaagaauaaacaggcugagaaagaaauuaggggaacaacacccuucucaauagucacaaauaauauaaaauaccuuguugugacucuaacuaaggaagugaaagauguguaugauaagaacuucaagucucuaaagaaagaaaucgaagaucucagaagauggaaagaucucccaugcucaugaauuggcagacuuaauauagugaaaauggcuaucuugccaaaagcaaucuacagauucaaugcaaucuccaucaaaauuccaacucaauucuucacagaguuagaaagggcaauuuucaaauucaucuggaagaacaaaaaaaccuagaauagcaaaaacuauguucagcaauaaaagaaccucugguaaaaucaccaucccugaucucaagcuguacuacagagcaauugugauaaaaacugcaugguacugaaacagcuacagacagguauaucaaacgaacagaauugaagacccagaaaugaacccacacacccauggucauuugaucuuugauaaaggagcuaaaaccauccagugaaaagaagacagcaucuucaacaaauggugcugacacaacuggugguuaucauguagaagaaugcgaauugauccauuuuuaucuccuuguacaaagcucaagucuaaguuaaucaaagaacuccacauaaaagcagagacacugaaacuuacagaggagaaauugugugaaggccucgaagauaagggcauaggggaaggaguccugaacagaauagcaauggcuuguccuguaagaucaagaauugacaaaugggaacucauaaaauugcaaaacuucuguaaggcaaaggacacugucaauaagaccaaaaggcaaccaacagauugggaaaagaucuuuaccaauccuuaauccuuuagggggcuaauauccaauauauacaaagaacucaagaaguugggcuccagaaaaacaagcaacccuauuuuuuaaauggaguacagagcuaaauaaagaauucucaacugaggauaucgaauggcugagaugcaccuaaaaaaauguucagcauccuuaaucaucagggaaaugcaacucaaaauaacucugagauucuaccucacauuagucagaauggcuaagaucaaaaacuugggugacaguagaugauggugaugauguagagaaagaggaacacuccuccauaacuugugggacugcaagcuuguacaaccacucuggaaaucagucuggugguuccucagaaaacuggacauagaacuacugguagauccagcaauaccucuccugggcauauacccagaagauguuccaacugguaagaaggacacgugguccacuacguucauagcagccuuauuuaucauagccagaagcuggaaagaacccagaugucccucaacagaggacuggauacagaaaauaugguccauuuauacaauggguacuacguagcuauuaaaaagaaugaauuuaugaaauucuucgacaaauggauggaucuggaggauaucauccugagugagguaacccauucacaaaagaacacacaugguaugcacucacugauaaguggauauuagcccagaagcucugaauucuucuuagaggggggaacaaaaugcccaugagaggauuucccgagacaaauuucagagcuaagacugaaggaaugaccauucagagacugccccacuuguggauccaucccauaaacagccaccaaacccacacacuaugacagaugccaacaagagccugcucucgggagcucgauaaagcugucuucugaggggcucugccagugccuggaaaauacacaaguggaugcucacaaucauccauuggacagagcacaaggucaccaaugagggagccagagaaaguaaccaaggagcugaaggagucugaaggaggaacaucaauauggacuaaccaguauacccagagcuccuuggaacuaaaccaccagucaaagaaaaccugugauggaacuuguggcucuagcggcuuauguagcagaggauagccuagucugucaucaaugggaggagaggcccuagguccugugaugguucuaugccccaguauaggggaaugccaggacuaguaaugggaguggguggguuggggagagggggaggggauaggauuuuuggagaggaaacuaggaaaugugauaacauuugaaauguaaauaaagaaaauaucuaauaaaaaaggaaaaagaaaaaagaaaauuccaaaaugacuuaaguuuauucaguauucagauaacaacuuugacucucaaauaguuuguacuuguauuucccuucagaaagucaugaauucagaauauguuuugacauggugaucaccuuugauauugacauuuaauuuuuuaggcaauuuuguucaccccacaggcuuucuccuuuccucccuccucccuuucucccacccaccccugucucucccucucccuguccugcuuccccucucaccccccuucucucuuucucucucucucucugcaucuuucuucuuuucccuaguucagucugccucugagagcucucuccccucaaugccaggcaaauaguucuguuauuagaaagcuaaguuauuaaggggaugaugagucacagagcauugccuuaugaugucuauagucaagaaagaucugugaaugacuguguggcaugugguuagcaggcuugcaggggucaguucaugagugacuauggggcaucuuacauugacagagccauaaaggaaaacauauuguaucaccuaccuguuucauguguguaagugcucuacuacuauaacaauagcucccaguucccuggagcaacgcugacacuugaacgguuuucaguggcacuuugguauaacugguauaugcugcaaaaaccaucuuccacauugauguuaggcuaagaacugagccaauguuauaaccaaaaaacaaugcuuugcuuucugguaggaauuuaaaaauuagauaaauauguuucauuaauuucugucuagcuacuugauaaaucuaugauacagcuaaagaucagcuuaggucugucccuugucugcugaagauagaauuugguacuuucauuacauagguuggauuauuuguguucuaucuguauucagauuguagguaauuugacuuacuuugacccaauacaccaacaaccaacugauacauauauaaaauucuuauguucaaaauuccaaaucuggguuuauauucaaaacccuaauauguuaacuagaauggguauuuugauuugaaaaugggacuaauggguaccugcaauuuaaaguagccuaggcuaguccucagcacccauagccuacucacuaaaauaucacacacacugaugcuuuguaguucgauuuuacuaugcaguuaacucuaauaguggccaaaauauauuuccaucuauugacacuccuuaaguaugauggcucuucauuugagaagguugcuguaauaauauaauauuuucacuuguuuuaaauaguuaaacguaagauuuucuuuucuuuguuguuguuauuaaagaauauggggcggcaacagcuauauauuuauaagcuauaauaugcuguaaaauguaggaaagguuaaucaucucugagagagccucacuuuuuacauuuucuuuugcucaugccuauuuuuucauucuuuaggaggaauuacccaugacacuuuccaaaaggagcucaugugcuucgacccugauacugacaaauggacccagaaggcaccgaugaccacuguccgaggccuacacugcauguguacggugggagauaggcucuacgucauugguggcaaccauuuccgaggaaccagugauuaugaugauguccugagcugugaauacuacucaccuauccuugaccaguggaccccaauugcuuccauguuaagagggcagagugauguuggggucgcugucuuugagaauaaaaucuaugugguugguggcuauucauggaauaaucgcuguaugguagagauagugcagaaguaugauccagagaaaaaugaauggcauaagguuuucgaucugccagagucucuuggugguauucgagcuuguacacuuacaguuuauccaccugaagaagccacaccaucaccuucuagagaguccccucuuucuggacccuaagaucauccuuacaauuaagaugcuauauuccuaucuuugcaaugugucaugauuaucuucuuuuccccccuuaaguagcauauauguuagaguuagccuucaguaauugauacagaaaaaaaauugacauugauguuacuugugauguuuguauggccuagaauguuuauaaagugguaacaaaccauccuugaaauauaucccauagaagcugauguuuaacaugaaaacaaaaaaaguauugucuacaaaguguuucuucaguacuuucuaaaugcuguguacugaguguaagggauuccucaucuuacauuauaagccaaguugaagguggauuauaguaaauguacaacugugcucacuagguuucaaagugaagaaguuuuccuuucaucuuuaacuguaagaugucaaagggaggcagccugcuccaauaggaaacaguacacaaaagguugccaacucgcaugagcuaccucccucuuuucauaaaguauuuuugacacaucugucaacccaccugacugugugggugcauugagaacacaccaaguuucuaagacacacaggagaaauaacugaaauucaccaacacuaguuugugggggaaagcaugaccccucugcuuauaagaauugguuugggguuuuuuuuaaguguguauagaugaacacacacauacuuauaucaaauacaaauuuuuaaaaauugacugucaggucaaauaaaugugaaauuaaacaaaauucuucuaaaaagcagcuuccaugaaaaauggggauucaguaugcacacauuaaaugcauauauuucaaaccauacugaauuuagguggauaagggcuagaaauuuugagcaacuaaauuuaucacuugaccaaauuuuaccauaaagaauuauauucucuuuuucuccuuugcuguugaaguaacuuaccuguuguguggauucuguauucuguacacucuugguucaugagguuauuuagcacaaaguguaacagcuucaccugggaagcugcuuuugcucuaugauguccaugguuucccuucuuuucuucaauaaaaacauuuaaugucauucugcucugugcca

SEQ ID NO: 9437 - RNA, 996 nt, Mus musculus
ugcuuuguucacugcuguguccaaacugaugucuggguaauagugaggggcccaacaucuguugggugaguaaauaaccacauacauuuauuucccuuaaguacuuaacuuacagacauuauuaaaaauauauauuaucuaucauuuagcuacaaucauuacuucaaccaugaaaaacagguuuuaaacauaugauaguacuuuagugaggucaaggacugaaggaaagguuagauagaggugccgaagucagcugcugaaguccucuucauucaagagucuauagucguuuucaagauucacuccagaagccccauucuugacucagcaaaccgaucagggcaagagguacacgaagacgaacaaggccaggucgaaaaggaugaagagccagagauccagccaguaggaguguuucggaagcccguucaucccggacugaggugccucaucuugguuccuucuuccagcuucgaacgagccccuccguucccggacaccaucgguaccagacaccgccuggcucaccuccauccccgcgucguuucacuucagcgcaacugagaccaaaccugaagaccgcuucgcgcccaggcuagcaaccaaucaaauucauuguuuuuaauugcuguguaguacuucauuuuguaaaugugccacauuuucuguauccauuccucuguugagggacaucuggguucuuuccagcuucuggcuauuauaaauaaggcuguuaugaacauagugcagaauguguccuuauuacaaguuggaacauauucuggguauaugcccagaagaggaauugcuggaucuagugguaguacuaaguccaauuaucugaggaaauuccauacugauuuccagagugguuguacaagcuugaaaacccaccagcaacggaagauuauuccucuuucuccacauccucgccagcaucugcucucacaugaacuuuuuaucuuagccauucugucuagagugaaguggaaucau

SEQ ID NO: 9438 - RNA, 996 nt, Mus musculus
augauuccacuucacucuagacagaauggcuaagauaaaaaguucaugugagagcagaugcuggcgaggauguggagaaagaggaauaaucuuccguugcugguggguuuucaagcuuguacaaccacucuggaaaucaguauggaauuuccucagauaauuggacuuaguacuaccacuagauccagcaauuccucuucugggcauauacccagaauauguuccaacuuguaauaaggacacauucugcacuauguucauaacagccuuauuuauaauagccagaagcuggaaagaacccagaugucccucaacagaggaauggauacagaaaauguggcacauuuacaaaaugaaguacuacacagcaauuaaaaacaaugaauuugauugguugcuagccugggcgcgaagcggucuucagguuuggucucaguugcgcugaagugaaacgacgcggggauggaggugagccaggcggugucugguaccgaugguguccgggaacggaggggcucguucgaagcuggaagaaggaaccaagaugaggcaccucaguccgggaugaacgggcuuccgaaacacuccuacuggcuggaucucuggcucuucauccuuuucgaccuggccuuguucgucuucguguaccucuugcccugaucgguuugcugagucaagaauggggcuucuggagugaaucuugaaaacgacuauagacucuugaaugaagaggacuucagcagcugacuucggcaccucuaucuaaccuuuccuucaguccuugaccucacuaaaguacuaucauauguuuaaaaccuguuuuucaugguugaaguaaugauuguagcuaaaugauagauaauauauauuuuuaauaaugucuguaaguuaaguacuuaagggaaauaaauguaugugguuauuuacucacccaacagauguugggccccucacuauuacccagacaucaguuuggacacagcagugaacaaagca

SEQ ID NO: 9439 - RNA, 1348 nt, Mus musculus
gguuugcucaugucaaucaccuaguauuuuaaauagucaauacuaaaaugcaguacaugcauuuuauuuuauagccucauagauuacugugggaguuuucauaguuuucaucucuauaaucucauuugacucaugauaauccaaggagguaugugcuauuauuguuaaugucucuguuuuacagaugagggaacugauauaucuagaucuaugagcagagggguguuugcaugugugugugugugugugugugugugugugugugugaguguuucucugugugugaaugaauauaugugcaugugcuauauauauucugaggccagaguugacacugugccuuccuccauaacucuccacuauauuuaauuuuaagcagucucuugcugaagccagauuuugcagcuuuggcuaguuuaguuagccaguuugccccagagauccccaccucugucuccuugaugcuauguagcugccgccccugucuggcuuuuugauggguucuggguaucugaacacaucuucccaacccuuugagugggauuuuuuugaaguuucugguucuaggauuucauaaaaaauaaaucccaaaggacuacuuaugauucugccaucccaguguauucaggccagcuaaggaaaagaccuagucuacaucuucuaaaaggcucaccauguagaucuaguuggacuuuacuggucccccuguagagugcacuccuguguucaaagaccuguguggcaggaggaacugguaaaauaagaauuaugaaaaugggcuccuaaugagggccuugacacugcucucacccauauauggcugccugugcucccucugaggcauauacauccucugaccuagaaauucuuuuguaaauuuuuaaaagauuuuuuuggaggguccccccaaucuccuauuuccugagguugccuguuuccauucuuucugcuggcccucagggcuucagcccuuuucccucacccaauaccagaucaggcuccccacuaaugcccacuuucucucccaguucccucccuuccucccugcuugugauugcuuucuucucccucccaaguggcacugaggaguucucacuugggcaccucagcuuguugaccuuuuugaguucuguggacuguauccuggguauucuguacuuuuuuguuuguuuguuuuuuuguuuuuuuguuuuuguuuuguucuguuuuggcuaauauccacuuauuagugaguacaugccaugcacguccuuuugggucugaaugcaccagagaccugggaggugagagacucuccagacucaaaggaagggaucuuagaugaaaugcccaacaguagggagaggga

SEQ ID NO: 9440 - RNA, 38507 nt, Mus musculus
cgugguaggagucacgugguugcguuuuauauaacgcuucgcugagacaagacaguuauuaggcagcgcggggcagccggcauggagcucgggaggcgaggcagacucgcgcgcgcggcgaucccgccuucucgcucgcgcagcccgcucccagccgccgcucuuuccugcuaguucccuguuccuagacgccucuccucacuccaaccuccgcaguuccuucucucaauggauucccuucagaccgcacagauggugagcuuguccgccgagcucggcagcaacaacuuggagcuggcggagccggaggagccggggacaucagcggccgcagggcagucagccgcccacccggaggaggugacacccgagggcucccaagcucucggggcucaagagcccgagcaaagccugccucuggcggucccgacaccgcuggagugcaaaguccugcucacgcaggcggaugccuuggcaucugaggggcaccuucgggaagcccucgagguguaccgacagcucuccgagaggcagcagcucguagcggagcagcuggagcagcuagugcgcugcuuggccgacagugucccgcaagaggagcuggccuccgacucgagcggcacuucgagcugcugcgccgcggcgcugaaagaggcaggggaggccgcggccguggcccccgagguaugggauggcuuuaagugcaagaagugucacggguuucucucagacccggugucccuguggugcggccacaccuuuuguaaacugugccuggagcgcgggcgagccgccgaucggcgcugcgcucugugcggggucaagcucuccgcucugauggcggccagugggagggcacgcgggccgcggcgcgcggggcagccggcgccccugcaacugcgaguuaacgugguacucagcggccuccugggcaaguuguucccgggccccgcgcgggcgucgcaacuccggcacgagggcaaccggcuguuccgcgagcaccagguggaggcagcucugcucaaguacaacgaggcuguucgucuaggugagucccccccaccccccaugcgccgccacaggggccgugcgggcuugcucgccacgcgaggggggcgggggagcgaucccugcugggaggcgggggcggggggacggaccggacugauuugguuucgcgcgcgcgcgcgcgcgcgcgggcuggggggugggguggcgagggaagagcccguggcccacgaggaggagggagggggcauugcaaggaguuugucuucccuacuuuagcuuuuuuuuaaaagcugugucucagucuucugauugguccuauagcuuuuuuuuucuuuucucgugcucuuucccucucuccugcuugcuuuccugcuccuauaccuccugguuccaguuucuuaguuuaucccguucgucucuuuuuugcgcauuuuuuuucucaguuuugucgcuguuucggucuugcucagugucacugucucuaguucacggucuuuccuggacacuuuggagcucgcucuuacaccugccgguaccuccccuaucagcagaagaacuuggcacuauuuuccaaacucccgcgcgguccuccuggcuuuuaccaaccggagguggcuugcgggcgccugaguccguggcucccgccucugggaguugucccuuccggggccgaggcucccuguggggugggucccgccuggaauuaggucaggagagcacugguugcauaaggcccucgagccagcccgggccggcggccccucccccgcgcgggcgggcgggcaggcaagcgggcgggcgggcgggcggggauuguguaacgcugagguaacugaagugggccacgcucgccucagaaaccaucccgcgagcgugugcggggggcggagggggggggggcucgcuccccgcugcccugugacucauugucaccguuuccuaucacacgauuccuuggcugaaauagaugcacuugccccgcccccuccacccgcugcaguuagacagccaguuccccgacaucgaacccuuugaccccucuaacccaaugaauggcaggacuaggcaacugcucgggaucccccccccccaaggcaacaagggacugaucacaaaggggccaugccucuguuuaaccugcuccaagaguugcccaagagagugggcuuuguagcuucaagggcaacccgggcagucccacaucucugcuggacuggaguaccagaguuuucccagggaccuguuugcaccuucugccuccucccacuccaacccaggaaguggccuuggaaccaccagcugaugccagccagcaccuaggcaggcaggcaaggcagggcgauguguccaaccaaacgugcugguguggagggaguuggcuaagcagaaggggcuguaggguccuaggaccuccuaggcaaucucugguggauagaggagggaugggauggagucuccccacauuucagucccacccaagccagcaacagguaaugcagaagggagcaaaaccaguggcuaugagaacuggggaacacagauauccucacaacacauacccugcuugugucuaaacaaagcaggcugugagcugccaaugggcuagugggugugugauucagagaagugucagagaguacuguaaacucuaugcuaaaaucaagagcaaguaaugggcacccaggucagcccagagcauacauccuucaggggauggcauagaggcagacaucaaagccuguuucuggcagcagaagcuguagccuagagcuugugaaagggcgaagccauaugaaugaaagagguaggggccacuuaaguauggaauucuaaggggggcuggauacuuucauccacgggcuagccaggaagccucuucccaccuuccucuuugucacugcuaucacuuccccaggaagacucuuuccuguaccuuuguuaauaaucuccuuggagcagucaggguaaaaaaaaaaaaaagucaauaccauccaucuucaccauucuaaggggaaaugggccccuuccacggacuauauuuauccuggaacuggcuaauguucuauuauucuaaaagcuguacccacacucaguaaaaggaacuuuccucuacccaagccucaaaacuugaacauuaaccagcagugacucgaaccagcugugugaccuaucacuucaccucauuggccuuaguuuuccuaucugaagaauggguggguugaagaccuacucaggccuggauucuagugauucagugauggugacaauaagacuccuaaaaguugugucaagaagguacuuucucauuuugccaucacuaggaggauggaccuuguaaaugcauagcuguuucuccaggaaagguuuauaccauaagcacugaccauuagggagagagggagguuuuuugucuuuguuguuguuuuguuuguuuucuuuuuguuuuuuggguuuuuuguuuuguuuugggguuuuuggggaguuuuuuuguuguuuguuuguuuguuuuuuguuuugguuuggauuuuuuuguuuuguuuuucgagacugggguucucccuggcuguccuggaacucacucuguagaccaggcuggccucuaacugagaaauccuccugccucugccucccaggugcugggauuaaaggugugugccaccaugcccggcuugggggagguauugguaugcuggaguuauuguuaggcuacaggucaucccuacuagaugacuagcauggacuugccuugcuuggggucaagguaugggucccaauuggcuuccucucucucucucuucccuggccucauucuuuuuggaugguggcucauuuagaagccagguuguugggcacuagcagugugcaucugcagaacagugccaggguuuccucuaggugaaaauuucuaauguauuguggacacuucaccucuuaggaacugcuugaaaaaggagggcaacauuacugcuuugcauggacaagcuaugguguuggucaggacaauauuaggacuggaaaugacacuuaacucuuuggguuuaguagaaagagcuuacauaacuuuucuuuccucaagcuccauccucauacaggauuuaucaugugcuucugcugggggccauuaauaagggcuuuuuuuucucauuucggcagcuccaaacgaccauuugcuuuauagcaaucggucccaaauuuauuucaccuuggagucucaugaggaugcacugcaugaugcagaaauagcauguaaacuacggccaauggguuuuaaggugagugugggacaagagggauggaaaggggcuaugcuauagagagacuggcaagaagggcugucucccuggggcagaagaugcuagagcuucugcagaauaggggagaaaacuuucuaaugagcuggacagugcagggcaucccuugauaaagggaggucuaagucugcaagggaucucaauaaaucuacauucaguugauaaccuucaggauagccuugucuuuauuuuuuuuuucaaauauggaaucaguaguacaaccugacuucaugucucagcucuucuacuuuucuuaacuguacagccuuggggagauuacuucauuuuggugcccucaccuauaacaugcuuauauccaaagcauccuucuaaauaggacuguuguggagauuauauaaggucacguaggggagaugcuuggaacaaugcauguagcauuauauaagcauuugcuaccaccaccaccaccaccaccaccaccaucacucauacauuuuuagggauaauagggagaggaauauaagaaagauauuccugcucugauccuucaggauaacuacugauagccaugcuuuuugaaagcucaaacagcuuuuggguuuuuaaagcgagaucuucauauuugcacaauggcugugccauuuugaaucauuaauacagucauuugacaugccaguauaccccccaaucuaagucacaugggagaggugggaagaaagacagaguagacaucaagagaggggaauaccugaauacaaagcaucacuuucuaugucucugccuggcaucaggaccaaucuccuccacauaccuguagacuguuuaguagaauugggucuguuuaugaaucuuugcaaagugugaccacgggaaaguggcuacauucucugaaacucaagcacccuuacuuguuaaaugaugcuauugcugucugccaugauuguuucacagguauguauaaggaucaacagugagaaugacaacuagaacauccugcaagcuguaaccauuauagguucuuguacaacccaagguagcaaaagcagugucuccaagaccagggccacugugauuuaucugaaucucauggggucagguguccucagguguccucugaauccagaauguucugaugguagaaagaccauggauuaggcaauaccucuaauaaucuucaggcaaccccccuaugugucuaauuaaacacacugcagcaauuuacaugcaaaaucacacugaauaguauaaauacuauacaacaguuuauaacaguuucguucagauguuggugccuagugaugauguuaaaccuaugaaaauauuggauaaucagaaguuuuacauaucuaggaacuuccgauaaggccuugugaaguugggugugguggcaugacccugcauugggauuccaggaggaucaugguugagcucagccuggacuauuacagugagcccuucugggggaaaaaccuuacauguggacugguaaacuuugucuauacuauuagagugaaucacauuggucuguaaugagaguuuucauggacgugauugaccaguguguuuucuuucccaagaaacauauuuacagcucaauacaagucuccaauaccuuaaguugccacugaaaugggcuaacaugugaguuagguagcugucuugggauaagaggggcuugcagccauuuccacuggaaaacuaaaucuggauaccaugaugggaagagcacugagacuuauguucuagaugcagugagaaaagggauuuccaccaugaaggaggaauuggugcaaguacuuggcaggggugccauuucccuauagcugggaaaaaagggaaagggagcauucagaggacucugcuggcuugggggcugaaagcuucuaaugcauauaccuccauacucugaguuuuguauuucccaccauuucuauaugagaugccauaagggagccaguccgguaggcagcccaauuucaucuagggcuuaaugucaucaccgcaccuugcugguaguauaggugucagugggguaagcuggccacccugagaaagugaggcaugugaguugcuacucuguugauuaccgggaccccagaggccucuccaguuuuccaggacuuagcacccuauagcuguucuggagcauagugcuagccuuucucccgaaggccacuguuggcagaaauaacaagggaguguggcagccaagauuaggcucgagaaagaagcaaggguguggaaagagguccccaagagguuuguggcuguggcuccuagccaaguccugacaccaugcagacacauguuagaagaggagguagagguagacuuccucugaggcuucccaguuguuuguuguacuuuggucaaguucucucucucuggaucucccuuugguugucuuugaaaugggauuuaaaauaguuuaccauuaggacagagaugaaaaucuaagucuuuagacaagacucugccugauagugacugcucaguagguacucagcgauugcuguuaauuguagcuacauuaagaaggugaauaagaugggacugacugcuacuguuuucuuccaggcacacuucagaaaagcacaagcuuuagccacucuaggcaaggugaaagaagcacucaaagaauuucucuacugcguaucccuugauggaaagaacaagagcgccagaucugaagcucaaagggugaguugagugaccuaggguuaggugucuaguagacccccgucacucugucuucuuuagggagaaggaugaagaugcuacccuccucaguauuugugguccugagugggugcuucucuggguuuaaggggcaugagagagaugccaacugauugcccagaagccccaucauugugguauguacuaucaaauuggcagguuuuuuuuuaggagucaguaaugaaugcuuugacucagaaucaguaggauauaaaacaaaacuaaaccaaguaagcuaaccuggagaugaaggcucacugaagaguaucuuuguggaugagggccugauagugggagcugcuuagaacuguauaacuuuucuuuggcugaaucacacguuucgcuagccacacaugaaggacagcuccugggaagggucacugaugucuccauguugcuugccacauacagaacuuaaaccuucaacucuucugcuagaaaauuaaaccuacuaucucgcaaaugcaagucagagaucauuaugaaagaauauaauuagcccuucuaacucuucgcuuucaggagauugugauuguaaaacaaauaucaugagaaaugccaggaacuugauuaaaaggucaagcaucuucauuggaugggcuuugacuuuuauugcuuuuuguacauuuauucuucuggugucugaauaauuggccugaaaguuggaugcugacacucagugauuguuuuugguuuccugccgccauacucucauucaacaccaggccacaagcccuucuauccaccaccacccuuuguaaugcuuuggcuggggagggguggaaaaaaguaggcaagagacaggauuugucucugaagacucuagaagggaauauuuagcaaaacuaauaaaguugacagaggcuggacucuagcaagaaauuuccugucuggaaaaaaaaugaccugauuugugugugugugugugugggggggguaagauuuuauugaaagggguguggaucaagcagaauuauuagccaugggccuuucuuaaaacuuaaguguagucaguccauaguauaacauuagcugagcauuccacuuaguucccauaacucacuguuauuucucuagaugagaaaucugaggcucagugacuuucuugaggccaccugcuucuuugcuuuuauuuugccuucagguggccccagagguucugguaucaucaguugaacuaaccucacuccaguuugcuuuuauagauaggcuguugucauuucuauaccugccugaugaaaggcacggcauugugugaaacucuggagacccaaggaagccuaagugccuauuggaacuuacaagcuuuuuuuuucuuuuuuuuuuucuuuuuuugguuaagaugaaugccaggcaauacaagugaauguguacuuacaagaaguauuauaaaauucugaaauuaauguaacaauuuggaggcaaauuucugcugaaugugaugaagcuauagcagccauuuaaacauacugagaggcuucgacuguguguauucacuggauuauucuaguuuuagggcuaaacauuugaaaacuaguccacaugcacuggguauuaauaagccuucucauaacccacagcccugugauuuauuuuaaacuacagauuuucuuucuuaacccaguugggccuuucuauggcuaaaguuagagcagaauugacuuuucauucauauggaaugauuauucucacugaaaguugacccuaacuuuuguuuuccaaagacauugaaaaggccuacagagagaucuuaggcaguaaagcuaagaagagaacugcuauguuauuucugccuuguuuccuuugauuuuggcuccuggccgccuuuucuucauauuaccuugugucuuuucgaccuuguucuugggugcuauauggcccccuccagguagacugucucagaaguggauauauucuuuuugguccuugaguaggauuucugauaaucaguucaauuccuggggaguguugugcacuaaaugauuauauguaugacccugggcacuaggugugucuuccaaccuuugucaguuuauaucuggaaaauaggguuuuagcacugcaaggggacauaaacaucucauugaggaugagaggcaccugaguucuaggcuucuucuugaucccuuggauguauaaaugccaacaucauuuccaugaauauguuguauauuugcuaagcacuuaucgcuggcuggagagaaagacuuauucugugacacacuucucgugcaaaguaagaugguauaguuuaagguuugguauucucuucuauagaggcaggaaaaggcagaugacaucagagagaugggaguacuggggcaaggcagcacuugagcagaacuuggaauacugaguagggcuuggauguauggaaagugcugauagauacagaaaggagcaucaugaagaaaccucagaggacaagcagaagaguaaacccaccuuugaauuuagcauucuugcaaagucucuugauaaaugaacacuucggacuauggagacugaauaacaguguggggcauuuuuaguggcuuuccaaacauggcagggucuucuaagugauaaacauuugaguauguuuuggaaguucagugaucucuuucuuguuguauuaugcacguacacacacaggauagaucuauggauggauacaugcaugcaugcauacauacauacauacuuacauaaaaucccuaaccccuaauggcuuaggggagaguggaaacaagaauguaaauagcuaaugguguaaccugcacccaaaugcuuaucucugaccccuagacccuuuuguucucucuucucccuugccaguguauccaauugcaagggaaccugccugacccuagguacuugaacuuaaaaucuagaaaucucugaagagaugacugggaugaggaagaggcuagaagugggagaggaaguuugagcucugcuuucuuaacacuucauugcucagauccccaacccugaaggaauuaaagguccaggggugacaauguggacaaggagagcaaaauggaaaaacagaaaagcagcagcaaacaauguagauugguugacuucucagcccaucgaguuguuacggauuugacucuguauucuuccuaguuugcuuuuccuuugcugugauaaacaccauuaccaaaagcaacuugggaaacagaguuaauuuuccuuacacaucccaggucacagucuaucacugauugaagucagggcaggaacucaaagcaggagccuggagacaggaacucaaacagaggaaucugcuuacuggcuugugucucagcaucacaaucagucaccuuucuuguacacacuggcaccaccugcccaggguuggcacgacccacacugugcugguacuuccuacauuaaucauuaaucaagaaaauacccaaacauauuugccuacaggccaaucugauacagacauuuucuuauguacccuuuccucaggaugaccuaguuuaaaaaaaaaaaacaccuaauacaugagguaucuauucugacuucaccucuauguuuccuucaauuaagauagauuuuaaagccccauugcagacauuucugcagaaugguggcaccaucgaggugacuaugaauaauguaggcaucugucaugccuucucaaaacccugauuccuggcucauacuucagaccuggggagauugaagcuggacccauggaccugacacuuucauaagcuccugggugauucuuuuugaaaaagauguauuuuacuuuuucaauauguguauauguuugagucuguguauugggugucuguacaugaggacugguaccccuggccaucagagguuucagauaugcuggagcuggaaugacagguggaugugaggcacucuacaugugugcugggaaucaaacucggcuccucugcgagaacaguaugugcucuuaaugacuaagcaaucuuucuuucccccuguuccuaaaugagucuguguguuuaugcaacaaccucuccuuagugugucuagggacauggcuccaaggcuuccucauuagaguuuugccuugcaagcugugcucucugguuccccaucccucccccugcaccuuagucuagcaccuguagaaacuugaguagugaagucuucuguuuuaugucacagcuucucuuuaguuucuuuucaccaucagucccgggggagucucaggaacauucucccgauauccugaagcuguuggcaccucacccuagauuaaaggaacacguagagucaauggcuacugaaggcaccagccauaaucuaccaaaguugucacagguaaaacucaacucacccagcucgcucaugaugcuucauuuggcucuuuugugggcacacgacaagugagcccuaccucuccuacuuugguuccugagggaaaaagaaagauggaguugauaauggcuguguccuuugcuuaaaaacuacaacugggaauuucaggcaugguccaaaaguuuaugaauuuauuauauuuguagucuuggucagauugagaaaauagagaaauuugauagaaauauaaagagauuggcccacuuccccuaaagcccuauaacuggggugugcuuauugacucugucuugguccaauccggaaaauagauuugauacaacuauaaagagauuggccuacuucugaaagccuuuaacugggacuuuagcuuuggggaagaugcugauggccuuugaguaccagugagauccuugugcaacguugauuccauuuggggaccaaauggagagaauuucuugcucuugcacuauaccuuacacguaaguaggcuucuuaugcacaucuauagcaaaguagagcacgagagcugaguugagaaggaugacaaaaaaaaaggaacagagagaugggcuucaggugcuggccuuucuagcacaggguaagugggcagaaguugggguucagaagaccagacuugaagcaaaguuuaacacugaauaccugggcaccuuuggggaguuguuucuucuccauuugugccugaaguuccucacuuguaucuaagcccuggauguucacaucuucccagucucugccccugcucuagagaaggaauagaaugcaagguagcugacuuuucuuggugauggcagaacucagaauaucucuugaaaucagagagcccccaguggucauuaguacaggacuaagacagcgaacacuagaccagaggaccuggaguggggacuucuacuugcaacucagucugaaaugaaggaaauagaaccucugccuuuccacugugagcagaccaggcaacagcgaaugcauuuccaccaaaacuuugcuuggcaaggccuuguccuguguggacaguacucugggcucacagaaaaucaaaacuguaguauuggggauuuuuuuuuuaaguucuugaaaccaucugaacacccagggauacaggcuaagaaacaucgcauccuuuccucugcucuucguuguuuccucucaccuguguccacugcgacuuuuggcagggcuuagaggggaaacaaccuuuugcugucaaauauggauguggguuauagagaagguucuccagagcaaugggaauaaacacauuuucgggauuauuuuagguugcauuuucaaauauccuuuuccuagaugaaauucuguaaaagcuuagagacagacuauuagaccaaauuauuuuugucuucucuuuagacuuuucacagaaaauggagcaaacagacuaaauaaucuuuuuaugaaaaauaaaaaaaccauauagcucuggagcaugaguuacuucggcaggcuuguacagagcuggccuaaaguccucugaaagaugucuaugaaugacagucagggugaggggaaguaaccaguaacaggauauccccucacugagugcuuugccuuccuuacagaccacuggggaaugcuuuggcuaggagggaagagugaugcuucccuuguaguucccccuucaccccugcucagccaacuuguccuuccaugugccuguuguccuuguuuagagaaguucuccuaacucuacugaagcuaggcaugucuuugacauagauaagaugucaccgauaagccucaaggcugucccuccguugaguugcguagccacuguguauucaggagugaggaucagagcuauguuucucuuuguccccucaggguaagacuauuggaggaccaaucuuggucccaagcagcuucugaucucuggguuuuugcuucaccuaggagaaucuggagcuuccccauuguucuaaucaggagggagcagcagcugcagaagagagcagcagccuagcaaauuccgcucaaggaaaggugaguaguaaagaagacagaaagaaagaucaggaaggagaggaccgggaugcugccuccgucaggaccggcaaaugccaggaaaagaagagaaaucguugccaaaucgaaacccaagaagacacagaauugccuaauaaagucuccaaacaagguacuaauucuacccaggaagaaaguaucauaaugcagaugacugggcucgcugaccuauguaguuacacucucuggggaccccucuaguucagaguauauggccuagcucuggcauuuaccaacuaugaaaucccagggguugcugugacgguucuuugagaguguauugguaacuaucauacugaaaguacuaugugauauaaugugauauagcucuguuauaguguaauauagaucauccauagucaggacaucuggucaagcacccgaucaaucaagggaugacaucucaugcuuuuccaucaugucacuuuccuccaggauaaccacuuccugccucaucccaguugugggaauguaggauggcagaggugugcucaggucucguucgguugugcccugagaagcagcagcuacagcuucauaucuuuccaagagagguuggcagugccaagacugaucucagcuuugaagaccuggcucaguccagggaguuaccaccaccgcugcugcugcugcugcugugccuacugaauuugaaugaccuuagccaggagcuccuagucuuggacuucucugucuaugggcccugcuaaaaugccucugggagcgcacuucagggaacccuacuggcaauugcucaggcagccacuaaauuaaacucugggggagauugagauugaaaaccagaaagacauuuuucccccagaaguauugucuguaaaaauaaaacgaguugcuccaucccugauuuacuguuuccuaaaucacagauuuuccugcugagcagggagccaaaccagaucucaguaauccacuuggauccuuugaugcaucugaccuugaaugcucacuguguaugagguaugugaugugggccagcacuugacugccuaguauuuccugcucuuuaguagcuggaccuuucugcuggugacuuaacuacugaguugguuaguauguaaaaucauggcacugaugaaauguaaaccacauugucacaugagagagcugguguccaagcuuacaaacuguguucuuuacagccuuagaucucaauuuaaagagacauggaaaguggcaaggcaauacaccuuucaaaggucaaaaauggaugggccacguguugaauaugccuacuauuuggucuucauuagauuugauuuuguuauauaugacuguacugaaacaagacauauauuuuccagcuucccauaaucccauuguuuuauaccagccugucuuacauuauuguuugagccuuagaguuuuuugaacuuguaacacugaaucuaaacuacuaaguuaagaacucaaugcucaaggguuaauguagaucccacaagcauuuucuuugaaagccaaauagaagccuaaauugauuuguguuuaugcuaucugaugaacaguacauguaacagauacuuggucaaguauuuuccuugcagcuaguaugugaucucuacuuucucgggucucugaagagcaguuuauccagauaucccacuucaaaaacaaauaaaaguuuauuucauuucauagcugugauuuaguggcuaagagaagaggcucugaagucaauguuugaacccuagcucuuuugaccuacagacucugguccuagagcaaauaacguuugcuaccaugauuuguuuuuuuaguaaaggacaguggaaucaacuccaucaguugugacgguuaauuaagaaaaauuauuuaauguuuagaguagugacuggaaaacaguaaguacucaaaaaaaauuuaacuaauuuuuuucuuccuacucauuggucuuuaauguuagauccagggaccucagaagaaacucuauguauacauucgaauagaugcaugaauucauugaagcaauauguaaagugugcauauguauggguggauguguuucuaagauagaagcauacugcuugcauuagauucucaaaugugcugauuuuucuccaaaagcauuaagacggaacuuaaauacuugaacaaauguuugccugccuuuugagagcacuuacucuucuguuaucugucauguguaagucauuauauucugaaugacauuuuuggucaugugaauaagaacaaggcaacuauuaugcgauauagacucuucuuaggaaaaauauauguauauauguucgcgcauauauauguauacauauauauauauacacauguguacauauauacauacacacacauacauucuugggucuaggggaauaguucaguggcacagcacuauucaugagauucuggauucauuaaccauuauuaucacaacaacaacaauaguaaaauaauaguauauaaaaaaucuguaguagcaaaauuuguucacaagcauauaaaagucucacacaacucagaagacacagcauagaugcagucaaauuaagcuucacacauccugucaguagucuguuuaagugguguggacaagaauggaaugaacaacaguaccagauccuuuuuacugccucacccagacccucacuacagaguggcaagcgcaucaugcuaaagccaagguaugagauagcaaaaaccugcuuucaagcagagaaugggcccugcagccaccacaccagcucugugucucuaaagccugugauaggcgcugugaauuccauuuaauuuagcuuacucagaaagagcaggucuuuguucugcuuaacccuccuuaacacuccugccaaaauccaggcgacacaaaaucaaacauccuguuuguauuuucucuguggaauaaaaauccugagguugaaauuccuuuguuccucuuccuuuucuuuuccucuuucaucuucuuuguccguaaucacaagggacuuuguagaagaguuaggaauuugcuccaagaaauaaacacacagaggauaagcaccccuucuaguuugcacccucugagcuuaaaaaccauuguggccccuuguuccauauuuggccagaguagauguuauggaggcuacuaaauuauagcuagacuuucacuaccuucugguguaagaaaccugaucuaaagcucuuuacauuucagcccuugagaagaaacauguagcuucccuuccaacaggauuugucuguuaaguuacacaucaguucuugaaggagugaauuuguuugccuguauuuuucuugucuugaaaguuucuuuucccacuuguagcuauugcuguuuucucugugguuguccuuagguuuuguuuuggcccuccugugucuuuagaagagagguuuuguacuugguuacuuuucuuguugcugugacuaaauauuugaccagaagcaauuuaaaggaagaaauguuuguucuggcuuaccauuggaggggaucauugucucauggugagcaagacauagcagcaggugggaggaaauguggcugugagcuccaggguccugcugcucgaaaugauuucacaacauacaggagacacagaguagugaauguuggcgcucaacucacauucuccuuuuuugaguucuaucagaucccagcccaugacauggugcagcccacaguuaagaugugucuuugcacuucaaauuaaucuagauaaugucucucaggcguacucagagguuaacccgagcuucaguugaggaaaugccuccaugagauccagcuguaaggcauuuucucaauuagugaucaagggaggagauccccuugugggugggaccaucucugggcugguagucuuggguucuauaagggaggaggcugagaaagccaggggaaggaagccaguaaagaacaucccuccauggccucugcaucagcuccugguuccugaccugccugaguuccaguccugacuuccuuggugaugaacagcaguauggaaguguaagccgaauaaacccuuuccuccccaacugcuucuuggucaugauguuugugcaggaauagaaacccugacugagacaggugucaaauugacaauugauauuaaucaucacagaggcuaagacuucagguaauuucaagucgccuggccaugaaauuagacauuuguaccaccuguacaaguuuguagacugaaaucuaagccugugguguuguccuggaagagagaaguuagacagaccaugaauguauauauuuugauucuagagagcaaauugauugguuuguaaguuucacagagaaaggguagaaagugugacuggaaccagguauaguggcucacauuguaauccuagcacuagggauggagauguaggaagauuaggaguucaaggucauccuuggcuacacaaagaguuuaaggucaucuugggcuacaugcggccuuuuuuuuuuuuuuuuuuuuuuuuuuaauggaggaguaauuggagaauacaccuauguuuuuuuuuuuucagucuccaaguucccauugcuaaauuggaagaauuccauucaaggaagucuucccuuaaucucaacaccuuagaacccugcccugcagucacuggaggcaggaaauccuccuuuaguuuuaccugguauacaucaccggagccauuggagcucaucaauggaaagcaauaccuuugggauaauaagaucuuuugaaauuagaagugagaauauuugcuaccugagcuuguuauccaauggcccagugacauuggugacaaguaaaaggaucagcuuuauauauaaucuaguuauagcucccuaagucacuggguauuaaggcaguuuacuuuucuuucuuucucucuuucccucccccuucuuucucccccuuugcuauaaucugauugcaaaacaacacaaugcaaggaugucacugguggagaaagauagcucuuucuagauaaggcaggcauuuuaucuggacugacaucuaacugaaggcauuuauucuuacuauuguuuaccccaucacucugauaaugugaaaugcuuucuugugagacaagcuggcccugcucugauuuaaaaaugucuccccaaaguguuuucaaaaucccuaucuuaaauggguaaaggacagacauuccaguuuauaccucuaucaucauagguaagagucuuuuuguuuaucuuucuagagucagaaagaagggagaguaucagaaagggaaggagaaaaguguauguggacguguguacaucuacagauggaucacuggcuggcuggcucgcuggaauguauuugaauguguggauacaauauaguccuggcuaucuuguagaguaaaggaggaagaguagcuggaaagucagacuugauuauauauuccaaacuuucugccuacuagcuaguaguguaaucuugggcauguuaucucaucuguuugaguuuuaauuuccuuagcaguaaaauagaguuacucacaauuaccauuuauuaauauauaaaguuaauuuuaaugaaaaauagcauugcauacagccagaaauauaguaauauaaauguauguguguauguauguauguauguauauaaacacauauacauauauaucuuugaugggagcaaaaaccaaagagcacauggcucugcguuaggaaggcaaccucuggaagggguggcaggacuucuccccauaaacauuauauuggguggaauaaggagucugggaucccaguugcagggaagaaaagcuuuguguacaaaugaaugugcaccugggaguguugcggcugcugcuccaaauuccugccugugcacauagggaacacuggagggagaggguuaaagacaggcacagccaggagaaaagcaguuuuuguacuuaaacccugcuagggaauagcaaggcacaucauccuaucuaccuacccuucaguaucuuggugauaguuaggagguacaggauguaaaaacagggaaacguguguguguguguguguguguguguguguguguguguuaguuaggagguacaggauguaaaaaucagggaaacuuguauauauacauauacauauauauuguuaaagguacaauaugcucaauuaugaaguucucgagaaaaaguguuuuguauauuaguaguagauaacauauuaaucaucauccuuauauguauaaccaaauaauauguuaaagcauucagauaagcugaauaguauaugucuguaacacuaauacucagaaguuuaaaacagguuaauuaggaguuacaggccagccugagcuacagaguaagaacuugccccugaaaaacacccagggcaaggaaucuaggggagguaauacauucuucuauuucuaguacuugagaaacugaggcaagaaguuugccagggauaugaggcuaaucuggcuugcugcauagcaagaccuuaucuuuaaagaaaauuggccaugugguuuggugauagaauacuuuucucacauguguaaggcuuuggguuugauuuaacacacacacacaggagggcgggaagagagagagaaagagaaacaaaauagaugcacagaauucaaguaguaaaaaaauaauuguucuggauuggccuuugugaucuuugaucaccucagugguuccugaaucagcucugaaaucauacuuuagaaacacauucuuguuguaaaauauauauguucuguagaaaauauuguaaagagccauguuuccacuugguuuccaaagugagauaucagcaggaccccagcaguuguccauaugccuuuuugcaaucaggaccauuacuccuguggugauuucagugaaaugucccccauugucucaguugguggcacuguuuggagaggcauaagagguauggucuugguggaggaagugcaucucugggugcaggcuuugagguuucaaagacuucuaugauccccagaucacuuucucuguugcuugcuugagguuugagaagugagcucucagcuucaagcuccagccacuuugucaccuacuauccuugcaggaccuuaacccucuggaacuguaaagcucaaauaaacucucuccuauagaauugccuuggucaugaugcucucucacagcaauauaaaaguaacuaauacaaccccaaaacuucuaucuugaguucgauuuuguuccucauaguuuuaccauguaaauaugcagcuguaaaugguaucagcugguuuggccuaaguccuaaaacucagguagaauccagugauugguuuuguuuuguuuuguuguuuuuauuuacaugaacauguaagcaaaguuuguucauuuucauuagcauauagcaucccauugugugaguauuccagucucuuuagucuauuguagagggaugcuugaguuagcucuaguuuggaauaccauggauggccacuauuucugcaagugccacuguaugccuguuuuucuacuagacauuuuguuucucuuacugcuuuagauauuucuuuucuuagaagcucuagguauguuuuaaauacaagccuuuucuuaccugcauguugcaaaaauucccucuuacuccauagcuugcccuuucagugaugcuuuuagauaaacuuaaaugaaacguucuucaucuuaucccagucaaaacuaacaaucuuuucauuuauaguguuucuuugaguuuucuuuaucuuuaucucugugucauaaguauguucucuuauuuuauguucugaaagcuguauuacuuuauuuuauuuuuggcuuauuuuucagaucaccuggaauugauuguuguguaugauguaaaagaugguccacuuuuauuuccucauacagauagccauuauaacauuuauagaaaaugcuauuugugcauuaaaaauacucccauggcccuguuuuaaaaugcuucauuugucauaagucaagaauccaugucugggucuauuccugagcuuucuauucuguuccauggaucuauuuguccuuauguuaguacaccccguuuuaaucaccguggcuuuauaauaacuucugaugcuuggcggagcaaguccucccacauccuuguucuucagaugugucuuggcacucagcccuuugcauuuccuuauugcauuuagaaaucagcuugccaaguuuucccccaaacaaaucaacaaauaaaauaacacauugcgauguauugagauucaccagauguuuauaguuuuuuuaauugauuuuuuugagaauuucauaucucaguacuguauuuacauaauuuucaccuuucucccuccaacucauaacugugucccuuccuccuccuccuugaaucauugacuucuucuucuucuuuugaucucuuuuuuaauuaaauauaugauaucauauaaugugaggcugacaguuucuuccuuucaacugaacacucuugggaacucaaaauaagcugaucaagauuugucucccuuuugucuauacucaccaucuuguuaaaugugagccccacuucuuaagucaucauuagcugaccccuaacuccugaugcuguuucugaugagcuucucuuuauacaaaguacaucuaugcauaucugaaugugcagaacacuuuucauuaaggguccccagauugcuuuagaaacaucuuccuuucccaaagcaacuaaaauaagaucuaauggaaguaugguacauauuuuuauauguagguagaugugcgaacauauuuaacuauugauagugacugaauuaacaauauuacuuauuaccacuggggaaguuauccauccacacaaaaggcagacaccaacuguuacuuaaauaaauagaagguucaaggguagcaaacacagaguuuuucuccauaguaacauuauguacagagucuguguguaugcauguguguaccucucuguguguaucugugugcuuacaauauaaucagguaaacagguuggcuaaacaauuuuguuuuauaauggaaucuauucagacacugagcacuaaucugaacuuucuuggaccagacaggaaaaggcuagaauuaauguuacaaaaugauuugguuaugccacaaaaaauuagcaaugcuucuuucuauauguagcucaggaauaaaaagaaaaugcuuuucugaggugugacaacacaaaaggagugcccucucccacaggcuuugacaaacaguacugugagaacuuaacugccaaugucccugucuggguuuuuuuuuuuuuuuugaucuuauuauaguuuucuccuauucauuuccuaaauuucagauuauucuaugagccagucacaacaccuuguggacacaccuuuugcuugaaaugucuugagagaugccuagaucauaaugcaaaguguccacugugcaaagacguucuuuuacagguaaacccucuuucuucuuugguuguguuagcuuauuuuguauuaacacugugcucagcuguauccaaagccacuguacugugcuugaccaaaauaugccacccccaccaucuguuuauuucugcugucuccuagacauccuuccucucuccacaaaguccuucaggaaaaugaggcaacaucuagcuuuucaauaacugucaguaaugaaguucauuuguguuagaagcaaaaacaugcaauagaugauaaacacaaggcuugguucugaucccauuguggaaccucguaaacaauaaucuugagugauuuuuugcuuccacuauccuugaacuagauagcucugacuucugcauaugauguuuauuugugcuucaaagaggucggcugcuaaaggccccugccaccacacccucaaaaacccucucagaucuucaagguggucuucuuuuuuacagcugcucaggagccacuguucuuacuagcagauacuugacugcuuguaaagcucugaggacuucagauucuuuaaaaugaaccccaccagcuuacaucuucaagugggucuuauggaguuuccuguggcgaaagacaggauucuugcuuuccuuccuucagagacuuaucaaucucagcuuccaaccaguauuaauauugcuuugcacuaaaauacuugaagagagguagcagaauaauaaauaaugccacauuaguucuagagaauaguggugcaugcugucucacgauuuggaaagcugagauaggagcucugugaguucagggucuaccuaagacacauagaaagaccuugucucaugaauacaagggacuauauacagguuccuauuggguccauauaaguauauguuaagacuuuaacucuugacaauaagaagauggaaugagcccaacauccaggguagccuugaggauguguauugggauugggaaacugcugaagucacagcuuuccuuugauuaaagaggugggauuugcaaccugauuguagauuaaaaaaaaaauuccaugguccuauuuaaaugaaacaucuauguuguguuaacaugacaaaguucagaccaacagaagggaaaaaguaccauaugcucagccucuggagucuggagaaaagcacuguuaccauuuuagagggucugcuuccuggaguuuuguuuuagcaucaccagaggggucacuuuccuccuuaaauugccuaccucuuaagucacugcuucuaaagucugggacuaggccuuuuuuuuuuguuuguuuuguuuugguuuuuuuuuguuuuuuguuuuuuuuuuuuuuugccccuguugccagucaauggcaguagcugauaaggcauccuuuaggcagaugcuguggagucagaagagacucagaggcuagaagauauucucaucuaucucuguauucauucacggccguacuuaacaaagagauaaauauucuagucauguucauggcagaauagacuccuggagaagaaaauggucuuaaaagcaacaauuugguacucaggagcucccucuacugggccccacagcaaucaauucucugcagauauuauuuauuuauuauuauuugaggaguccauaugaauacuguauuuacuuccuuuuccccucccacucuccauccaacgcugcuuguguuuccccacucccuacaaauuuugagacuucuuauucuuuaacuguuguuucauguauggugcauguauaaauaaauaaauacaacuuccugaguuccuuuaguguugcucauauacauauguucuuaaggcucaccacuugauauuggauaaccaauuauggggcuucucccuggagaggagugauucuuccuaacucaguagucacuaguugccuguagcuauucagcuaggaguaaggccucaggagauuuccuccauccuccuugacaaguuuucugguguugucucuuguuaaggucuuguugaggaaacuuuuaggauuucauggguacaagguuccugucauuuacaaagaaagccaucucgaagcacacaccuugguccccuggcucuuucaaucuuucugcccccucgucuagaauguccugagcuuuacaagcagggguuguguuguaguugaaucaacuggggaugagcaccacauagugaauugcucucugcauuuucacaaaaccuguacauggcuguuagcaugugugugcuauuuauuuuaacuaaagacuuaaagacuuggaaauaucuaggagccaggcauucgauugggauggaggugggggcaggacaugaaaggauauaugaacauugccuuuugguucccugaauccuuugaccagagucuuucagcacuacccagagagagcuuauaaacauaacaauaaagaaagcaaaaaggaaauauguuccaccccucuuuaguucaaacaugaacaugaucucaaauccaaagcucuagcucaucugugagauuuucaaaaguuuaaugccauuauuuucuuuguuaaaauacuuuuuucuaauuauaaaggaucaauuguauauuuuuaaagaaaaucaaaacucuuaacauccaaaagauacacacauuguggcuguauuugcuugcaaauuuuggguccaaauaacaacauuucaugauuugacuacuuaugugggcuacguccgaaguuuucuguguucuucugugaccuauauaauaguucauuaccuugucccucuucuagugcuugccaucaagaaaauauagcaaaaauguaauccuggaagaacucauagcuacguuccugccagaagaauucaaggaacgaaagaggcuuuaugaagaggaaauggaagagcuuucuaaguauguauacucuugucuguauuuuccauuucaugcacaccagcucaggaaaacugucacguuucuuaccagcuccuuacucaaaugauaucaugugaauagucugaaauaaccaugguuauuuacauauuuacaguaugaagucaacaagugcuauagaccaccccucccaucccccucagaagcaguuaaacuuuucccagcacgcuuccaaagaagcucaucagccacaccacagaaucaccugcugcaucucagcaccagugagcgcauagugugaggagugacuugaggagcagcuuaauuaggagaccacaugaaacaauuagaagauuccuuggaguccuuaagcaggugauagggugguuaaagaguggugugacgcaggugcacgcccgggguuaagacucagcugcuucaguaaguaugcuuuguagaccuagauaaaaugcucuuucaccucucugggaggaacuugaagaagauagcucuuacaucauagacuuguucugaagacccaaagaguuuguacauagcaaguacugaauauguggcaauagcaccugugcguguuuccucugccgcacacaguguuagaggcaaaaggucgggaugaagacauaauuacaucuucaggggcucugccucuugugcacuuagcagaaaaagcaggaaauaauagcagcagaaaaagcaggaaauaauagcuaaggcuggccucgaugaguguugcccuccucccuacucuccacaaggguggaucaucacggcauucugaaggugaacuguuuccugaggggggggaaacucuucugcuuauaugccuccugggaagagaccauguuugaacugugcacccaguugguuuggaugugccuuuuggcucauauaauguuuuccucagagacuagaaaucuuuguuucucacugacuuuuuuuuuuuuuuuuuuuuuuugguuuuucgagauaggguuccucuguauagcccuggcuguucuggaacucacuuuguagaccaggcuggccucgaacucagaaauccaccagccucuaccucuccagugcugggauuaaaggcgugcaccaccacgccuggcucauugacuuuuauagugaaacuacccuguacauuuguagcuuuuuucccugauucuuuacuuaaucuuuaaccuuucucagucuuuuucucagcuaucacuuaagguuguacuacuggagcauugugagggcucuucugucauaaaggcaucucagaccuauccccuuuuaagauggaggcagcuggcagcuggcuauacauuucuuggcccauuuagguguagugucccuguacuggauuuauuacauaauucagaggaccaggaucuaugaagagcuggcccaguaggggauucccagugggccaugugcaugaauuuucgaggguauccauugaaaagcagauuccuguaucccaguuccagagugaaugcaucaguagcucuggaggcccagucaucuagguuuaagaguuccccauuauucuaauguccaaaagcauuugagcaucacuggaauacauuauucuuggcagccuauugcuggcuacuccuccuggcugagucugcucggaaugaucucuaaaggcuuugcaaauuagagcugcauauaaggacuuugcaggagguuuucuacugcuccucugaaagcuggcacacguagaccaucagugcccuuuaugccucaagcaaaggugccucaccugaaucuguccaguuggccagagaaagaggugaggggguaacagagggagcgaaggaaggaagaaguagcagagcugucaugcacaguaaguuuauagagaacuaaucaacaaauuuagacugugugaugacaguuuaggcuuccagccuuggcauagucugcacuggaucauaggacuuggccuacaagauggggugcauuucaguguuuuucuaucguccguuaaaucuucgaugacuccuugucuuucuccaagggaaacauaucaugacguuugaccagucuuucuguguucugaccccuuggauugagauacaucucaucuucuauucuugacagcuuaaauaagaaugucccuauuuucgugugcaccauggccuaucccaccguuccuugucccuugcacaucuuugagccuuguuaccgccugaugauucggagauguauugagacaggcacaagacaguuuggcaugugccuuggagauccugucaaaggguaagugaagagaccuagacagcagggaaguuggguggagagguauuuaugcuuuacuuuggaaacauccuagaggugggaucaacaaguccaugaggcaagcucaaaaaacaccaagcaucugugagggugaaagucucucuugugccugcauuacaguaugagaaucucauuauucuagagaacccuagagggagggaguguuucauccagcaggugacauauauuaaaaaaaacuugucuuguaggcuuauggcuguagcucagccugccuaccagucacaaagcccugagaucaaugcucagcacuacauaaagcagaaggguauugcacaccuacaaucccaacuauagggaaguagaggcaagagaauacaaguuuuaaggucauucuugauuaccuaugagguucaaggacaguuuggaacacaugaaagccugucucagaaacaaacaacacagaugaaacauguugucuuguuaagaguguuaaguccuagaguuaagcuacccacuuuuacaugugagcaauggccuugaagucuacuacuaagauucuggcauuugauaauagucauuguuuguauggaggauuaaauccagagccuugcacaugcuaggcaggcacucuaccacuaaccaagcagguuucauuuuauuuugacaccagguaccacaaacuugcccgagcaagccucaagucugagauucuccuguuaauagccucuuuuguaucuaggacuauaacuguguacuaucauguucaggaugugauaaggccuucuuguguccuaacaugguagaaagacaaagugacuuuugggcuagcauuggaaauguaauugaggaaaauacauaauaaaaaaaaaaagacaaagugagagacagugaccccaaccugccucuuaacaaugaaugugcucuugcaguaauuaauccacacaugugagcagacuucucauagccugaucacuucuuaaaagcccugccuucuaacaguguuaaaaugacaauuaaauuucaacacaagcuuugaggaggauaaacauucaagccauagcacugguacauaguaugugcuuagcaaaugguagcaguuauaccauuauguucaggucucuuuuuuucacugauguuuccuauuguguagcuguggugguagaucugggcacagaaauccuguaguaaucagcucaauguguuaagaauggcugggguccaggccaagaacaauagaacucaccaacaaucuacuuucuugacuugauucucaauaaacagguuuguagaauauggcugcaucuuagagaucagaaauguccaauucuuuucugauggccgaucggugguagacagcauaggcaagaggcgcuucaaagugcuccaucagggucaacgggauggcuacaacacugcugacauugaauacauugaagaucaaaaggugaggguggccagugccaagaaaccuggaagccaaauuaucaauguagcuugguauacaaagaugauugcaaagugggcucucagaauugccgugagaccuugggguuucucauaaaauugcuccugagauaaugcugcuggacugcugcccaauugcacccauagucuucucuuucccuguuauucucccugcuuagccaaauuguaguuauguuuaauguuugucuagacuaaucccuggacccauuccgccuauguuaggucucugcugggaacaccaagggcucaauuuagcauggggucuacauauaaguauuuuaacuauggauugauuuauauuguccaacucauuucuucugagauuauugaugauauauauaaauuugcaucuuuaaaaugugcaaccugcccaagagcacucuuccuaaaucaaaguuguuugccaucccuuaaagcaaaaauggucacauguccaauuaagccuugcuuuucugagcuaauggguagauaaagacaucaggaacccuauguucgauuauauuccuuauguaauggauuaauauaugauaguuggauaaaugcauuugaccuugaaaacauacugaggcacacauauaguaguaucugccuucccagugaguaggaaagaaaugaauauaaaaauggaaggaacagaggcaugccuuaaaccagcacgaugcgccuucagcugugccagaucaagccucugucucucugcuugcuguuugaggcaucguucucaaagcuuugccuuccugcuuucucugccauauugguacaccaggugcuggguguuccauaucuuacacaagagauugccugaugagugaaggggaggcaggucagauucucagaagagagucagguguugaaaacaguucuaaggcagauucaggagauggugauugcuucacuuucauucugaugguuucagguucagggagaugauugugcugaacuuaugggguuacacaacuguguguaugagcaagcgucaucaugguuucacucgcucaaagcaucucugaagaaucggauacuaaaucacuuugguccaaugccagagaaggacgaagacccccagguauauaaaaauaucuacuuaugauauguuggcccaccacguggggcuguccaggguuugugauuagauggguguguaguugucaugcagcaagucaagugcagaauaugguaugguguagcuagggagugagcaucaugaguaaggccaaaagggucugaauugaaugaacaaagauaaauaguaggaacuuggaccuaagacagauauugagaaauaagugagacgagaggaagggagcacagauaccaccaacaaaacuaucgguggcaguccagagccacaccauaggaauguuagggugacagaaucuaugcaaaggccagggacuaagagaggugauaccaaagguuacuacuuccagccagcuucauguccccacuguugcaggagcugggagguagggucgccuaucuuauaagaacacagcugcauaaaccuuccuguccauggcccugcaagucuagaccuucccuguuuucccuaaccugaccagguccuaagaaaacugaccgccaaggacauaguuuguuagguucuacuggauugucuucugugaggaccagcuuucugugagcucaggcugcagaaagccuugccucucugcuuucaaucaggcaauguuugugggggaauuccaguuuggagauuagauggccuaugcaaauauauauucuuagugcuguaaucuggcuauuccauagaaucacuccuguaacuucuuugauuucuuuuuuaauguaugcuuccugauucuaucacuauagaaaauucauuauauauauauaaugcauugccuaccuuucuaacugugaccuuggguaaaucccuuccccucuuucaauuuuucucuaaaaucagaaaggaucauuaaaaaucucuaaauuucuuccuccucuuacauucugagacuccaaaaugccucaguucccuaauuggcugaggugucuuguuucccucagagcacagagugguuuuuccccuuccugauacagaggcaucacuccgauguucuaaagagagcaaggucaccaagugcuuucuggugauccagcucuuggcuguugugacucaagaagucagcauaacucugaacaaggucauguucaagcuuaauguuccccuucaccugcuggggaacauucucucccagucagacaaaagauaaagaucagcagugcuaaccacaucuuccacaggagaaaacacagaugccuccgugugauucauaaggccuuaaugacauagcaagcucaaaucauuuccuuccuuauuaguuuugcuaucguguugccuuggugguggcagcagcagcaaaaacucauccagcuugcucuagcuaacccuguagccccaagcaguuccgcgaauaaggauguuguaccuuagugggagguuucuuagaaacagccagaguuaacaucagcuuaaguagcucuguugcugauccuggggaaauucaaaggaucaaccugguaguguccacaugaagcuaaagauacagagaagccaagaguucacagacauucagggaguaacacauggaacaauuuggagugaaagaaccccauccacguggaaggaguuaaaucagccacaugugcuucucuacaagcugaaagcugaccugcuuugaaaguuguggaaagaaaacucacucgagguuuaguaauaaaugucuaaaacgugugcuaaggacgcuuaugaccaagagaauuuuggugaaggauugauaaggagugugaaaugucuuuuuaaaaggaaaaccugaggguuaacacaaauguguuuucuaauuggaauguuugcuguuuuuuuuuugagacuggaaaucauagcucuugguuacaggggagaagauagcuauagcuguuagugacaugguauauuuagacuucagccuuccaccacauaaaaaacugaugggacuuaaaagacauacuaagcccagagagucauaggauuaaaggcccaauuuuaaauggaucaguccaacggaccuaaccaaacccugagaaguaaaagggacaaagugguggguacuccaucucuuaaaaucagacagccuagcagggcgugguggcacacgccuuuaauacuagcacuugggaggcagaggcagguggauuucugaguucaaggccagccugucuacagaguaaguuccaggagaaacccugucuugaaaaccaaaaaaaaaaaaaaaaaaaaaaaaaaaaaaaaaaaagacagccuagggagcauagugaaucuguuaaaauguugauuuccuugguuuaacaaguaccaaauaugauuguggcuccaaugagaaagaagaccucaguccuggagggcuaaggcacuucuauuccaagagaacauucaguaaccagagcucuuccaucacaaagcucugccaucuuuagaggguuacuuuuucuugauugaccaagacugaucaucaccaugucuucagucuugcuagagaaauggggaagagacggagagauggcucagagauuaagagcacugacugcucuuccagaggacccggauucaagucccaacacccacaugguggcucaaaaccaccaguuaauggaaaucugacacccuuuucugacuucuguagugcacagacagacaugcaugcaggcaaaacaccauacacauaaaauaauuaaaaacauuuaaaagaaauuuuaaaaaauuggaagaaagaggagggaagagacuacauguucuuuucccauaaaaugaugggaacuuagauguaucaccucucuuuguuuuuagccaaaauuugaccuuauggccucaccuagcugcaaagaugccugagaaguaacaguuuuccucauccccugccaccauguaugcuuagcugaaauaaaagaggaaaacaaugccucucagcaaugugugccacacacagaagcaguuccaugugugauacuuuacuguaugcauguggacuucuauacauggacuacaugggauccaugaacuguguuucucuguugcagguuaauccgaaugguccagccuggugcugguggacacuggcgguucuuccucuggaaagcagagcucagcuucccuuccuagcaaugagguccuuaaaggacagauugaaugguauucggcguauccuggccuuuauaucgagaaaccaaaauuaaagggacuggauuguggaagaggaauuucuacccucuccacugccccgaggcaauguucuuguaaacauaucuaauugcaauaacaccuuaacagaagagaguacccuagauagauguuguuauucuuuuugaccacacagaaaugagguagaaagaccaaaaggaugugaccuguuugacuuacugucuucaaaugcuucuugaaacacuauacuaacacacaaauagcagaagugugaagaagucaaaaagaguugauguuuagcaucaauuuuucugaaguuaaaaaagugaguuguuguucauagcuaaaugagugugugguugaaaugucaagcagagauacuaauguuacugcauucuuucacugacuugaggucucauuucaaaugguucagguuuuauaaagcauuguaaaaaauaauguucauacuucuuucuguuuuaauaauuuauuuuuugcacuacugcgucguuuuucuacauauauguuuguaacuauuuaaguguacauuacugaaaaguccauugcuuuauuuauugauguggcuuacucuguagggaggauaacaguacuaaccaugugcaauguucuuucuuuacucaguuuuuguugaauuaaucccaguucuuguugggcuuuuauauauacauaguucaggucuauucuaguggacuaaguuuaaaagaacuucagaagaauucuaaaguaauucaucuucacagauuccacauuuucaguuuaauuuaaggacuagaaaaaugcuuaauugauuuggcauaaauugugggauauaccaaaguaaaguaaaagaauccauuuuccauguguaauacagaauaagguugaaagacauauucaagaucagagagaugaauuacaggugucuuuuuauuacagucuacuacuauagguauuuauuucaggcaaucuaauuagaaaaguauuaauuucuccccagugcaguuagggaagagauuaauauuuaccuguauuuucagaggggauggcuuucaauuuggcgugccucuccccuaucuucugaguucugaaguuuaaaaccuguaccaaugugugcuggaauacuugagagacuguucuuaaagugugaagaaacuggauagguuagaaccccuuuuaaauuacuauaaaagauccagagaaugaauccaugguuuuauguaaacacugccuucccuccugguaaagaugggccaaagauuucaaugcagggggagaaaagacagugaagagaugggaguaaguuucugagcuuagugcuagucugaguccuucggugucagagaaaccugaaaaauggagugugggaguguuauaguggcagaggagaaaaugagaguuaggaaaagugaauugucagauuuuguuucucaugcaaacuacucccaggugauuuuggacaacuaugguguguuauucacguguaggcucuccauucuguuaacaagagaggggguucgaagaaggagagagauugcuucaaggaucagucuagguucuucuauaaccaccagaaacauggaagagguggggcuugugugugugagagagauggucucuaaaugcuauaaaagagacucauggaagcagaaagcaacuuaucacugacaacuugcuugauggaggcgguguugucagagcauugccaggucuguuuggaauaaucugggcuggugaagaaugaugcaaguguagggaauguaaauaaagaaguagauacuauccaaguuaagucuagagggcucggaaagcaggacauuaagaggauuuuucccuggcaccugauacccagccagccaugugauuauagugaaguccuaguaugacugcuuccuauucuauagugcaaacacaacaaagaagagcagaagcuucuccacuuacgacauauguuacuuuggcaaguaauuuagcuuccguugagucccaguuuucuuauauauaugaaaugguacuugugcucacaucagcaguacauauacuaaaauuagaaugaaacagagauuagcauggccccuucacaaggauuguaggcaaauuuggauaguguucuauauauuuuacuaaaagaugaaauuguagugauauuaauaguauauaggcuugcuaggaacauuaaacgggacauguaagaaauuacuuaacaguaccuugauguugggagcuauuuggugaacuauaacuauuaucagccauguugcagaauaucaucaguggucuacaguugcaugaagcauugcuuuuacuuguaauucucauuuguacccuacuguaaauccaaaccacugauucuuggaccacaacuugauaguuugcaagugacuccuauuggaguuaaggccagcaaaguagagcuggggauacaucucaguugcugacauggcauggggcgcugauucucucuccaguucuguaaaaaauaaaauaaauguagggaaaauuaaaauacuggagagaaaaugaggguuaguuguagggacuaauuucuaugccaagaaaacuguucccauuuuaauuagggcuaaaaaauagugucguauugggggacaucuagaguucuugauaaaaugggagccuuaaguucugguuccauaagaauaaccaaaaccaucucucccucuuuuucauauauugagaaucucaacuagaacaauuagauuucagaacaauuagauuucaccaucuauggaguuugcacacagccaauaguauuucuuucugcugccccaaauaacaggcucuacaaugauguacugaaaaccuaccauguaccagguacuaaacugagugagugaucucgaucucccuuaccugaacacaugaaauaaccuuuuaaacagcaucauuagauauauagauaagaaaacauagguaagaaaacagaauggacaauuuuaaagaauaugccuauguaacauguucagugaguggccaagcuugauucuguaccaacaaugugacagauguuugaacauuuuguguuauguauguuucacucaguaggcauggcaaaaccccuaagagcucaaaaugaggaguuccaggugaagucaaaugaagccguccaacacaucucuuacuaauccagggggaaaguggauuuuuggcuucuugauacaauuccuuugauaagagaauacccaagaacagauggagaucuuugcuaggcuaaauagcacuuuccucugagccuggaucuagauuggguuguucuccagcaauuauaguaacggcaggauacuaggcuuugacuuucuuugggauguacauaagugggcuaauccaucgaacuugaccacuuuuaacaccuguggauagguucuguuucuaagcucagacaugagacguacagagauaaaaacuauaucugaguuggaaggauaagaguccuccuuguagacagugccacuuuauuggguuagucuuucuuucuaucuugaauucaugacugacccagaccuuguagauuauucucucucucucucuugucuguguguguguguguguguguguguguucaugugugcacacacacaaagagacccuagguagcaagcagacuuuaugccuuucugcuuuguaccguacuauugcugcuagcuaaaaaccagcaaaauguagaaagugaaaacugaagaaacuacuuugcaguggauaauuuuaagaaaaaaaaaagaugcuugcuccucauuuaggggagcagagaacuauuccaauagcaugccuuuucugaaggccacgugcuucgaguuccgugcugccucaguagcgggauugaguugugauggcgcacguggcacugccaccucugccuguggagcugcccuggguucagauaauccccugugaguagccacagaagccucagaacuccuauggcugggucacugcaccccugucaacaaguuguguccuguugauagacugcgacccccuggagccugcauucccugugccaacuccauuuucagcaugugaauuuuagccauagauucaucccugaguucccagcuuguggacuguguguccguuucaacuccucaagguagaaaugggcaggcugcaagcccauucuugggucuagggaaugagguuuagauucuggauagaagacagcucugaaaagcauaugcuuggcuuucuggcauuucuaauguucagcgggcaggaaugcaaaggagccaugcacaguguacacauucaauuccuuuuagaacgauaggucccauucagucuacugcuuuacuacuuaauagucuggauugugcacauccagugaugaaaugaagaacuuuucacuuacaaguggguguuuccaaacauguuaaaauaaccuccagagagaagugccuggaaccacuguuccuggugucacuuuaaagcuuuuugcuucaugacucuagcauuuaaaaccuguuugcagccacaaaugugauuaacagaaguuuacaaagcaacacuguaccuuaugcauuaucuuaaaaucuguggacauucaucuauuguucaagcaaugaugacaaccagugagauaaaaagagaguagauaguucagcauggcaccauuggcuguuguuagacuaguuucauugguguaugcuguccuuuguaaugucaggacuaaaauaucuagcaagccacauaaacgguggcaaguguguauauuguuugguuuccauuuguuuguuaaacagccauuuuacuuuuccauggucaugaguugaagggaaauuaagauaacgcucccuccccaccaacacuauucaacuaccucucuaugccugauuucuuuaaaaggguucccuucuucuaaaucugcacaaaaauaguuccagcucaucuacguuguaaucgcgaugugauauagauggucucugugaaaaaaaaauuguucauuaaacagaaauuuccuguugu

SEQ ID NO: 9441 - RNA, 5856 nt, Mus musculus
ccuguagaaacuugaguagugaagucuucuguuuuaugucacagcuucucuuuaguuucuuuucaccaucagucccgggggagucucaggaacauucucccgauauccugaagcuguuggcaccucacccuagauuaaaggaacacguagagucaauggcuacugaaggcaccagccauaaucuaccaaaguugucacagguaaaacucaacucacccagcucgcucaugaugcuucauuuggcucuuuugugggcacacgacaagugagcccuaccucuccuacuuugguuccugagggaaaaagaaagauggaguugauaauggcuguguccuuugcuuaaaaacuacaacugggaauuucaggcaugguccaaaaguuuaugaauuuauuauauuuguagucuuggucagauugagaaaauagagaaauuugauagaaauauaaagagauuggcccacuuccccuaaagcccuauaacuggggugugcuuauugacucugucuugguccaauccggaaaauagauuugauacaacuauaaagagauuggccuacuucugaaagccuuuaacugggacuuuagcuuuggggaagaugcugauggccuuugaguaccagugagauccuugugcaacguugauuccauuuggggaccaaauggagagaauuucuugcucuugcacuauaccuuacacguaaguaggcuucuuaugcacaucuauagcaaaguagagcacgagagcugaguugagaaggaugacaaaaaaaaaggaacagagagaugggcuucaggugcuggccuuucuagcacaggguaagugggcagaaguugggguucagaagaccagacuugaagcaaaguuuaacacugaauaccugggcaccuuuggggaguuguuucuucuccauuugugccugaaguuccucacuuguaucuaagcccuggauguucacaucuucccagucucugccccugcucuagagaaggaauagaaugcaagguagcugacuuuucuuggugauggcagaacucagaauaucucuugaaaucagagagcccccaguggucauuaguacaggacuaagacagcgaacacuagaccagaggaccuggaguggggacuucuacuugcaacucagucugaaaugaaggaaauagaaccucugccuuuccacugugagcagaccaggcaacagcgaaugcauuuccaccaaaacuuugcuuggcaaggccuuguccuguguggacaguacucugggcucacagaaaaucaaaacuguaguauuggggauuuuuuuuuuaaguucuugaaaccaucugaacacccagggauacaggcuaagaaacaucgcauccuuuccucugcucuucguuguuuccucucaccuguguccacugcgacuuuuggcagggcuuagaggggaaacaaccuuuugcugucaaauauggauguggguuauagagaagguucuccagagcaaugggaauaaacacauuuucgggauuauuuuagguugcauuuucaaauauccuuuuccuagaugaaauucuguaaaagcuuagagacagacuauuagaccaaauuauuuuugucuucucuuuagacuuuucacagaaaauggagcaaacagacuaaauaaucuuuuuaugaaaaauaaaaaaaccauauagcucuggagcaugaguuacuucggcaggcuuguacagagcuggccuaaaguccucugaaagaugucuaugaaugacagucagggugaggggaaguaaccaguaacaggauauccccucacugagugcuuugccuuccuuacagaccacuggggaaugcuuuggcuaggagggaagagugaugcuucccuuguaguucccccuucaccccugcucagccaacuuguccuuccaugugccuguuguccuuguuuagagaaguucuccuaacucuacugaagcuaggcaugucuuugacauagauaagaugucaccgauaagccucaaggcugucccuccguugaguugcguagccacuguguauucaggagugaggaucagagcuauguuucucuuuguccccucaggguaagacuauuggaggaccaaucuuggucccaagcagcuucugaucucuggguuuuugcuucaccuaggagaaucuggagcuuccccauuguucuaaucaggagggagcagcagcugcagaagagagcagcagccuagcaaauuccgcucaaggaaaggugaguaguaaagaagacagaaagaaagaucaggaaggagaggaccgggaugcugccuccgucaggaccggcaaaugccaggaaaagaagagaaaucguugccaaaucgaaacccaagaagacacagaauugccuaauaaagucuccaaacaagguacuaauucuacccaggaagaaaguaucauaaugcagaugacugggcucgcugaccuauguaguuacacucucuggggaccccucuaguucagaguauauggccuagcucuggcauuuaccaacuaugaaaucccagggguugcugugacgguucuuugagaguguauugguaacuaucauacugaaaguacuaugugauauaaugugauauagcucuguuauaguguaauauagaucauccauagucaggacaucuggucaagcacccgaucaaucaagggaugacaucucaugcuuuuccaucaugucacuuuccuccaggauaaccacuuccugccucaucccaguugugggaauguaggauggcagaggugugcucaggucucguucgguugugcccugagaagcagcagcuacagcuucauaucuuuccaagagagguuggcagugccaagacugaucucagcuuugaagaccuggcucaguccagggaguuaccaccaccgcugcugcugcugcugcugugccuacugaauuugaaugaccuuagccaggagcuccuagucuuggacuucucugucuaugggcccugcuaaaaugccucugggagcgcacuucagggaacccuacuggcaauugcucaggcagccacuaaauuaaacucugggggagauugagauugaaaaccagaaagacauuuuucccccagaaguauugucuguaaaaauaaaacgaguugcuccaucccugauuuacuguuuccuaaaucacagauuuuccugcugagcagggagccaaaccagaucucaguaauccacuuggauccuuugaugcaucugaccuugaaugcucacuguguaugagguaugugaugugggccagcacuugacugccuaguauuuccugcucuuuaguagcuggaccuuucugcuggugacuuaacuacugaguugguuaguauguaaaaucauggcacugaugaaauguaaaccacauugucacaugagagagcugguguccaagcuuacaaacuguguucuuuacagccuuagaucucaauuuaaagagacauggaaaguggcaaggcaauacaccuuucaaaggucaaaaauggaugggccacguguugaauaugccuacuauuuggucuucauuagauuugauuuuguuauauaugacuguacugaaacaagacauauauuuuccagcuucccauaaucccauuguuuuauaccagccugucuuacauuauuguuugagccuuagaguuuuuugaacuuguaacacugaaucuaaacuacuaaguuaagaacucaaugcucaaggguuaauguagaucccacaagcauuuucuuugaaagccaaauagaagccuaaauugauuuguguuuaugcuaucugaugaacaguacauguaacagauacuuggucaaguauuuuccuugcagcuaguaugugaucucuacuuucucgggucucugaagagcaguuuauccagauaucccacuucaaaaacaaauaaaaguuuauuucauuucauagcugugauuuaguggcuaagagaagaggcucugaagucaauguuugaacccuagcucuuuugaccuacagacucugguccuagagcaaauaacguuugcuaccaugauuuguuuuuuuaguaaaggacaguggaaucaacuccaucaguugugacgguuaauuaagaaaaauuauuuaauguuuagaguagugacuggaaaacaguaaguacucaaaaaaaauuuaacuaauuuuuuucuuccuacucauuggucuuuaauguuagauccagggaccucagaagaaacucuauguauacauucgaauagaugcaugaauucauugaagcaauauguaaagugugcauauguauggguggauguguuucuaagauagaagcauacugcuugcauuagauucucaaaugugcugauuuuucuccaaaagcauuaagacggaacuuaaauacuugaacaaauguuugccugccuuuugagagcacuuacucuucuguuaucugucauguguaagucauuauauucugaaugacauuuuuggucaugugaauaagaacaaggcaacuauuaugcgauauagacucuucuuaggaaaaauauauguauauauguucgcgcauauauauguauacauauauauauauacacauguguacauauauacauacacacacauacauucuugggucuaggggaauaguucaguggcacagcacuauucaugagauucuggauucauuaaccauuauuaucacaacaacaacaauaguaaaauaauaguauauaaaaaaucuguaguagcaaaauuuguucacaagcauauaaaagucucacacaacucagaagacacagcauagaugcagucaaauuaagcuucacacauccugucaguagucuguuuaagugguguggacaagaauggaaugaacaacaguaccagauccuuuuuacugccucacccagacccucacuacagaguggcaagcgcaucaugcuaaagccaagguaugagauagcaaaaaccugcuuucaagcagagaaugggcccugcagccaccacaccagcucugugucucuaaagccugugauaggcgcugugaauuccauuuaauuuagcuuacucagaaagagcaggucuuuguucugcuuaacccuccuuaacacuccugccaaaauccaggcgacacaaaaucaaacauccuguuuguauuuucucuguggaauaaaaauccugagguugaaauuccuuuguuccucuuccuuuucuuuuccucuuucaucuucuuuguccguaaucacaagggacuuuguagaagaguuaggaauuugcuccaagaaauaaacacacagaggauaagcaccccuucuaguuugcacccucugagcuuaaaaaccauuguggccccuuguuccauauuuggccagaguagauguuauggaggcuacuaaauuauagcuagacuuucacuaccuucugguguaagaaaccugaucuaaagcucuuuacauuucagcccuugagaagaaacauguagcuucccuuccaacaggauuugucuguuaaguuacacaucaguucuugaaggagugaauuuguuugccuguauuuuucuugucuugaaaguuucuuuucccacuuguagcuauugcuguuuucucugugguuguccuuagguuuuguuuuggcccuccugugucuuuagaagagagguuuuguacuugguuacuuuucuuguugcugugacuaaauauuugaccagaagcaauuuaaaggaagaaauguuuguucuggcuuaccauuggaggggaucauugucucauggugagcaagacauagcagcaggugggaggaaauguggcugugagcuccaggguccugcugcucgaaaugauuucacaacauacaggagacacagaguagugaa

SEQ ID NO: 9442 - RNA, 5856 nt, Mus musculus
uucacuacucugugucuccuguauguugugaaaucauuucgagcagcaggacccuggagcucacagccacauuuccucccaccugcugcuaugucuugcucaccaugagacaaugauccccuccaaugguaagccagaacaaacauuucuuccuuuaaauugcuucuggucaaauauuuagucacagcaacaagaaaaguaaccaaguacaaaaccucucuucuaaagacacaggagggccaaaacaaaaccuaaggacaaccacagagaaaacagcaauagcuacaagugggaaaagaaacuuucaagacaagaaaaauacaggcaaacaaauucacuccuucaagaacugauguguaacuuaacagacaaauccuguuggaagggaagcuacauguuucuucucaagggcugaaauguaaagagcuuuagaucagguuucuuacaccagaagguagugaaagucuagcuauaauuuaguagccuccauaacaucuacucuggccaaauauggaacaaggggccacaaugguuuuuaagcucagagggugcaaacuagaaggggugcuuauccucuguguguuuauuucuuggagcaaauuccuaacucuucuacaaagucccuugugauuacggacaaagaagaugaaagaggaaaagaaaaggaagaggaacaaaggaauuucaaccucaggauuuuuauuccacagagaaaauacaaacaggauguuugauuuugugucgccuggauuuuggcaggaguguuaaggaggguuaagcagaacaaagaccugcucuuucugaguaagcuaaauuaaauggaauucacagcgccuaucacaggcuuuagagacacagagcuggugugguggcugcagggcccauucucugcuugaaagcagguuuuugcuaucucauaccuuggcuuuagcaugaugcgcuugccacucuguagugagggucugggugaggcaguaaaaaggaucugguacuguuguucauuccauucuuguccacaccacuuaaacagacuacugacaggaugugugaagcuuaauuugacugcaucuaugcugugucuucugaguugugugagacuuuuauaugcuugugaacaaauuuugcuacuacagauuuuuuauauacuauuauuuuacuauuguuguuguugugauaauaaugguuaaugaauccagaaucucaugaauagugcugugccacugaacuauuccccuagacccaagaauguauguguguguauguauauauguacacauguguauauauauauauguauacauauauaugcgcgaacauauauacauauauuuuuccuaagaagagucuauaucgcauaauaguugccuuguucuuauucacaugaccaaaaaugucauucagaauauaaugacuuacacaugacagauaacagaagaguaagugcucucaaaaggcaggcaaacauuuguucaaguauuuaaguuccgucuuaaugcuuuuggagaaaaaucagcacauuugagaaucuaaugcaagcaguaugcuucuaucuuagaaacacauccacccauacauaugcacacuuuacauauugcuucaaugaauucaugcaucuauucgaauguauacauagaguuucuucugaggucccuggaucuaacauuaaagaccaaugaguaggaagaaaaaaauuaguuaaauuuuuuuugaguacuuacuguuuuccagucacuacucuaaacauuaaauaauuuuucuuaauuaaccgucacaacugauggaguugauuccacuguccuuuacuaaaaaaacaaaucaugguagcaaacguuauuugcucuaggaccagagucuguaggucaaaagagcuaggguucaaacauugacuucagagccucuucucuuagccacuaaaucacagcuaugaaaugaaauaaacuuuuauuuguuuuugaagugggauaucuggauaaacugcucuucagagacccgagaaaguagagaucacauacuagcugcaaggaaaauacuugaccaaguaucuguuacauguacuguucaucagauagcauaaacacaaaucaauuuaggcuucuauuuggcuuucaaagaaaaugcuugugggaucuacauuaacccuugagcauugaguucuuaacuuaguaguuuagauucaguguuacaaguucaaaaaacucuaaggcucaaacaauaauguaagacaggcugguauaaaacaaugggauuaugggaagcuggaaaauauaugucuuguuucaguacagucauauauaacaaaaucaaaucuaaugaagaccaaauaguaggcauauucaacacguggcccauccauuuuugaccuuugaaagguguauugccuugccacuuuccaugucucuuuaaauugagaucuaaggcuguaaagaacacaguuuguaagcuuggacaccagcucucucaugugacaaugugguuuacauuucaucagugccaugauuuuacauacuaaccaacucaguaguuaagucaccagcagaaagguccagcuacuaaagagcaggaaauacuaggcagucaagugcuggcccacaucacauaccucauacacagugagcauucaaggucagaugcaucaaaggauccaaguggauuacugagaucugguuuggcucccugcucagcaggaaaaucugugauuuaggaaacaguaaaucagggauggagcaacucguuuuauuuuuacagacaauacuucugggggaaaaaugucuuucugguuuucaaucucaaucucccccagaguuuaauuuaguggcugccugagcaauugccaguaggguucccugaagugcgcucccagaggcauuuuagcagggcccauagacagagaaguccaagacuaggagcuccuggcuaaggucauucaaauucaguaggcacagcagcagcagcagcagcgguggugguaacucccuggacugagccaggucuucaaagcugagaucagucuuggcacugccaaccucucuuggaaagauaugaagcuguagcugcugcuucucagggcacaaccgaacgagaccugagcacaccucugccauccuacauucccacaacugggaugaggcaggaagugguuauccuggaggaaagugacaugauggaaaagcaugagaugucaucccuugauugaucgggugcuugaccagauguccugacuauggaugaucuauauuacacuauaacagagcuauaucacauuauaucacauaguacuuucaguaugauaguuaccaauacacucucaaagaaccgucacagcaaccccugggauuucauaguugguaaaugccagagcuaggccauauacucugaacuagagggguccccagagaguguaacuacauaggucagcgagcccagucaucugcauuaugauacuuucuuccuggguagaauuaguaccuuguuuggagacuuuauuaggcaauucugugucuucuuggguuucgauuuggcaacgauuucucuucuuuuccuggcauuugccgguccugacggaggcagcaucccgguccucuccuuccugaucuuucuuucugucuucuuuacuacucaccuuuccuugagcggaauuugcuaggcugcugcucucuucugcagcugcugcucccuccugauuagaacaauggggaagcuccagauucuccuaggugaagcaaaaacccagagaucagaagcugcuugggaccaagauugguccuccaauagucuuacccugaggggacaaagagaaacauagcucugauccucacuccugaauacacaguggcuacgcaacucaacggagggacagccuugaggcuuaucggugacaucuuaucuaugucaaagacaugccuagcuucaguagaguuaggagaacuucucuaaacaaggacaacaggcacauggaaggacaaguuggcugagcaggggugaagggggaacuacaagggaagcaucacucuucccuccuagccaaagcauuccccaguggucuguaaggaaggcaaagcacucagugaggggauauccuguuacugguuacuuccccucacccugacugucauucauagacaucuuucagaggacuuuaggccagcucuguacaagccugccgaaguaacucaugcuccagagcuauaugguuuuuuuauuuuucauaaaaagauuauuuagucuguuugcuccauuuucugugaaaagucuaaagagaagacaaaaauaauuuggucuaauagucugucucuaagcuuuuacagaauuucaucuaggaaaaggauauuugaaaaugcaaccuaaaauaaucccgaaaauguguuuauucccauugcucuggagaaccuucucuauaacccacauccauauuugacagcaaaagguuguuuccccucuaagcccugccaaaagucgcaguggacacaggugagaggaaacaacgaagagcagaggaaaggaugcgauguuucuuagccuguaucccuggguguucagaugguuucaagaacuuaaaaaaaaaauccccaauacuacaguuuugauuuucugugagcccagaguacuguccacacaggacaaggccuugccaagcaaaguuuugguggaaaugcauucgcuguugccuggucugcucacaguggaaaggcagagguucuauuuccuucauuucagacugaguugcaaguagaaguccccacuccagguccucuggucuaguguucgcugucuuaguccuguacuaaugaccacugggggcucucugauuucaagagauauucugaguucugccaucaccaagaaaagucagcuaccuugcauucuauuccuucucuagagcaggggcagagacugggaagaugugaacauccagggcuuagauacaagugaggaacuucaggcacaaauggagaagaaacaacuccccaaaggugcccagguauucaguguuaaacuuugcuucaagucuggucuucugaaccccaacuucugcccacuuacccugugcuagaaaggccagcaccugaagcccaucucucuguuccuuuuuuuuugucauccuucucaacucagcucucgugcucuacuuugcuauagaugugcauaagaagccuacuuacguguaagguauagugcaagagcaagaaauucucuccauuugguccccaaauggaaucaacguugcacaaggaucucacugguacucaaaggccaucagcaucuuccccaaagcuaaagucccaguuaaaggcuuucagaaguaggccaaucucuuuauaguuguaucaaaucuauuuuccggauuggaccaagacagagucaauaagcacaccccaguuauagggcuuuaggggaagugggccaaucucuuuauauuucuaucaaauuucucuauuuucucaaucugaccaagacuacaaauauaauaaauucauaaacuuuuggaccaugccugaaauucccaguuguaguuuuuaagcaaaggacacagccauuaucaacuccaucuuucuuuuucccucaggaaccaaaguaggagagguagggcucacuugucgugugcccacaaaagagccaaaugaagcaucaugagcgagcugggugaguugaguuuuaccugugacaacuuugguagauuauggcuggugccuucaguagccauugacucuacguguuccuuuaaucuagggugaggugccaacagcuucaggauaucgggagaauguuccugagacucccccgggacugauggugaaaagaaacuaaagagaagcugugacauaaaacagaagacuucacuacucaaguuucuacagg

SEQ ID NO: 9443 - RNA, 7942 nt, Mus musculus
auaggcuccgcccccggagccccgccccucccgagcuuuucuuccucugucaaagaacgcugcgcgccacuguucgcugggagggcggaggaagcggacuguuccggagcucugccuagccgggcccaaccuuugcuccagagaucauggcugccgaggaugugguggcgacuggcgccgacccgagcgagcuagagggcggcgggcugcugcacgagauuuucacgucuccucucaaccugcuccuccugggccucugcaucuuccugcucuacaagaucguucgcggggaccagcccggugccaguggcgacaacgacgacgacgaaccacccccgcugccccgccucaagcggcgcgacuucaccccugccgagcugaggcguuucgauggcguccaggacccgcgcauucucauggccaucaacggcaagguguucgacgugaccaaaggccgcaaguucuacgggccugguacggaggcagggccagggggucguggagacaaaagaggggacccuggcguggaagcggggcgggagagaggccgggggagguggggcgcccccgugggagggucggagggaaggcgggcagcaaugggagcgggccgggggcacgaggcucugggugggugggggugcguacggggggaugggaugcccgaaugaggcugagccuuggaaaccgcgggugggagggacagcgagguccgaagccccgggauauuagggaacuuuucgaagguagugggcuuuggggcggggguccugaaaagagggggagacuucggauuugaggggaaaaaaugaaggugucuccagagaggcccagacacuugagaagacguggaggccgaugacgccggaggagccaugguggaauguaaggguguguaaagagagaaaguggagaaggggauuagugucagguaaagcagcauuguuccuggcggagaauguguguguguguguguguguguguguguguguguguacacugugugcaugcgcagugaauguguguuugguguacaccguuugucugggggguggcgcuuggaaugugacauguguuagguaugucuuugguauguguaugugcgugcagagugggguggacucaggcuggaugaugaauaagcgaccaagcuugguuggaugcauuaagagcagugugugguggacuaugguaacauggugagauggucagaaacaccauauuuaguguaugauagaguggggagacugggagguggaaaaaauaaaaugaaaugaaacgggggugggagggaggaguggaaggguccugagaaacaauaggguaaggcugugaagcccgauggguggggggauuucaggaaaagccaaccaaggggaaaacaagagauggacaacuccccagaaaugaggcuuuuccaaacuggauugccuaucacaaucaccugaugcuuaugaaaaauacagauucuuggccugaccauccauagccacacuuagaucucuggggcaggggagagggcuaaaaagaucuacauuuuacuccucugcuguagggaaauggggaaucagccagauuuagaaagcccugcuuucuagaacauuuagagaggaagaagaggcuuuagcucucccaauauggauuccucuaagcaccaggaacucggggcugggggguggguauguucacaugcucauuggucugagagggaagacuagccagcacuaauccaaaccagacauacccacucuguuacgucucagaguccagccaaucaaaagcacaugugccaaaggcuuuuuagugaacucucacucuuccuuucugcuuucagacauuuuagaaaauuacguucuguaggcaugugacugcaaaauaauaggaaaacuacauauuguuugucacuguagucacacauuauccauaaacaaugguguaauuacccauaauuauuaagcuaaaccauaagguaaucaacacaaaugcacgaggccucgucaucugguuguauuugcaaagucaucacauggggauccuccgugcuuucagagagcacagcuggagucaagcugucuccauucuaaccagguagguuacaguuugcagagucauccugccggauaucgauguguguacuggaacagcuacaacuaggagucaaccugcacucuacauucuagccucgcuguugucccugaccagcugugugaucuggugcaacgcccuauggucucaaggccuuaguuuucccucugggaacauaaaaagacaagcacgcccccagugugaggaggccaaggaacacugauaguaucauaguggaaauauuuucuguuacagaguacucuuagaagugaagccauuugagugucuaguacucuguacagcacagucguagaugcuagcgaguagcagugagugaaaaacacaaagcucugcucaccaagcaucuaguuaauaugcuuuguagugaacaaaauauacucuccaaagacuauuaauauuugccuuagaucuuguuuaaguaugcauuaccaguccagggacuguaauuucuaaaaugguaagaguccaaaccaagacuuugacuuuguuuccaagcacuaggugauacuauuuccauuagcaguauauauuuugugaaaagcauaugaauuuuguucuuuuuaaaccuucucuaguggcagcaugcaaugaggacugaaaccaaccccuauuuuagaaucuuaguugcauuuacaagaugauccuaaggguuugaaguauaucucagcacuagggugcuuuccuagaauaugcaaagccccaguccuacaaaaaauggaucuuaauauguuagaaagaaaaacaguuuggucgacuaaaguuucagauaaccacacuguaaugaaauaccagccauuccuaguugguaugacgauuuuaaugucagaguugcuaucuagccuccuuuugggaaaacgaggcauugcuuaaaguacuccgaauuccuuucauuuguuugugcaauauuuaacucuaaauaaccacuucagguggauucagauugauccacuguccucagacaaaagcuugcuaugauguuauacauaguagcauuuuucagguuuuaggagauuauuugaaggcguugauugcagcccuuuucagugaaaauuuuaguguuuucacugcuguuuacacucauuuguaugcuuacacuuaauaauaguaccaaaacugaucucccuuguugugaguucugauuuaaauaagacaguaaagguuauauaacgcagagaggcuuuggaaccacugguauuuguaaaaugauuguucuugcagaugccuuaggguucaugacuugcaacuaaagaucauuuaaaacauaucagaauauguugauaagaaaauguuuucauuuacacauuagugguuagaaacuguaacuuugacugucuuggcucaagcacccagaauagagccaaccuguagauacaaagucuuugagcugaauucuaacccauggaguguauaaucaaacaauccccauuaaggccaccgucaaaagaacuacuugagcuuauauuagcuaugugcaggacauagauuucaaaugcuacacaucuuuauuucauuuuacuuaucaaagugacaguaagucugucaaugcccuuauguaaugaucaaaguguauucgugcagcucaauaauggaaugugaagccaggaagugguggacuccuuuaaucccagcacucaggaggcagaggcaaauggaucucugugaguucucuguggcuauucuggucuacaagagugaguuccaggacagccagggcuacacagagaaauccugucucaaaacaaacaaacaaacaaacaaauuaaaaggaggcuuuugguguugaaagcaaggaagccgucuucuguuuacgugagccaaggaaaaguguauuaucuaauaaagaaucugucuuugguuucauuuugucuuuaaagaggggccauauggggucuuugccggaagagaugcauccaggggccuugccacauuuugccuggacaaagaagcacugaaggaugaguaugacgaccuuucugaccucaccccugcacagcaggagacccugagugacugggacucucaguucacuuguaagcauugcuuuauauuuugccuagaucaaauuucuaccaguaaugcagauuuaugaucaaacaauagcuaugaguaagcacccugaaaucgggugcauuuugauaggcuccugaaucuuggacaggucaaguucaugacauaaaggaaugguagcagugcugagucacuuacuaugaugacauaccaaguuuucuugauaugugcauuuuugcaugaaaggauauagauuccauacuagcauuugagcauguagcgaaaggacagugggccucuugccuacaggaagauuuucauaagcccugucuugucagacuuacuguuuaaaagcagcccacagcucucuugaagaaugggaaacuuguguucugccaaacaacuucucauugacucugauuuaacccaccuauaaauuaggccucaccuauaaaugcugcuuauaaucugcccagcaaacaauggugucugcauuguuuuuaaagaaaaaggaaagacuuguuucagacuuagguauguaugggagggaggguaaagcguuuacaguuaggguagaaauuaaggggugaacuucaaagcaugagacugcaggaacaagcuucaaugaaaccuaagucccggggguuaaaaugaucauuuuaagauuacuucccuggcacacaucugaacuuagaauaaucuuuuccagauuuuaugaaaugucugugaggggggaagcuuuuaauuucccuauccccacaaucaguuuaagucaugcacacucuuuugguuauauccaacuaucuucuucagaauaacccgagaggguucuugguuaauaauaagccagguguggcacuaccuuuugaguuuggaucuugaacagaccaaguacaaguauagcuuucaaggcaggacgcaaaucuuuggacuuugaaaacagcccagcuaccuaacauagucacuaacauuugcccaagaugccuguguaaucauaaucuucaauaugaaaguagugaguuaugauuuauaauccauaaagcucugcucuagagcuuucuggcaucagugggaaaaaggugauuuuuuuuucuuuugcccacaacgccuuucaccuaggccuaacccagccuguucugacacccuagcuacacucagaaaucacuguggauuccccuuaagcagguuuccacuugacuuauuuaucuugcacagucccaagccaccaucccccccaacacacaaacacacuuuauacuauguucaaauagggaaguuucaguuguucccagcgauuauuucacauaaaagcagcuuuaguuaccuguuuagacagguugcuuacucucaucccuccccauaucagaaaagaaaugugccuuaacccugcauucacuugauuauaauggagcuugcuaauucugacuucacaccuaaaccucuuggcuacaacaucuucacucccuuccuagacccuugccauuccuuuaauuacccauagccuuuucccacgcugaaaaaaacugucuucugcuguccugcugauguucuuaaccauuauuccagcccaucauggucuaacauccuccaaguugccccuagcacugcuucagcuuucugucccuccugauucuuuucugguacuaauuucucaauucuggcccggccucuggcucuggcucuccugucauguggccuucucgaguggcucccuuuuugcaguccucauuuugguucccaggcuguccagaugccacuucauuaauggauguuuccaguuuucuuugaagcugucucguauccuuuuaauuuuaguggacuuacccuacuccuggcugugguuccuucacaucugccucugcauaccagccuccuggucacccugcucaacugcucuuacugaauucugcccugcauaguugggugauaacauugcuggagugcuauuuugcugugucauucuuucucuuacaaacuuucaguaccuuugccaccuauaggcgaaguucagauuucucaggcuggcuuuucaggucuuucguaauauucccacacacugauuagccagacuuaucuccuacuauuuccaaaugccaauucuacuccugccgacauguucuuacuguuccccagauaugcucagucuugccuaugugccuuugaauauguuuucauuuuucuggaaauuucacccgacaucuguccguacauuucccaaaguguaucuuucuuccaugaaauuccuuacaaccucccuagcucauagugaggucuuaauauaaauacuuccuacagaggcucaggucauuuuggugccaccugacaugguuugcugcuuuauauuuuaacaaaacucuuaauuccauuuuuggcaaagaguaugauauaaucccuuuauaucuaucaagaagccuaagacauugcggaguauauuguguggaccgcucauaaaugcuuuaaaaugaaauguagugauucuguuguaaagcaugagagugacugauuguguggugguuuuuuucuucuacuuccagucaaguaucaucacgugggaaaacugcugaaggaaggggaggagccuacuguguacucagaugaugaagaaccaaaagacgagacagcucggaagaaugaaugaagcauucgguggagcauaucuauuuuuguauuuugcaaaaucauuuguaacauuccagucugucuuuacaacauggugauuucaauauuuagaaaaguuuugaacuugcuguaaauuuuuuaaguaacaucacuagugacaccgauaaaaucaacucgucuuagaaugcaugauguguuuguaugucacaaauccagaaagugaaguucagugcuguaaugcaaaugguaaagcuauuucucuucuaucuguaguuagaacaaacugaauuacaauuugauuuuccugagagagggaaaacuuggguauuuccacauacuggucaaaaugguaagugcacacacacuggucaaaaugguaaauguccuaagaaugaagaaggaucagcguguagccaugcuguauucuaaaacaagcccauuuuacccaacugacuuaacugcaugauuuuuguuuuaucuaccccuaaagcaaaucugcaguauuccaaaaucuaugguauugauucaaaacagaaguccaguaacaaaaugaaaccucaauacugaacucaguuagggcaaacccauugccuguguucguggacugauuuaucauccaugucugcauguggacacucucccacacacaguaacucucacacacauggucauugacaguuggaacuaaaacagcaucggaaaauccaaaggagaacuuugcaaaagaaaauucucuugcuuguagcagggugaugguuaugugguuauugaccagcuguaaaauuugagaggaauuacagggcaggaacagguaugugcuuuuccaaaagccuucacugacaucucugaagaaugagaaaacacuacauggcacuagcugggugaguuugaaaggacaauacauucauuccuaagguaacacuuaaauccuucuguuguuacaagcuuguagucacuucaaaaguagucgucaggugucuaggucuuggguaauacuccuuugguuaauacuaaaccuagcuuaaguagacucuacaguuguguaaauuuguaaaaguauuaucugaacaacuagugagguuucaaacucuuguaauuguaguuaaauagucauuguauuuucuugugagcuguguuuaaugguuuuaccucaaaucagaaaaaaaaaugaagugcuugggucaguuaauaaaaagguuuuacccaauau

SEQ ID NO: 9444 - RNA, 7942 nt, Mus musculus
auauuggguaaaaccuuuuuauuaacugacccaagcacuucauuuuuuuuucugauuugagguaaaaccauuaaacacagcucacaagaaaauacaaugacuauuuaacuacaauuacaagaguuugaaaccucacuaguuguucagauaauacuuuuacaaauuuacacaacuguagagucuacuuaagcuagguuuaguauuaaccaaaggaguauuacccaagaccuagacaccugacgacuacuuuugaagugacuacaagcuuguaacaacagaaggauuuaaguguuaccuuaggaaugaauguauuguccuuucaaacucacccagcuagugccauguaguguuuucucauucuucagagaugucagugaaggcuuuuggaaaagcacauaccuguuccugcccuguaauuccucucaaauuuuacagcuggucaauaaccacauaaccaucacccugcuacaagcaagagaauuuucuuuugcaaaguucuccuuuggauuuuccgaugcuguuuuaguuccaacugucaaugaccaugugugugagaguuacugugugugggagaguguccacaugcagacauggaugauaaaucaguccacgaacacaggcaauggguuugcccuaacugaguucaguauugagguuucauuuuguuacuggacuucuguuuugaaucaauaccauagauuuuggaauacugcagauuugcuuuagggguagauaaaacaaaaaucaugcaguuaagucaguuggguaaaaugggcuuguuuuagaauacagcauggcuacacgcugauccuucuucauucuuaggacauuuaccauuuugaccagugugugugcacuuaccauuuugaccaguauguggaaauacccaaguuuucccucucucaggaaaaucaaauuguaauucaguuuguucuaacuacagauagaagagaaauagcuuuaccauuugcauuacagcacugaacuucacuuucuggauuugugacauacaaacacaucaugcauucuaagacgaguugauuuuaucggugucacuagugauguuacuuaaaaaauuuacagcaaguucaaaacuuuucuaaauauugaaaucaccauguuguaaagacagacuggaauguuacaaaugauuuugcaaaauacaaaaauagauaugcuccaccgaaugcuucauucauucuuccgagcugucucgucuuuugguucuucaucaucugaguacacaguaggcuccuccccuuccuucagcaguuuucccacgugaugauacuugacuggaaguagaagaaaaaaaccaccacacaaucagucacucucaugcuuuacaacagaaucacuacauuucauuuuaaagcauuuaugagcgguccacacaauauacuccgcaaugucuuaggcuucuugauagauauaaagggauuauaucauacucuuugccaaaaauggaauuaagaguuuuguuaaaauauaaagcagcaaaccaugucagguggcaccaaaaugaccugagccucuguaggaaguauuuauauuaagaccucacuaugagcuagggagguuguaaggaauuucauggaagaaagauacacuuugggaaauguacggacagaugucgggugaaauuuccagaaaaaugaaaacauauucaaaggcacauaggcaagacugagcauaucuggggaacaguaagaacaugucggcaggaguagaauuggcauuuggaaauaguaggagauaagucuggcuaaucagugugugggaauauuacgaaagaccugaaaagccagccugagaaaucugaacuucgccuauagguggcaaagguacugaaaguuuguaagagaaagaaugacacagcaaaauagcacuccagcaauguuaucacccaacuaugcagggcagaauucaguaagagcaguugagcagggugaccaggaggcugguaugcagaggcagaugugaaggaaccacagccaggaguaggguaaguccacuaaaauuaaaaggauacgagacagcuucaaagaaaacuggaaacauccauuaaugaaguggcaucuggacagccugggaaccaaaaugaggacugcaaaaagggagccacucgagaaggccacaugacaggagagccagagccagaggccgggccagaauugagaaauuaguaccagaaaagaaucaggagggacagaaagcugaagcagugcuaggggcaacuuggaggauguuagaccaugaugggcuggaauaaugguuaagaacaucagcaggacagcagaagacaguuuuuuucagcgugggaaaaggcuauggguaauuaaaggaauggcaagggucuaggaagggagugaagauguuguagccaagagguuuaggugugaagucagaauuagcaagcuccauuauaaucaagugaaugcaggguuaaggcacauuucuuuucugauauggggagggaugagaguaagcaaccugucuaaacagguaacuaaagcugcuuuuaugugaaauaaucgcugggaacaacugaaacuucccuauuugaacauaguauaaaguguguuuguguguugggggggaugguggcuugggacugugcaagauaaauaagucaaguggaaaccugcuuaaggggaauccacagugauuucugaguguagcuagggugucagaacaggcuggguuaggccuaggugaaaggcguugugggcaaaagaaaaaaaaaucaccuuuuucccacugaugccagaaagcucuagagcagagcuuuauggauuauaaaucauaacucacuacuuucauauugaagauuaugauuacacaggcaucuugggcaaauguuagugacuauguuagguagcugggcuguuuucaaaguccaaagauuugcguccugccuugaaagcuauacuuguacuuggucuguucaagauccaaacucaaaagguagugccacaccuggcuuauuauuaaccaagaacccucucggguuauucugaagaagauaguuggauauaaccaaaagagugugcaugacuuaaacugauuguggggauagggaaauuaaaagcuuccccccucacagacauuucauaaaaucuggaaaagauuauucuaaguucagaugugugccagggaaguaaucuuaaaaugaucauuuuaacccccgggacuuagguuucauugaagcuuguuccugcagucucaugcuuugaaguucaccccuuaauuucuacccuaacuguaaacgcuuuacccucccucccauacauaccuaagucugaaacaagucuuuccuuuuucuuuaaaaacaaugcagacaccauuguuugcugggcagauuauaagcagcauuuauaggugaggccuaauuuauagguggguuaaaucagagucaaugagaaguuguuuggcagaacacaaguuucccauucuucaagagagcugugggcugcuuuuaaacaguaagucugacaagacagggcuuaugaaaaucuuccuguaggcaagaggcccacuguccuuucgcuacaugcucaaaugcuaguauggaaucuauauccuuucaugcaaaaaugcacauaucaagaaaacuugguaugucaucauaguaagugacucagcacugcuaccauuccuuuaugucaugaacuugaccuguccaagauucaggagccuaucaaaaugcacccgauuucagggugcuuacucauagcuauuguuugaucauaaaucugcauuacugguagaaauuugaucuaggcaaaauauaaagcaaugcuuacaagugaacugagagucccagucacucagggucuccugcugugcaggggugaggucagaaaggucgucauacucauccuucagugcuucuuuguccaggcaaaauguggcaaggccccuggaugcaucucuuccggcaaagaccccauauggccccucuuuaaagacaaaaugaaaccaaagacagauucuuuauuagauaauacacuuuuccuuggcucacguaaacagaagacggcuuccuugcuuucaacaccaaaagccuccuuuuaauuuguuuguuuguuuguuuguuuugagacaggauuucucuguguagcccuggcuguccuggaacucacucuuguagaccagaauagccacagagaacucacagagauccauuugccucugccuccugagugcugggauuaaaggaguccaccacuuccuggcuucacauuccauuauugagcugcacgaauacacuuugaucauuacauaagggcauugacagacuuacugucacuuugauaaguaaaaugaaauaaagauguguagcauuugaaaucuauguccugcacauagcuaauauaagcucaaguaguucuuuugacgguggccuuaauggggauuguuugauuauacacuccauggguuagaauucagcucaaagacuuuguaucuacagguuggcucuauucugggugcuugagccaagacagucaaaguuacaguuucuaaccacuaauguguaaaugaaaacauuuucuuaucaacauauucugauauguuuuaaaugaucuuuaguugcaagucaugaacccuaaggcaucugcaagaacaaucauuuuacaaauaccagugguuccaaagccucucugcguuauauaaccuuuacugucuuauuuaaaucagaacucacaacaagggagaucaguuuugguacuauuauuaaguguaagcauacaaaugaguguaaacagcagugaaaacacuaaaauuuucacugaaaagggcugcaaucaacgccuucaaauaaucuccuaaaaccugaaaaaugcuacuauguauaacaucauagcaagcuuuugucugaggacaguggaucaaucugaauccaccugaagugguuauuuagaguuaaauauugcacaaacaaaugaaaggaauucggaguacuuuaagcaaugccucguuuucccaaaaggaggcuagauagcaacucugacauuaaaaucgucauaccaacuaggaauggcugguauuucauuacagugugguuaucugaaacuuuagucgaccaaacuguuuuucuuucuaacauauuaagauccauuuuuuguaggacuggggcuuugcauauucuaggaaagcacccuagugcugagauauacuucaaacccuuaggaucaucuuguaaaugcaacuaagauucuaaaauagggguugguuucaguccucauugcaugcugccacuagagaagguuuaaaaagaacaaaauucauaugcuuuucacaaaauauauacugcuaauggaaauaguaucaccuagugcuuggaaacaaagucaaagucuugguuuggacucuuaccauuuuagaaauuacagucccuggacugguaaugcauacuuaaacaagaucuaaggcaaauauuaauagucuuuggagaguauauuuuguucacuacaaagcauauuaacuagaugcuuggugagcagagcuuuguguuuuucacucacugcuacucgcuagcaucuacgacugugcuguacagaguacuagacacucaaauggcuucacuucuaagaguacucuguaacagaaaauauuuccacuaugauacuaucaguguuccuuggccuccucacacugggggcgugcuugucuuuuuauguucccagagggaaaacuaaggccuugagaccauagggcguugcaccagaucacacagcuggucagggacaacagcgaggcuagaauguagagugcagguugacuccuaguuguagcuguuccaguacacacaucgauauccggcaggaugacucugcaaacuguaaccuaccugguuagaauggagacagcuugacuccagcugugcucucugaaagcacggaggauccccaugugaugacuuugcaaauacaaccagaugacgaggccucgugcauuuguguugauuaccuuaugguuuagcuuaauaauuauggguaauuacaccauuguuuauggauaaugugugacuacagugacaaacaauauguaguuuuccuauuauuuugcagucacaugccuacagaacguaauuuucuaaaaugucugaaagcagaaaggaagagugagaguucacuaaaaagccuuuggcacaugugcuuuugauuggcuggacucugagacguaacagaguggguaugucugguuuggauuagugcuggcuagucuucccucucagaccaaugagcaugugaacauacccaccccccagccccgaguuccuggugcuuagaggaauccauauugggagagcuaaagccucuucuuccucucuaaauguucuagaaagcagggcuuucuaaaucuggcugauuccccauuucccuacagcagaggaguaaaauguagaucuuuuuagcccucuccccugccccagagaucuaaguguggcuauggauggucaggccaagaaucuguauuuuucauaagcaucaggugauugugauaggcaauccaguuuggaaaagccucauuucuggggaguuguccaucucuuguuuuccccuugguuggcuuuuccugaaauccccccacccaucgggcuucacagccuuacccuauuguuucucaggacccuuccacuccucccucccacccccguuucauuucauuuuauuuuuuccaccucccagucuccccacucuaucauacacuaaauaugguguuucugaccaucucaccauguuaccauaguccaccacacacugcucuuaaugcauccaaccaagcuuggucgcuuauucaucauccagccugaguccaccccacucugcacgcacauacacauaccaaagacauaccuaacacaugucacauuccaagcgccaccccccagacaaacgguguacaccaaacacacauucacugcgcaugcacacaguguacacacacacacacacacacacacacacacacacacauucuccgccaggaacaaugcugcuuuaccugacacuaauccccuucuccacuuucucucuuuacacacccuuacauuccaccauggcuccuccggcgucaucggccuccacgucuucucaagugucugggccucucuggagacaccuucauuuuuuccccucaaauccgaagucucccccucuuuucaggacccccgccccaaagcccacuaccuucgaaaaguucccuaauaucccggggcuucggaccucgcugucccucccacccgcgguuuccaaggcucagccucauucgggcaucccauccccccguacgcacccccacccacccagagccucgugcccccggcccgcucccauugcugcccgccuucccuccgacccucccacgggggcgccccaccucccccggccucucucccgccccgcuuccacgccaggguccccucuuuugucuccacgacccccuggcccugccuccguaccaggcccguagaacuugcggccuuuggucacgucgaacaccuugccguugauggccaugagaaugcgcggguccuggacgccaucgaaacgccucagcucggcaggggugaagucgcgccgcuugaggcggggcagcgggggugguucgucgucgucguugucgccacuggcaccgggcugguccccgcgaacgaucuuguagagcaggaagaugcagaggcccaggaggagcagguugagaggagacgugaaaaucucgugcagcagcccgccgcccucuagcucgcucgggucggcgccagucgccaccacauccucggcagccaugaucucuggagcaaagguugggcccggcuaggcagagcuccggaacaguccgcuuccuccgcccucccagcgaacaguggcgcgcagcguucuuugacagaggaagaaaagcucgggaggggcggggcuccgggggcggagccuau

SEQ ID NO: 9445 - RNA, 908 nt, Mus musculus
gcucucuucuuuuccggcuggaaccauggaggcugcuccagagaagaaaaagguugccacuguuccaggaacccuuaaaagguuccugcugugccaaaaacucucaagaaaaagguucccgcugugccagaaacccuuaagaaaaagcgaaggaauuucgcagaguugaaggugacacuccugaggaaguaguuugcccugaagacacugcgaaaggcaaggaggaagcucaucuaugagaaggcaaagcgcuaucacaaggaguacaggcagaugcacugagauucggauggccaggauggcaaggaaagcuggcaacuucuaugugcccgcagaaccaaagguggccuuugucaucagaauccgaggcaucaauggagugagcccaaagguuccuaagguucugcagcuccucgucuucgacagaucuucaauggcaccuuuguuaagcucaacaaggcuucaauuaacaugcugcagauuguggaaccauacauugcauggggguaccccaaccugaagucaguaaacgagcucaucuacaagcgaggcuacggcaaaaucaacaagaagcggauugccuugacagauaauuccuugauugcucggucucuugguaaguuuggcaucaucugcauggaggaucuaauucaugagaucuauacaguugggaaaugcuucaaggaagcaaauaacuuccuguggcccuucaaauuaucuuccccacgagguggaaugaagaaaaagacaacucgcuuuguagaagguggagaugcuggcaacaaggaagaccagauaaacagucuuauuagacggaugaacuaaggugucacccgugguaucuuuguaaucuggucaguuaauaaacagucacagcuuggcaaauugaaaaaaaaagacacaccccu

SEQ ID NO: 9446 - RNA, 3215 nt, Mus musculus
aacugguuuuggguauuuuuauuucuucaauuuuuuauuaucaggagugacugaaauaaaaaauauaauugagucccaucauuauugucauuauggaaauggcuuuaagagaaaacuggucagaugaauauuauugcuucccacuuuucaacugguaaauaguugccacugauaaaacagacaagcccagagaaucuguccagaauguucaagauaugguauauuauacaacaugccuguucucggggagaacaccuaggacauaauuauguguauuucuugaucucaucauacaagacaagcacaaaggcgccacccaugccucugagaacguuggaccaugcgcccuugaaaaaagccuugcucccuucaucgcgcgcgaucuuccgccagcagucaagcgugccuguguacaugauaucagcugcaaagaauaaagacauguaguugaugacuaaaagccagugaacaccuccaaaauccuaauacagaaccgagccccaccuuuaaaaaguauuuuccccccuuuuccccccaugcuaaggauggaaccuuaggccuuguguaugcuaagcucucuacuacugagcuauucuaagcacuuaauggcaguuuuaaacccaagcauuuacacauuagcacaggcauugacuggagaacagggacagccaugucauaggcaucuaaagggcuguuugcucacaggcacuugugcagacaacauggaugcuguccaucaccccuucagagccuacagcauuucaaugacacuggagauugaauauagggccuugaguacggugggcuaaugcucuaccaccgagcuguaucucuagcccuagacuguaguuauuaaaggcagccacccacucauuuuuggccauaacuugccucacucccaugacuuuuuaucuuacgaucaagccgaacuuacuuccuuugcguccagacugcaucaucauacgacggcgaaccgugucaaaaggauaggaagucaggccagcgacagcagugacagacugugcaaucauccagcugaugaagaugugaguauucuugggaucugggagcauuccugaaaaauaagagauuaaaaaaaaucaaaauguaguuuugcugaccuauuuacuauaaccaacuaacauuuuaucuaccacaagcuucacacuugaagaaucuggcuuccuucagcaauuaaaaacaaaaugaguggugggcuucuguuauauuggugcaagaccuugcuacccugucuuaagguggauggcuaugaauggguagccuggucuacauacuggguucuaggcuagccagggauacacagugagacccugucccaaagaggaggaaaaaauaggaaccugggguuuggggauacagcucagcacuagauuagcaugcacaaggcccuagguugaguuccuauaacugcaaauaaguacccacaucucccacagccucuaagcaaauagcaaacuuacccuuugcagugucauagauaccaaaguaggcagcucgguagaugauaaugcccuguacugacacauuaaagccuugguacaggcccuuaaucccaucagauuuguagaucuuaaccaggcagucaccaaggccuuugaauucccuuucagcuccagcuuugcccacaucagcugcuagacggguacgggcaaaaucaagaggguacacaaagcacaaggauguagccccagcggcaccaccugaugccagguucccugcaaaguagcgccagaacuggguccucuuguccacaccacccagaaagaucugcuuguauuuaucuuugaaggcaaaguugagagccuggguggggaaguaucugaugacauuggccagguucccacgccagaaggacaggacucccuguuccuuggggauacgaaccacgcagucuaugaugcccuuguauugcuuaucugccgugauuugcuugcuggcaugcugcaccugauggauaggaagaaggcaauagggacaguuauaaucacagagaaggggaaagggaagaacacacacauaaaaucguuaagguucguuccccuuucuccaaaucuagcuuucagaaucacaugagcuggacaauucuaacugcugacacuacuggggggcguaggggaaguguuuaagaauugagcagcaccaucagaaguaguaagucucgacuucugugagugaggcacccucaagcguaccuaugaccuuuagaccaggaagaaaggucauuccuuccagaucagguucagaagcauuagggugggaccugcauaggacacggucaccuuggugaccagucaacuucucuagucuccggagcugcucccuuuccgccccacccccacuccugucgggagggguggcggugacgacgacuaaacgcucgcccgcgagcgcccccuagaggcagugcgcggcgagcgcgcggcaggaaggcuggcgaggggcugcgcgggggcggacguagccggcacaugcucuucccggcguccacuuccggccugccggccggcgagcccacaccgcguuguucgccggcugcguggccgcagaaccgguccgcguggccugcccaaagcuguaaucuccuugccgugaccuugagguuuucggucaggccagguacucuguuuuccagcgccugcuuucaggccuauugcccuugccucuaaauccgggcuagacagagccucucgggcaaccccauccuaguucucugugccggggauggcccugagcgccucuggucccucuggucccgaccacuugcgacacucaaacuccagguccuuaaaggcgccuuccucccgguugccuuucgaucugacacuggcuaggcccggccuucaccuugcccccaaaucuaaagacugagccccacuuuuccgcuaggguacccccuuucugugcagauccuuuacuuccugccugggccccucgaucucagaacguaccugcagcagcagcuugacccucucgaugggugcuaccgcugucuuggagauggcugcggccacuccaccggccaagaaguccuuggcgaaggacacagcggcaucugucauguugaaagcaaaaaaagaagaggcaggcgagugcgggacagggcuggguugacaaccggcuuugacucccgggcucuggggcggagcaaagcaaauggccgacuuauauagcggcagccaggcggugagcugccg

SEQ ID NO: 9447 - RNA, 2435 nt, Mus musculus
agaaggggaggcagugcugucugggaaagcuagcccugggaggggcugaggaaaccugagauaacagcacuggcuaaacuccugcgcuuuaauuuccaacugugcggaaggagucccugugggugagaguuaccccagucucuucauccguccucuuagggaaucaucaacuacggaagagccaggccuaagcucugccuuaauacucuguacagaguagggaagagaacacgcgcaucugggcacucugagcgcuaucccgaaagagaaugaauuguuuauauuaagcaaggacagagugguuuuauuuuauucugugaauuuuagucuugggaaauccugacugaaccugagcccugaaugcagacacuucuccaagacaguuaggucaccuuugugguuagucaaucaagugacuguuucaaaggcacacauagguucugcacucugcuagucgcccugaauauaaacgugaguaaggaugauuucaucgggucuaaaaugcugcauguuuguuuaugcauggauggccuccaaggggaaugaggagggaggggcugucagaauguggagguaacacagauggccugugagagguuggguaccagcuugggagggagagugaugaccugguaccugcaagucaguuaugcguugggacuuuggcacuguaggguuauacauguugcccgugcaggaauaagugauuccuaguguuguguuuuauaaaaaaagaaaaggaagccagggauguuugguagaggcgcgguauggugcuggggaagagggugccucugcgggggcccaugcugaggcaucccuucccccacugagggaccaaucacaugacgaguauaguauggaauagaguuuauuuagggcaugggaagggaguagagacagaggggggguggggggaagaggaguagaggccggccaugaacacguggagagagacagggagaggaauggggagagaaggggcagagaagggaggguacgauagugaggagggagcaagcagccccuuuuauagugagucaggcauaccuggcaacagccagguaacuguggggcagagccuagacgaaauguuaauacccagcuucacgcacaaauaaauaaaugaaaaugagggagagaugcuuauguaaauauguaagaaagcuagauguuuuguuuauuucguucccuccuuccugucuuccuuucuucuaucuuaacuuaccuuuucuuucuuuuuauuccuaaauaagcacuuacuguauccccagcuuguuuaaaacucacaauguagagccgggcgugguggcgcacgccuuugaucccagcacucgggaggcagaggcaggcggauuucugaguucgaggccagccuggucuacagagugaguuccaggacagccagggauauacagagaaaccuugucucgaaaaaccaaaaaaaaaaaaaaaaaaaaaaaaccucacaauguagucgaagcugaccuuaagcaagugggaguccuucugccucagcuucccaaaagcauuguuaugguauugggguguuggcaagggaggagacaggguauagacugaauugacaguuucucuuccugucuugagccagaaugcuggguuuuagccaagacaguuauuuucaaguguuuuucguuuuccaaaaucuuaggaaggaaaugaaagaaagcugccuaaggcaaaagaggugucuuuucacucacaaguuugggcuucuuuccuuuauuacacuuauuuauuuuuauuuuguauguguuuaugugagggugagggugugucugugugagugcuuaugugccaugacuuguauguucuaggaguuggcucucuucuuccauccuguagguccugggcaucaaacagguugucaaguuuaaucgcaagugaucuuagccacugaagcaucucacgagcuggagguuugaguuucuuacccugcccuucacccuguccugugcaaaggguaugaaaugaaugucucagaaggaaaacgcccucuguuaaagauucuacaggccugguggacugauuagaaguucaugguuguggaguugggauguugcagauacagaugucauggacuaucauuagccuccuucaaagccauucuuugcccgauugucuaucugacuuaaucuccaugugacuaccaugugaaaacuuuggaaauguacugacagacaacuagcuuucccaagccaaaggcuaaggauaccaucugauaccaugaggccuacagcagagguuagccucaguuugcuggaaacaccugccugauguuuccacuaauguauugaaagauuaugacuuuucuuuugcuacuauaaaaccuucauaacaugguuauuucauuuguauuugcaauacccugaagccauguucccucauaaagucuuaauucucuuugagguaag

SEQ ID NO: 9448 - RNA, 50383 nt, Mus musculus
agugauuucacaucacuuuaaucauuauuauuuacaagcauaaagacaaugggaauccggguucuagacacuaaaaugcagagucaugccuuucuggagaccucaucucaggccuccacucuuccagaugcccuggaagcauuggcaaaggcaugugcuagaaggcugugugaauccugggauguguguguugggcaggucuuggcagccggcgaacgguuucugauuucuauugagguuugagccuuuccuuucugagcauuauugacccuuuaauaucuguguccucacccuggucacuuuccauccuguguauuacacagagggaucaccacccucucagcugcacaggauguucucaggcugaugccaagagcgaauggagcccggucagcacuucugccagccucccgagacacgggguacagcagcaugccugggggcggggugggcaguagagaaaggaugagagaaaaauuauuggcaccugaacuuccugguuauagaccaucugguucauaaaaaccuguuuaugagagagagagagagagagagagagagagagagagagagagagagagagacaacacuagugagugugugggaaggucccccuuccuccaaguguuagcaguaaaaaaaggauucuccccguccaggaaggcucccaugcaggauucugcacugugcucuguuuuuuuugcuagaaagaaauccuacugucagccagguuuggacugguugauucauucagucaccaagggcugaccuuugugcugagugugguauaggguggagcuggggacuauaccaacagagaccuuucagccuaggugccaacaaugaacacucaucugcacaauaauaucagagaaagacaugaaaacauggacccaaacugcacgggagcacucccaucugaucagcugcccacagguuaccuaaggagaaaagauugguauauauagccuucaaguucaugcaaagcuuacacacagagaauggacagaaugcugggugguuuuccacuaggaaacguuaggccaauccuggcucagucagcaagaggcucaacuacagaccuaaagguucauggcuacccacuccuucugcucaauguaaccaaggacuaaaguguagauuucaaaacauggcuugcaccuguaaucccaguacuugggaaacugagacaguaguacuguuguggauuccaggcuagcuugagagacagugagacccuguuucaacuaaacaaacaaacaaacaaacaaaaaaaucagaacagaaagguacccuccaaggauuaacacggaaucacccccagaaguaggguuccaaggcucuggguaacaccuuagagacagaauaagaggauuugcacuggccccaccccauggccuauagucuucaguauucccagacucucuggaaagccuucagcuaucaauuacagcccagccuggagcauggccaaauggacaaagggcuaagcuacugugcucuggacuuccuccuacguuucucuucuucucuuuaggcuugagugcuugccagaugugccucccagaaucagggcaaguguguuccaccuagucagaaagggacugccaacccaggggaggaccucuguugccaguugauucucagcacacucauacaagguggaagugaugcuuuggugccagcugggucaacucuagaaucuaagccauccaaggcaguagacuggaggguccugagugaaugguaaagggaaguuggagggaggaggugucauuagggaucuagaaugguacuuggucauggaggugugguuuuuccucuuggcccaugacaacugauugcuacauuuuuuagaaaccguguuaaccaguuaaacacaguuacuaaauccacaugagggcugaggaggugucucaucagguaaggagcuaaaggugagaauuugaaucuucggaauccauuuaaaagguucggugguucaccuguaaauuccaguccacagaaggcagaggcagugaguuucuggaacaagucggcuggccugacuagaugaaccugugagcuuagcuucagugagagagucugcuucaauguauaaaguauagaaagacugaggaagacaucagaugucaaccacaggccuucacagacugauugauagacggacggacggacagacagacagacacacauacacucccacaaaugcaagcauguauauaagcaugcacauauaccauauacauaagaaaagaagaaauauacauggaauuccuggggaaaguauuucaacagcauguucaagguccuggacucaaucucuaguauugccaaaauagaaaaacaaaagagauacauaaaauuaaaauccuauuaaaaaccaagaugauuaauuucuauagcucaucacuuccuaaucauuuuacuacaguguauuauuacccacgagccugaaauguaaacugaugggcaauugccucuuuccugaacauugcauugaaaaggucagcuugaaauuagguaugguagcaagauuuaaagcucacaaucugugaaagcuauaaacuagaaucugccucaaugcucugcugacuaaaucuaagaaaguaaugggaggaaacauuauucagacuaaaccaaaagguuugccauauguuguuacaguaugaauaaacaagagagagagagagagagaggugugugugggaacuagcuccuaguguuugaaaauccuuagccuauuuaucaaagaaauugccuucauuguugacaaaugacauucuucuaucuuuuccaguucgcacauaaauguaaguaucaaccaauauucacggcagaacuguauugaucuacugcaacuacagauaaaugaguuggcaaaaaagaaagcauuuugugagaaucauauuaaaaaacauauaacaaauaguauaugccuauuauaugauauuuguauaguauacaucuggucucuggucuaggaacucaauuugugauuaacuuuuuuuuuuuuuuuuuguuuuuuuuuuuuguuuuuuugagacaggguuucucuguauaacccuggcuguccuggaacucacucuguagaccaggcuggccucaaacucagaaaucugccugccucugccuccccccccccccccccccgagugcugggauuaaaggcgugcgucaccauggccggcuaauuugugauuaacuuauuguacacacauacauacauaaauacauuuccccuaagauuuaucuguuaaacauuuagcugcacaggcugaucccaagguucaaaaccacuuuggcaucagaaauacaaaggucaaagguccuagagguacuucaauucaacccugaccaaaguuaagaggacaggcaugugaggagaaaaugugugugugugugugucugucucucugucugucuaucugucugucugucucucuguccgugugugguaauuuuuuuuuuuuugagggcuuuacuguguauguagucuugaccagccuggaacucauuauguagaccaggcuagccuugaacucauagguguguguauguguguguguguguguguguguguguguguuuaaagcaaccaauaaacauuuuuuaaauguuccuaggcuguaaaacgcaagaaggcagagacuuugcuuuuuuuauuccuuuggcaccaaacacuuuaagaggaacucuuuccauuuuuuucuuuucuuuucuuuuugugguuuuuugagacaggguuucucuguguagcccuggcuguccuggaacucacucuguagaccaggcuggccucgaacucagagauccaccugccucugccucccaagugcugggauuaaaggcaagugccaacacugcccggcuccauuuuucuugaaaacuaaaugaaaugcaauaguucucccagugagcugacuuuaacuucauuacaauaucaacuagaaauggcccugauuggagagcuggcccuauccugguuaaccuagaaagugccaaguccccagguccccuugcucuaagucagugaauguauccuaacaguaguacuucaucugcaucggguuuugauggugccugauugguaggcucacugaugagcuuccuguggcaacugaugggaucucugcuuccucuaaaggcaagacaccuggcuaacagaaugccuuucugccuugacgcuggaugggacuaaucacuguucuagcugcuagcuggggccuauauggaccaaagaaaacaaaucagggaaggaugcgggcaaggaaaucagugggggaagcccagaaaaguuccauccaaaugagaggccaagcaucaaccagacugccugaccacaaacuucuggccuuuccaguaucguugggagaccuugaacaagcugcugugcguuucugaacuucggucugcuuacgcagaaugugauaaagauuccugcuccggaaagucuccacccucuaauaccacaacgacagacuuacugcuaccaucagcaccugcaaccugagaagagaaagagaauuaugauaccuacccuauaggaugggcauuacuugagagaggaguguuuugaauaacagaauuucacuuuaagaggaagcaaaaguguaucuaagccaccccucuuggugaggcugaaaggcugcugcagcuucucaaaguuguagauaaauuaauucccuguuggccuauaugucuuaugauccagcccucaggcacacaguggcuuuuuuuuuccucccagauuuguuuaccuuucaucacgggccagcggguucuugaaugugugugugcaugcaugugugugccuuuuagggcacauguggggaacagauggcaacuuuuuggaguugguauugaggcagggucucucuugguucucuguacugcugaauaugccacaguagcugaucagccagcaucuggauaauucuccugccucugccuucaaucucacgauaggaauugggcuuuugacauggguuucaggaaugaaaacucaggacaugaggugugugugccaagccccacuacccacuaagccaccccucugaccccacagugugacuuuuuuuucucuuacguucucacguccuucuagcauccagcuccccaguauauguacacacauacacauacauauacacacaaacuucuccccauccucugaacacacugccucaagacgggcaaaguaucugguaaacucaaggccucucugcuuucagaaaguaggcaaaaggcugcuaggccccucuacccuugccacuucccaagaaaaaggcagauuaugaggcccaugauuuuaggaaguuucugucccaguugaaacgucggcucaagccagucucagccuucuuugcaccucuuucucucuucuugugcuuagacuugaaaccagggcuauccuaaauccuucuuuuaaucauuuuuguuucguauuguuuucucuuuugagacaggguuuguuucuuggcuguccuagaacuagcucuauagaccaggcuggccuuggccuuggagauccaccugccuguauccugaguguuggggucaaagcugugcacuaucaccuccuggccaacuugguguauuguuaaaaagacguaguuugccuuauuaaaguauguaugcaugucuguguauguacauguugggcguugcccuuggaggcuggaagaggauacuacaucuucuagacuuguaguuacaagugguuaggaguccuuucauaugaaugcugagaacugaacccuagucucugcaagagcagcaaauauaccuacuuuguuguugguuuuagagacaagaguuucacucuauaucccagacgguccucaaauuuuguauguagcucauauuggcuucagacuuagugaucuuucugcuuuagccucuugggugcugauauuacaggugugugccgccagccacuccauauguuuuaugguguuggggagaacacuuauaaaagcgauaaugcaggcauuguuggacccuggcucugcaguggaauaaggagcggggccuccuuaauggcaguuucucccuccuacuuguuuguucagguugcucccagcugccuauaacugugagucuaaguucauggccugaccuucaaagagaggcugucaugaaaacagcauuugcuaugugucagcuacugggccuaaaggucacguccacuugaaccugguagccugaauaggcaggacaggcacccaaacgauuccuaaaaugaucaagugaauucaucugcagaacaacccuguaucggaagucaggagacuggggcugagagaaguuaaucaacuugcagaggacucaguuaggaagagcugggaaccaaauccagaucuccgggauucuaaaucaaaaggagguuguuauguggcucuucagacccagcagacaagauccuguaauauuaaugguucuuuauucccagagagauacuacagucuucauggaggaggccccacaugccagcuccuuuaucuccuagcaccgccccccccccacgcacaccaggcagcucguuauauuccaacaacagaaauauaaagcaauuugcacagucauccuggaguaaucaaaucugugaccacccaccaccucugggauauagaggaauuucucggaaguccugguaguauuagaagcuccuuucaggcuuuuucuguagcugcucugcuccuguaggaccuacugaccucuugugggcagaguauaaauucgcuguguuggacagucuugggcuggaacucagccaacggcccuuucacgcuagaagcuagcuaucccuagucagacugacucagcucugcuggaauggguuagucugucaacuuuacuuccaucuugguuuccucaccucuaaaccagggauggauggagaccccagcccuacuuuaaaacauaggaagucugaauaaagcucaguuguuagaguggcugccuagcaugcaugaagcccugggcuggauccacaguauuacauaaaaccaguguggguguucacaccuguaauccuagcacucuggggaugaaggcaggacagucugggguucaaggucauucuuggcuacgcugcgaguuugaaaguauccuggaauauacgacauccuauaucagaaaaaaaaaaaaaggaaaaacaaaaaacaaacaaagauggccuagucggccaucacuggaaagagaggcccauuggacacacauacuuuauaugcuccaguacaggggaacaccagggccaaaaaaaugggaauggguguguagggaaguggggguaugggggacuuuugggauagcauuggaaauguaauugaggaaaauacguaauaaaaaaauauuaaaaaaacaaacaaacaaaaaacccaaaacaacuuuaacagcaaaaucugcucucaaucaaucaaccaauuaagcagccaauggaacagacugggauuggggguuuggcucaccacagaacacuuuccagcaugcauaaggcucuggguucuacccucaguacagaaagguuccagauggaaggaaaggaaggagggaagaaggaagggacagagcacgagauagcgagagagcaagacagagacugacagacagacagacagacacacacacagagagaaagagagagagagagagugcugggguggcaaaacugcuguucuauuugaaaagcaguugcagaagcugcagugacuuagaaaagugucccuucauuccagaccauguuauauccgucuguagaaauggccccugagcaggacaugccugucccagagcucugcccugcuccaguucuuuccacuguugagggaaaugaagagaucauaugcacaaguuacaggcagaguucaguagcaaagcacuugccuagcaauucagaaacccuggguuccaucuccugcauaaaaagaagaggggggaggaggagggccagagcacagucucacacacagcuggagacaaaaacagauugccuuagaguauuugggaccaugcaagucugucacaggccauagacaggauguuucugcagcacuaaauugugagacaggagcaucugucuuccgucucucaucacagcccuuguucccucccuccccccuuccuucucauucauacuucaaugacucauuuaugcaacaagcacuuacuugagugauaaagcgcacgccaaacccuguacuggguucuggcaugaaaccgcuggcuucaaggaauucaaauugagagguaccagggagggagugcuaaguucacuagaugucugugaagaggagggacagggcaagggucuaaauuagcuucugagagucuggaaaguugggaaaggcauucaaggcucuguggaggaaggaaagucagcaggguuuaggguauuuucccaaagcgggagggcagguucaaagaaggcccuggaaugacuucaaguagugaauuauagcagaauggcagguguggugaagccagguagguaagguagguuugagagggguggcaacagauagaaacccuacuucauucugaaggcagcaggaagcuacuggagacauuuugagcagagaacugccaggauccagacugcuugcuuuaaagcugugguucucaaccuguuuaaugcugaaacccuuuaauacaacuccucauauuguggcgaccccaacuauaaaaucauuuucauugcuacuucauaaccauaauuuugcuacuguuaugaaucauaauggaaauacaugauaugcaggauauuugauauguggcccugugaaaggguugguugacccagaaggggcugagacccauagguugaggaccaccucucuggauguggcaguguagccgauguggucuagaaauacuggcagggcagaggauuaaggcaggaggaggcugcuggcucacauggcuuugaaaccuaacuaggacauuaggcaagaagaaaugcaggaauccgagagcccuuaaagaagcagagccaccaggacagggugguuuggggaagacgguuauaagagggagggaucaugccaaugaaaucuggucucuggcuugaguaagcggguaccagguaagguaguagcauucacugaaacaaagaagacauuccgggacaagggauaacggaagcuacuguggcuaugugggguugaaacaccugugggucaguggaguggagaugacaaauagucacuugaacaugaaagugucucacucggaagcagcagcaaaaccugagcugaagauauauauccauuuuggcaucuuuccuauguguuaauaucaaggggaggguagcugaggccacaccuaugaaugcaaucaauggaaagagggcaaagaacagagccuugaugaucacaggcaguuaaggacuagaaaguaaagggggggguacuccaaguguaccaacacuaggggaggcugagacagaaagaagcauuuguaaauauaaggucagucuggacuacauacugagaccacauuucugucaacaaacaaaaaggauaguuaaccaguaaaaaggaggaaauggcagaagugagaaggggacuuuacugaaaaucuauucaaauuuguacaccuaagacaaauuugacccgugaaaggguugccagaaagagaggagucaagugguaaaguccgaggagagguggggggaccuguauccgacauggaugaauguugccccugggcugcagaaggaguucacugaggagcacgugucuuucuuuuauuuauuuuuauuuuaccugucgcaauguuuugccuacaagcaugucuguggaccagguguaugcaguaccagagggggccagaagagggcgauagauauccuaaaacugaauugcaaaucguuuauccuuuauguaggggcuugaaaauccccaccccagguccucugccggagcagcaagugguauuaacuaccgaguccucucuccaccccaccccaucccauccccauacagacucucggguaauaucagccacaggggguuuaucggagaguucucaggggauuaccaugugggaaaggaugcauagagacaggccuaaaggagccaggggacuagggcccaggcuccagcuuuugcgaagcuccgaaacuagaagacugggcuucagucagcccggugguuguauacaggcuaccgcgaggaaaccgugcccuugggaaagugguccuccucagcggaggcagucccacaggggccugagagcgcaaggcagagcucuuaagagcagcaaggaagcgcaucucagcauccaccacagggaggaagagaguauuguugcacugguguuggucugaggcggaggcauucagacuguuagacugaauucugcucugagaaaacagaaaacaaucuuccugcugaaaggcucaggguugaggggcgcuggcgggaggagaauggaauggcugcuucaggauacugaaggagagcugaccagggacucacaauguguuugccaagggguauugguuuuucuguugacucuagagaauauaucauucuagcugaaucaaacgguucaaauuccuaggcucucuugucuugggucucucagauuucauuaguuuguaccaggaaaugucuauacuauuucaaggacaauuuaugggucuguguuucuaaaaaccccaaaucuuuaccuaagggauuuccugaacaagaauuaaauuaacuaucacuauagauuuuuccuugagacaggaucucucguauucuagacuaguuucaaacuugcuuugugucugacgaauggccuugaccuucucauccuccugccuccaccccagugcggggauuacaggcaugggccagcaagcauucuuuauuugcugcuagggaucaaccccaaggccuugugccugcugggcaagcaugcuaggaagugcgucuccucucccucuccuaugacaguuauucugauuacaauaauuacugaugguaaagacagcaaccuugcugauggacaacaaaaccuguguacagauuaaaacauuauaaacugauuuaaaaaccuaccccaggcuugacaaugaagauaaacacuugucuacgagggaugaauaaacauuauaggagucaggauuaaaccuaauugguaggcagauacaaugcacaggaaaugacaaaggaacacuaauuauaaagcuacaaagaaaaaaaaagcauuacuacgugacaaaauagaaaguagcagguggcucauuaccuaucaaagugacaacagccagguacgcugucuguacaggauuuauauacauggucauucgagacuucacugagaaaauuccuacuuauggagaagugguuguaaugagaaauucacuaggauugaagcauggcuaagcauccacaugugugccucauuuuuucuuuauuggguauuuacauuuacauuuccaaugcuauuccaaaagucccccacauauucccccacccacccaaucccacuucuuggcccugucguuccccuguacugagacagauaaaguuugcacaacuaaugggccucucuuuccacugauggccgacuaggccaucuuuugauucauaugcagcuagagacacgagcuggggggggguacugguuaguucauauuguuguuccaccuauaggguugcagaccccuuuagcuccuugguuacuuucucuagcuccuccauugugggcccugugauccauccaauagcugacugugagcauccacuucuguguuugcuaggccccggcauagucucacaagagacagcuauaucaggguccuuucagcaaaaucuuacugguguaugcaauggugucagcguuugguggcugauuaugggauggauccccgcguauggcagucucuagaugguccauccuuucgucucagcucuaaacugugucucuguaacuccuuccauggguguuuuguucccaauucuaagaaggggcaaaguguccagugugccucauucuuaaagccuacguguuacccacggggagcuaugaacaaguagcaacaacuuuuacuuuuuuuacugugcguagguguuuugcccgcacuuagugugugcaccacaugcauaccccacucuaauucaggcagucuggccugcaaguguccaugcucuaagccaucauguucuguaucaguacgccaagggacucggcuagucacuaccaauggcacagugaacaagauagauauggucaauaaacaauuccaucauggcauaaugaguucuaggacagagggccaggaggcugugccuaggcuccccuaagcaccucugggcuggcuucaagagaagaagccaacaauuuacaggaauuuauuucuugggcacuagauagaucaaagaagccaaacagggccuggcaugcuguugcacacaugcaaucccaauccuaaggauguuggggcagggagauuaucugucugaggucagucugaguacacagacacaccagucuggccuacuugagaauccaugcccccccacccgugugugugugugugugugugugugcgcgugugugugugucuccacuaaacagaaguaaaauuccuauugcaagguagaccuaguuagcucccacuauugaguccuggaaaccaaagaucuaugagucucucacaggaaugcagcaggaggaaacaaggggucauacaguuuaugugagucuggcugccaaugcaggagguaucagaaaucagacccacaacucugucuccucuuccuggagagaguguaagcucucuaggggcaagauugaggccugaagcauucuuccuuuuauuguuuuugaauguguuguuugucauauuaguuacacuuacuuauggaggacugcuguauuucaauacauguucucaaauauguaaugaucaaaucaagguaauuagcacugccaucucuucaauuacuauacccccaugcugggaacaucuuuaacaucuuuaaacgcuacucucaaccugcaucuuucucuaucauacagauagcucagcaucugucuggcagaguccuugaguucagaggaggagggaagcacaucgcagugugccauggggaggaagagggaauuauugcacugauguugguuaacaaucagugaguguauguuucacucauugagcaucuacuguguuagcagcuaacucuccuugguucuaccccuccacacccccacucaucccuauuuuugcugaacucugagcugagagccagguaauaaaucacaugagaaaaaaauaugcuugggcuuauaggaagaaaaaaagagagagaaagcaaaaauagggacgugaugaaauuuuagauacaguggucaccaaaguccucagagaaaaaaaugauauuuuugcaaagacagugaagacgugaagggcgugagggaagaggcuaugccugagggaaugggugagggaaaaguguucccggaacugcaauugcaaaggccucucaaggcaggaaugugcuuauuuguuugaaagccagggagaccccuggggcuguaaaggccugagcaggaggaacuguggucagaaggaaguagagauuguaucuggugccugggagcagaggaaccaaaccgguuccacgagaaaaggugacagaaagccuauugauaauucacaaccuuucugcuccauccuauaauacccaccccacccucaaacuguggcuucuuccgggaaaggcaaggugguccuugagcuuccaggaauucuccuaucugcacuucccauaagcaugcugggauuacagauaaccaugcuguaaucuccaguucugggaacuugaacucagguccuuacacuuuuuagaccauggagccauuucccuaguucuccuacugagauucugauugggauaguauuguaucuagaaaucaguuuauagaggauacauuauaguuauuauacuuuacaaccuaugaacacaguauaucacuccauuuacuuugguucuaauuuuauuuuguuuuguuuuuguuuuuucgagacaggguuucucuguguagcccuggcuggcuuggaacucacuguagaccaggcuggccucgaacucagaaauccgccugccucugccuucaagugcugggauuaaagacgugcaccaccacugcucagcucuaauuuucuucuaugacugucagaguucugacaucaauuauacuauuuuuuaaaauauuauuuauuuauuauuuauaugaauacacuguagcugucuucagacauacaccagaaaagggcauugcugggauuugaacucaagaccuucggaagagcagucagagcucuuaaccgcugauccaucuuuccagccccaacuauacuauuuuaugauagaaauucagagaagucaugauagaacaaugcuauacucugguuacccacaaaucacugugugugugugugugugugcaugagagagagagagagagagagagagagagagagagagagagagagagagagagagagagagagagaacgaaccugagggugucacuguuuuccaggcuaaucuuaacuccuuaggucaagcaauccuccagccuuagcuucuugaguucuggaauaauagauguguaccaccauacuuacuugagaccacugucuuuuuucuuuuucuuuugguuuuguaaaacaggcucuuguuauauagcucuggcuggcuuugaacuccugauuuucaugcuuccaccucccaggugcuaggauuacagauguugcaccaccaugccaggcugagaccaucacuuuuauugucuuaauguguaucuguaucucuucuuucgucuucuuuccuuccucuccuuuuacaugcauauacacagagauauguaggauacuaaagauaucacucuacauacuauuuuguaaacggcucuuuucugucaacagucuuuagagucugcugauaucauucaggugcuagaaugcuugccuaagaugacugaaacccugauuugaauccccaguacuguauauagccaggcauaguggcacauccagggcuacauagugaguucaagaccaaccucagaugugagaccuugugucaauaacauuauaacaucuaugauuucaauaaaugacaugucuguuuuuucuaaaugaccuuaaaagauucuguuauuuccccuagcuugagagcacccaucagucuuacuuccccucuacauaccaguccaccccuccuuuauagcaaaaauauuaauuuuuuucuuuuuuuugaaagguucuauauuuuauuacuggacaaacauccuaauuuaagacacgaaaagucuccagguuuaaauguugaaauccaucugguaggacugauugaugacaauucaguauaaauccucagucuugccauugugugaauccuuacagacccagcuucguucuccuccagugucuucucuuaagaguuguaccugauuuuguugccaauuuucauccggauccacugaggaauagggcgauuuugcuuuuguuucuuggccaggaaucgcuugguuuggaaagucuugugagaagacauggcgagaagccgaaucaggaggagugcgcacgauggcggaggagaggagaagagaaagaaagcuauuuuuuuucuauaacaacacugcuacucuacuuugccuuucucucuugaacucauuucugucaugugcuugcugacacugcuccauuccaauugcucuuguccaggucaccaaccuuuugcuuguuucuaaaugcacguggcauuuccaagcccuuguuauauuuacauguggcaucuggcagacgaucguuuccgcuuccuuugacucgggcuggccuuuugcccauuugccucuuccugcucugcugaguguagacgacaaugccauuucccaggcuccuuucuuuucugacuuccugauguguuuggcugguggaaauuauuggcaggagauuggagaaaaggcagaagccaggguauuucccuuccuuucuuuccauuaugaauguugucuccaacagugauuguuccgccucugugguuuccacuggauaguuggaccccuccaugggcccacuuccuacuggacugguguuucuguuguauuuaguagucccugaucauccauacuccaacuuuagccucagcuucuuagucuucaauucucuaggaucuauucuuucuuucucucucucucucucucccucucucucuuuccagcccugcuugcucuggcccaaagauuuauuauuauauguaaauacacuguagcugccuucagacacaccagaagagggcaucagaucucauuacagaugguugugacccaccauguaguugcugggauuugaacucaggaccucuagaagagcagucagugaucuuaaccacugagccaucucuccagcccucuaggauuucuuugccagguauauuuaucuuuagcaaccucauccugucucguggcuuuaauuagcauccuuauuuuaugugcaugcguguuugccugcauauguguguaugugacaaagaucacugggggcauguucuugcccuagccccuuccuguuacuguuuccuggcucugcucuuccacguccuuuccugauguucuaccucaguucaggcccggaaaccacagaggcuaauuaucagccuguauggaaccccugaagcuacaggccacaguaagauggccuuaaaauaguuucucucaggcuuuaggucacggugacaaacggcugacgaaugcaacauccaacugcuuagcugacaucuccacuuagagagccaauaagcaauucagaagcauguccaguacauagaacuucugggcugcaagauggcucaguaggaaaaggcucugcaagccuugaaccuacacagugaaaggaaagaaaugacugcacaaaaauuguccuuugaccuccacauacacacaaugacaccccucaccgcacccucacugagagagaaauauaagacagcuuuuaaaaacagaaaauggcaccuauucacccaguuauucuagccauacuucaagggggcuaugcuugcuucgucccucccucacucccuacaccucauccagcagcuagccucgguagcaucccccuaccaagccaccuaacaaacguguuuacuuuccuuccuccaauuuuuccuuuacucuuaucucauguuggguugucaaaauggucuccuaacuggugucccugccuccguucuugcuucccuccaaggcauuccccacauuguagcuauugccuuaaagcguggaucggggcuacagagauugcucagcacucagcaccuaucauucuuccagagacaaguuugauuccccagcagccccaagggguagcuuaaacuaccuacaacuccaauccagggaauccaacgccuuuggccuccacgagcaccugcagacauguguguauacccccauaaacacacacacacacacacacacacacacacaauuaaaauaaauaaaaaaagaaaacaugaaucaggggaccuaggggcauaguucaguaguagaaugcuugcguagaaugugcaaggcccuaggaucaaacccuagcacugucauuuugaaaguuuuuuuuuaauuucuuuuauuuuugugauuagagcaugagcaggacgaggaguaagccauagacaugcuaaggugcacaaagaaaagcccacaaggccuccaccccacacaggcaccuacagcugagaaaugccgaguaggggaacggucuuccccagagaagcacacagcaaccgcuuacucaauaccaagcggucggcccugacaacgugcaaaguuugaacauaaaaugaaaggcauacccaggcgugguggcgcacgccucugaucccagcacucgggagguagaggcaggcggauuucugaguucaaggccagccuggucuacagagugaguucuaggacagccagggcuacacagagaaacccugucucgaaaaacaaacaaacaaacaaacaaaaaaaugaaaggcauaaaucguauggugugacaccuuggcuuuagacuuucuaacagcuuccuagugcauccucauuccagucuagagggccuucugcagccuggcuucugcucaugccuuuaaccucacuuccuguuccagcacuuacucggucacacuugcuguccguuuggcuucugcaaugcaagcuucuucccuucuguacuuugcgaugccaucagcugaacacuuccccuugaccuuuauauguuggaccauucagccuuuucggauaccacauggcucagaacagccccuucucugagcccaccucucuauggcccagaguucucuauuaugccaucacacuauuuguucaaaaucuuuuuuuguuuguuuguuuguuuuucgagacaggguuucucuguguagcccuggcuguccuggaacucacucuguagaccaggcuggccuugaacucagaaacccaccugccucugccucccaaguacugggauuaaaggugugugccacuacgcccagcuuuguucaaaaucuuauguguguaugugugagugcaggcaaguacacauggagcucaggggacagcuuugccuguugauccuggucuuccgcccugacacaggguuucuuguucgcugaugcauaagccagacuggcuagccucaagcuuccugggauuguccugucugccucccaucucaucauagauacgcugcuacugcaucaggcuuuuacaugacuucugaggauaugaacccacuugaauguuaaguacucugcuuacuaagucaucggaccagcuuccuaucacauuauuuuaacuacauuuuucuucucucucucucucuuucuuucuuuauuauauguaaauacacuguagcugucuucagacacaccagaagagggcgucagaucucauuacagaugguugugagccacugaccuuuggaaaagcagucagugcucauaaucgcugagccaucucaccagccccccuaaauuuuucuuuauuucuuucaagaaaauuauuauucauguguguguuuacacaacuguggaggucacacauguggaggucagaggacaguuuucaguacccucuacccaacaggggucccgggaauugaacaaaaauuggccaguuuggcaagcccuuaaacucacauuuucaugguugggaguuccugucacuuugcuuuuaaaaugggacuuucuucaccacuauguccucugcuccaacagcacacagcacacacaccaagagcucaaugacugaaagguaguggacuagucuuaaacgagaagacagacaggcaucuuucccccugaagacugcaaagccaggaggacagaagcaucugaguauauuccuuuacucucuuagugcuuuggagauggaagucaucugccagagggguugcgugcagggaaaaaaucagaagauuggaaguaaagggcccuaauuuaaucugauugagcugaacaccugacugucuguggugugaucuuaucugacacaagagccauacauucauggccucagccuccauucauuuacaagauauagccauucaacucucaggauauaagaucacagaaggcagacuguaugacugauucuaaauugagaguuuguaggaugcaugcugugacauaguccagauucagaaaaacagaaaagacaaauaccacauauucucuuucauauguggaaccuaccuuugauauauauggguauaggucaugaaacuagaaaagggaccguuggaggggaaaagguuuugaggaagugggcaguguaacagaauacaugugacauaaaagcaaaagggacagcugggagugggguggcacaggaggagcagggcaacggaaaagaaauggggaaucucuacaaaaacaaauuauggagacuuuuuuaagaaacacaaacaaaaagccaggugugauggugcaagccuguaaucccaacccuuggagguggugacaggcagagcagggcuuucaaggucucucccuggcuagccaaugacuuggacgucagccagggcuccaugauuuaaaaaacgaaaacagaaacagaauugggcuggagggguggcucauuggcaaggaucacaugcugcuccugcagaggaccuugguuccauucccagcacccuuaugauggcucacagcuaucuggggacccaacacccucuucuagccuccuugggcaccaggcaugcauguggugcauaugcauauuugcaagcaaaacacuuucacauaugucucuguguguacacacacacacacauaaacuuagaaaauuagaaaaaacuuaauuuuacaaaagagaaaaaagguuacauuuauaacagcaccagaaaaaaauuuaguagccaaguauacauuuuaaauuaucuacaggaucuguacaugaaaaauuauaaaacacuaaugaaaagaacuaaauaccuaaaauaccuaaauaaaugucaauucuccuuaaaaugauuuuuuuaggucaaaucugcuaacucagcaagguaacuuuauucucuuaacuauaugcaaaauaucucauuuucuuucucuauuuauguauguauguauguauguauguauguauguauguauguauguuuuucaagacaggguuucucuguauagcccuggcuguccuggaacucacuuuguagaccaggcuggccucgaacucagaaauccgccugccucugucucccaagugcugggaucaaaggcguucgccaccaccccuggcuaagauaucuuauuuucaagacugauucuacaauaaagaagcuagguuagcucuuuagaaaucucuuuuuaucugugucauccuaccaagcuagucuaccuuuuucuugagccccuccaaacccaagaggucucuuuugcccucuugccuagaacacuguuucauuugcauccugccagcugcuucucuguggcuccugcaaguccaaagagaaaggcgcucuuaccuggaggacguccuuccgugaagcucuugcgagccaaaguagaguugaaaaacacuaaaaugaucuuuagauuuuacaaaaucccucaaauccuagaaagaauacugaaccuaucaacaagcugauuuuaaaauauuggaaaagacaaaaauucagaauagucaaauaacuccaaaacaaaacaagguuggaagaaucaugacccagcaguaaaacuaaccauaaaguuacaaucaccaaaucaaggcauucuauauagccaggcagaguggcacaugcuuaggguuaugguuacuuggaaagcugaggcaggaggaucacaugagccccuaaguucauagccagccugggaaacuuaacaaaacuaaacagacaaaacuaacaaagagcuggaggguaaugcucaauggcagaguguacugugucaauugagacucaugauuaaaaaggaaaaaggaaaaguucuguguggguaaaaugacaauggauguacaauaagcugacucugcuuuuuuuuuuuugagauacagucuuguuuauauagccccugguuggccuacaacuugcuauguaaccaggcuggccucugacucccagggauacaaagugcccuugcuuuucugagugcugaaauucaagguaugugccaccacacccagacaugaacugauuuuugacaaagcuauacaagaauagaugaaggaaaaauagucuugucacuaauuagguaucaaaacaacuagacaucuguguguuaaaaguaaacugacccaaaauuuauguauaauacaggaacuacuucaaaacagacuacaaguguaaaugucaaaagaaaacuucuuggaguacagaggguauuuauaaaugagugaagagaggcacuacagaugcuggggagauggcucaguggcaagugagcaguggcucacuugcucuugcugaggacccauguucaguugccagcaccuauacagacgaggcucacaaucaucugaaacccuaguuccaggguuccaaugcccucuuuuggcuuccacaggcacccccaugcaaguagccacacaugcacacauacacacaaauaaggguaaagagaaaucauuuguaaaaaaaaaaaugaaaacacaaaccagaccaggagagauuguacaucauacgucuauauggacuuagaggcagacgauacaaagaucucuuaauaaucauuuuuuuaaaaaagcuacuaccuccaaaaaggagguuuauaaauggguagaagaguuaaauacagacuuuauaggagauacacagaugaaauuuuaacauauaaauauauguaguaaaaagcaaacaaacagcugggcagugguggcgcacgccuuuaauuccagcacucgggaggcagaggcaggcggauuucugaguucgaggccagcccggucuagagugaguuccaggacagccagggcuacacagagaaaccgucucaaaaaaccaaaccaauccaaaacaaaaccaacccccccaccccggucuuggauaaauaaacaguucucuaaagguauaugaaaggccauaugaaaagacaguugacaucacccaucaucaaagaaaugcaguaaaauacaaugaaauuucaauaagggcauagagaaauuugacccuuugcauacaguuugugauuguaaaagauugugaaacaguacaacagccaaggaacacagaauggaaccuccuggaaaaauuacaaguaggcaggcccgguaaggggagucugcaauccuuguuaggcaaauaaauaaauaaauaaauaaauaaauaaauaaauaaauaaaaaagcagggucugccugggcuacagaguuggcccaaggcuagccuggaaaaucuagcaagacccugucucaaaauuuaagccccaaggacacauuucagugauagaguacuuagauagcauguggaggacccaagauucaaugcccacuacaaaaacaaaccccaaaacucuagagacaucuuacuucugaacuuauccaaauaaacugaaucuaagaugucagaaauacuaggaaauacauauauauauaaaauuugguuuuuuuuuuguuuuuuuuuuguuuuuuuucgagacaggguuucucuguguaguccuagcugucuuggaacucacuuuguagacuaggcuggccucaaacucagaaaucugccugccucugcuucccaagugcugggauuaaaggcaugugccaccacugcccggcggaaauauauuuuugcaugcccauguucacugcaacauuauccuaauagucgacugacaacaaaugaauaaaaaaagugugguacaugugcuagggaauuauuacucaccuuaaaagggaaggcguuuuaucacacacaugaauaaacaccaaggacucguaccgugugaaguaagcccaucacaaaaagaaaagugcuauacugcuuccauucacauucauuaucuaaaggagacaaacucauaaaagcagaaagaacagcagcaguuaccaggcauucagagacacaaagaaaggaguggucaauguaugcaugguuucagauuuagaagauggaaaguucuacagaugugugucacaaggaugcaaaugaauacuacugaacugaguaauuaaaaauggguucgagggucaggcaugguggcacauggcuuuaauccuaggaggcuggugggucucugaguuugaggccauucuagucuacauaguaaguuucaggacaaccagagcuccauagugagaccccaucucacacaaauaacaauaauaauaauaauagagaaacuggacaguagcccaagucuauaguagcagcaggcaggaggguucaaagucauugcuggggaauauagcucagugguagagcuugaccagcagauacuagauacuacauucaauuuuugcuagcagaaaaaaaacccaaaaacaaacaaaaaacccucuaaaaaucccacagucauuaggucuagggugcauugaaaauaccuucuggagcuggagagauggcucagugguuaagagcacugacugcucuucuggagguccugaguucaauccccagcaaccauaugguggcucacaaccauccauaaugagaucugaugcucucuucuggugugucuuuauuauuauguguccuuacauauaauaaauaaauaaaucuuuuuuuuuuuuaaaaaaagaaagaaaauacuuuccuguuuccaaaaacuaaagauaggagcuagagagauuguuuaguguuaaaagcacauuugcuuuccauucccaguacccacccauagcuccaauuccagggaucucaaugccuucuucugaccuuuguaggcaccaggcacaugugcaacacacauacauauaugcaggcaaaaugcucauucacauaaaauacuuaaaagauccuaaaaacaccccauuaaaacuaaaacccacuaaguauggaaucccagcauucaggagguagagacagaagaucuggaauucaccgucaaacucaggcaggcagagaaucugaagucagccugggcacugugagauuccauuucaaaaaacuaaaaugaaaauuaagagccaguagcuacacgggaccccaccucaaaacaaaaauaugccuaagauaauaaccuuuaaaaaaaacuguaauaaaaguaguauguucaacaucaucugucauuaggaauugaaaugaaagucaguugauaccuauaagaaacacacaaaucaggagacuaaggaaauaugguucacagcaauaugaaucuuaaaaugaucaaaacaagcuaguuuaguucauuccauucuguuauuuauuuuauuucauuuugaagagaguuuugcuugguaugacacucagaacuauucauacaugucagcacccccaacaaaacagguuagcuuuuaaaaagccuuuuaauuuuucuuaagugauaguuacaaugccaaaugucaccaacuauuagaguaagaauauuuuauaacauuuucauaauuuucucacagcugaucacuugcagacuuaugacuuucccaaaugucaauauggcucuuuuuauuaauauuaaaacacauuugcuaaaaaaaaaucacuggaaguuaauaaagaauagagaaaguacaucuuguucuaauaacuucugguagaaaguaaaauauaaugagaaguauguacuuacuugcuacuaaugacguaauauuucauuauuguuagaagcaguaaaauguguaacuugugucagauauucaaaugguuagagcgaguuauuucauaaaauauguacaagcauaacuacagaauugcuuuagggaguucucuagcuuaauauuuuuacauugcaauucagugguuuuuuuuuuuuuuuucaaaaugaaauuauguucuaaucgaaugauacaaaauuccauagaagcagcaguucagcauaggaaagagcuugaguuuucaagucagucuucuggcuuuaccaaaggcuaguggaucuugggaaaggaaaauuccgaguuuccgagugcuuuguaaaacagugauggcaacaguuaacuuaucuccuaggaggugcuaagcgugagcucauaccucuaaagugcuuucuccaaccaaguacucaauggagacuaaugaguauuaauguuacuguuacgacaauuauguuucauuauuauuagcaaaauaaucaccccucaaaucgaaagucacaccuaaaaaggucuaaaaggaugggagcuugugagacuagaaacagcuacaggcuguggccagagaauagaagccugaauuucuaugguggucuguguauauccaagcuguacacauaagaauuuggggauaaaguggcggaaagguagaggucauugccuggacauauuugaccauucacaaauguuaauuuuaauucugucucacaacuaggacagaaaaugaggugaagacuuagcuauaggaagacccugcugucuacagaauaacugggaaggugguaacauagccccauucuuccaauucccaggaucgcuaacccacaucaguccagucauugcuagcucaacuguaccucuccucuaaguggcuuucccccgcagaaacagaaaucagaaaaaaggcgaagaaaacuauuuccuggcaacaccucaccaacaagccuugaguauuuaaaaagugcaauccaucauagauagcacgaggaagacaacacauucagugucuccuugggccuugcaagacaggcaaacagagaacuauauggaagaaucacauggaugcugacauaauugaaggagaaugacacauuucagacgcucuucagcaaagagcaaacauaaaacaagaugcccaacaacagauaagcuccucucacuaugcccccuucuguguacucauagaguauucucccagcugacugacuaacuccuuuggguuacuuagcaaggccauauuuaaauccgaccugagccauccuagcccugcaucugugaucuggcuuuccuguuuguuuguuuuuuguuuuggugcuggggcuguccucacacaugccuagcaugcauuccacuacugagcuacacccccagccacauggcuuuuccuucuuuuauucugaagucugacauagcaugguucaccuagaauucuaagauuuugaguaaggaaguauuucugcagguuugguguuucuaacugaucucuacugauaggagaaagauucaaaccauagaccauagucaauucuaagaacaguucaaagaucagagacaguguuucuuaaaaggaucuaccuggcuguauuuuaaacuuaauuuuggucaccuuccucucauaccauauuuaaaaaaaaaaacaacaaaaaaaaccuuuaaaaacugcaauaacuuugaagaagaaaagacaucuaugucagacacuagagaaagucaaaugcuuacuaguacuagcuacauugcaaaagaaguauacgucaaaagaaaagaggacugcuacagaagccaggugugguggugugguccuggaacuucagcagagagagagagagagagagagagagagagagagagagacuaagacaggagaggaggcucacaaaguucaaggccauacucugguauguaacaagaccugaucucaaagacaagaaagacagaaaacauauauacagagauuuuacaaacaaucuaccuccuagaaagcaagugaaauggagucaaggacuucaauggaagaaaagaaaaagugucagaaaaccaauaggauggucagaaaacccuucugggagaaacagaaacgaaaacacaucuugaagcuacucuuccucaucuaacugcugccuccagucugaacccagaaagaucuugauuauuugaacugauugucgaucaggguccccuucauuuuugcuuucuuggcuuccaauucagccuggaaagaaaaaaaaguaggcccugauauaucacaaucacaugacacucuuaacauuucuuguuuacucuaacuguucacgcucccuuccugcucaguguacaugccaaaaaugguuuuagaauccuuacucaucaacuuaaagccuggcuccuaaaaccuagauuuaaaauccuauguguaugcguguagggcaugagucuagaaagaaggucaugaagggggaaaaggacuaauggaauacaugugaugagaaagcaaaagaggaagcagaguguguccuguaaucacaggacuagggcgcuggcggcaggaggaucaagaguucaaagccagcuuuggcaacauagcaagucugaagucagccuggacaaauccugucuucaaaagaaagagagggaggaagggaggaaggaggaagggggaggggaaggagggaggaagggagggagagaaagaucaaacaaaauaaagcagaggagacaauguggaagaaggagaccaaccagagugggcaaggaguccgggaaggaggagggaaagaaugagaacaaagauaaugagacauaauuacaaaacugccauaaugaaaccuguuacuuuauaugcuaguauaaaaaauuaaaaagacauuuauauagaauuugauuaagcaccaaugcaguaugucugagauuaaugaaauaagcaauuauuauuaucuaaaaaaaauguuauccaaaaaaaaucaaauaaauuaguaauggacaggagugggagagagauaagagggaauggguaagggcagucagaauguagacuacaucagcaggcagaggaggcccaugccuuucaucccagcacuugggaggcagaggcagguugauuucugaguucgaggccagccuggucaacagagugaguuccaggacagccagggcuauacagagaaauucugucucgaaaaaccaaaaccaaaccaaaccaaaccaaaaaaccagaauguagacuuuauauacauacauacauacauaccugaaauuaucagagaacaaauucaauuaagcauuaaaaaagcaaaacaauggaggucccaaccuacauagaggugcugagcucuaaguuaauccccuggauaaggcagaaaacuagcagggcuuuaaaagcagugauagcagcuccaauucagguauaccgagguagcacaacuggacaccaucacacuggagagcacuaaaaaccuggcuccuaucuccugacuuuagagcacaagcagcagaguaaaacaguaucccaguuaggcccaucaaaucagauuucuaauucaggcuuugggcuccagccacuauuguagagcagaguuuacaaacacagucagcccggggugagaacgcuggcagccaacuauacuagaaauucacaacagcuccugcaaaucauucaaaguacgaaacccaaggcagguagaccugggcccuuccuccccacgccacuuaccaacuccugcagccuccucuugcucaugccuuugcgcuccagcugcuuuucaaucacuuuggcauucugcgcguaagagucagcaacuucccucuguaggaaacaaggcagaccgaugcacuucucagggaccacaacaaagaccucaguagguauuuauacuacucaagugcacgacuguaacuccucaucuucucuacgacccaggaaaguucagguuuccauggggaucauuugcuaagaacccucagugaaaaccacuugacugaaauagcagaaaagcaacugcugguauuaaggacguacucaaaccauuagagccaggcugggagggacugaaaacuauucagugcgcuaucucauugauuuuuuauuuguuuugaagauagaaucuugcuauggagauccugaauuugagacccuccugccuaagccuccagaguacuggaauuauaguccugaauccaguucaguggcuuuaaaauuaaaaagugaugagaggauccagguuccuuguucucauuuuauagcuguuccucccauucagggagacaggcacuagcucaauagcauagagcugcuuaauagcagagcagagugugaaaacuagguugccaacuguucugcucgcucugcacaggcucuugcuccccucccccauuucaauuuuccugaaagcagaaacacuuacagccucuaucuccucuucuucuucaucaaugguagacacaguaacagagcugaacuugcccaugucuuuaguccuuuuggucaucauaaccuagaacaguaggaagaggcaucaagcuaaguucaccgcagaaggauccaugagccacguacacaaguacuuuaugugcaugucugccuacagaaagggcaugggaauaccugccucuuggggacaggcugacuaucuacaugguaguguuaugaaguauuugcuauugagguuuuuggcucuuuuuuuuuuuuuugauuuccaagacaguuucucuguguaguccuggcuggccuggccugggacacacucuguagaccaggcuggugugaaaaucaaagaucugccugccucuaucucuggagugcuaggauuaaaggcaugagccacugccaccaccaccaccaucaccaccaucauguaaaagguggcugaagagacagccauggaugcuaggaaccaaacuuaaauauuuuuaguugugagccuagccuuuaauggcugagccaucucuccagcccacuauuaacgguuuuaaaacguauauuuaaaaaccagucuaauucauugaggauuuaguuguucccaaucuaaaaagaaaagaaaaacugaaaaggaaaauaaaaauucuacaaugucuaagguuacgaaacuacuauauguaaagcaaauaauaaaugccacaguccuauaacaucuacuuguacaggacaauggcaacuucuucauaaauauuucaucaacaaaugcaaguuucucagguauuauaccguauuuuaaaaagucggggaggcaggcauugcuacaggucagugaugcuugccugacaugcaaaaguccuggacucgauccccagcacuaaguaaauuuggggcuaaauguguugccaucuuaagccaucuguguccuuugaugauaauuaccuucuuaggaggcucuuguuucugaguauauauauugguuuucccaaagccuuggccaaauuucacuacugcuccauccacaaugaaggucacaggagcauucuucggcugggauugguagaagagcggcaguccacaccugcaaauggcagagugaaucucugggaggccucuaauucuccauccuuaacgcuugcaaaaguagacucagauucugagaagaguuugguuuguggcauaaaauguucaauuuuccccaaaagaacuugauaagaauuaauuagggugcauguugaaauuucugaucagauuccuaggucucaaccagaauauucugguuuggcaaaugcagggaugagugaggccagagacucggcuauuuucaucugcaucacauguauauacugacauuaaacaaaguuugggaaaugcuagcuaaugcugcuauuggccuuauaguaaaaaacugcuaccauucuucccaggcgcuuuaacacugguucgggcauucuguccccuuugcuauuucauuuuacagcaucaagagaaauggacagguaucacugcaguguuuggcaaaucaaaucuuguacaaguaccacuuucucuggcugaccauuaugcuuucugagcuaaaaaguagaccuauaagauaugauaaaaauuagcuucauccauccauugaguaguguggcuagcuacucaaaugccuuccugucuucaacuuauuuuccucugccucauucagugcuccugcucugagucuucuaagagccaacacacaauuauccuuacaccaagauuaaacucaacugcuaggcauaguggcuggccuuuaauacuaguacucaggaggcgucggguggugguggcgcacaccuuuaaucccagcacuugggaggcagacggauuucugaguucgaggccagccuggucuacaaagugaguuccaggacagucagcagggcuauacagagaaacccugucuugaacccccccaaaaaaccaccccacaaaacuaguacucaggaggcauuggcagguggauuucugugagcucaaggccagccuggucuucauaguaaguucuaagacagccugaacuaccccuacucaaaacaacaacaacaacugaaaucacugagagucuuacuacuaauagccuaaaacuguaaauuuuguuuuaaaaaacauccuuuaagauucuuagcuuuagggucuacauauuacauuguauacaugaaccuggaacuaaauuacauuguccauuuuccauuaugacccagccaauucuacuucauacauacauauauaucucccacaauaagaccuaucuagaauacucagagcaauguuacuggcaauagcuaaaacuagaaguaacucaaauucauaaacaaacugauaccauagaauacucaaaaauaaagaguacugugaauaaguaaaugaacugauaggaugggauacucagcacuaaagagaaacaaauaaucucauagcaauuuugaucaaucccuaaaacaccaaacagaaaaacuagguauagaggccagugagaggcugaguaguuaaaggagccuauugccaauccugacaaccugaguuugauccccaacacccacauggaaaaggugagaacugucugcaaguuggcuuuagauccccacauguauggaaggaaggaaggaaggaaggaaggaaggaaggaaggaaggaaggaaggaaggaaggaaggcaggcaggcaggcaggcaggcaggcaggcaggcaggcaggcaggcaggcaggcagggagggcaggccggcaugcagaaagguaggcaggccagcagagagugggagaaggagagggaaacaggaacaggaaacaggaaagagaaagacagacuagguauaaaaggcaugcauuuguauguaauagagaauuuacuauagauuuuccuaaaacauuaggaaaggcaagagcacagggauacaaagcagcaacuaccagggaaggguaaacggaggagacaggcugcaaaggacauguggacugcuggaaauggcuucuaucacgauggugguggcacuauuuaacuggaguuuuucugucaaaacccaucaaauugaauacuuaaauggguaaauuuuauugcagacauauuuaaucuuacucucucgaauuguuugcuuuuaagcccagagugaguuccaggacugccagggcuauacaaagaaacccugucuggaaagaaaagaaagaagucaccucacguuucugccugccguggggguucacgccuagagucccaguaguugggaggcaaaugauugaucagaagcuccagccuagccugaacugcauaucaagacccugcccccaaagaacaaaaaaaagcugucauuguucucacuuuuauaaucagcuggucagggaugggauuuaacuagcaucuuugggaaacaaauuagcauuugguuugaaggccuuugagauuaucgaugcaaaaagagagacuucuuuuucuaacacaucaugcuucgacuuaccuaggaccagcaagccccacacugcuguuacuuacuuugcacacuucuuccuguacugacguucaaugcccucaggccugcacagaaaauggauguuaacaggaaaaguuaagaguguaucucacuacugauucacccccuagcugauuucuucugcuuauucaucacuuaccagaauucaugccaaaagcucagacgcucuucauuguguagaucuacuggcuggcuaagcauuuauuaaacagauaacucuagcaugcauuccuucuuucccaaacagguacugagcaacuaauggggucagguaccaugcuaacugagcagacaaaagagugacaauauaaacagucacaagagugacuagacuuauaguagcaacaauauuaacuauaguauaacagcaaccagucauauaaucaguauauaaucuauggguccugaaucuauggauucuaccaaccauggguaaaaaaaaaaaaagacaaagguugugucagaggcuggggaggggacucaaugacuaagagugcuugcucugcuagaacaaggaccaaagguaaaagccucagcagccacauaaaaagucaggcauggcuauauauacuguaaccccagggauauggggaucaagguaggcugauccugagagaucacuggccagccagccuaguugaaauggcaaagcucuaguucagcgagauacugucuucagggaauacacugcagacugacagaggaagacaccccaacauucagcucuagacuauacaugugcacauacgugcauguauucaugugcgugccacacacacacacacacacacacacacacacacacacacacacacccauuaauacacacauuuucacuaacauagcuagauacaucucagaagcaaagaaaacagaaccucccaguuugcauuucuugguuuuaaacugaagcuauacauuuuagccccaguaugacagacauuuguuuguuuguuuguuuguuuguuuguuuuggugaaccauuagcuuauauauuuucagucacguuuuucuuuuacauuaagaagacuugcacuauuaaugggcuucacaaguauuucuuucuuaguuugugaucugucuucgauucuuguuuuguuuugagcauguggaaauuugagauuuuuuuucccuauagucaauacagagucaaugucucucuugcccuugcccucugccauguacguuauaacaaagcuaggacugucucaaucugaauuccuaucugaaauaaaaacuuccaaccucauauucuaaaaucugcucccauuaguuucuucucccaaaucacuauggaaaacgaggcagaaguggcuucccuuuacagagucaauuccagauucucugccauggcuuaccagccaccacggaagaacauaacuggcuucugcggcaacuucuacauugucucccuuuuauacacacuggccaaaucagucuuccuucugucucgguccuuugaaaagaacaugugcuuuccggcaggcaaccguuugcacacauuccucccucugccuagaauguuuugcucaccgcgcugcuguggcugcucucuucaucuacuuugaugcuacugcauacauaacuuaaucagaggccuuucccugaccacuuucacuaagcaguucucacgugacuuucucuaccaaaucuuuguuucauucauauggcuucuaauaaucaucaguccuugauuuuucuaugcaaucuucaucauccauuccccuuagaagagacagagucugccuuaucccgcgccagggcugagcgaagcacuacauauagggcuggagagagggcucagcaguuaguuaaaagcacuggcugcucuuccagacgaucuagguuuaauucccagaacccacaugguaguuaacaacuaucuguaacuccaguuccagguguccagugccuucuugucucucagguacaaggugcacaugugguaaacaaauauacaugcagacaaaauaccacagauauaaaauuuaaaaugcuagacauacagaagauuuauaauaaacacugaaugaauuuggaagaauuuaccuucuauaagaaaacuaaacuuauauuucaaggaagcuuuuucugaguuaagaucuuauugaaguccccuaggaagaucuggaguuugccuaugcagcccaggaugaccuuaaacucaagcaauccuccacagcuucagacuuccauauacuaggaugacagucuuaagccaucacaucuggcuaaugauaucaaguucuuaaauggaggaaucuguaauggcaccagaggugguauucauauuugagggagucacagaaacuucaugaagaggugaugcuccugccagaguccugauagaaaaugggacuuccccccagagcucgugucucuagcugcauauguagcagaagauggccuagucggccaucauugggaagagagaucccuuggucuuguaaacuuuauaugccccaguacaggggaaugccagggccaagaagugggagugaauggguagaggagcaggguggggggaggguauaggggacuuucaggauagcauuugaaauguaaauaaggaaaauaucuaauaaaaaauugaaaaaaaaaaaagaaaauggaauuucauccaaaggaaauacuuuauauaugcauaguauucaugggauuacuauguacaaagaauuagucuaaugucaucaggaccucaaacuccaggguuuuguaccaacaguauagacauaaaaagguuauucuaaaauaaauaaauaaauaaauaaauaaaagguuauucuaugaacaauuauaugccaacaaacuagacaauuuagaaguuacagaaugaaaaagaaaggcauaagugggugugguggcauuugccucuaaggccagcucauaggaggcugaagcagaaggguccggcugaaggccagcuugggcugcacagugaaauccugucucaaagaacaaaaacaaaaacaaaagagacacaguaagaacagacuagaacccugcuuuggccaacaaaagggcacagcguguccuuggaaaagcugcucaguacuagagcaugaacuaugucaaaggggagaacacuugcuuguuggucagugcuaagaacucugaaagcuuggccaaaaguuccuggcguaggaacugccaauaaauaagacacuacuugccacuaaguaaggcuaggucuaaggcugauuugcccuaaagggaagucugauuggauuucagcauuucuacuucaaccuagggucacccaguaguuuucuugacuagccaaaugauacaggaaacugaagcguaguuguaugaaauuacuuucuguacuaacagaauaauacauauuaauauauaauacuguauuaggguucucuagagucacagaacuuaugggaugucucuuuauauugagggaauuuauugugaugacuuacaaucugcaguccaacuaacccaacaaugggcagcuaugaaugggaacuccaagaaucuaguaguugcuuagucccaugaggcuaguuguuucagcuggucuucuguagaaguagguucuaacagaugugcuggcaaguaaaugcaagcaguugaagaaggggugaaucuuccuucuuccaauguccuuauguaggucucuaauagcagguauggaccauauuaaagauuuguaccaccaugccuagaucugggacuugcuuugccucaggcugaccuugaacucagauaucuccuugccucaguuucccaggauuaaaggccuguacuacuuugccuggaccuaaccucuucauggccacuauggcucaagaucuccacgucaagaucugggucaaaagucugugucuuccaaccucaagaucuggaucacaugugaacccuccaauucuggauuguaguucauucuacguauaaucaaauugacaaccaggaauagccauuacaaauacuauuaaaauagagaacuuuuaaaaaauauaugugcuuauuacaaugauccuaaaaauaguugaugauuuucaaaagcaguagucuagauaaugggggggggagauaaaaaccuaggacaaaaugacacauguaaugugagcacuugggaaguauaagcaggaggucaggacacuuccacuaaguaucccacucaaggcucugugcuacaugaaagacugucaaagcaaaacuaaacaaaacaacaacagaaaguuaaaauaagagggcagggacuggagagauggcucggagguuaagagcauuggcugcauuuccagaggucccaaguucaauucccagcaaccacauggcaacccacaaccaucugcaacuccagguccaagggauuccuguucuggccucgaugggcacaaggcacacagaugguauacaaacauauaugcaggcaaaaaaucuuauacagaaaaucaacuuucuaaaaauuaaaaggcacagaaaaaaagccacaugaugacacgggcagauaauggcagaugcauggauaagccaaggagcacuaaggauagcagggggagaagaaauuucagaaaaaagagagguaguucagagaacaaagcaucuaacaccaauuuccaugacccaaguucuaucccugggaagaaaacuaccaaaagcuguccucugaccuccacaggcaggcuauggcagccccaucaugucuuaucccuacccccgcccccccccccccacacacacaaaaguuaaaagaaauaaacaaaaaccugccaggccugauggcacaugguuuuaaucccagaauuuaggaagcaaaggcaggcagaccucaaugagcuccaggacagccuggucuacauaguaagaccucccccaucucuccacuccccgggaggugauagguaguaggaaggaguaagacagcaaaaacaggagcugggugugguggcagaggccuacagagugagcuccaggacagccagggcuacacagacccugucucaaaaaaccaaaaaaaaaaaaaaaaaaaaaagacagcaagaacauagcucugcugacaauuuucagacuucagccuccaaaucugagccuguucauuuuuuguuuguuuguuacuuaaugcuacccagguuguguuauuuuacuauagcagauuuagcauguuaauauaccaguguauucaagugacuaagacagugcucagcauauaaaggagcucagaaaaugaaguauuggcuaaagaaaugaguggccuuuauuccugagaaugagaagauggcaucagauccccuagaccuggaguuagagaugguugugagccaccauguaaaugcuggaaacugaaccuaggaccucuggaagagcagccagugcuguuaacugcagagccaucucuccaacccuucuuuccuuucuuauucucugcauuauuagguucuccugguucugucccaauuuuuuugucuacuuuguaaaucuucacuccuuucucuuucucaucuguuuuaucuuguauguaugaaaagggucuauauauauauauauauauauauauauauauauauauauauauauauauauauaaacguuuaauccuccugcccuaucucccuagagcugggauuacaaggguacaaggguauauuauauuaccauuccagcuauauguaguaucagugauugcaaauacuguaccaacugagcuauagccuuauacuuugcucuacauucauuuuauguaacuuugaauuaccauauacaucaaggauuccucaacuuggaaacauauacaucuaacuauguuacucccuccuuacaaaauggaaauaaggggcuggagagauggcucggugaggugacuaagaguauauuguuuuuuuagaagacccaaguuugguucccagggucuuuaggugguugacaaguaccaccaggaacuucagcuccaggggaaucaaacaucuucucuucaccucuacaggcaccugcacucacaggaacauaucaaaacacacacacacaaggaaauagcuuuucauugccuucagauaaagcauuucacucuccucaccacaguacuuaugaagccuuuucuauaaaacaguaagccaugcucuggccacagaagacuacugaaaugucccauagacauauuugaugcucauaaugcuuccagauucccucuaccuggacuguuuccgcaucgucuuccaagaacuagugaagucuucguucaagccaagcacaaacaccacuaucguucagaucuuuuccugaccacaacacauguaaaauaaauaaccuucucccaccuguuuucccauagccuuuguucacagcaccagcauuucuuucuaucauaagaagaagccuguuuccaaacugauuucuuuuaaaaggacugugccuuauucacagauuugguaccuagcucaguaccugacacaugacagucauaaggcugcagauguaacuguaggagagugcccacuaaacaagaguaaggcccuuguuccauccccagcccuggaaauaauauugauaacaacagcagaaguuacagguuguacuaacucauucaagccuguaacuggaacaucauagccaucaaaugccaagagaggcacauuucaguaccauuucaacaaaguacaauaaagaauuuguugaauuaaaauaaguuaggagauuagcacaaacgucaaaguaucaggccuaacuguaugagcugcuuaacacuagcauaggguaauuuacauuccucguaaagagaccgcaacccaacagugaacuagagcauuaagcccuuaccuccgaagauaaguagucuccucaucuucuguguuacaaaacuugugagcauguuuggcagcaucgaucacgcgagaccggucccggggccucaugggcaauuucucuaacuggcaaucugaaggaauggagaaaaauuuccucgcuuagucacuaaaaaaaaaauacccugaacuuaagagugguaaugcacuccuggaaggagaauuaccaacaaguucggggacaaucuaggcuacauaaugaguucaagaucgagcuacuuugugagaucuugucucaaaggagaaaaggaaaagggggggggggggcggggagaaagauugaaaaagaaagaaaaaagaagcccgauguuuccuugcagccgccacuucccgccacucacccagcaccaggaccaucuggccacauaaacaguaguagacauggaggggcuucucgccaucaucauauuccucgcggucccgggugucugagcagaccaccgaccgcgacacgacuuucggcauagcuccggcagagcagccagaaaacucccagaaaaugaagagucgcgccgagauggcgucacagacacucgcgccagaccguuucuccacuugaucacguguugacaccggauugauuaacuuccggaacgucccaucccgcuaaauugcagggagaggcgggggagggugcugaguugacagaagcucagucagcugagacagcuuuagauaucgacaccuuccguguuauuugaaauacuuuuauuucuauacagucgucaauauuguuuugauuuauuggcgccuccggagcgcgcgccccccuccgcguccccuccccuucccacgcuuguaugugacuuucaggauucuguugcuuccacuuaguggaccucaaaacaagcaacucaggucuucaggcuuagcggcaaacuuuuacauacugagagccggcucucuuguucaugaauauuuaugaguauauguaaaacucgacauaauaaaggacugacuauacauuauaauauaaccuagaucuuagauauacugguaaauauuuugguuuuacgggcuguauucagaaccuaaugaaguagaagcuuuuuuuuuuuuuuuuuuuuuuucugauguaguggggauuaaauauaggguguuguaaauacuugacaggccuucuaucacugagcuauauccuccagucccguugcuucuuuguuucuuaaauuguguuuuuuaagcuuuuuuuaugcacauugguguuuugcccgcauauacgucuguaugagggugccaaaucccuuggaacugaagucacugccagcugccauaugugugcugggaauugaaccaggguccucuggaaaagcaaccagugcucuuaaccacugagccaccgcucccgccccuaguuuagcaccucuaguuuauuuauuuuaagguuuauauaucuuuacuuuauguguacuagugcuuugcccgaauauaugucugugcaccucauuugugccuuguuucugcagaggccagaaggcggcuuuggaucuggcauuacagaugguuguaagcugccaugacuccaaugaguacaauagaacccaaguacucuggaacagcagccagcacucuuuuuuuuuaaacuuuguuuucuguuuauuauuuuacauacccaucuuaacaaaucaagugugacuucuauaaugcuaaaauauuaauaucacaauaucagaaaauaaaaaaugaaauauuaacuuuaaaugcucuaggaaugcaagagauuaugacuaaggagcagacaauauaucuaggugucagagcucaauagcugaaggaauaaacaauaaacacuaagugcuauccaagcagaaaugaaucccaguguucaggggacaaaggcacaucagguuuucauaaagcauaugaugggacuggucuaguuucaaaugauuacaauauagcagccagcacucuuaacugcuuuaucucuccaccuguuuuguuggggguguuguuguuguuguuguagauuuuauuuauuuauuauagauaaguacccuguagcuaucuucagacacaccagaaaagggcaucagaucucauuacagaugguugugagccaccauuugaacucaugaucucuggaagaguagucagugcucuuaaccacugagcuaucacucuguagaccaggcuagccucaaacucagaaaucugccugccucugccucccaagugcugggaucaaaggccugcgccaccacgcccggcuccaaugguaaucuuuuauuuuaaagaaagaucucggagaaaaccacaggagccagugacuagagaaacacaagauguaucccaacugaaauuuaaagcaguuuaccagaccuucaauggaguuguauuauuuaaaauauaaaagucuucuuuuuacauuuauugggugugggaggcuggagagauggcucagugguugguugggagcacugacugcuacuccagaugaccuggguuugauucccagaaccugcauggugguucauaaccaucaauaacuccaguuucaggaaauucaacacccucuuauggcuuccacaaacaccaggcaugcucauggugcagagguauaaaugcaggaaaaacaauagugcacacaacaacaaaauuuuaacuuuauugacaaacauuuuguuuaauuauauagauuucauugugacauuuucauacauguacuuaauguguuuuggucauauucauccucauuacuguaucuugucccccuccugcuuccacugaucuucucucucuucccagaguugcuuccaguggugugcauuagggguuaauuacaagagcauaagaguaugggcaaguuaccacugaagaaaggcucucucucucucucucucucucucucucucucucucucucucucucucccucccuccuucccucccucccuccuucccucucagcaaccauuaacugccuacagcuccacaagaaaggaugaggucucaugagucccuucccccuucaugacagaaugguuaagggucuaaaucaugaccagaaaaguguucuaaucuccuccaacccuuccuucagcucuuauagucuuacccucucuuuugggcauguuuccuccacauuaaauuggauggcuuagacgguccauuuaggacugagccuccaacauuaagacucuauuuucagcauuucaaccagguaugaguuucugcaguaaucauuaccuacugcaaaaagaagcuuugcugaccaaaguugacagcagcacuaaucuaugggcauaaacauaaauauguagaagguaacuagacaggugccuuggaccuaugaccucuccagucuucucuugcaggauauuugaucacacugcaaacccugagauuuacugagaaacccuauuucuaguugugguguggcucagcucuucgcacacaccuuuaaucaucuggcuagaauacagauacaugcuaaguacacaucuguaaucccgaauaaugaaguuaaaguuaguuuguagaaggaagcacuuauguuugaaagugacaucuaauugaguggcagacaagugacuaaugagagaaagauuugacagaauaggauaugcccaacucucaugaagagaggaaagggaagcuucuuaagagagcagugcacagaggaagaagacagcaguaguaccaggacaguuauagagaaacaauuugagagagagaacaagcuagacacagcggaaagcggaaagcagaaugagccagagaaugagaaggagccaggagauuagaacagauugccagaguuaguuugaggccaagcaaagcaguucaggagaagcugacagaagcuaagagaguguggagagaaguuugagccagaacaucugaguucaaccagcuagccagaguacagaaaaaaacaagaaaggcugagcuuagucagcaguaaaucucagaggcugaaaacaguucuaggccuagaugaggcuagaagcuuccagaacuaggccuagguuagcagacagaggcuguaagccucagaugacaauuaucacaggcaaauaaaaguuacuuuuacagucugcaguuuuaaauuuuuaaaauaucuauuuauuuaauauauggugugugugcacgcgugugcgugcauguguguaugcacacacauacacacugucuaccagauagguccuaggacuaugacucagacugcagacuaugacucaacagcagacuuccuauagagcucacuuaguuuugcacucacaacuccucugcuucagccuccacagggcuggaaauacaggcaaacaccacacaccuggcaagaucauuccucuuguuuuguuggguggcuaggacuugaaauaagggcuugugcauguuaagaaaguagcccccuacuguuuaacacauagcccaaauauaagagaauuauuaaugaaagucuuagagaauaacaaucuuugacccuuggguccuaaaccaguagcauccuuuucacuccauacuauucaguauuuauugauccucuguuuuguguuagguacugugcgagaguaaucaguuacaaguggucucacuccucauguggcuuagucuagugcuggaguuagcaaacuuuuucuguaaagaagcagagaaugaauccauuggggggggcaagaagcaaaaucaagaacauagucuaagaauuaauauaagaggaaauagauuuccauaagcccuuuauugaaaaaguucuaaauauaagcauuccuuuaauauagagauuuaauaauacagguuuacuaauuagaaggauggcauauuuaucuauuuauuuauuacagauuuauuuauuuauuuauuuauuuauuuauuuauuauauguaaguacacugcagcuguccucagacacuccagaagagggagucagaucucaugacgguugcugggauuugaacuccugaccuucagaagagcagucgggugcucuuacccacugagccaucucaccagcccggcauauuuauuaaaagggauaauauuucucauauuucucuuaaugaagauuuagaacaaguauuuuuuuggggggguuguuuguuuguuuguuuuuuguuuuuguuuuuguuuuuuuuuuuugagacaggguuucucuguguagcccuggcuguccuggaacucauucuauagaccaggcuggccuugaaaucagaaauccaccugccucugccucccgagugcugggauuaaaggcgugugacaccacggcccagugaauagaagcuucuuaauuguacaguuacauugauuugugaaacacaguuuuuuguacuugcauuaugauuuggaaaaugcugcugcaacugugauugagcuugggaaauguguuugcugcaaauuuauauaugaaggcaacuuuuuaaaaauguuuaaauaauauuuuuauucuuugaaaauuuuauacauauauccauuguauguugauuauauucauuccucauuucccuccagcucaccucacucucaaccauuuuagucaugcucucucucucucucucucucucucucucucucauacacacacacacaaauacacacacauauaaacacauacaaauacacacauaaauacauacacacacacugaauaaauguaaaccaaaaaugaagacgcaaauaucacaaaucauuuaucaaguauguagcagaagauaauuccaagaaaauguucuguaacagaugcagaggguggugcuucuuauucagaaaacauucugucucagucgugagcgcuaagaguuuucaagugcugagcuguaaaacucugccuggcagggcaaaccagaaacccugguuuucugucuccaauaaaaguaagggaacugaugaugcuucccucuaggagagaguguccucugcucucaggcauugugaaguccuuggcugugaagagggcacuucuuccagaugucaaggcgagaugggagugaacgaaugcucggcuagcugugggacagguacuguguucuaaccugauaaucaccugugcuggaaaauaacucuguguuccggcuugcuauggcaaccuugcuuugaugaggagaguggggcccacagcauccccaggauacaauuccaugcuucugucagaggacacgauuaucagacaggggcccuggggcuuguaaauuacuuugguucagacccuugaguuguaaaggaagacaaggaacuuuuccaaaaaaaaaaaaaaaaaagacaagcccacagaaaauuucaacaugucuacuguaucuuguaauuacuuucagacacuuauaaccagucaauaauuucuccuucauuucuccuaacaacuucucucuucuucccaaccucacuaugcaacccagguuggcuuugaacuugcacucuuccugccucagccuccccauugcuccccauuuuuuaaaaagauguauuuauuauuauauguaaguauacuguagcugucuucagauacaccagaaaagggcaucagaucucauuacgggugguugugaaccacuaugugguugcugugauuugaacucaggaccucuggaagagcagucagugcucuaaaccacugagccaucucuccagcccccauugcuggacuuaaagacaccauucgccaugccuagcuugcaugcugcuucuuaauaauauacaguuuguagcgcgcucucucucucucaugcucaaacucucagaaaagcuggccauggagccuaaauuccacccccacccuugcauuuaagggcauuuacucaacuuugucacucuugaucuuccaagcugauguuucauuauuuccugugaaguacuucucccaaucuuggucugaugguucacacuggcaaccucagcacucaagagguuaaaacaggaagucugcugugagucugagaccaacuaaggcuacacaacauagugcuuuccaagaaacuuggguuaucaaguaagaccuugguucaccuccugcuaaaaacagccaaguggacguaugaacuccuugaguaagcaaggcagcguacccacuuccucaggcugugcuuuagcuucauauacuugcucagaaaugggauuuuugucucuuuuacagcaaaaccgaaaugggcuuguuuuaggaaguuugucuugaccacauuauaccagugguauuuugguggugcaguuucucaacacugagggauucccguauacuuaauauagaucucacucuugcuguggcagguaggguuguaaugaugccagccuucccaaagacucuugauccuuggugcaugcacauagcuuugucuaguuauuaagacaacgcuugguuuagauuuuuuccaauuuuuaauuagguauuuucuucauuuacauuucaaaagcaaucccaaagucccccauaccccccacuccccuaccuacccacucccacuucuuggcccugguguuccccuguacuggggcauauaaaguuugcguguccaaugggccucucuuuccauugauggccgacuaggccaucuuuugauacauaugcagcuagagucaagagcucagggguacugguuaguucauauuguuguuccaccuauaggguugcagaccccuucagcuccuuggguacuuucucuagauccuccauugggggcccuguguuccauccaauagcugacugugagcauccguuucaguguuugccaggcaccggcauggccucacaagagacagcuauaucaggguccuuucagcaaaaucuugcuaguguauacaaugguguuugcauuuggaggcugauuaugggauggauccccgggugcggcagucucuagaugguuagucuagauuuuauagugaagaaauugaguagcuuuuauuuguuuguuuauuuauuuagguacuggggaugggacauggagccuuacacacaccaggcaaguacugaacugcauuucagucaauugacaagaguaacuaccaccugaaguuagaggauuuuuaagauauagagauuaucaacauugggucugauauaaucagagaaguuagagaaaguacauugcagucuccuugaagaaaaauguucaaaguagggaaaggagcuaauaauagagaaauauucaguuggcaaugaaaaggggaguaggucacauagcaaagaauggagguggccucugggagcugggaguggucccaguuuggcaguuaauagugaaauagggcuccaagcccuaugaccacaaggaacuagacuugaccugcaguucauggcuaucaguucagcagugacagagaacaaaugcucuuuuugcaggccuugcuuuugcucuuuucaugugugaacuagaagacuucguguuccuagaugaggagaaaggauauuugaaauuuguuugguaaccuuuucccaccaacagccauaauccaacacuauuagggaaacuugcuuuaacggauucauauguugggguuaauggggggguaacaauuguuagucaggaaggcacuugccauuaaguaccuaggaaaaucacuacuguugguaugugcuuccuacuccuaugcaccugaugacuucuggacaucuucgcauggcuguuucaucacucccaggagcucaggaagucccacucaaaauuucuucucccagaugugucccuucacccuuuaugccuaguucuguuaacggccacuucaaagccccacugcucucaggguuuaaagcaucauucuugccaccacauucaaucuauugccaagugcucuuuauuuaccccccuccuuuucucugaugacuauagaagacugggcucuccgagagagagagagagagagagagagagagagagagagagagagagauugauuucaaaaugugagcaggauuuaaugggaaagaaaaucucuguugaagacugaagcuguaguaguucccaugguaaaggaugcgcuugucucugggaggugagauugccugauacaguguuucuccuccacaguagcaaaagagcccugcagcuacuuucuugcucucuagggagaagauucugaaugcccagcucuaauggugucgcuuccugccuccacuaccuuccaaggauuccauuagcuuggcauucaaaacucucccagauuuaacucaaaccugccuuucucauaauuuccagcauccuugucugcccacuaagugacuuuuggguugaucuuugaaaaugcuucuuugaaacuguucuugcuuuugcaggucccuauacucccugggaggcuugccugagacuugcagcuuuuccugugcgcccugccucuccuugccgccuccgguccuuccaauacucuccagcuggauaagcucauaccucagacucuucuaaacuagcugcuuggcuugcugaauuaccaaggggaaaugugguuccagagacaaauugugaguacccauagagauuguaaaaagucuauuuucccugggagaagcucucauuucuuuuuuuucuuucuuucuuucuuuucuuuucuuucuuuuuuuuuuuuuccgacacaggguuucucuguguagcccuggcuguccuggaacucacuuuguagaccaggcuggccucgaacucagaaauccgccugccucugccucccgagugcugggauuaaaggcgugcgccaccacggcgaagcucucauuucugccacugccccccaacaucauuucauucaguccuaggguuaaaaguuggguuugaauugugcacccucaucucaaagaagauggacccaaaguccauuuucauacucaagagcuauuuauuuauuuauuuauuuauuuauauuacuuuccccaugacuuuaagcaguuaccccagccucucgugucuacaggacugugacccuaacauccuugccuuuggagaacugcuuugccugugccaagucuuuccuccacucuuuucuuucaacuaaucuucucgccucuuuccccgacccuaaacaguaguuggcaguuuaauaauucauucuuugucaaaacagaagaaagguuaaagacauauuccuggcaggcugaggugaccuccaaguccagccucugggauucacagugagucugaguuagccuguguuacauuagauacuacaagagaccaacccuacaaucaaucagccaaucaaucaaucaacaaauaaguggaggaagaagggggaaccaauaacaaaacaagaaguaauuaaaagacuggcaugguggugcacucuuguaaucccagcauuugggaggugaaagcaggagagucaggaguucaaaaucaugcucaacgacacagugaguucgagguucucuggccuauaggagacucugucucaacagagggggaaaaaagauagaaaaagagccccuccuucccgaaaaaaaguaaguaccuauaaaaagaaaacuucgcagggguuccucuucaagucagcaaguggggcccgcgcugcucccuguuaaaucaccgggacu

SEQ ID NO: 9449 - RNA, 50383 nt, Mus musculus
agucccggugauuuaacagggagcagcgcgggccccacuugcugacuugaagaggaaccccugcgaaguuuucuuuuuauagguacuuacuuuuuuucgggaaggaggggcucuuuuucuaucuuuuuucccccucuguugagacagagucuccuauaggccagagaaccucgaacucacugugucguugagcaugauuuugaacuccugacucuccugcuuucaccucccaaaugcugggauuacaagagugcaccaccaugccagucuuuuaauuacuucuuguuuuguuauugguucccccuucuuccuccacuuauuuguugauugauugauuggcugauugauuguaggguuggucucuuguaguaucuaauguaacacaggcuaacucagacucacugugaaucccagaggcuggacuuggaggucaccucagccugccaggaauaugucuuuaaccuuucuucuguuuugacaaagaaugaauuauuaaacugccaacuacuguuuagggucggggaaagaggcgagaagauuaguugaaagaaaagaguggaggaaagacuuggcacaggcaaagcaguucuccaaaggcaaggauguuagggucacaguccuguagacacgagaggcugggguaacugcuuaaagucauggggaaaguaauauaaauaaauaaauaaauaaauaaauagcucuugaguaugaaaauggacuuuggguccaucuucuuugagaugagggugcacaauucaaacccaacuuuuaacccuaggacugaaugaaaugauguuggggggcaguggcagaaaugagagcuucgccgugguggcgcacgccuuuaaucccagcacucgggaggcagaggcaggcggauuucugaguucgaggccagccuggucuacaaagugaguuccaggacagccagggcuacacagagaaacccugugucggaaaaaaaaaaaaagaaagaaaagaaaagaaagaaagaaagaaaaaaaagaaaugagagcuucucccagggaaaauagacuuuuuacaaucucuauggguacucacaauuugucucuggaaccacauuuccccuugguaauucagcaagccaagcagcuaguuuagaagagucugagguaugagcuuauccagcuggagaguauuggaaggaccggaggcggcaaggagaggcagggcgcacaggaaaagcugcaagucucaggcaagccucccagggaguauagggaccugcaaaagcaagaacaguuucaaagaagcauuuucaaagaucaacccaaaagucacuuagugggcagacaaggaugcuggaaauuaugagaaaggcagguuugaguuaaaucugggagaguuuugaaugccaagcuaauggaauccuuggaagguaguggaggcaggaagcgacaccauuagagcugggcauucagaaucuucucccuagagagcaagaaaguagcugcagggcucuuuugcuacuguggaggagaaacacuguaucaggcaaucucaccucccagagacaagcgcauccuuuaccaugggaacuacuacagcuucagucuucaacagagauuuucuuucccauuaaauccugcucacauuuugaaaucaaucucucucucucucucucucucucucucucucucucucucucucucggagagcccagucuucuauagucaucagagaaaaggagggggguaaauaaagagcacuuggcaauagauugaaugugguggcaagaaugaugcuuuaaacccugagagcaguggggcuuugaaguggccguuaacagaacuaggcauaaagggugaagggacacaucugggagaagaaauuuugagugggacuuccugagcuccugggagugaugaaacagccaugcgaagauguccagaagucaucaggugcauaggaguaggaagcacauaccaacaguagugauuuuccuagguacuuaauggcaagugccuuccugacuaacaauuguuacccccccauuaaccccaacauaugaauccguuaaagcaaguuucccuaauaguguuggauuauggcuguuggugggaaaagguuaccaaacaaauuucaaauauccuuucuccucaucuaggaacacgaagucuucuaguucacacaugaaaagagcaaaagcaaggccugcaaaaagagcauuuguucucugucacugcugaacugauagccaugaacugcaggucaagucuaguuccuuguggucauagggcuuggagcccuauuucacuauuaacugccaaacugggaccacucccagcucccagaggccaccuccauucuuugcuaugugaccuacuccccuuuucauugccaacugaauauuucucuauuauuagcuccuuucccuacuuugaacauuuuucuucaaggagacugcaauguacuuucucuaacuucucugauuauaucagacccaauguugauaaucucuauaucuuaaaaauccucuaacuucaggugguaguuacucuugucaauugacugaaaugcaguucaguacuugccugguguguguaaggcuccaugucccauccccaguaccuaaauaaauaaacaaacaaauaaaagcuacucaauuucuucacuauaaaaucuagacuaaccaucuagagacugccgcacccggggauccaucccauaaucagccuccaaaugcaaacaccauuguauacacuagcaagauuuugcugaaaggacccugauauagcugucucuugugaggccaugccggugccuggcaaacacugaaacggaugcucacagucagcuauuggauggaacacagggcccccaauggaggaucuagagaaaguacccaaggagcugaaggggucugcaacccuauagguggaacaacaauaugaacuaaccaguaccccugagcucuugacucuagcugcauauguaucaaaagauggccuagucggccaucaauggaaagagaggcccauuggacacgcaaacuuuauaugccccaguacaggggaacaccagggccaagaagugggaguggguagguaggggagugggggguaugggggacuuugggauugcuuuugaaauguaaaugaagaaaauaccuaauuaaaaauuggaaaaaaucuaaaccaagcguugucuuaauaacuagacaaagcuaugugcaugcaccaaggaucaagagucuuugggaaggcuggcaucauuacaacccuaccugccacagcaagagugagaucuauauuaaguauacgggaaucccucaguguugagaaacugcaccaccaaaauaccacugguauaauguggucaagacaaacuuccuaaaacaagcccauuucgguuuugcuguaaaagagacaaaaaucccauuucugagcaaguauaugaagcuaaagcacagccugaggaaguggguacgcugccuugcuuacucaaggaguucauacguccacuuggcuguuuuuagcaggaggugaaccaaggucuuacuugauaacccaaguuucuuggaaagcacuauguuguguagccuuaguuggucucagacucacagcagacuuccuguuuuaaccucuugagugcugagguugccagugugaaccaucagaccaagauugggagaaguacuucacaggaaauaaugaaacaucagcuuggaagaucaagagugacaaaguugaguaaaugcccuuaaaugcaaggguggggguggaauuuaggcuccauggccagcuuuucugagaguuugagcaugagagagagagagcgcgcuacaaacuguauauuauuaagaagcagcaugcaagcuaggcauggcgaauggugucuuuaaguccagcaaugggggcuggagagauggcucagugguuuagagcacugacugcucuuccagagguccugaguucaaaucacagcaaccacauagugguucacaaccacccguaaugagaucugaugcccuuuucugguguaucugaagacagcuacaguauacuuacauauaauaauaaauacaucuuuuuaaaaaauggggagcaauggggaggcugaggcaggaagagugcaaguucaaagccaaccuggguugcauagugagguugggaagaagagagaaguuguuaggagaaaugaaggagaaauuauugacugguuauaagugucugaaaguaauuacaagauacaguagacauguugaaauuuucugugggcuugucuuuuuuuuuuuuuuuuuuggaaaaguuccuugucuuccuuuacaacucaagggucugaaccaaaguaauuuacaagccccagggccccugucugauaaucguguccucugacagaagcauggaauuguauccuggggaugcugugggccccacucuccucaucaaagcaagguugccauagcaagccggaacacagaguuauuuuccagcacaggugauuaucagguuagaacacaguaccugucccacagcuagccgagcauucguucacucccaucucgccuugacaucuggaagaagugcccucuucacagccaaggacuucacaaugccugagagcagaggacacucucuccuagagggaagcaucaucaguucccuuacuuuuauuggagacagaaaaccaggguuucugguuugcccugccaggcagaguuuuacagcucagcacuugaaaacucuuagcgcucacgacugagacagaauguuuucugaauaagaagcaccacccucugcaucuguuacagaacauuuucuuggaauuaucuucugcuacauacuugauaaaugauuugugauauuugcgucuucauuuuugguuuacauuuauucaguguguguguauguauuuauguguguauuuguauguguuuauauguguguguauuuguguguguguguaugagagagagagagagagagagagagagagagagcaugacuaaaaugguugagagugaggugagcuggagggaaaugaggaaugaauauaaucaacauacaauggauauauguauaaaauuuucaaagaauaaaaauauuauuuaaacauuuuuaaaaaguugccuucauauauaaauuugcagcaaacacauuucccaagcucaaucacaguugcagcagcauuuuccaaaucauaaugcaaguacaaaaaacuguguuucacaaaucaauguaacuguacaauuaagaagcuucuauucacugggccguggugucacacgccuuuaaucccagcacucgggaggcagaggcagguggauuucugauuucaaggccagccuggucuauagaaugaguuccaggacagccagggcuacacagagaaacccugucucaaaaaaaaaaaacaaaaacaaaaacaaaaaacaaacaaacaaacaacccccccaaaaaaauacuuguucuaaaucuucauuaagagaaauaugagaaauauuaucccuuuuaauaaauaugccgggcuggugagauggcucaguggguaagagcacccgacugcucuucugaaggucaggaguucaaaucccagcaaccgucaugagaucugacucccucuucuggagugucugaggacagcugcaguguacuuacauauaauaaauaaauaaauaaauaaauaaauaaauaaaucuguaauaaauaaauagauaaauaugccauccuucuaauuaguaaaccuguauuauuaaaucucuauauuaaaggaaugcuuauauuuagaacuuuuucaauaaagggcuuauggaaaucuauuuccucuuauauuaauucuuagacuauguucuugauuuugcuucuugccccccccaauggauucauucucugcuucuuuacagaaaaaguuugcuaacuccagcacuagacuaagccacaugaggagugagaccacuuguaacugauuacucucgcacaguaccuaacacaaaacagaggaucaauaaauacugaauaguauggagugaaaaggaugcuacugguuuaggacccaagggucaaagauuguuauucucuaagacuuucauuaauaauucucuuauauuugggcuauguguuaaacaguagggggcuacuuucuuaacaugcacaagcccuuauuucaaguccuagccacccaacaaaacaagaggaaugaucuugccaggugugugguguuugccuguauuuccagcccuguggaggcugaagcagaggaguugugagugcaaaacuaagugagcucuauaggaagucugcuguugagucauagucugcagucugagucauaguccuaggaccuaucugguagacaguguguaugugugugcauacacacaugcacgcacacgcgugcacacacaccauauauuaaauaaauagauauuuuaaaaauuuaaaacugcagacuguaaaaguaacuuuuauuugccugugauaauugucaucugaggcuuacagccucugucugcuaaccuaggccuaguucuggaagcuucuagccucaucuaggccuagaacuguuuucagccucugagauuuacugcugacuaagcucagccuuucuuguuuuuuucuguacucuggcuagcugguugaacucagauguucuggcucaaacuucucuccacacucucuuagcuucugucagcuucuccugaacugcuuugcuuggccucaaacuaacucuggcaaucuguucuaaucuccuggcuccuucucauucucuggcucauucugcuuuccgcuuuccgcugugucuagcuuguucucucucucaaauuguuucucuauaacuguccugguacuacugcugucuucuuccucugugcacugcucucuuaagaagcuucccuuuccucucuucaugagaguugggcauauccuauucugucaaaucuuucucucauuagucacuugucugccacucaauuagaugucacuuucaaacauaagugcuuccuucuacaaacuaacuuuaacuucauuauucgggauuacagauguguacuuagcauguaucuguauucuagccagaugauuaaaggugugugcgaagagcugagccacaccacaacuagaaauaggguuucucaguaaaucucaggguuugcagugugaucaaauauccugcaagagaagacuggagaggucauagguccaaggcaccugucuaguuaccuucuacauauuuauguuuaugcccauagauuagugcugcugucaacuuuggucagcaaagcuucuuuuugcaguagguaaugauuacugcagaaacucauaccugguugaaaugcugaaaauagagucuuaauguuggaggcucaguccuaaauggaccgucuaagccauccaauuuaauguggaggaaacaugcccaaaagagaggguaagacuauaagagcugaaggaaggguuggaggagauuagaacacuuuucuggucaugauuuagacccuuaaccauucugucaugaagggggaagggacucaugagaccucauccuuucuuguggagcuguaggcaguuaaugguugcugagagggaaggagggagggagggaaggagggagggagagagagagagagagagagagagagagagagagagagagagagagagccuuucuucagugguaacuugcccauacucuuaugcucuuguaauuaaccccuaaugcacaccacuggaagcaacucugggaagagagagaagaucaguggaagcaggagggggacaagauacaguaaugaggaugaauaugaccaaaacacauuaaguacauguaugaaaaugucacaaugaaaucuauauaauuaaacaaaauguuugucaauaaaguuaaaauuuuguuguugugugcacuauuguuuuuccugcauuuauaccucugcaccaugagcaugccugguguuuguggaagccauaagaggguguugaauuuccugaaacuggaguuauugaugguuaugaaccaccaugcagguucugggaaucaaacccaggucaucuggaguagcagucagugcucccaaccaaccacugagccaucucuccagccucccacacccaauaaauguaaaaagaagacuuuuauauuuuaaauaauacaacuccauugaaggucugguaaacugcuuuaaauuucaguugggauacaucuuguguuucucuagucacuggcuccugugguuuucuccgagaucuuucuuuaaaauaaaagauuaccauuggagccgggcgugguggcgcaggccuuugaucccagcacuugggaggcagaggcaggcagauuucugaguuugaggcuagccuggucuacagagugauagcucagugguuaagagcacugacuacucuuccagagaucaugaguucaaaugguggcucacaaccaucuguaaugagaucugaugcccuuuucuggugugucugaagauagcuacaggguacuuaucuauaauaaauaaauaaaaucuacaacaacaacaacaacacccccaacaaaacagguggagagauaaagcaguuaagagugcuggcugcuauauuguaaucauuugaaacuagaccagucccaucauaugcuuuaugaaaaccugaugugccuuuguccccugaacacugggauucauuucugcuuggauagcacuuaguguuuauuguuuauuccuucagcuauugagcucugacaccuagauauauugucugcuccuuagucauaaucucuugcauuccuagagcauuuaaaguuaauauuucauuuuuuauuuucugauauugugauauuaauauuuuagcauuauagaagucacacuugauuuguuaagauggguauguaaaauaauaaacagaaaacaaaguuuaaaaaaaaagagugcuggcugcuguuccagaguacuuggguucuauuguacucauuggagucauggcagcuuacaaccaucuguaaugccagauccaaagccgccuucuggccucugcagaaacaaggcacaaaugaggugcacagacauauauucgggcaaagcacuaguacacauaaaguaaagauauauaaaccuuaaaauaaauaaacuagaggugcuaaacuaggggcgggagcgguggcucagugguuaagagcacugguugcuuuuccagaggacccugguucaauucccagcacacauauggcagcuggcagugacuucaguuccaagggauuuggcacccucauacagacguauaugcgggcaaaacaccaaugugcauaaaaaaagcuuaaaaaacacaauuuaagaaacaaagaagcaacgggacuggaggauauagcucagugauagaaggccugucaaguauuuacaacacccuauauuuaauccccacuacaucagaaaaaaaaaaaaaaaaaaaaaaagcuucuacuucauuagguucugaauacagcccguaaaaccaaaauauuuaccaguauaucuaagaucuagguuauauuauaauguauagucaguccuuuauuaugucgaguuuuacauauacucauaaauauucaugaacaagagagccggcucucaguauguaaaaguuugccgcuaagccugaagaccugaguugcuuguuuugagguccacuaaguggaagcaacagaauccugaaagucacauacaagcgugggaaggggaggggacgcggaggggggcgcgcgcuccggaggcgccaauaaaucaaaacaauauugacgacuguauagaaauaaaaguauuucaaauaacacggaaggugucgauaucuaaagcugucucagcugacugagcuucugucaacucagcacccucccccgccucucccugcaauuuagcgggaugggacguuccggaaguuaaucaauccggugucaacacgugaucaaguggagaaacggucuggcgcgagugucugugacgccaucucggcgcgacucuucauuuucugggaguuuucuggcugcucugccggagcuaugccgaaagucgugucgcggucgguggucugcucagacacccgggaccgcgaggaauaugaugauggcgagaagccccuccaugucuacuacuguuuauguggccagaugguccuggugcugggugaguggcgggaaguggcggcugcaaggaaacaucgggcuucuuuuuucuuucuuuuucaaucuuucuccccgcccccccccccccuuuuccuuuucuccuuugagacaagaucucacaaaguagcucgaucuugaacucauuauguagccuagauuguccccgaacuuguugguaauucuccuuccaggagugcauuaccacucuuaaguucaggguauuuuuuuuuuagugacuaagcgaggaaauuuuucuccauuccuucagauugccaguuagagaaauugcccaugaggccccgggaccggucucgcgugaucgaugcugccaaacaugcucacaaguuuuguaacacagaagaugaggagacuacuuaucuucggagguaagggcuuaaugcucuaguucacuguuggguugcggucucuuuacgaggaauguaaauuacccuaugcuaguguuaagcagcucauacaguuaggccugauacuuugacguuugugcuaaucuccuaacuuauuuuaauucaacaaauucuuuauuguacuuuguugaaaugguacugaaaugugccucucuuggcauuugauggcuaugauguuccaguuacaggcuugaaugaguuaguacaaccuguaacuucugcuguuguuaucaauauuauuuccagggcuggggauggaacaagggccuuacucuuguuuagugggcacucuccuacaguuacaucugcagccuuaugacugucaugugucagguacugagcuagguaccaaaucugugaauaaggcacaguccuuuuaaaagaaaucaguuuggaaacaggcuucuucuuaugauagaaagaaaugcuggugcugugaacaaaggcuaugggaaaacaggugggagaagguuauuuauuuuacauguguuguggucaggaaaagaucugaacgauagugguguuugugcuuggcuugaacgaagacuucacuaguucuuggaagacgaugcggaaacaguccagguagagggaaucuggaagcauuaugagcaucaaauaugucuaugggacauuucaguagucuucuguggccagagcauggcuuacuguuuuauagaaaaggcuucauaaguacuguggugaggagagugaaaugcuuuaucugaaggcaaugaaaagcuauuuccuuguguguguguguuuugauauguuccugugagugcaggugccuguagaggugaagagaagauguuugauuccccuggagcugaaguuccuggugguacuugucaaccaccuaaagacccugggaaccaaacuugggucuucuaaaaaaacaauauacucuuagucaccucaccgagccaucucuccagccccuuauuuccauuuuguaaggagggaguaacauaguuagauguauauguuuccaaguugaggaauccuugauguauaugguaauucaaaguuacauaaaaugaauguagagcaaaguauaaggcuauagcucaguugguacaguauuugcaaucacugauacuacauauagcuggaaugguaauauaauauacccuuguacccuuguaaucccagcucuagggagauagggcaggaggauuaaacguuuauauauauauauauauauauauauauauauauauauauauauauauauauauagacccuuuucauacauacaagauaaaacagaugagaaagagaaaggagugaagauuuacaaaguagacaaaaaaauugggacagaaccaggagaaccuaauaaugcagagaauaagaaaggaaagaaggguuggagagauggcucugcaguuaacagcacuggcugcucuuccagagguccuagguucaguuuccagcauuuacaugguggcucacaaccaucucuaacuccaggucuaggggaucugaugccaucuucucauucucaggaauaaaggccacucauuucuuuagccaauacuucauuuucugagcuccuuuauaugcugagcacugucuuagucacuugaauacacugguauauuaacaugcuaaaucugcuauaguaaaauaacacaaccuggguagcauuaaguaacaaacaaacaaaaaaugaacaggcucagauuuggaggcugaagucugaaaauugucagcagagcuauguucuugcugucuuuuuuuuuuuuuuuuuuuuuugguuuuuugagacagggucuguguagcccuggcuguccuggagcucacucuguaggccucugccaccacacccagcuccuguuuuugcugucuuacuccuuccuacuaccuaucaccucccggggaguggagagaugggggaggucuuacuauguagaccaggcuguccuggagcucauugaggucugccugccuuugcuuccuaaauucugggauuaaaaccaugugccaucaggccuggcagguuuuuguuuauuucuuuuaacuuuugugugugugggggggggggggcggggguagggauaagacaugauggggcugccauagccugccuguggaggucagaggacagcuuuugguaguuuucuucccagggauagaacuugggucauggaaauugguguuagaugcuuuguucucugaacuaccucucuuuuuucugaaauuucuucucccccugcuauccuuagugcuccuuggcuuauccaugcaucugccauuaucugcccgugucaucauguggcuuuuuuucugugccuuuuaauuuuuagaaaguugauuuucuguauaagauuuuuugccugcauauauguuuguauaccaucugugugccuugugcccaucgaggccagaacaggaaucccuuggaccuggaguugcagaugguuguggguugccaugugguugcugggaauugaacuugggaccucuggaaaugcagccaaugcucuuaaccuccgagccaucucuccagucccugcccucuuauuuuaacuuucuguuguuguuuuguuuaguuuugcuuugacagucuuucauguagcacagagccuugagugggauacuuaguggaaguguccugaccuccugcuuauacuucccaagugcucacauuacaugugucauuuuguccuagguuuuuaucucccccccccauuaucuagacuacugcuuuugaaaaucaucaacuauuuuuaggaucauuguaauaagcacauauauuuuuuaaaaguucucuauuuuaauaguauuuguaauggcuauuccugguugucaauuugauuauacguagaaugaacuacaauccagaauuggaggguucacaugugauccagaucuugagguuggaagacacagacuuuugacccagaucuugacguggagaucuugagccauaguggccaugaagagguuagguccaggcaaaguaguacaggccuuuaauccugggaaacugaggcaaggagauaucugaguucaaggucagccugaggcaaagcaagucccagaucuaggcauggugguacaaaucuuuaauaugguccauaccugcuauuagagaccuacauaaggacauuggaagaaggaagauucaccccuucuucaacugcuugcauuuacuugccagcacaucuguuagaaccuacuucuacagaagaccagcugaaacaacuagccucaugggacuaagcaacuacuagauucuuggaguucccauucauagcugcccauuguuggguuaguuggacugcagauuguaagucaucacaauaaauucccucaauauaaagagacaucccauaaguucugugacucuagagaacccuaauacaguauuauauauuaauauguauuauucuguuaguacagaaaguaauuucauacaacuacgcuucaguuuccuguaucauuuggcuagucaagaaaacuacugggugacccuagguugaaguagaaaugcugaaauccaaucagacuucccuuuagggcaaaucagccuuagaccuagccuuacuuaguggcaaguagugucuuauuuauuggcaguuccuacgccaggaacuuuuggccaagcuuucagaguucuuagcacugaccaacaagcaaguguucuccccuuugacauaguucaugcucuaguacugagcagcuuuuccaaggacacgcugugcccuuuuguuggccaaagcaggguucuagucuguucuuacugugucucuuuuguuuuuguuuuuguucuuugagacaggauuucacugugcagcccaagcuggccuucagccggacccuucugcuucagccuccuaugagcuggccuuagaggcaaaugccaccacacccacuuaugccuuucuuuuucauucuguaacuucuaaauugucuaguuuguuggcauauaauuguucauagaauaaccuuuuauuuauuuauuuauuuauuuauuuuagaauaaccuuuuuaugucuauacuguugguacaaaacccuggaguuugagguccugaugacauuagacuaauucuuuguacauaguaaucccaugaauacuaugcauauauaaaguauuuccuuuggaugaaauuccauuuucuuuuuuuuuuuucaauuuuuuauuagauauuuuccuuauuuacauuucaaaugcuauccugaaaguccccuauacccuccccccacccugcuccucuacccauucacucccacuucuuggcccuggcauuccccuguacuggggcauauaaaguuuacaagaccaagggaucucucuucccaaugauggccgacuaggccaucuucugcuacauaugcagcuagagacacgagcucuggggggaagucccauuuucuaucaggacucuggcaggagcaucaccucuucaugaaguuucugugacucccucaaauaugaauaccaccucuggugccauuacagauuccuccauuuaagaacuugauaucauuagccagaugugauggcuuaagacugucauccuaguauauggaagucugaagcuguggaggauugcuugaguuuaaggucauccugggcugcauaggcaaacuccagaucuuccuaggggacuucaauaagaucuuaacucagaaaaagcuuccuugaaauauaaguuuaguuuucuuauagaagguaaauucuuccaaauucauucaguguuuauuauaaaucuucuguaugucuagcauuuuaaauuuuauaucugugguauuuugucugcauguauauuuguuuaccacaugugcaccuuguaccugagagacaagaaggcacuggacaccuggaacuggaguuacagauaguuguuaacuaccauguggguucugggaauuaaaccuagaucgucuggaagagcagccagugcuuuuaacuaacugcugagcccucucuccagcccuauauguagugcuucgcucagcccuggcgcgggauaaggcagacucugucucuucuaaggggaauggaugaugaagauugcauagaaaaaucaaggacugaugauuauuagaagccauaugaaugaaacaaagauuugguagagaaagucacgugagaacugcuuagugaaaguggucagggaaaggccucugauuaaguuauguaugcaguagcaucaaaguagaugaagagagcagccacagcagcgcggugagcaaaacauucuaggcagagggaggaaugugugcaaacgguugccugccggaaagcacauguucuuuucaaaggaccgagacagaaggaagacugauuuggccaguguguauaaaagggagacaauguagaaguugccgcagaagccaguuauguucuuccgugguggcugguaagccauggcagagaaucuggaauugacucuguaaagggaagccacuucugccucguuuuccauagugauuugggagaagaaacuaaugggagcagauuuuagaauaugagguuggaaguuuuuauuucagauaggaauucagauugagacaguccuagcuuuguuauaacguacauggcagagggcaagggcaagagagacauugacucuguauugacuauagggaaaaaaaaucucaaauuuccacaugcucaaaacaaaacaagaaucgaagacagaucacaaacuaagaaagaaauacuugugaagcccauuaauagugcaagucuucuuaauguaaaagaaaaacgugacugaaaauauauaagcuaaugguucaccaaaacaaacaaacaaacaaacaaacaaacaaaugucugucauacuggggcuaaaauguauagcuucaguuuaaaaccaagaaaugcaaacugggagguucuguuuucuuugcuucugagauguaucuagcuauguuagugaaaauguguguauuaauggguguguguguguguguguguguguguguguguguguguguguguggcacgcacaugaauacaugcacguaugugcacauguauagucuagagcugaauguuggggugucuuccucugucagucugcaguguauucccugaagacaguaucucgcugaacuagagcuuugccauuucaacuaggcuggcuggccagugaucucucaggaucagccuaccuugauccccauaucccugggguuacaguauauauagccaugccugacuuuuuauguggcugcugaggcuuuuaccuuugguccuuguucuagcagagcaagcacucuuagucauugaguccccuccccagccucugacacaaccuuugucuuuuuuuuuuuuuacccaugguugguagaauccauagauucaggacccauagauuauauacugauuauaugacugguugcuguuauacuauaguuaauauuguugcuacuauaagucuagucacucuugugacuguuuauauugucacucuuuugucugcucaguuagcaugguaccugaccccauuaguugcucaguaccuguuugggaaagaaggaaugcaugcuagaguuaucuguuuaauaaaugcuuagccagccaguagaucuacacaaugaagagcgucugagcuuuuggcaugaauucugguaagugaugaauaagcagaagaaaucagcuagggggugaaucaguagugagauacacucuuaacuuuuccuguuaacauccauuuucugugcaggccugagggcauugaacgucaguacaggaagaagugugcaaaguaaguaacagcaguguggggcuugcugguccuagguaagucgaagcaugauguguuagaaaaagaagucucucuuuuugcaucgauaaucucaaaggccuucaaaccaaaugcuaauuuguuucccaaagaugcuaguuaaaucccaucccugaccagcugauuauaaaagugagaacaaugacagcuuuuuuuuguucuuugggggcagggucuugauaugcaguucaggcuaggcuggagcuucugaucaaucauuugccucccaacuacugggacucuaggcgugaacccccacggcaggcagaaacgugaggugacuucuuucuuuucuuuccagacaggguuucuuuguauagcccuggcaguccuggaacucacucugggcuuaaaagcaaacaauucgagagaguaagauuaaauaugucugcaauaaaauuuacccauuuaaguauucaauuugauggguuuugacagaaaaacuccaguuaaauagugccaccaccaucgugauagaagccauuuccagcaguccacauguccuuugcagccugucuccuccguuuacccuucccugguaguugcugcuuuguaucccugugcucuugccuuuccuaauguuuuaggaaaaucuauaguaaauucucuauuacauacaaaugcaugccuuuuauaccuagucugucuuucucuuuccuguuuccuguuccuguuucccucuccuucucccacucucugcuggccugccuaccuuucugcaugccggccugcccucccugccugccugccugccugccugccugccugccugccugccugccugccugccugccuuccuuccuuccuuccuuccuuccuuccuuccuuccuuccuuccuuccuuccuuccuuccauacauguggggaucuaaagccaacuugcagacaguucucaccuuuuccauguggguguuggggaucaaacucagguugucaggauuggcaauaggcuccuuuaacuacucagccucucacuggccucuauaccuaguuuuucuguuugguguuuuagggauugaucaaaauugcuaugagauuauuuguuucucuuuagugcugaguaucccauccuaucaguucauuuacuuauucacaguacucuuuauuuuugaguauucuaugguaucaguuuguuuaugaauuugaguuacuucuaguuuuagcuauugccaguaacauugcucugaguauucuagauaggucuuauugugggagauauauauguauguaugaaguagaauuggcugggucauaauggaaaauggacaauguaauuuaguuccagguucauguauacaauguaauauguagacccuaaagcuaagaaucuuaaaggauguuuuuuaaaacaaaauuuacaguuuuaggcuauuaguaguaagacucucagugauuucaguuguuguuguuguuuugaguagggguaguucaggcugucuuagaacuuacuaugaagaccaggcuggccuugagcucacagaaauccaccugccaaugccuccugaguacuaguuuuguggggugguuuuuuggggggguucaagacaggguuucucuguauagcccugcugacuguccuggaacucacuuuguagaccaggcuggccucgaacucagaaauccgucugccucccaagugcugggauuaaaggugugcgccaccaccacccgacgccuccugaguacuaguauuaaaggccagccacuaugccuagcaguugaguuuaaucuugguguaaggauaauuguguguuggcucuuagaagacucagagcaggagcacugaaugaggcagaggaaaauaaguugaagacaggaaggcauuugaguagcuagccacacuacucaauggauggaugaagcuaauuuuuaucauaucuuauaggucuacuuuuuagcucagaaagcauaauggucagccagagaaagugguacuuguacaagauuugauuugccaaacacugcagugauaccuguccauuucucuugaugcuguaaaaugaaauagcaaaggggacagaaugcccgaaccaguguuaaagcgccugggaagaaugguagcaguuuuuuacuauaaggccaauagcagcauuagcuagcauuucccaaacuuuguuuaaugucaguauauacaugugaugcagaugaaaauagccgagucucuggccucacucaucccugcauuugccaaaccagaauauucugguugagaccuaggaaucugaucagaaauuucaacaugcacccuaauuaauucuuaucaaguucuuuuggggaaaauugaacauuuuaugccacaaaccaaacucuucucagaaucugagucuacuuuugcaagcguuaaggauggagaauuagaggccucccagagauucacucugccauuugcagguguggacugccgcucuucuaccaaucccagccgaagaaugcuccugugaccuucauuguggauggagcaguagugaaauuuggccaaggcuuugggaaaaccaauauauauacucagaaacaagagccuccuaagaagguaauuaucaucaaaggacacagauggcuuaagauggcaacacauuuagccccaaauuuacuuagugcuggggaucgaguccaggacuuuugcaugucaggcaagcaucacugaccuguagcaaugccugccuccccgacuuuuuaaaauacgguauaauaccugagaaacuugcauuuguugaugaaauauuuaugaagaaguugccauuguccuguacaaguagauguuauaggacuguggcauuuauuauuugcuuuacauauaguaguuucguaaccuuagacauuguagaauuuuuauuuuccuuuucaguuuuucuuuucuuuuuagauugggaacaacuaaauccucaaugaauuagacugguuuuuaaauauacguuuuaaaaccguuaauagugggcuggagagauggcucagccauuaaaggcuaggcucacaacuaaaaauauuuaaguuugguuccuagcauccauggcugucucuucagccaccuuuuacaugaugguggugauggugguggugguggcaguggcucaugccuuuaauccuagcacuccagagauagaggcaggcagaucuuugauuuucacaccagccuggucuacagagugugucccaggccaggccagccaggacuacacagagaaacugucuuggaaaucaaaaaaaaaaaaaagagccaaaaaccucaauagcaaauacuucauaacacuaccauguagauagucagccuguccccaagaggcagguauucccaugcccuuucuguaggcagacaugcacauaaaguacuuguguacguggcucauggauccuucugcggugaacuuagcuugaugccucuuccuacuguucuagguuaugaugaccaaaaggacuaaagacaugggcaaguucagcucuguuacugugucuaccauugaugaagaagaagaggagauagaggcuguaaguguuucugcuuucaggaaaauugaaaugggggaggggagcaagagccugugcagagcgagcagaacaguuggcaaccuaguuuucacacucugcucugcuauuaagcagcucuaugcuauugagcuagugccugucucccugaaugggaggaacagcuauaaaaugagaacaaggaaccuggauccucucaucacuuuuuaauuuuaaagccacugaacuggauucaggacuauaauuccaguacucuggaggcuuaggcaggagggucucaaauucaggaucuccauagcaagauucuaucuucaaaacaaauaaaaaaucaaugagauagcgcacugaauaguuuucagucccucccagccuggcucuaaugguuugaguacguccuuaauaccagcaguugcuuuucugcuauuucagucaagugguuuucacugaggguucuuagcaaaugauccccauggaaaccugaacuuuccugggucguagagaagaugaggaguuacagucgugcacuugaguaguauaaauaccuacugaggucuuuguuguggucccugagaagugcaucggucugccuuguuuccuacagagggaaguugcugacucuuacgcgcagaaugccaaagugauugaaaagcagcuggagcgcaaaggcaugagcaagaggaggcugcaggaguugguaaguggcguggggaggaagggcccaggucuaccugccuuggguuucguacuuugaaugauuugcaggagcuguugugaauuucuaguauaguuggcugccagcguucucaccccgggcugacuguguuuguaaacucugcucuacaauaguggcuggagcccaaagccugaauuagaaaucugauuugaugggccuaacugggauacuguuuuacucugcugcuugugcucuaaagucaggagauaggagccagguuuuuagugcucuccagugugaugguguccaguugugcuaccucgguauaccugaauuggagcugcuaucacugcuuuuaaagcccugcuaguuuucugccuuauccaggggauuaacuuagagcucagcaccucuauguagguugggaccuccauuguuuugcuuuuuuaaugcuuaauugaauuuguucucugauaauuucagguauguauguauguauguauauaaagucuacauucugguuuuuugguuugguuugguuugguuuugguuuuucgagacagaauuucucuguauagcccuggcuguccuggaacucacucuguugaccaggcuggccucgaacucagaaaucaaccugccucugccucccaagugcugggaugaaaggcaugggccuccucugccugcugauguagucuacauucugacugcccuuacccauucccucuuaucucucucccacuccuguccauuacuaauuuauuugauuuuuuuuggauaacauuuuuuuuagauaauaauaauugcuuauuucauuaaucucagacauacugcauuggugcuuaaucaaauucuauauaaaugucuuuuuaauuuuuuauacuagcauauaaaguaacagguuucauuauggcaguuuuguaauuaugucucauuaucuuuguucucauucuuucccuccuccuucccggacuccuugcccacucugguuggucuccuucuuccacauugucuccucugcuuuauuuuguuugaucuuucucucccucccuuccucccuccuuccccucccccuuccuccuuccucccuuccucccucucuuucuuuugaagacaggauuuguccaggcugacuucagacuugcuauguugccaaagcuggcuuugaacucuugauccuccugccgccagcgcccuaguccugugauuacaggacacacucugcuuccucuuuugcuuucucaucacauguauuccauuaguccuuuucccccuucaugaccuucuuucuagacucaugcccuacacgcauacacauaggauuuuaaaucuagguuuuaggagccaggcuuuaaguugaugaguaaggauucuaaaaccauuuuuggcauguacacugagcaggaagggagcgugaacaguuagaguaaacaagaaauguuaagagugucaugugauugugauauaucagggccuacuuuuuuuucuuuccaggcugaauuggaagccaagaaagcaaaaaugaaggggacccugaucgacaaucaguucaaauaaucaagaucuuucuggguucagacuggaggcagcaguuagaugaggaagaguagcuucaagauguguuuucguuucuguuucucccagaaggguuuucugaccauccuauugguuuucugacacuuuuucuuuucuuccauugaaguccuugacuccauuucacuugcuuucuaggagguagauuguuuguaaaaucucuguauauauguuuucugucuuucuugucuuugagaucaggucuuguuacauaccagaguauggccuugaacuuugugagccuccucuccugucuuagucucucucucucucucucucucucucucucucucucucugcugaaguuccaggaccacaccaccacaccuggcuucuguagcaguccucuuuucuuuugacguauacuucuuuugcaauguagcuaguacuaguaagcauuugacuuucucuagugucugacauagaugucuuuucuucuucaaaguuauugcaguuuuuaaagguuuuuuuuguuguuuuuuuuuuuaaauaugguaugagaggaaggugaccaaaauuaaguuuaaaauacagccagguagauccuuuuaagaaacacugucucugaucuuugaacuguucuuagaauugacuauggucuaugguuugaaucuuucuccuaucaguagagaucaguuagaaacaccaaaccugcagaaauacuuccuuacucaaaaucuuagaauucuaggugaaccaugcuaugucagacuucagaauaaaagaaggaaaagccauguggcuggggguguagcucaguaguggaaugcaugcuaggcaugugugaggacagccccagcaccaaaacaaaaaacaaacaaacaggaaagccagaucacagaugcagggcuaggauggcucaggucggauuuaaauauggccuugcuaaguaacccaaaggaguuagucagucagcugggagaauacucuaugaguacacagaagggggcauagugagaggagcuuaucuguuguugggcaucuuguuuuauguuugcucuuugcugaagagcgucugaaaugugucauucuccuucaauuaugucagcauccaugugauucuuccauauaguucucuguuugccugucuugcaaggcccaaggagacacugaauguguugucuuccucgugcuaucuaugauggauugcacuuuuuaaauacucaaggcuuguuggugagguguugccaggaaauaguuuucuucgccuuuuuucugauuucuguuucugcgggggaaagccacuuagaggagagguacaguugagcuagcaaugacuggacugauguggguuagcgauccugggaauuggaagaauggggcuauguuaccaccuucccaguuauucuguagacagcagggucuuccuauagcuaagucuucaccucauuuucuguccuaguugugagacagaauuaaaauuaacauuugugaauggucaaauauguccaggcaaugaccucuaccuuuccgccacuuuauccccaaauucuuauguguacagcuuggauauacacagaccaccauagaaauucaggcuucuauucucuggccacagccuguagcuguuucuagucucacaagcucccauccuuuuagaccuuuuuaggugugacuuucgauuugaggggugauuauuuugcuaauaauaaugaaacauaauugucguaacaguaacauuaauacucauuagucuccauugaguacuugguuggagaaagcacuuuagagguaugagcucacgcuuagcaccuccuaggagauaaguuaacuguugccaucacuguuuuacaaagcacucggaaacucggaauuuuccuuucccaagauccacuagccuuugguaaagccagaagacugacuugaaaacucaagcucuuuccuaugcugaacugcugcuucuauggaauuuuguaucauucgauuagaacauaauuucauuuugaaaaaaaaaaaaaaaaccacugaauugcaauguaaaaauauuaagcuagagaacucccuaaagcaauucuguaguuaugcuuguacauauuuuaugaaauaacucgcucuaaccauuugaauaucugacacaaguuacacauuuuacugcuucuaacaauaaugaaauauuacgucauuaguagcaaguaaguacauacuucucauuauauuuuacuuucuaccagaaguuauuagaacaagauguacuuucucuauucuuuauuaacuuccagugauuuuuuuuuagcaaauguguuuuaauauuaauaaaaagagccauauugacauuugggaaagucauaagucugcaagugaucagcugugagaaaauuaugaaaauguuauaaaauauucuuacucuaauaguuggugacauuuggcauuguaacuaucacuuaagaaaaauuaaaaggcuuuuuaaaagcuaaccuguuuuguugggggugcugacauguaugaauaguucugagugucauaccaagcaaaacucucuucaaaaugaaauaaaauaaauaacagaauggaaugaacuaaacuagcuuguuuugaucauuuuaagauucauauugcugugaaccauauuuccuuagucuccugauuuguguguuucuuauagguaucaacugacuuucauuucaauuccuaaugacagaugauguugaacauacuacuuuuauuacaguuuuuuuuaaagguuauuaucuuaggcauauuuuuguuuugagguggggucccguguagcuacuggcucuuaauuuucauuuuaguuuuuugaaauggaaucucacagugcccaggcugacuucagauucucugccugccugaguuugacggugaauuccagaucuucugucucuaccuccugaaugcugggauuccauacuuaguggguuuuaguuuuaaugggguguuuuuaggaucuuuuaaguauuuuaugugaaugagcauuuugccugcauauauguauguguguugcacaugugccuggugccuacaaaggucagaagaaggcauugagaucccuggaauuggagcuauggguggguacugggaauggaaagcaaaugugcuuuuaacacuaaacaaucucucuagcuccuaucuuuaguuuuuggaaacaggaaaguauuuucuuucuuuuuuuaaaaaaaaaaaagauuuauuuauuuauuauauguaaggacacauaauaauaaagacacaccagaagagagcaucagaucucauuauggaugguugugagccaccauaugguugcuggggauugaacucaggaccuccagaagagcagucagugcucuuaaccacugagccaucucuccagcuccagaagguauuuucaaugcacccuagaccuaaugacugugggauuuuuagaggguuuuuuguuuguuuuuggguuuuuuuucugcuagcaaaaauugaauguaguaucuaguaucugcuggucaagcucuaccacugagcuauauuccccagcaaugacuuugaacccuccugccugcugcuacuauagacuugggcuacuguccaguuucucuauuauuauuauuauuguuauuugugugagauggggucucacuauggagcucugguuguccugaaacuuacuauguagacuagaauggccucaaacucagagacccaccagccuccuaggauuaaagccaugugccaccaugccugacccucgaacccauuuuuaauuacucaguucaguaguauucauuugcauccuugugacacacaucuguagaacuuuccaucuucuaaaucugaaaccaugcauacauugaccacuccuuucuuugugucucugaaugccugguaacugcugcuguucuuucugcuuuuaugaguuugucuccuuuagauaaugaaugugaauggaagcaguauagcacuuuucuuuuugugaugggcuuacuucacacgguacgaguccuugguguuuauucaugugugugauaaaacgccuucccuuuuaaggugaguaauaauucccuagcacauguaccacacuuuuuuuauucauuuguugucagucgacuauuaggauaauguugcagugaacaugggcaugcaaaaauauauuuccgccgggcagugguggcacaugccuuuaaucccagcacuugggaagcagaggcaggcagauuucugaguuugaggccagccuagucuacaaagugaguuccaagacagcuaggacuacacagagaaacccugucucgaaaaaaaacaaaaaaaaaacaaaaaaaaaaccaaauuuuauauauauauguauuuccuaguauuucugacaucuuagauucaguuuauuuggauaaguucagaaguaagaugucucuagaguuuugggguuuguuuuuguagugggcauugaaucuuggguccuccacaugcuaucuaaguacucuaucacugaaauguguccuuggggcuuaaauuuugagacagggucuugcuagauuuuccaggcuagccuugggccaacucuguagcccaggcagacccugcuuuuuuauuuauuuauuuauuuauuuauuuauuuauuuauuuauuugccuaacaaggauugcagacuccccuuaccgggccugccuacuuguaauuuuuccaggagguuccauucuguguuccuuggcuguuguacuguuucacaaucuuuuacaaucacaaacuguaugcaaagggucaaauuucucuaugcccuuauugaaauuucauuguauuuuacugcauuucuuugaugaugggugaugucaacugucuuuucauauggccuuucauauaccuuuagagaacuguuuauuuauccaagaccgggguggggggguugguuuuguuuuggauugguuugguuuuuugagacgguuucucuguguagcccuggcuguccuggaacucacucuagaccgggcuggccucgaacucagaaauccgccugccucugccucccgagugcuggaauuaaaggcgugcgccaccacugcccagcuguuuguuugcuuuuuacuacauauauuuauauguuaaaauuucaucuguguaucuccuauaaagucuguauuuaacucuucuacccauuuauaaaccuccuuuuuggagguaguagcuuuuuuaaaaaaaugauuauuaagagaucuuuguaucgucugccucuaaguccauauagacguaugauguacaaucucuccuggucugguuuguguuuucauuuuuuuuuuuacaaaugauuucucuuuacccuuauuuguguguaugugugcauguguggcuacuugcaugggggugccuguggaagccaaaagagggcauuggaacccuggaacuaggguuucagaugauugugagccucgucuguauaggugcuggcaacugaacauggguccucagcaagagcaagugagccacugcucacuugccacugagccaucuccccagcaucuguagugccucucuucacucauuuauaaauacccucuguacuccaagaaguuuucuuuugacauuuacacuuguagucuguuuugaaguaguuccuguauuauacauaaauuuugggucaguuuacuuuuaacacacagaugucuaguuguuuugauaccuaauuagugacaagacuauuuuuccuucaucuauucuuguauagcuuugucaaaaaucaguucaugucugggugugguggcacauaccuugaauuucagcacucagaaaagcaagggcacuuuguaucccugggagucagaggccagccugguuacauagcaaguuguaggccaaccaggggcuauauaaacaagacuguaucucaaaaaaaaaaaagcagagucagcuuauuguacauccauugucauuuuacccacacagaacuuuuccuuuuuccuuuuuaaucaugagucucaauugacacaguacacucugccauugagcauuacccuccagcucuuuguuaguuuugucuguuuaguuuuguuaaguuucccaggcuggcuaugaacuuaggggcucaugugauccuccugccucagcuuuccaaguaaccauaacccuaagcaugugccacucugccuggcuauauagaaugccuugauuuggugauuguaacuuuaugguuaguuuuacugcugggucaugauucuuccaaccuuguuuuguuuuggaguuauuugacuauucugaauuuuugucuuuuccaauauuuuaaaaucagcuuguugauagguucaguauucuuucuaggauuugagggauuuuguaaaaucuaaagaucauuuuaguguuuuucaacucuacuuuggcucgcaagagcuucacggaaggacguccuccagguaagagcgccuuucucuuuggacuugcaggagccacagagaagcagcuggcaggaugcaaaugaaacaguguucuaggcaagagggcaaaagagaccucuuggguuuggaggggcucaagaaaaagguagacuagcuugguaggaugacacagauaaaaagagauuucuaaagagcuaaccuagcuucuuuauuguagaaucagucuugaaaauaagauaucuuagccaggggugguggcgaacgccuuugaucccagcacuugggagacagaggcaggcggauuucugaguucgaggccagccuggucuacaaagugaguuccaggacagccagggcuauacagagaaacccugucuugaaaaacauacauacauacauacauacauacauacauacauacauacauaaauagagaaagaaaaugagauauuuugcauauaguuaagagaauaaaguuaccuugcugaguuagcagauuugaccuaaaaaaaucauuuuaaggagaauugacauuuauuuagguauuuuagguauuuaguucuuuucauuaguguuuuauaauuuuucauguacagauccuguagauaauuuaaaauguauacuuggcuacuaaauuuuuuucuggugcuguuauaaauguaaccuuuuuucucuuuuguaaaauuaaguuuuuucuaauuuucuaaguuuauguguguguguguguacacacagagacauaugugaaaguguuuugcuugcaaauaugcauaugcaccacaugcaugccuggugcccaaggaggcuagaagaggguguuggguccccagauagcugugagccaucauaagggugcugggaauggaaccaagguccucugcaggagcagcaugugauccuugccaaugagccaccccuccagcccaauucuguuucuguuuucguuuuuuaaaucauggagcccuggcugacguccaagucauuggcuagccagggagagaccuugaaagcccugcucugccugucaccaccuccaaggguugggauuacaggcuugcaccaucacaccuggcuuuuuguuuguguuucuuaaaaaagucuccauaauuuguuuuuguagagauuccccauuucuuuuccguugcccugcuccuccugugccaccccacucccagcugucccuuuugcuuuuaugucacauguauucuguuacacugcccacuuccucaaaaccuuuuccccuccaacggucccuuuucuaguuucaugaccuauacccauauauaucaaagguagguuccacauaugaaagagaauaugugguauuugucuuuucuguuuuucugaaucuggacuaugucacagcaugcauccuacaaacucucaauuuagaaucagucauacagucugccuucugugaucuuauauccugagaguugaauggcuauaucuuguaaaugaauggaggcugaggccaugaauguauggcucuugugucagauaagaucacaccacagacagucagguguucagcucaaucagauuaaauuagggcccuuuacuuccaaucuucugauuuuuucccugcacgcaaccccucuggcagaugacuuccaucuccaaagcacuaagagaguaaaggaauauacucagaugcuucuguccuccuggcuuugcagucuucagggggaaagaugccugucugucuucucguuuaagacuaguccacuaccuuucagucauugagcucuuggugugugugcugugugcuguuggagcagaggacauaguggugaagaaagucccauuuuaaaagcaaagugacaggaacucccaaccaugaaaaugugaguuuaagggcuugccaaacuggccaauuuuuguucaauucccgggaccccuguuggguagaggguacugaaaacuguccucugaccuccacaugugugaccuccacaguuguguaaacacacacaugaauaauaauuuucuugaaagaaauaaagaaaaauuuaggggggcuggugagauggcucagcgauuaugagcacugacugcuuuuccaaaggucaguggcucacaaccaucuguaaugagaucugacgcccucuucuggugugucugaagacagcuacaguguauuuacauauaauaaagaaagaaagagagagagagagaagaaaaauguaguuaaaauaaugugauaggaagcugguccgaugacuuaguaagcagaguacuuaacauucaaguggguucauauccucagaagucauguaaaagccugaugcaguagcagcguaucuaugaugagaugggaggcagacaggacaaucccaggaagcuugaggcuagccagucuggcuuaugcaucagcgaacaagaaacccugugucagggcggaagaccaggaucaacaggcaaagcuguccccugagcuccauguguacuugccugcacucacacauacacacauaagauuuugaacaaagcugggcguaguggcacacaccuuuaaucccaguacuugggaggcagaggcagguggguuucugaguucaaggccagccuggucuacagagugaguuccaggacagccagggcuacacagagaaacccugucucgaaaaacaaacaaacaaacaaaaaaagauuuugaacaaauagugugauggcauaauagagaacucugggccauagagaggugggcucagagaaggggcuguucugagccaugugguauccgaaaaggcugaaugguccaacauauaaaggucaaggggaaguguucagcugauggcaucgcaaaguacagaagggaagaagcuugcauugcagaagccaaacggacagcaagugugaccgaguaagugcuggaacaggaagugagguuaaaggcaugagcagaagccaggcugcagaaggcccucuagacuggaaugaggaugcacuaggaagcuguuagaaagucuaaagccaaggugucacaccauacgauuuaugccuuucauuuuuuuguuuguuuguuuguuuguuuuucgagacaggguuucucuguguagcccuggcuguccuagaacucacucuguagaccaggcuggccuugaacucagaaauccgccugccucuaccucccgagugcugggaucagaggcgugcgccaccacgccuggguaugccuuucauuuuauguucaaacuuugcacguugucagggccgaccgcuugguauugaguaagcgguugcugugugcuucucuggggaagaccguuccccuacucggcauuucucagcuguaggugccugugugggguggaggccuugugggcuuuucuuugugcaccuuagcaugucuauggcuuacuccucguccugcucaugcucuaaucacaaaaauaaaagaaauuaaaaaaaaacuuucaaaaugacagugcuaggguuugauccuagggccuugcacauucuacgcaagcauucuacuacugaacuaugccccuagguccccugauucauguuuucuuuuuuuauuuauuuuaauuguguguguguguguguguguguguguguguuuauggggguauacacacaugucugcaggugcucguggaggccaaaggcguuggauucccuggauuggaguuguagguaguuuaagcuaccccuuggggcugcuggggaaucaaacuugucucuggaagaaugauaggugcugagugcugagcaaucucuguagccccgauccacgcuuuaaggcaauagcuacaauguggggaaugccuuggagggaagcaagaacggaggcagggacaccaguuaggagaccauuuugacaacccaacaugagauaagaguaaaggaaaaauuggaggaaggaaaguaaacacguuuguuagguggcuugguagggggaugcuaccgaggcuagcugcuggaugagguguagggagugagggagggacgaagcaagcauagcccccuugaaguauggcuagaauaacugggugaauaggugccauuuucuguuuuuaaaagcugucuuauauuucucucucagugagggugcggugaggggugucauuguguguauguggaggucaaaggacaauuuuugugcagucauuucuuuccuuucacuguguagguucaaggcuugcagagccuuuuccuacugagccaucuugcagcccagaaguucuauguacuggacaugcuucugaauugcuuauuggcucucuaaguggagaugucagcuaagcaguuggauguugcauucgucagccguuugucaccgugaccuaaagccugagagaaacuauuuuaaggccaucuuacuguggccuguagcuucagggguuccauacaggcugauaauuagccucugugguuuccgggccugaacugagguagaacaucaggaaaggacguggaagagcagagccaggaaacaguaacaggaaggggcuagggcaagaacaugcccccagugaucuuugucacauacacacauaugcaggcaaacacgcaugcacauaaaauaaggaugcuaauuaaagccacgagacaggaugagguugcuaaagauaaauauaccuggcaaagaaauccuagagggcuggagagauggcucagugguuaagaucacugacugcucuucuagagguccugaguucaaaucccagcaacuacauggugggucacaaccaucuguaaugagaucugaugcccucuucuggugugucugaaggcagcuacaguguauuuacauauaauaauaaaucuuugggccagagcaagcagggcuggaaagagagagagggagagagagagagagagaaagaaagaauagauccuagagaauugaagacuaagaagcugaggcuaaaguuggaguauggaugaucagggacuacuaaauacaacagaaacaccaguccaguaggaagugggcccauggagggguccaacuauccaguggaaaccacagaggcggaacaaucacuguuggagacaacauucauaauggaaagaaaggaagggaaauacccuggcuucugccuuuucuccaaucuccugccaauaauuuccaccagccaaacacaucaggaagucagaaaagaaaggagccugggaaauggcauugucgucuacacucagcagagcaggaagaggcaaaugggcaaaaggccagcccgagucaaaggaagcggaaacgaucgucugccagaugccacauguaaauauaacaagggcuuggaaaugccacgugcauuuagaaacaagcaaaagguuggugaccuggacaagagcaauuggaauggagcagugucagcaagcacaugacagaaaugaguucaagagagaaaggcaaaguagaguagcaguguuguuauagaaaaaaaauagcuuucuuucucuucuccucuccuccgccaucgugcgcacuccuccugauucggcuucucgccaugucuucucacaagacuuuccaaaccaagcgauuccuggccaagaaacaaaagcaaaaucgcccuauuccucaguggauccggaugaaaauuggcaacaaaaucagguacaacucuuaagagaagacacuggaggagaacgaagcugggucuguaaggauucacacaauggcaagacugaggauuuauacugaauugucaucaaucaguccuaccagauggauuucaacauuuaaaccuggagacuuuucgugucuuaaauuaggauguuuguccaguaauaaaauauagaaccuuucaaaaaaaagaaaaaaauuaauauuuuugcuauaaaggagggguggacugguauguagaggggaaguaagacugaugggugcucucaagcuaggggaaauaacagaaucuuuuaaggucauuuagaaaaaacagacaugucauuuauugaaaucauagauguuauaauguuauugacacaaggucucacaucugagguuggucuugaacucacuauguagcccuggaugugccacuaugccuggcuauauacaguacuggggauucaaaucaggguuucagucaucuuaggcaagcauucuagcaccugaaugauaucagcagacucuaaagacuguugacagaaaagagccguuuacaaaauaguauguagagugauaucuuuaguauccuacauaucucuguguauaugcauguaaaaggagaggaaggaaagaagacgaaagaagagauacagauacacauuaagacaauaaaagugauggucucagccuggcaugguggugcaacaucuguaauccuagcaccugggagguggaagcaugaaaaucaggaguucaaagccagccagagcuauauaacaagagccuguuuuacaaaaccaaaagaaaaagaaaaaagacaguggucucaaguaaguauggugguacacaucuauuauuccagaacucaagaagcuaaggcuggaggauugcuugaccuaaggaguuaagauuagccuggaaaacagugacacccucagguucguucucucucucucucucucucucucucucucucucucucucucucucucucucucucucucucucucaugcacacacacacacacacacagugauuuguggguaaccagaguauagcauuguucuaucaugacuucucugaauuucuaucauaaaauaguauaguuggggcuggaaagauggaucagcgguuaagagcucugacugcucuuccgaaggucuugaguucaaaucccagcaaugcccuuuucugguguaugucugaagacagcuacaguguauucauauaaauaauaaauaaauaauauuuuaaaaaauaguauaauugaugucagaacucugacagucauagaagaaaauuagagcugagcagugguggugcacgucuuuaaucccagcacuugaaggcagaggcaggcggauuucugaguucgaggccagccuggucuacagugaguuccaagccagccagggcuacacagagaaacccugucucgaaaaaacaaaaacaaaacaaaauaaaauuagaaccaaaguaaauggagugauauacuguguucauagguuguaaaguauaauaacuauaauguauccucuauaaacugauuucuagauacaauacuaucccaaucagaaucucaguaggagaacuagggaaauggcuccauggucuaaaaaguguaaggaccugaguucaaguucccagaacuggagauuacagcaugguuaucuguaaucccagcaugcuuaugggaagugcagauaggagaauuccuggaagcucaaggaccaccuugccuuucccggaagaagccacaguuugagggugggguggguauuauaggauggagcagaaagguugugaauuaucaauaggcuuucugucaccuuuucucguggaaccgguuugguuccucugcucccaggcaccagauacaaucucuacuuccuucugaccacaguuccuccugcucaggccuuuacagccccaggggucucccuggcuuucaaacaaauaagcacauuccugccuugagaggccuuugcaauugcaguuccgggaacacuuuucccucacccauucccucaggcauagccucuucccucacgcccuucacgucuucacugucuuugcaaaaauaucauuuuuuucucugaggacuuuggugaccacuguaucuaaaauuucaucacgucccuauuuuugcuuucucucucuuuuuuucuuccuauaagcccaagcauauuuuuuucucaugugauuuauuaccuggcucucagcucagaguucagcaaaaauagggaugaguggggguguggagggguagaaccaaggagaguuagcugcuaacacaguagaugcucaaugagugaaacauacacucacugauuguuaaccaacaucagugcaauaauucccucuuccuccccauggcacacugcgaugugcuucccuccuccucugaacucaaggacucugccagacagaugcugagcuaucuguaugauagagaaagaugcagguugagaguagcguuuaaagauguuaaagauguucccagcauggggguauaguaauugaagagauggcagugcuaauuaccuugauuugaucauuacauauuugagaacauguauugaaauacagcaguccuccauaaguaaguguaacuaauaugacaaacaacacauucaaaaacaauaaaaggaagaaugcuucaggccucaaucuugccccuagagagcuuacacucucuccaggaagaggagacagaguugugggucugauuucugauaccuccugcauuggcagccagacucacauaaacuguaugaccccuuguuuccuccugcugcauuccugugagagacucauagaucuuugguuuccaggacucaauagugggagcuaacuaggucuaccuugcaauaggaauuuuacuucuguuuaguggagacacacacacacgcgcacacacacacacacacacacacacgggugggggggcauggauucucaaguaggccagacuggugugucuguguacucagacugaccucagacagauaaucucccugccccaacauccuuaggauugggauugcaugugugcaacagcaugccaggcccuguuuggcuucuuugaucuaucuagugcccaagaaauaaauuccuguaaauuguuggcuucuucucuugaagccagcccagaggugcuuaggggagccuaggcacagccuccuggcccucuguccuagaacucauuaugccaugauggaauuguuuauugaccauaucuaucuuguucacugugccauugguagugacuagccgagucccuuggcguacugauacagaacaugauggcuuagagcauggacacuugcaggccagacugccugaauuagagugggguaugcauguggugcacacacuaagugcgggcaaaacaccuacgcacaguaaaaaaaguaaaaguuguugcuacuuguucauagcuccccguggguaacacguaggcuuuaagaaugaggcacacuggacacuuugccccuucuuagaauugggaacaaaacacccauggaaggaguuacagagacacaguuuagagcugagacgaaaggauggaccaucuagagacugccauacgcggggauccaucccauaaucagccaccaaacgcugacaccauugcauacaccaguaagauuuugcugaaaggacccugauauagcugucucuugugagacuaugccggggccuagcaaacacagaaguggaugcucacagucagcuauuggauggaucacagggcccacaauggaggagcuagagaaaguaaccaaggagcuaaaggggucugcaacccuauagguggaacaacaauaugaacuaaccaguacccccccccagcucgugucucuagcugcauaugaaucaaaagauggccuagucggccaucaguggaaagagaggcccauuaguugugcaaacuuuaucugucucaguacaggggaacgacagggccaagaagugggauugggugggugggggaauaugugggggacuuuuggaauagcauuggaaauguaaauguaaauacccaauaaagaaaaaaugaggcacacauguggaugcuuagccaugcuucaauccuagugaauuucucauuacaaccacuucuccauaaguaggaauuuucucagugaagucucgaaugaccauguauauaaauccuguacagacagcguaccuggcuguugucacuuugauagguaaugagccaccugcuacuuucuauuuugucacguaguaaugcuuuuuuuuucuuuguagcuuuauaauuaguguuccuuugucauuuccugugcauuguaucugccuaccaauuagguuuaauccugacuccuauaauguuuauucaucccucguagacaaguguuuaucuucauugucaagccugggguagguuuuuaaaucaguuuauaauguuuuaaucuguacacagguuuuguuguccaucagcaagguugcugucuuuaccaucaguaauuauuguaaucagaauaacugucauaggagagggagaggagacgcacuuccuagcaugcuugcccagcaggcacaaggccuugggguugaucccuagcagcaaauaaagaaugcuugcuggcccaugccuguaauccccgcacugggguggaggcaggaggaugagaaggucaaggccauucgucagacacaaagcaaguuugaaacuagucuagaauacgagagauccugucucaaggaaaaaucuauagugauaguuaauuuaauucuuguucaggaaaucccuuagguaaagauuugggguuuuuagaaacacagacccauaaauuguccuugaaauaguauagacauuuccugguacaaacuaaugaaaucugagagacccaagacaagagagccuaggaauuugaaccguuugauucagcuagaaugauauauucucuagagucaacagaaaaaccaauaccccuuggcaaacacauugugagucccuggucagcucuccuucaguauccugaagcagccauuccauucuccucccgccagcgccccucaacccugagccuuucagcaggaagauuguuuucuguuuucucagagcagaauucagucuaacagucugaaugccuccgccucagaccaacaccagugcaacaauacucucuuccucccugugguggaugcugagaugcgcuuccuugcugcucuuaagagcucugccuugcgcucucaggccccugugggacugccuccgcugaggaggaccacuuucccaagggcacgguuuccucgcgguagccuguauacaaccaccgggcugacugaagcccagucuucuaguuucggagcuucgcaaaagcuggagccugggcccuaguccccuggcuccuuuaggccugucucuaugcauccuuucccacaugguaauccccugagaacucuccgauaaacccccuguggcugauauuacccgagagucuguauggggaugggauggggugggguggagagaggacucgguaguuaauaccacuugcugcuccggcagaggaccugggguggggauuuucaagccccuacauaaaggauaaacgauuugcaauucaguuuuaggauaucuaucgcccucuucuggcccccucugguacugcauacaccugguccacagacaugcuuguaggcaaaacauugcgacagguaaaauaaaaauaaauaaaagaaagacacgugcuccucagugaacuccuucugcagcccaggggcaacauucauccaugucggauacagguccccccaccucuccucggacuuuaccacuugacuccucucuuucuggcaacccuuucacgggucaaauuugucuuagguguacaaauuugaauagauuuucaguaaaguccccuucucacuucugccauuuccuccuuuuuacugguuaacuauccuuuuuguuuguugacagaaauguggucucaguauguaguccagacugaccuuauauuuacaaaugcuucuuucugucucagccuccccuaguguugguacacuuggaguaccccccccuuuacuuucuaguccuuaacugccugugaucaucaaggcucuguucuuugcccucuuuccauugauugcauucauagguguggccucagcuacccuccccuugauauuaacacauaggaaagaugccaaaauggauauauaucuucagcucagguuuugcugcugcuuccgagugagacacuuucauguucaagugacuauuugucaucuccacuccacugacccacagguguuucaaccccacauagccacaguagcuuccguuaucccuugucccggaaugucuucuuuguuucagugaaugcuacuaccuuaccugguacccgcuuacucaagccagagaccagauuucauuggcaugaucccucccucuuauaaccgucuuccccaaaccacccuguccugguggcucugcuucuuuaagggcucucggauuccugcauuucuucuugccuaauguccuaguuagguuucaaagccaugugagccagcagccuccuccugccuuaauccucugcccugccaguauuucuagaccacaucggcuacacugccacauccagagaggugguccucaaccuaugggucucagccccuucugggucaaccaacccuuucacagggccacauaucaaauauccugcauaucauguauuuccauuaugauucauaacaguagcaaaauuaugguuaugaaguagcaaugaaaaugauuuuauaguuggggucgccacaauaugaggaguuguauuaaaggguuucagcauuaaacagguugagaaccacagcuuuaaagcaagcagucuggauccuggcaguucucugcucaaaaugucuccaguagcuuccugcugccuucagaaugaaguaggguuucuaucuguugccaccccucucaaaccuaccuuaccuaccuggcuucaccacaccugccauucugcuauaauucacuacuugaagucauuccagggccuucuuugaaccugcccucccgcuuugggaaaauacccuaaacccugcugacuuuccuuccuccacagagccuugaaugccuuucccaacuuuccagacucucagaagcuaauuuagacccuugcccugucccuccucuucacagacaucuagugaacuuagcacucccucccugguaccucucaauuugaauuccuugaagccagcgguuucaugccagaacccaguacaggguuuggcgugcgcuuuaucacucaaguaagugcuuguugcauaaaugagucauugaaguaugaaugagaaggaaggggggagggagggaacaagggcugugaugagagacggaagacagaugcuccugucucacaauuuagugcugcagaaacauccugucuauggccugugacagacuugcauggucccaaauacucuaaggcaaucuguuuuugucuccagcugugugugagacugugcucuggcccuccuccuccccccucuucuuuuuaugcaggagauggaacccaggguuucugaauugcuaggcaagugcuuugcuacugaacucugccuguaacuugugcauaugaucucuucauuucccucaacaguggaaagaacuggagcagggcagagcucugggacaggcauguccugcucaggggccauuucuacagacggauauaacauggucuggaaugaagggacacuuuucuaagucacugcagcuucugcaacugcuuuucaaauagaacagcaguuuugccaccccagcacucucucucucucucuuucucucugugugugugucugucugucugucugucagucucugucuugcucucucgcuaucucgugcucugucccuuccuucuucccuccuuccuuuccuuccaucuggaaccuuucuguacugaggguagaacccagagccuuaugcaugcuggaaaguguucuguggugagccaaacccccaaucccagucuguuccauuggcugcuuaauugguugauugauugagagcagauuuugcuguuaaaguuguuuuggguuuuuuguuuguuuguuuuuuuaauauuuuuuuauuacguauuuuccucaauuacauuuccaaugcuaucccaaaagucccccauacccccacuucccuacacacccauucccauuuuuuuggcccugguguuccccuguacuggagcauauaaaguauguguguccaaugggccucucuuuccagugauggccgacuaggccaucuuuguuuguuuuuuguuuuuccuuuuuuuuuuuuucugauauaggaugucguauauuccaggauacuuucaaacucgcagcguagccaagaaugaccuugaaccccagacuguccugccuucauccccagagugcuaggauuacaggugugaacacccacacugguuuuauguaauacuguggauccagcccagggcuucaugcaugcuaggcagccacucuaacaacugagcuuuauucagacuuccuauguuuuaaaguagggcuggggucuccauccaucccugguuuagaggugaggaaaccaagauggaaguaaaguugacagacuaacccauuccagcagagcugagucagucugacuagggauagcuagcuucuagcgugaaagggccguuggcugaguuccagcccaagacuguccaacacagcgaauuuauacucugcccacaagaggucaguagguccuacaggagcagagcagcuacagaaaaagccugaaaggagcuucuaauacuaccaggacuuccgagaaauuccucuauaucccagaggugguggguggucacagauuugauuacuccaggaugacugugcaaauugcuuuauauuucuguuguuggaauauaacgagcugccuggugugcguggggggggggcggugcuaggagauaaaggagcuggcauguggggccuccuccaugaagacuguaguaucucucugggaauaaagaaccauuaauauuacaggaucuugucugcugggucugaagagccacauaacaaccuccuuuugauuuagaaucccggagaucuggauuugguucccagcucuuccuaacugaguccucugcaaguugauuaacuucucucagccccagucuccugacuuccgauacaggguuguucugcagaugaauucacuugaucauuuuaggaaucguuugggugccuguccugccuauucaggcuaccagguucaaguggacgugaccuuuaggcccaguagcugacacauagcaaaugcuguuuucaugacagccucucuuugaaggucaggccaugaacuuagacucacaguuauaggcagcugggagcaaccugaacaaacaaguaggagggagaaacugccauuaaggaggccccgcuccuuauuccacugcagagccaggguccaacaaugccugcauuaucgcuuuuauaaguguucuccccaacaccauaaaacauauggaguggcuggcggcacacaccuguaauaucagcacccaagaggcuaaagcagaaagaucacuaagucugaagccaauaugagcuacauacaaaauuugaggaccgucugggauauagagugaaacucuugucucuaaaaccaacaacaaaguagguauauuugcugcucuugcagagacuaggguucaguucucagcauucauaugaaaggacuccuaaccacuuguaacuacaagucuagaagauguaguauccucuuccagccuccaagggcaacgcccaacauguacauacacagacaugcauacauacuuuaauaaggcaaacuacgucuuuuuaacaauacaccaaguuggccaggaggugauagugcacagcuuugaccccaacacucaggauacaggcagguggaucuccaaggccaaggccagccuggucuauagagcuaguucuaggacagccaagaaacaaacccugucucaaaagagaaaacaauacgaaacaaaaaugauuaaaagaaggauuuaggauagcccugguuucaagucuaagcacaagaagagagaaagaggugcaaagaaggcugagacuggcuugagccgacguuucaacugggacagaaacuuccuaaaaucaugggccucauaaucugccuuuuucuugggaaguggcaaggguagaggggccuagcagccuuuugccuacuuucugaaagcagagaggccuugaguuuaccagauacuuugcccgucuugaggcaguguguucagaggauggggagaaguuuguguguauauguauguguauguguguacauauacuggggagcuggaugcuagaaggacgugagaacguaagagaaaaaaaagucacacuguggggucagagggguggcuuaguggguaguggggcuuggcacacacaccucauguccugaguuuucauuccugaaacccaugucaaaagcccaauuccuaucgugagauugaaggcagaggcaggagaauuauccagaugcuggcugaucagcuacuguggcauauucagcaguacagagaaccaagagagacccugccucaauaccaacuccaaaaaguugccaucuguuccccacaugugcccuaaaaggcacacacaugcaugcacacacacauucaagaacccgcuggcccgugaugaaagguaaacaaaucugggaggaaaaaaaaagccacugugugccugagggcuggaucauaagacauauaggccaacagggaauuaauuuaucuacaacuuugagaagcugcagcagccuuucagccucaccaagagggguggcuuagauacacuuuugcuuccucuuaaagugaaauucuguuauucaaaacacuccucucucaaguaaugcccauccuauaggguagguaucauaauucucuuucucuucucagguugcaggugcugaugguagcaguaagucugucguugugguauuagaggguggagacuuuccggagcaggaaucuuuaucacauucugcguaagcagaccgaaguucagaaacgcacagcagcuuguucaaggucucccaacgauacuggaaaggccagaaguuuguggucaggcagucugguugaugcuuggccucucauuuggauggaacuuuucugggcuucccccacugauuuccuugcccgcauccuucccugauuuguuuucuuugguccauauaggccccagcuagcagcuagaacagugauuagucccauccagcgucaaggcagaaaggcauucuguuagccaggugucuugccuuuagaggaagcagagaucccaucaguugccacaggaagcucaucagugagccuaccaaucaggcaccaucaaaacccgaugcagaugaaguacuacuguuaggauacauucacugacuuagagcaaggggaccuggggacuuggcacuuucuagguuaaccaggauagggccagcucuccaaucagggccauuucuaguugauauuguaaugaaguuaaagucagcucacugggagaacuauugcauuucauuuaguuuucaagaaaaauggagccgggcaguguuggcacuugccuuuaaucccagcacuugggaggcagaggcagguggaucucugaguucgaggccagccuggucuacagagugaguuccaggacagccagggcuacacagagaaacccugucucaaaaaaccacaaaaagaaaagaaaagaaaaaaauggaaagaguuccucuuaaaguguuuggugccaaaggaauaaaaaaagcaaagucucugccuucuugcguuuuacagccuaggaacauuuaaaaaauguuuauugguugcuuuaaacacacacacacacacacacacacacacacauacacacaccuaugaguucaaggcuagccuggucuacauaaugaguuccaggcuggucaagacuacauacacaguaaagcccucaaaaaaaaaaaaauuaccacacacggacagagagacagacagacagauagacagacagagagacagacacacacacacacacauuuucuccucacaugccuguccucuuaacuuuggucaggguugaauugaaguaccucuaggaccuuugaccuuuguauuucugaugccaaagugguuuugaaccuugggaucagccugugcagcuaaauguuuaacagauaaaucuuaggggaaauguauuuauguauguauguguguacaauaaguuaaucacaaauuagccggccauggugacgcacgccuuuaaucccagcacucggggggggggggggggggaggcagaggcaggcagauuucugaguuugaggccagccuggucuacagagugaguuccaggacagccaggguuauacagagaaacccugucucaaaaaaacaaaaaaaaaaaacaaaaaaaaaaaaaaaaaguuaaucacaaauugaguuccuagaccagagaccagauguauacuauacaaauaucauauaauaggcauauacuauuuguuauauguuuuuuaauaugauucucacaaaaugcuuucuuuuuugccaacucauuuaucuguaguugcaguagaucaauacaguucugccgugaauauugguugauacuuacauuuaugugcgaacuggaaaagauagaagaaugucauuugucaacaaugaaggcaauuucuuugauaaauaggcuaaggauuuucaaacacuaggagcuaguucccacacacaccucucucucucucucucucuuguuuauucauacuguaacaacauauggcaaaccuuuugguuuagucugaauaauguuuccucccauuacuuucuuagauuuagucagcagagcauugaggcagauucuaguuuauagcuuucacagauugugagcuuuaaaucuugcuaccauaccuaauuucaagcugaccuuuucaaugcaauguucaggaaagaggcaauugcccaucaguuuacauuucaggcucguggguaauaauacacuguaguaaaaugauuaggaagugaugagcuauagaaauuaaucaucuugguuuuuaauaggauuuuaauuuuauguaucucuuuuguuuuucuauuuuggcaauacuagagauugaguccaggaccuugaacaugcuguugaaauacuuuccccaggaauuccauguauauuucuucuuuucuuauguauaugguauaugugcaugcuuauauacaugcuugcauuugugggaguguaugugugucugucugucuguccguccguccgucuaucaaucagucugugaaggccugugguugacaucugaugucuuccucagucuuucuauacuuuauacauugaagcagacucucucacugaagcuaagcucacagguucaucuagucaggccagccgacuuguuccagaaacucacugccucugccuucuguggacuggaauuuacaggugaaccaccgaaccuuuuaaauggauuccgaagauucaaauucucaccuuuagcuccuuaccugaugagacaccuccucagcccucauguggauuuaguaacuguguuuaacugguuaacacgguuucuaaaaaauguagcaaucaguugucaugggccaagaggaaaaaccacaccuccaugaccaaguaccauucuagaucccuaaugacaccuccucccuccaacuucccuuuaccauucacucaggacccuccagucuacugccuuggauggcuuagauucuagaguugacccagcuggcaccaaagcaucacuuccaccuuguaugagugugcugagaaucaacuggcaacagagguccuccccuggguuggcagucccuuucugacuagguggaacacacuugcccugauucugggaggcacaucuggcaagcacucaagccuaaagagaagaagagaaacguaggaggaaguccagagcacaguagcuuagcccuuuguccauuuggccaugcuccaggcugggcuguaauugauagcugaaggcuuuccagagagucugggaauacugaagacuauaggccaugggguggggccagugcaaauccucuuauucugucucuaagguguuacccagagccuuggaacccuacuucugggggugauuccguguuaauccuuggaggguaccuuucuguucugauuuuuuuguuuguuuguuuguuuguuuaguugaaacagggucucacugucucucaagcuagccuggaauccacaacaguacuacugucucaguuucccaaguacugggauuacaggugcaagccauguuuugaaaucuacacuuuaguccuugguuacauugagcagaaggaguggguagccaugaaccuuuaggucuguaguugagccucuugcugacugagccaggauuggccuaacguuuccuaguggaaaaccacccagcauucuguccauucucuguguguaagcuuugcaugaacuugaaggcuauauauaccaaucuuuucuccuuagguaaccugugggcagcugaucagaugggagugcucccgugcaguuuggguccauguuuucaugucuuucucugauauuauugugcagaugaguguucauuguuggcaccuaggcugaaaggucucuguugguauaguccccagcuccacccuauaccacacucagcacaaaggucagcccuuggugacugaaugaaucaaccaguccaaaccuggcugacaguaggauuucuuucuagcaaaaaaaacagagcacagugcagaauccugcaugggagccuuccuggacggggagaauccuuuuuuuacugcuaacacuuggaggaagggggaccuucccacacacucacuaguguugucucucucucucucucucucucucucucucucucucucucucucucucucauaaacagguuuuuaugaaccagauggucuauaaccaggaaguucaggugccaauaauuuuucucucauccuuucucuacugcccaccccgcccccaggcaugcugcuguaccccgugucucgggaggcuggcagaagugcugaccgggcuccauucgcucuuggcaucagccugagaacauccugugcagcugagaggguggugaucccucuguguaauacacaggauggaaagugaccagggugaggacacagauauuaaagggucaauaaugcucagaaaggaaaggcucaaaccucaauagaaaucagaaaccguucgccggcugccaagaccugcccaacacacacaucccaggauucacacagccuucuagcacaugccuuugccaaugcuuccagggcaucuggaagaguggaggccugagaugaggucuccagaaaggcaugacucugcauuuuagugucuagaacccggauucccauugucuuuaugcuuguaaauaauaaugauuaaagugaugugaaaucacu

SEQ ID NO: 9450 - RNA, 2887 nt, Mus musculus
uggccaccaaggcuguggcccucagcacaaugaugaucaccugcaggaacaggcauggacgcggaggccucggaauuacguucucuauaaaccgguuuggguucccacggccccaugggagcgcagggguggagcuagggaggacgcugcgagucauccaucccccccuaagcuccgccucuagcgacuucuucuaaucgcguucuuccggucccggccuuucucuucuccauuccuccgccaucgugcgcgcuauucuugauucggcuucucgccaugguaagacuaucggccgccauccgucccucagcggcuuuccugaggccacagaccgcugugccuuuguggcagacaugcgcagcauugagggcuggguguauuuuucaggguuuuaguguucguuuuuggagcugggacaccuaucggccugugggcgcggcaugaaauuaucaaguccauuuacccuugcaggaugagaacgcucuuccugcagccuggcaaggggugcaaaguauucuuguuucauauagccuggggcugacggugaucuucaugauggggggggggcagaacgagaggcuugggaccacucuuagauugucccugaucgaagagcaugaaucgccauuugcacagcgagauguccacaguaaggguuaacagaacuuugagaucccuucagaaguuagcgcgucacuccuuggaggcgucugcuaacagcgcaucagucauugccuacuggcaagauuaugcuuaugggcgucuagguacaaaguggguuuaguaucugaauuuguuaaauaaaaccuccaacuggucuagggggacgagugcgcuuggccuucguugcauuuuuuuauguaaugguguuugccuacggagugucuagggcuccguaaucuuagguuagccagcaaugucacuuggagguagauaagacuuacagaguacaguaccuagugucauugacuuaaaacuggccaggguuugccuaaccucaagccauccuuguuccaguaaguccguuuccucuccuacuccagcuauuccguguuucaucgcuggagcccagcagacagccaguuuauaggucagacaggaccugggcuuagaaacuuggugcugauuaugagccauguuuaagccauuaacucuuccuccagagaagugaugaggauaaaggacuuggugguucgaggucggggagcuuuuccuggguguauguucugcaggccugauguuaguuuguuggaauuugugacugaaucaagagacuaggcuguggugucacuaagcugguugcaucuccucguagucuucucacaagacuuuccgaaucaagcgauuccuggccaagaaacaaaagcaaaaucgcccuauuccucaguggauccggaugaaaacugguaacaaaaucagguaagccuucucuuguccggcuuggaaaucguuauguuuuaaguaacuuugggcauggagauacacaguugcaaaguacgguccaccccagucaauuagugugcuggggacucccuuuugaaauguuuuuccuuuuguuuggguugggagcacgggguugagaacugggaggaaacacuucuccauucaucaaaugggucuuggggcucuagcucaggucaugaggcuccuugguagugacuagcuuacuuagcccccgaaaucccuccacaaaccuuuuauaaaugcuuccuaauuucccuaggaaggcuucaagggauuugacuauucuggcaggaguguucuuuccugcaaccagaguugagcucaggaccagcugggucuuugagagagguggaagggaucgaacccagggucucccccaggcaagggaagcgccuuucugaguucuuucuguggugugggggaugcaggcccacauguggucagaggacaguuggugggaauugguuuuucccaacaugcugggauuaaagauaagcauugcccaguuuugggauuaguaaaaaucuggguguggcucugcuggggcaaaaagugagccuccuuguucuuaauuuagccacuuaagcuugauaucaacaacccacucuagccuuacauucgaguuaauuacuaucuucugucuucugguaugguacauguauuuagagacuuuacuugcagucaggacuagacuuucaaacuuugguucccccccacccccauagagugcuaaggaaagcuuugaagcacuaggcagcggaccuuagaugcuuuaccggguagucuuuugcuuuuugaaacagucuuguuuagcccaggcuggcuaaucugcuccaaccuuccaaguaagugcugagguuacaggugugugccaccuuuauagguaacuuugaaagaaaagcagguagcaauuacagugcuucauuuugugggaguacugccauuauccugcugaaagaaaagccauguugguuguuucugauuuuugcuuuugggguaaaaaucgugacaccuugacaugaacaguucagagacugguuagcuuagcucugcuacuuacuguaaguccuuuuaugcucuagcaagcgcuuuaaauaaauucucuuguuccucugaaagucugacucugcuagaggagcagguuuguugugaccaacccaccuuguaacugguggcuucucuuuguacagguacaacucuaagagaagacacuggaggagaacgaagcugggucuguaaggauucacacaauggcaagacugaggauuuauacugaauugucaucaaucaguccuaccagauggauuucaacauuuaaaccuggagacucuucgugucuugaauuaggauguuuguccaguaauaaaauauagaaccuuucaaaaugcuuuucugguuuauaaaguacugaauugcccuuaua

SEQ ID NO: 9451 - RNA, 4889 nt, Mus musculus
auuuuaagaaacaacaaaacauuuauuuugagacugagaauuauggaaagucuaaauaauggaaacuggacucuccucuaugucuucuagagaaucagaaacaccacccucugcuucagcucgaugcuuucccaguuuagcaaucaguucuuuggcuggauuaaagacgccauuggucugcuggucacagacauagcagcgugaggugguacggaaaugcugcaaugcacagcgcucgcagaaauaaugccuacacuuggugacaacuggauuuuggaaggucuggcgacagaugaaacacuugaaugguauuuccucaucaucgcuucccacuucguaguuuucguccucauagacaccauagcgacccucaucaagcucacguucgaucugccacccgugcuuguaaucugaacgaucauggaggaauuugcagcuguccccgaagccgcagaaaccagucuccuuguaguccuuacagauaucgggcugguaaucccagcgcacgguggcacguagaugcucaggagcucggauagggccuuuccucaccaucccggaggaagcauugcccauggauguauccuugggcuucacguacuucugauaauuauugauuccccgauagaucuugucaucuuccuugccccucagcuccuccuggaucuucuggcuccgcucaaagauggacugugcaucucgauccuucucaguguccaguucguagacggcggucgcccccauauccucgggccccacggguuuugccgaacggguagacuuguagacgacgccgagacccuccgguucauucucguccucgcuacucaagccgccauagguugccuucuguuuagcgcugccacgcgucuucuggaucaucggauugugggucgcuugcuucuucuccgggcggaccacagagcugccuucaucacugcugcugcagcuguccccggagccugcaucacagagccggcgcuuucggcggcccgccgcuccuuuccgcccaggcuuuuugaagaggaacgugcacaccugacggguagaauucccgggagaaaguugcuccgccauuuagagauccccaaguucugaaacugccgcgacguccgggaccgcuucgcgucgucacacuccgugguggucucugaugcagcggaucagauaggaggaguaggacgacagaaagaauccuguccgggaacgcuugcuggaccgcgaacgccagucacuuuugggcccccacagccaccgucgcuuccuccuccggagccguacggggcaccgccccucccgcgugcugccggaagagagguaaagccgggucaccucugaggagccggugacggguuggcgugcgaguaacggugcggagaugugguucgagauucucccuggccucgccauuaugggggugugcuuggucauccccgggguguccacugcguacauccacaaauucaccaacgggggcaagguaaggcggccgacucggccgcgggugggggacggugggggacgggggccauuuauggugggggacgguggccguuuggaugcgccuucgcucugugaagaagaagccaucuaagggggauccuccucuuaauguugccugaacgcggagacuugggauuccaccuuuuaacuuuaguaaaacauagccaguuugagggcugaggaggaguggcccaaaaggcaaaaucuauucggcaguuagcaagguagaugacaagaguugggcccugguuccuaggcagagggagaaagguguuagucauguccccgcuccuucccaucguucaucuccuugcggacacuguuuaauugauuuugguggauguauuugugccuuugagugcaggagcccgcggagaucaagagagguccccgggucucuuggaacuaguaguuaaaggaggcuaggaggcagcagaagugggugccacgaauccaguccacugcaggagcaaagagcagucaaguccaggaaagcugguacuacuacagugaagccccgucucaaaaaaaaaaaaaaaaaaaaagaaguaguugagagggggaggaggauaaaggaaaaaaaucagugguguugguccccucccccaacucaaaaagggagaaggcugagaagucaguugccaucauggucugguuucauuuaggagauuuuggcuuuguauuagucauuuagcuuuuguuuuaacuuugucaagauuuacuaucuauguaugugucugcugcugucugugugcacccaugaagaguagaagaggguauugaaucucuccuggacuugcaguuaugaccccucccccccccaaauaaaauccaaccaacuuggugcugggaagccaguugagcacccaagaauagcaggcagguacccuuccccucugagcuaucucuucagccucuaguaugucauuuaagaaaaauugugggguauaucuuuuuacugggucacuuauauuuauaaacugccuuguccuuuauuuaaaggaaaaacgaguugcucguguucaguaccagugguaucugauggaacgcgauagacguaucucuggagucaaucgcuacuauguguccaagguaagaugacuaaaagaauugugguggcuucugguaaugccuugccuaaggucauacagggcucauuuacuuugcaugguuuuuacuagugugguauacaaacuuuauauauauauauauauauauauauauauacacauacauacauauauagauagaugcucaguguauguggugugcaugcauacaugugugugugcacuuguucaugcaugugcauauggagggcacacccauuuauuuacuugguugguugauuuguaauugagacagggucuuaauauuuagccuuugcuugccuggaauccgcuauguagacuaagcuggccuugaagucauaaauuggccuaccucuggcuccugagugcuggaaugaaaugugugcacuagcaggccuaggaacuuauuuauuuuuaaauuugucuuuaguucuaugcaggcuccaugguacaaauguggaggucagaagacagcuugugggagugccuuauuuagagaagugauagagcugccuuggcagcgugugcuuguaaugcuaaccccuggaaggcuaaggcagggggaaucugugaguuugaggcuaacuugggccacguaguaagauacugucucaucaaacaaagcauaaaaaagaauuaauguaguuugauauguuugugugugguuugaguuggugagugcaggcuaugcguggaggucagaggacagaggacaaucugaaggcagucacuucuggaucugggaacccuuguaggaucugggaaucaaacucagguugacaagucugcaugcaaagccauuucucugccucucacccucauaauucuuuaaguuucauaaaucacuuaauagcugcuccuaccucauggauaccccacagugaaccuagguaaauuuugugcucguuuucuagauaggaaaacauggauagagcauggggcucaguucggugcugugugagaauccaucucauguacaugaggggagauuaaguagcugccuuguaaaaagccugugccucgcuguuccaugcuuucauuuacccuaugguauuuucauaccuggaaggaaugccauuacuuaucucuaguagagucuuaagcuuuugguugugagugagguuuuuuggagaggggacuauugcuuuuguuugaaggcaggcacuuguuacauaagccuggcuggucuggagcuugcuguguagccuacagcagccuugaacucagagcaaacuuccugcccuugccucuaguagccgaaaacuugccuccugaauacucacugggauuaggauuacagaugugcaauacuauguccacuuuagaucuuuggauguuuacgggcaaagguuuuggaguuaggauacuuuggcucugcugcuacuugacugacuuaaggaagugauuuuugucuucuugagacagaaucuaacaguuucuaacuucuuugguucuuacuucuucucuauuucaucaccuucugaagacguugacugauucgguguucaccuuguguucagugcuguugugugagacaguuuacuguuuggcccucugauccaugguaggggcuguguaugagggcccaggagguaaauaauuacuugacuguaguuccaguuagagugaagggaaggucuuuucauauauaauaauauguuugcugcugucaggaaacgaacagguacaguggugcaucccauaauccuagcauuugggagguggaggcaggaguucaccuuugguacauagggaguuuaaggccaacuuugauuauaugagaccuugucaaaaagcaacaacaacaacaacaaaaacacgagacaugauguagugucacacaccuuuaauccuaacauucuaggggcagaggcaaguaaaucucugaguuugaggccaaccaggccuauggaguaagaaccugucuggggucgggggcgacgucauuuaguggccauucuuuaaugauuaugaagucaauuuaguuucuguuguugcaguuagagaauugugggaugugaaaucgcuuguuuuaauaacagaaugccauucugugacacuggaaauuaaacagcaugcuacauuuugaugggaacagaauccucacauucuccuuuucauacuguuuuacagggccuggaaaacauugacuaaggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaagucauuuu

SEQ ID NO: 9452 - RNA, 1248 nt, Mus musculus
ugggggcccaaaagugacuggcguucgcgguccagcaagcguucccggacaggauucuuucugucguccuacuccuccuaucugauccgcugcaucagagaccaccacggagugugacgacgcgaagcggucccggacgucgcggcaguuucagaacuuggggaucucuaaauggcggagcaacuuucucccgggaauucuacccgucaggugugcacguuccucuucaaaaagccugggcggaaaggagcggcgggccgccgaaagcgccggcucugugaugcaggcuccggggacagcugcagcagcagugaugaaggcagcucugugguccgcccggagaagaagcaagcgacccacaauccgaugauccagaagacgcguggcagcgcuaaacagaaggcaaccuauggcggcuugaguagcgaggacgagaaugaaccggagggucucggcgucgucuacaagucuacccguucggcaaaacccguggggcccgaggauaugggggcgaccgccgucuacgaacuggacacugagaaggaucgagaugcacaguccaucuuugagcggagccagaagauccaggaggagcugaggggcaaggaagaugacaagaucuaucggggaaucaauaauuaucagaaguacgugaagcccaaggauacauccaugggcaaugcuuccuccgggauggugaggaaaggcccuauccgagcuccugagcaucuacgugccaccgugcgcugggauuaccagcccgauaucuguaaggacuacaaggagacugguuucugcggcuucggggacagcugcaaauuccuccaugaucguucagauuacaagcacggguggcagaucgaacgugagcuugaugagggucgcuauggugucuaugaggacgaaaacuacgaagugggaagcgaugaugaggaaauaccauucaaguguuucaucugucgccagaccuuccaaaauccaguugucaccaaguguaggcauuauuucugcgagcgcugugcauugcagcauuuccguaccaccucacgcugcuaugucugugaccagcagaccaauggcgucuuuaauccagccaaagaacugauugcuaaacugggaaagcaucgagcugaagcagagggugguguuucugauucucuagaagacauagaggagaguccaguuuccauuauuuagacuuuccauaauucucagucucaaaauaaauguuuuguuguuucuuaaaau

SEQ ID NO: 9453 - RNA, 2542 nt, Mus musculus
gaguauugauugcuguguauuccuaguccagucugggaaacauagugaauacauuggaggcuagggcuacaguaacaagccugccucaaacaaaacagaggggggaaaaaagcccaaaacagcaccagaaaugucugggaaaagaguucaaauugugcccuaucuccaagguauguaguugagccauucauuuuacugcuauccuuuauucuaguugugcgcaugugugggagcguauaugugugcaacaguguagaagcccuuggaguucaaaggcaucagauuuucuggagaguugcaaggggccaugagccacaugacauuaguacuuugaaccagaguucucugcaauauaacuugcucauaaguacgaaaccauuucucuaguccuaacuuuuucuuuuuuuuaaugauuguauguguucugacugcauacugugaaggucagaggacaacuuucuuggaguuuucucucuccuuuuauucuggaauugaacucaggguuuuaugcuuuuauagcaagcaccuauauccucugagccaccagcuccuagauuguucuuuguuccaauuuuugaaaaauuuccaauuuguuaauguuuuaccaacaaccacgccaauuauuuuggcagugucuuaagaugacauaacuauuuuagaaaaauuaaaaucuaggcuuaggacuauucauacuauauuacucuaggcuaaaaauaggacagucagguacuuugacuuuugagauaucuucaucagagcuaaauauguguuuaauugcuuauauacuguguuuggguaaauuguccuuuuaucgcaaggccacaaccuaaauuuguucaauuugcuaaguugguaugcuuuaauccaaaaaugcauauauggauuucuugccuguguggauggaccauaugcacagggaaaccggaagaguaucaaaucugaaaccggagguaaaggucguugggagccaucauguacguucuggaguuugaaucuggauccucuugacuguugaguuaucucucccaaccuguuuuaaaaaaugauuauuggaaucacaaaguuaagccuuggguacugaacuuacuuccacccacccagaaguauuccuaagcaacaacacugcuacacacaguuacauuuuauuuacucuuacacaguaaacaggaggagcggguugguuccuugucuuuuucuuuucccauuaguaguuuacaauucuuuuggugagauucccauuagaaguuuacucaauuuuguuuauuacccccaaaugccaauuuuaauauucacuuugcaaauaucagauagggaauaaaaugggaagcuagcuuauuccuuuuucaacuccucccaaaauuuauuaaauuucacaaacauggggcagguaacaaggagaaaacugugaaacgucuuuuugcaccuuuuagaaugacugcuugagcagcuccucuuccgguucacugugcccaacggauucagcuucggguucaacacuugugggcauuccaacuucguuucugaggggaauaaaacaacacauguucaagauuuugugauagguauaaugaaauauagucaacugguggugacccuccuuucucugugcuaggacccuaagagcuggggacacugaagcucagcaaagaugauagggcccaccaaaugggucuccuacagggagccugugacuauggagggaagggaaggaaacccaagggguccccagacuucaagcccccuagagcaagugguuuaccucacaaagauguuggggaacugagugcauuggaacacgugguccagaucuucaaguuucagcuggcugaaggcucuacagaucaugcuuaugucagcaucguccugcaaaugcuggguccugguuucugcagguagaguuggcugguccuggucaccauagcccuuguguuugccuucguuuuuggcuccgggcgcuccuguacccacaaaacuacugucuucuccugucgcucuucccaagucagauuuaggccaaaauuggucaccaccaucauuuccucccucaacauugaucauagguggcaucacuucugaaaaggauaaagagagaagaugccaagaggcagauagaaaaaccuaaaggcauucagaccccuggcauccaaaggcugccagcaaggaguaguagcacuuguggcggucucuacucucuuauccacuuguguaccucacaaaacuuucuuuugccuuggggggguauacccucugaaaucccccagagguuucuuuggggaggcgugcccaccaauuucucuauagcagcccaaguaccaaccuuuagcucuuuccgaagacacaucaauuccgaggcucugguagcugauguccugguguucaaacuugcggggaugguccauuuuaaaggugucuuugaaacuuuaggcgcuuagagcucuaucggggaguuuagucugaaagaugacaguugggccguccucucgcugcgccaccaccaacgguucugccccaagcuuugagaggccagcacaaggggcuugua

SEQ ID NO: 9454 - RNA, 2542 nt, Mus musculus
uacaagccccuugugcuggccucucaaagcuuggggcagaaccguuggugguggcgcagcgagaggacggcccaacugucaucuuucagacuaaacuccccgauagagcucuaagcgccuaaaguuucaaagacaccuuuaaaauggaccauccccgcaaguuugaacaccaggacaucagcuaccagagccucggaauugaugugucuucggaaagagcuaaagguugguacuugggcugcuauagagaaauuggugggcacgccuccccaaagaaaccucugggggauuucagaggguauacccccccaaggcaaaagaaaguuuugugagguacacaaguggauaagagaguagagaccgccacaagugcuacuacuccuugcuggcagccuuuggaugccaggggucugaaugccuuuagguuuuucuaucugccucuuggcaucuucucucuuuauccuuuucagaagugaugccaccuaugaucaauguugagggaggaaaugaugguggugaccaauuuuggccuaaaucugacuugggaagagcgacaggagaagacaguaguuuuguggguacaggagcgcccggagccaaaaacgaaggcaaacacaagggcuauggugaccaggaccagccaacucuaccugcagaaaccaggacccagcauuugcaggacgaugcugacauaagcaugaucuguagagccuucagccagcugaaacuugaagaucuggaccacguguuccaaugcacucaguuccccaacaucuuugugagguaaaccacuugcucuagggggcuugaagucuggggaccccuuggguuuccuucccuucccuccauagucacaggcucccuguaggagacccauuuggugggcccuaucaucuuugcugagcuucaguguccccagcucuuaggguccuagcacagagaaaggagggucaccaccaguugacuauauuucauuauaccuaucacaaaaucuugaacauguguuguuuuauuccccucagaaacgaaguuggaaugcccacaaguguugaacccgaagcugaauccguugggcacagugaaccggaagaggagcugcucaagcagucauucuaaaaggugcaaaaagacguuucacaguuuucuccuuguuaccugccccauguuugugaaauuuaauaaauuuugggaggaguugaaaaaggaauaagcuagcuucccauuuuauucccuaucugauauuugcaaagugaauauuaaaauuggcauuuggggguaauaaacaaaauugaguaaacuucuaaugggaaucucaccaaaagaauuguaaacuacuaaugggaaaagaaaaagacaaggaaccaacccgcuccuccuguuuacuguguaagaguaaauaaaauguaacuguguguagcaguguuguugcuuaggaauacuucuggguggguggaaguaaguucaguacccaaggcuuaacuuugugauuccaauaaucauuuuuuaaaacagguugggagagauaacucaacagucaagaggauccagauucaaacuccagaacguacaugauggcucccaacgaccuuuaccuccgguuucagauuugauacucuuccgguuucccugugcauaugguccauccacacaggcaagaaauccauauaugcauuuuuggauuaaagcauaccaacuuagcaaauugaacaaauuuagguuguggccuugcgauaaaaggacaauuuacccaaacacaguauauaagcaauuaaacacauauuuagcucugaugaagauaucucaaaagucaaaguaccugacuguccuauuuuuagccuagaguaauauaguaugaauaguccuaagccuagauuuuaauuuuucuaaaauaguuaugucaucuuaagacacugccaaaauaauuggcgugguuguugguaaaacauuaacaaauuggaaauuuuucaaaaauuggaacaaagaacaaucuaggagcugguggcucagaggauauaggugcuugcuauaaaagcauaaaacccugaguucaauuccagaauaaaaggagagagaaaacuccaagaaaguuguccucugaccuucacaguaugcagucagaacacauacaaucauuaaaaaaaagaaaaaguuaggacuagagaaaugguuucguacuuaugagcaaguuauauugcagagaacucugguucaaaguacuaaugucauguggcucauggccccuugcaacucuccagaaaaucugaugccuuugaacuccaagggcuucuacacuguugcacacauauacgcucccacacaugcgcacaacuagaauaaaggauagcaguaaaaugaauggcucaacuacauaccuuggagauagggcacaauuugaacucuuuucccagacauuucuggugcuguuuugggcuuuuuuccccccucuguuuuguuugaggcaggcuuguuacuguagcccuagccuccaauguauucacuauguuucccagacuggacuaggaauacacagcaaucaauacuc

SEQ ID NO: 9455 - RNA, 2950 nt, Mus musculus
acugcgacugugcgagaagucaggacagaccgccucuccggacagaccauaauuugggugaggcgccagaagaaaaacccuuccgggucaaggaucggagcagagagauauauauucaggcuccggaacugugaggacacagcguuggaagccucuucgggagcagcgucggauccagagauucucgcuauggaaacuccucaagacagccgccaaagcauccaaaagccuccgaguccggcagccgaggaggacaaggaagaacagccuggugaguaaacugguucugacuggacuugggugaaguuuggggagaaacgguggguggaaagaagaguggacaggcacuucaggucgguuacagagccccugccugugcuuccucuccgggcuuuccaggcaucccugggccauguugcucaggucuuuaucucuguaucuuccuucugucuuucaggugggaaugcaguggucuccggggcuccagaggaaagaauagacaagaaagagcuuguacugaacuggcucgcucagggugaguuugaucagggcgaaggcgcucagggcgagguugcuggaggugagcaggcucaagaagagccugcuccauugaguccagcucaggaagccacuggaggagaagaggagggagaaaacaaggaaggagaaauggaaggaagacaugcuggugauggugcuucuagcuccgaggaugacagcauccuggaagaaggcggcgaaaacauagaucaacagccgccucagcaagaggcagccaguccugauagcaucagaaacccacauguucugaauaggcuggcucaacugcgguacagacgcaccagguucacccacucucagcugcaugaccuggagcgccuuuuccaagagacucgcuaccccagcuugcgagcaagguaagaagauggccagugcuuggcgccacauuuacgggucuccuuugccucucccuggcccucugaaucccugcagaaauaauggcaaugguccgugaccggcaccugcaauuagaaccgucugccugcaauuagauccugugguagugguaugggagcugugaggacuggaaacaaauguguuuuguugcccuguucaagacugggaaauuuagacaauguuuaguguuguaaaugaguuuccagaaguacgggugagaagucuggggcguggcuaggaagagcaggagggauuccaacucgcguuaaaauguugcuagugcuuuucaucccagacgcucucuucacugauuuuacauugucaguucaccaaagagacaucuguguauugggggacacccuuagauuuggucuguggaagaaacccauugcuaaagcuagguuuaagguaaauguuaagaauagugacuguaaguaaauguguaugagcacacaagugugggcccaaacauauaaaaccaaaucggacauguccuuacacaauugauuuccaccagaaaggcuaaauguuggaacuuuuucucuuuaggagggaucuugcacgauggauggguguggaugaaugugaugugcagguaaguguucugaaaacacaaaacauacaguuuuuggaagggugccacacccagugauguugcccuccggaaguacaacagcagaacaggacccugaaguucccuccaaaggcugcuagaccaguacacagccaggcuagguucaagaugacgccaggccuccauuuuuacaggcaggaaaugccaacggaaaagcuaagaggcuaaggugcuuuguugguccuucagaggacugggugugcccuugaaaacauucagaaaucugugcagcccacaugccucacaggagugaagagaccaugcucuuacucacuuuuaacacugucacucagagaauuuucucucagaaaucuccuuggucuagucuguaaauguaagagaccuagcauauuucuaaaagcaauauugggaccaaggaccugaaacagccuguggcacauuguuuuauugaguguguaucucucuguacucugaccacaauuacacucagcccuagucacaaggggaaaggccuauagucacuaauuugggaggccagaaaggaaguaccaagcaggaagagguacccuggugucaucacugugcauucugggugcucaaaagaggcauacaguggauccugagcagacugccucccaccuuccuauuguucuugggcaugggcuggagagguuuugguauuuucccacagcaaggccuaggaaccaccaaugagcuacaagugaauucuuuccugaagaaaggcaugaaaaauaucgaggauggagagaggaggcgguguuuugggucuguuccgugguugaaagacugggugugguguuccauguccuaaggggcuugggaaccuguuuuuauuucagagacaaugaacccuauugcuuccaacauacugaauaaucagaauacacccgaggaaccucuugagccccucuugggguuagagcaauaaucacauaguuucuggguauuuaaaagaugcagugacucuuccaggggaguggcucagugcuacagcacauggcuagcacacaccuggcccugggauggguucugaauaccuuccaaacuguuaggaaaaugaagagggcauauagcacuccaggauguguguguuaugaugauaguguugaauggacuaaagugucucugucuccugcuuauagaauugguuucggaugaggagagcccuuuuccagagaaacaggagagugcugauguucugcgaacugccgccucuuccccagagcgacucucccugaagauuuuggagcagcacuugagugccagcccugucauggagccagaugaggauggcuucuucugagccacccaugauggccaugacaaccuuuucuucucuacaauuauuucagcaauaaagaugagcauucugaauau

SEQ ID NO: 9456 - RNA, 2678 nt, Mus musculus
gagcagagagauauauauucaggcuccggaacugugaggacacagcguuggaagccucuucgggagcagcgucggauccagagauucucgcuauggagacuccucaagacagccgccaaagcauccaaaagccuccgaguccgggagccgaggaggacaaggaagaacagcauggugaguaaacugguucugacuggacuuggguaaaguuuggggagaaacgguggguggaaagaagaguggacaggcacuucaggucgguuacagagccccugccugugcuuccucuccgggcuuuccaggcaucccugggccaugaugcucagaucuuuaucucuauaucuuccuucugucuuucaggugggaaugcaguggucuccggggcuggagaggaaggaauagacaagaaagagcuuguuaugagcgggcuugcucagggugggcuugaucagggcgaaggcgcucagggcgagguugcuggaggugagcaggcucaagaagagccugcuccauugaguccagcucaggaagccacuggaggagaagaggagggagaaaacaaggaaggagaaauggaaggaagacaugcuggugauggugcuucuggccccgaggaugacaacauccaggaagaaggcggcgaaaacauagaucaacaaccgccgcaacaagaggcagccauuccugagggcaugagaaauccacaggcugggaacuaucuggcucaccagcggacccgccgcaccagguucacccacucucagcugcgugaucuggagcgccuuuuccaagagaaucgcuuccccagcuugcgaguaagguaagcagauggccagugcuucgcgccacauuuauagguagugcaucggguccagaguguccuuuggcucucccuggcccucugauucccuccagaaauaauggcaccugccccagacuggcgccugcaauuaggaucuuccgccugcaauuagaacugucagccugcaacuagaucccaggguaggggugugggagcuaugcggacuggaaacaaauguuuuguugcccuguucaagacugggaaauuuagacaauguuuaguguuguaaaugaguuuccagaaguacgggugagaagucuggggcguggcuaggaagagcaggagggauuccaacucgcguuaaaauguugcuagugcuuuucaucccagacgcucucuucacugauuuuacauugucaguucaccaaagagacaucuguguauugggggacacccuuagauuuggucuguggaagaaacccauugcuaaagcuagguuuaagguaaauguuaagaauagugacuguaaguaaauguguaugagcacacaagugugggcccaaacauauaaaaccaaaucggacauguccuuacacaauugauuuccaccagaaaggcuaaauguuggaacuuuuucucuuuaggagggaucuugcacgauggauggguguggaugaaucugaugugcagguaaguguucugaaaaaacaaaacaaaaccuauuuuuuuggaagggugucaugcacggugauguugccuucagaagucugugcagcccacaugccucacaggagugaagagaccauguucuuacucacuuuuaacacugucacucagagaauuuucucucagaauucgccuuagucuggucuauaaauguaagagaccuagcauauuucuaaaagcaauauugggaccaaggaccugaaacagccuguggcacauuguuuuauugaguguguaucucucuguacucugaccacaauuacacucagcccuagucacaaggggaaaggccuauagucacuaauuugggaggccagaaaggaaguaccaagcaggaagagguacccuggucucaucacugugcauucugggugcucaaaagaggcuagcacaguggauccugggcagacugccucccaccuuccuauuguucuugggcgugggcuggagagguuuugcuauuuucccacagcaaggcccaggaaccaccaaugagcuacaagugaauucuuuccugaagaaaugcaggaaaaauaucgaggauggagagaggaggcgguguuuugggucuguuccaugguugaaagacuggguguggagucccauguccuaaggggcuugggaaccuguuuuuauuucagagacaaugaacccuguugccucgaacauacugaauaaucagaauacacccgaggacccucuucagccccucuugggguuagagcaauaaucacauaguuucuggguauuugaaagaugcagugacucuuccaggggaguggcucagugcuacagcacauggcuagcacacaccuggcccugggauggguucugaauaccuuccaaacuguuaggaaaaugaagaggggguauagcacuccaggaugugugcgcuaugaugauaguguugaaugaacuaaagugucucugucuccugcguauaggagugguuuaagaugaggagagcccuuuuccgcagacacagcaggcugaugauguucugcgaacugccaccgauuacagagaacaacucucccugaagauuuuggagcagcacuugagugccuccccugucguggagccaugauggccaggacaaccuuuacuucucuauaauuauuucaacaauaaagaugagcauucugaauau

SEQ ID NO: 9457 - RNA, 8548 nt, Mus musculus
auaaauggaaaauccuguacuuuauugcuaacugaagagaagagagagagggcuguuuugggugucaauguucugguguucccagaaaagcccaucccccucuugcuccuggaaaaugaugauuuucuuggauuccaccaaagucuucaugcgaaguucuuccuggguaggagugauguucuugccccccaguauuucccucugaaucuuccuauauuuagcucucuuauuguugaaccaauccugaaaccagacagagagagggaguagauuagcauguuuagccguugcugcuuugauggggaaacacauccggcagugucauaugcccccauuaaucucuuuugaacacacaaugcagguuuugccugcucaugugcuuuacacgguugcagucauuagucaucaaggguuuuccuacaguuucuugguuccugguuuguaugccaccaccagcaaaguaaagaaaacuauuacauauucugcacaacuuuaccuaauuagagccaugugacaaggucucuguacauaggcuuauggucauucuuuuuaaaauuguccuuagacaaagucucaugcaugccagugugguuauguacuuccuuuguagccaagaugcuacuuuucuccacucuagugggaauuuggggcaauaaucuagacacaagauauaauaaugccauaaacuuagauuuagaacugcuacugucuagaucaccuuucaaaacauucuaaaagaagugaagagauucaccaagcucucuuucgacauuugucucaccuaauaugaaaaggucuuagauugugugagcauauuuuauuccccuuucuacgugagauucaagcauccucccuugggccucccuucuuauuuaguuuccuugggucuguggaguguaauauggguauccuguacuuuauggcuaauauucacuuauaaguguguauauaccaugcaugcccuuuuggguuuggguuaccccacucaggaugguauuuucuaguuccauccauuugccuaaaaauucaugaugucuuguuuuuaauagcugaguaguuuuccauuguguaaaugaaccacauuuucuguauccauucuuugguugagggauauccaaguuguuucuaguuucuggcuauuaugaauaaaccugcuauaaaaauaguggaccauguguccuugagguaugguggaguaucuuuuggguaucuucucaagagugguauagcugggucuuuagguagaacuauuucgaauuuucugaaaaacugccagauugauuuccggagugguuguacaagucccaccagcaauggaggagagacacacuuucuccacauccuccccagcaugucaccugaguuuuugaucuuaaccauucugauggaugcaacauguaaccucagggucguuuugauuuacauuucccugauaacuaaggacuuugaacauugcuuuaugugcuucucagccauuugagguucccccauugagaauucuguuuauaucuguaccccauuuuuaauuggguuaauugguuuguuggucuguaaucucuugaguucuuuauauauuuuggauguuagaucucugucagaaguaggguugguaaagguccuuuccuaaucuguagguugcugauuuguccuauugacaguguccuuugccuuacagaaguuuuucagcuucaugaggucccauuuauuaauuguugaucuuagugccugagccacugguguucuguucagggaguugucuccucuaccacugaguucaagccuauggucauaggauguaauuggagugagggaaccaggcgggagaagggaugggaaggggagugggggaauucaggaucaagugugggaagagucaggagauagggcaagagggccaggagaauggauggaaaucaguagguggcaggguuaggggguaugggggcaucucuagaacauaacagacaccugggauuugggagguucccagucuauggaagugacuuuagcugagacuccuagcaguggggauauggcuugugaaaugacuaccuccuguagucaggcagaacucccagaggagcaauaggaacagcaacccacccacaaaacuucugaccuaaaauuuauccugucuacaagaaaugcagggacaaagauggagcacagacugagggaauggccaaccaauaagugacucaucuugagacccaucccauaggcaaacacaaaucccuggcauuauuaaugauacucuguuauauuugcagauaagaaccuaguauaacuguccucggagaggcuccacccaguagcugacugaaaccaauacagagacccacagccaaacauuggagguagcucagggaaaagaguugggggaacgacugagggcccuugagggaauaagaacuguacaggauuucuggguucuuuccagcuucuggcuauuauaaauaggguugcuaugaugucuuuguuagaaaaguaaaaauguuuuuuuaaaaaaagaaacuuuccuuguaucgucucuuuuuuaggauuagcaggcuagauaacucagugaacagcuugccugcccuuuggccugagaaauggauguucuuuuccugcucagccggagaugauuacuucaaccaaagcuucauuugcacucuagauuucaaguauucuaguuaaagagaggacagccuacaauugaaugucuuacuaguuuauauuacauacuuaccaaucacuuaauaaaaaaaaacuuaaccaaaaaaaaaaaaaaggaacuguacaggacucuguacuaacagagucaacuaaccuggacccucuuggaucucagaaacuuaaccaccaaccaaagagcauacacuggcuggagcuagcccuccacacccccacaaccccugcauauauauaacagauguacaguucugucuucuugugggucaccuaacaacuggagaaagguugucccuggcucuguuguuugucuguggaucccguuauccuaacugagcugccuuaucuagccucagugggagaggauauacuuaguccuucagagacuuaaugugcuaggaaaggggggaugcccaggaggcaccuaaaugcucaaaggagaaggggaaggggguugguuggagggacugugugauggagagacuggaaugaaggggaccagugaucaggauauaaagcaaauaaauaaauaaauaaauaaauaagaaaaaagaaaguguauuuuaugguucaacuauuccauuucccucauucuauuuuucauucauucauucuuuuaugaagugcuuaugugagcuuuugugaccaaauucucccugcaauuauaugaucauuuccaagucacuuuggguuucaaaaugaugccuaauagaagacuccuguaugaaggucuccugugugucacaagucaauuauggguuauuauauauauguauaucacauaugugcaaaauacauaugcuacacacacacacacacacaaacauauaagauagauagauagauagauagauagauagauagauagauagauagauagauagauaagugaagauucuauuuauuucuuuaugcuuuuacuuuaggaaugaacauaugugacugccagucaugggguagaaacaccagcuaaauuucccuuuuuccaguuuccacuugccaaagcccuauaguccaaaucuuauuucucaggauaaaacacacaagaaaaaaacauauggcagcuacaugggccuaggacaaggucaucguguccuaaggcgggcuugagaucaguacccugcuaaaguaaaaagcgagccgacugaccuuuauuuucuguucauccacauucaggagcccugccagcucuuuucuauggagagaaaaagacaaauacucaguauuccauaccaggcaaaaaaaugaaguaaaauuuguaugcucugugcauauuuuaagauuuaauagcuugcucuccauacuuauucuuaguucuguugcagccugccuguaggaggcacuccucccagcccaccccaagccuccuggugcaacgugcgaacagccaucgcacuggccuugagcaucguuaccucgcugcagccacauuuggcuugaaccaaaggacccacucaccaaaaaugauaccagauauauacaccaagaaacaccuguuuugaaccucagacgccuggaucauagcaccaaaacacaaccaugaaccaauacaauaugcuuccuccagaagucagcaacucuauuguauuaagcuguaaguaaaacaguugagcugaagcucaagacagaaacuucaaaacaucaacuauuauuauguucaaagacagguaugaagaaaugccuuuaaagaccaugagaacacacacaguugaaugaaauagugagaccuauucaagacauguaaguaaaacuuaacaaaggaguagaauaaaggaaagccaaaaugaaauaaaaauggaaaugaaaaacaguaugccaaacaaaagcuucauauguaagucucaacaauagauuaaagagcauggaagacagaaauuucagaucuugaagacaagguagaagauacauaacaucucagucaaagaaaauguuaaauauuagaaaaaaucuagguguaaguagcccaggaaaucuggaacaauauuaaaaucuggaacaauauuaaaaugccacaccucucaagguauaaaagugugugaaacaccaaauagacuggaccaggaccagaaaacaaauuccccgugacacauaauaaucgaaacacuaaauguacaucaaaagauaggguauuaaaagcugcaagggggaaaagaccaagucauauacaaaggagggcccauuagaauaaaagcuggcuuuucuauggagacucugaaagccagaaggaaguggauaaauauucuagaagcucuaagagaucacaguugucaaaucagacuacuagacccagcaaaacuauuaaaggcaguugacagagaaagaaaaccauuucacaauaaaaacaaauguaagcaauuuuuguacaccaauccacuuccacagacacaaagaauaaaaaaaucccagaaaaguucaucaggagagggaaaaauccaugcuaccgcagcaaaauaacaggaaucaauaaacacugaucauuaauaacucuccauaaugcuuccuccaaaagacacagacuaauagguuugauaagaaaauggauacgcugaaccugauacaugggaaaauggagaauauccuugaacacauugguacaggagaugacuuccugaacagaacuccaauagcucaggcacuaugaucaacaauuaauaaauagggccuuaugaaacugaaaagcuucuuaagacaaaggacaacauuauccccauaacucuccaggguaggccccauguucaagaguagucgaccaauaccaaagugacuccauauauuuuuuguuacuuugugggugucuguaugaguguguacaugagugugccugagugugcgugaaugugugugugcuuauuuuuaucuuguuuuuuuuuucuucuaauuuucucugcuuugauuuggguuuuuggucuugauaguuuuccuguuuuguuuuguugaugaaguuggauggguaggaagaaucugggaggaaguaggaaagggaaaauguaauuaaauauauauuguauaaaauauuuuuaauaaaaauuuuaaaaugcuaucuccucucacacaucuacaagcauaguuuuucaguaauucuuagaaggaaccauguuuacaagugguuuuaccuuguuccaacugacucuugggaugguauauaguuucacgggcaugaaggucuucauucuauugaacaugcucucuaaaaaaauguauguacaaaaagcagguuccagcacaggcaauacacaugaaauagagaaccuggaaugcugacaaaauuuaaauguucuguguauugaacguaaaaagcaucacauggaagcagacaacauauaugaacaucaguaacccacuccaaaaacacgcccacacuuaaauacaagaccuuuuuaaagagacacgugaccacaaagacagguuaugguggcuaaaagcacagguaaagucacacaacaguaaggaaauaaacuccaaaucacacagauauuaucccacacccagagaagugguuauuaacaauguccuccacaaaauaacaagccugguaagucccuaaaggcauuggaaacaucaugcuggauuuugggagaugucaagcaauauauccacaaaggaagggucggguccccuucaaauagugagcauagaaugaucacaugauacagcaaauuguuuuuggguguacacccccaaaugacugaaaaucuggaauuuuaggagaggcauuuguguacucucucuccucauagcagcaaagcacagucuacaugggccacagagaaaaucauccagauauccuuuuugcagauggugggaauaacagaaaacauaugauagcuaugcaaagaggucuuugagauguaauuuacccccgagaaagcagaaauucagccagauguuagcacacugaggaggccugaagacaugccaauugaagcagguuaacucagaaaagacaaauucugucugauuucccuuaagugacguuccuagacaaggcacccagagaggagcaauaaggcaggagagugguagcuagagccuguggacaugggaagggcaguuguuuaauggguucagguuuuccuuugguaucauagagaagaucccagagaccuguccccaaaccacuugacaagacuucaggcugcucaauuuugaccuucagauuugguuuaggcuuuuauguuucuguauuuaaggauaaucuuuucaaugaaagcaaccgaaggaguggucagugagcauuccagggaccucguucgcaccaagcaugcaaccccaguccuccaggagaggucuccucguggggggacuaagagcuaaacaaaccccagaccugaagacagcuagggaaaggggccucagacgaguaagaggggaaaccuucugcuccuucuucaccuucuucaccugagacaaaggccuagugggccuuuucuccugccuuuggcugaccacugcagucuggucagguacguucaaagccuguccugaucauauuucaguuuacaugaagcuaugaaccugucagcuugccuuucuuugucuaaaacgacuagucuaagaaugagcaguuuugguaggcugacacauacacccccagaugaaaaaaaaacauuucauuuucagaugccccuaucuacuuaguagaggggcaucucucugccugccuugccuugcaccagucuuauuuccguuuuaauagcuuuguuaccuauugcugccugccgagucuggaaccuuuccugccuuucaauucuuuaaccgauagagaaaacaaauuccacucagaaccucucgauaauaacucuccccaaccaccagcacaaaguuagcugaaaacuucguggguuuaaggccgagaggggaaggaggucaacccugcugccaguaaucucagcuaagacaagaggcugagacaggagggucaaaaguucaaggacggcgagcagggauacagaguugauucaaggccagccugcacaacucagacagaccccgauuuagauuuaauaaaacuaaagagaggcugugaccacccugguagcccucgcaacaaaaugcaugcagggggccugccacugcuuugcaaaacccuccacuacugccguguagguuuaguuagguuuuauucagauucagucuuuguuacggcuugagcucgcuagagggcgcacucccgccgcguccgcugaggcuaugucuccugaagcucugaggagauuguaccucagggacaaagguaugccacugugagugaaucuaugugcugaaucucaaagacuuuaaaacauuuuaacaagaguggaaaggggucaggggagaggaaaaagagcccgagggacaaacccggaacacacaccuuuugagggcaucuggauacugauuuucuacgaacacugcuugcaguucccacagcuguccagguguaaaucuguaugcuuuccgaggaauccugaauaacgacugcucacuggucucggccaccuuacuggucuccucuggcucuucucgcccaguguccugaguguuaggcaugacacagcuaugcucgccuauagagcucugguggcccucuuucgggaugccuguuacuucaucggcgaagccgccacuguuugauguguaggccaccuuuuccucggguucagucgugauuucuuccucacagaagcucaucccauaguagucguagucgaaguagaaguacuuacgggacaugaucuaugcucgucagaaggcacacucuugugguuuccaauggggcucugcuccuugaagcccucuaaauuguuacccuaggcuacacacguuccucucugacacagacacucguccuccuccaccgaugcuacuggcuuucaacucacaaaccugugugagg

SEQ ID NO: 9458 - RNA, 485 nt, Mus musculus
ggccaguaaaaaacucuguuuuuuucaacaccuaguguuuuauucagauagcagucccguuacacaugguccaagaacauucaaauaagaacucaaaucagaaguuaaagauuggucuucaaacaucauagccaacaaugccacguuugccuaugaucucuccgauauaaaaccacauccacaccucaguggccaccaaaccauucagcacagcuuccuucacuguaagguguuugaagcuaccaguuuuagcacuuugaaugguuuuuuuuuucacacucugaauagcuguagggauuucaccagggguugggggaaccagcucaaccuuggcguagugccaaaauguggccaaucgaggcuucgaguaagucacggcagcggccaccaucgauggugccgucuccgugaaguuacagaugagcuuggccauggucuaagguggaagguaugucuccccgaaccaccggcugaaugucccucug

SEQ ID NO: 9459 - RNA, 55106 nt, Mus musculus
cgccccuggucuuaugacuccagcugaagcggcgaguccaggcuuuugcggugccugggugccucggucgguggucucucgugcuuucgcuuccgcagggcugcgaggggauucguuggaauugucgguccgguggucgccuggccugagggaucacgaugugccucucuccgguuaaaggcgcaaagcucauccugaucuuucuguuccuaggugaguuuucgggcccucuggugucuuugagccgggcccgggggaucggggaguuucaaaggccacaaccugaaagacuggucuuugagaaggcuuugagagaccgaacagcugacacugggcggcggcggcccgaggcggcggcggaggggggacgcgggggggccgggagggggggacacacgaccuggaggaaggccuggccgugggauggcccgccaggagggccucugagaguaacagcggggcaaguaaggggacgagggaggacgacgucaagggauuaggcaagaggagcgcagaguucuagaccucugggcuagagagagcaacuuggaaaaagagucggggagcagacaccggggaggcuugguuuccuggaucaggggagaguuuuaaagauggugaaaaaaaaguguagagcgagaaaugaauuuggaacggaaggcgcuguacccucgugaaauuauuggggagggggagggcauagggggguagguagauaggacaguagggcccaagggacagagacaccguuuugggagcuuuguagguaggacuugaggcugggagaagcagugauugaagagcuaaggaauggccuuggaguuuugagagugaagggauacacacacacguacauacauauacauauagugacuggggcuggaguaacuuccggaaagaaaaguuauauccaaccucuggagacuaaagggaugaguugauaacuuugguggggggugaguaucugacuuaaagguggugaggaucucgguuuuuuuguuucguuuuguuuuuuuuuuuuuuuuuguuauuguuguugguuugcuugauuuuuguugcuuuguuuguuuuucucgaauaacuuucgcuacuuccucccagccagacaccggacagaaauaccccuagaugcuaaagccggggagcuuccaagaugguaauuguguaucugagcuuuguauauucaauccauuuucuucacaaccgcuuggauuuuuuuuuuuuucugcuucuuuuuuuuccucacuacaggucagcuuagucgugguuuuaaaguggugggaagaguugcuggguuaauaauguugguuguuugugaucugucccaauagacuugagaguccauaacagccuaggcuugaacuuugaucccaguguccuccugaccugauuuacucugcuccuuguuaccuugugccuucugcuguuugugcuuuaauaaagagauagaagaaaaagacccaccagaaugggcuggagauaggccuauugagggggcuuugagaaagcaaaagaauugcauuuguaauucacauguuggugggauagaaucaacugguacaguguguucuuacacagugggcauuuggcaauaucuucuuagaggcauuaauuuuuuuccauaauagcuuuugagguuuuuuuuuuuuugagauuguauuucaauuauauuucccccucccuucuccaccucuaaaucuucccauauacuucucccuucccuuauucaaacccaugccuucuguuuuuuuguuauuagaugcuuauaaguauuuguauagauauauguaguccagaggaauuuuugugugucccacugggcagcuucgaguggauagaggccagggauccugcuaaccugcuugcaaggacaggaacagccccucucaagaaagaguucucucuuucaacaucagcagugccaaaugugagagcacagcauccagugggcuccucccgugacucccaagacgcuuacuagggagccuuuggaaugaaaaccuuccccaaccauauuaaggucuuucuucuuuuccuccuagacuuuugcuuauacacaguagaguuuucuagauguuguauacauaauaugugcugauaugauucuauuguccucgccauuucuuaauuuaucaacuuucauuucuaauacuaguaaaugccagcagauauaauucaccuaagccgagacucugugacgucuuccauagaccagaacguucugacucuaauauauuugcaggcccuugaucuagcugaccauacuguguaagaaacuccucuaacacuucugaaguugggucacgaggcuuggcacgcacaccuaauucuuagccuuaccugugaggcacuuacuggcugacccccaaagagaggcuuguuugcaguggaaaacaccuuaucagugaugagagaacaucugacaaaggccuauuaaccaguaauucccugccaauugaaucugcacaaacauaaugcuguuauuguucagagaaagugagaaaaguacauuaccuaugugcuggcuuuugugccauuaauuuuuuuuuaaugaagucuuuucuuuugcauuuaaaaaagcaguacacgcucauugcagaaaguaaacagauaaggcuuagugcauagaagaacagcucaaaccuaguggcuuguaguuaacuagauccauccuuguagauguuuccugagcugauuccauccacaacuucagcaagggaguuacaggagcaauaauguaggaugcaggguuggguuuuuuuuucauauuuuuugauuuaucuauauuuuauuuauguauuuuucucugccuguaugucuguguauuacaugugucccugguaccaguggcaguuugaggggggcaaucauaucccccuggaacuggaguuugcacagacacucgugaguugccaugugggugcugggaaucaacuggguucucuggaagagugauggaugagcccccuccagcccccacgaucuaguuuuuaggucugcacagcucuucuuucaggcauauccugguuugcugucaggcugaggaagauucugcggaucuuaagaauuguuuuuggauuuuacguuuuacuuuuuuuuugguuuuucgagacaggguuucucuguauagcccuggcuguccuggaacgcacuuuguagacuagguuagccucagaaaucagaaauccgccugccucugccuccugagugcugggauuaaaggcgugugccaucacgcccggcacauguuuuacauuuucaugucaaaauggacacccaagaauaggauuuugaaaacuguaggcauaacugugucuugguacuuaaguggguaccaguccugaauguguacucugcuugguguacugguucagcuugcaaacuucauaauucuauuccaucucuagcaguggccucuuaaaaauaacuauuuaaguggagcagugguuuugcacgcguuuaaucccagcacuugggagguagaggcaggcagaucugugaguuugaggccagccuggucuacauauugaguuccuggacagccagggcucuuuagcagagaaaccucaucuuaaaaaaaaaaaaaaaaaaacaaaaaucuacuuuaagguuagggcuaucucucaguuguagagagcacuuacacagagugggugaagcccuagguuuaaucuccagccauuucuguaaaaaaggaagaccaaaaaccuugcuuuaaaguaaguauaggagauacucuuaaacuuuaaauuguuuuccacagacauuuauuuuuuaauuuuuuaaaauuauuuuucuuuuuuuuuuuuuuuaaggcaggguuucucuguguaguccuggcuguccuagaacucacuguauagaucagucucucugccuccugagugcagggauuaaaggggcggaccacuacaaaaggcucacaaaaaacuucuguuggcuuucauuugaaugaauuacaaacaaugaaagacaaccauuuuuggggaaaaggccuaugaguuagagacaugaaaagggcaacagaugaaaguccuugccuaacaucauugcuuaauuuuguuuccaucguuuccucugugcucaucgauuuuuauaacuagccuaaccuaacuucuguuuuuuuuauuuuuccucagaguuuuucagugaaauagcccuggcuguucugaaacucacucugcagaucaagcuagccuccagcucacagagauccacaugucucugccucguuagugcugggacuaaacauuuaccccccaccaugccccacuuaacuucuggguuuucuuuguguaacucuggcuguccuggaacucauucuguagaccaggcuggccuugaacucagaaaucuguaugccucugccucccaagugcugggauuaaagcuugcgccaccaccgcccagcuugagugagacuuuuuaaaaaaaagcuuuguuaacuauccugaguguaggucagguuggggccucucccucccagaaauuauuaacugccuacuguaggcuaaccacagccagaugaaagggaggcagcaauggacaguggagggucugcuguccuagagccuacauuuuagagggugaagauagcccuauagguaaguaacauuucggauagugggacaaacaaaaggcuuucucguguugagugacguucgggcagagaccuuggugcugggaggaggcccaccauaccuguaagccuuugggauggugugggugaggaggcucugggaggggauggggggugggaaaucaugaucaaggcuaauaggaacuuucagucaaaauacaacaaauaaauuacugaagcugaaaaaggaguauguuuuccagcucuuagauguaguagccuauuuucuguuuuuauggucuuagucucugaguggaggaggugaccgguguuggcgguagcuagcaguagaucuacuguggaguggcugaaggucaguagguaagauggugaauuagaccaaaggugaucucuuuuugucuuccguggcucuuacacgguguuuuacaaaaagcucguuuguguuuuugaaugagcaguaagaguucagguaauuauaaggcuggucucaugugauaauucuagucucuccuccuugggcugcuguuuaggggguuaggggaaacacggucucacuguguagcccuggaacacucuacggcaaccaggccaaccucaaauguaagagcucaccuacgucuagcucuucagugcagggauuucaggcaugcaccuucacauuuggcacuugaacuuugccuguacaggcaugaggcccaacguggagagcuaagaaggacuuggugaggagaauuaauuuucucaaacaaccagcaucucucuuuuuggagaacaucaaaaaauguuuaacacuguuuuccuguugguuuuuuuuuccccucuguagccuuaccacauuuuguuugcacagugacuuuugauuuuaugguucaauuaaaauucaucuaucugugguagagauacuugaaagggcagguuugacaauuuccaugagucauuggguuaucacaucugauaggguucuaaauauuuaaauauuccugugugucuagccuuauuuuccuggaauugacggugacuuuugucugcaacccagcauugucucagcccuggagagagcuucuggauccugcuucgugaaggcugcgcuuccuaaucgcaguuucuaaagugcucggagauucuuccauuccagaaguggauuuuaugagugcuuguugguaucccagugugcauuacaaaagcacucuggaggccugccaacuguggcucagcaauaggcacuuuccauuacuucaggaaaguugucuccuuuucuuaccuacucucugaccuuaaacagaaucaaggaagucauuuuaugguuuagaacauuauguuuuguuaguuuuaacuguugcuuuucacgcaccaacauucauagcuuaaaauuguauuuucuguuguaagcagaccuaacaaaaaggaaacuguaaacaagggagucacagguaaacaugagaacagcuggccagauguaaacucaugggaaacuugucacuuagcagagaaggaaaugggagccuuuuguccugcaguggguuuuucaguggucuuguucugucguccaagcucaccugcaacuccuacuguguagccuggauuagccuggaauucauagcaguccuccugccucaauguccugagugcugagauuauaggcuaugcccuguuuuguagaguguguguauucauguaugaguacauaugugcauguuguacauguggaauguagaggacuacuugcaagagucaguucuucuacccuguggguucuaggaauugaacuuaguucuuaguuccuaaguugucagguugguauaagcagcuuuacuucugaggcaucucuggccccaugccuuuuaagaaaaacauuuauauguaugcauuuucugcuuguguguaugucuguguucuacauucaugaccuagagacccucagagacaagaagagagaguugguugcccuggagcuggaguuaaggaugguugugagcaccauaagggugcugggaacuggacccagguccucugcaagagcaacaaaugcuuuuaaccacugagcuaucucuccaggucuguaugccucccugccugccacaaacaaacaaacaaacacacacauacaaaaauaaaccaaccaaaaaacccacuuuuuggccaaccucaagguaaauggauaaaguuuaggguaggacuuaaugggcugaaaguaaagauacauuuuagaaugagacagauucccuuucuuuacauccuguguuuauugaaagggaggaucucuaacuugcuuggaaaacuucucuuagcuuagaguguuuauaccccaucgagaaacccauuagacaaauacugcaguucuuggcaagaguaacuggcccagagucucccagcuaguaaguuugccuuccugaguggauuguagcuuuucagcucugcacauggguggugaguucucgucgucauuccauucuauuguuucugagaucacuguuacgugggcuuugguuuuuuuguuuuuguuuuuaauuuuauuucuaugagugcuuugccugcuugcaugucugccauguugugccuggugcuugaggaugccacgggaggguguugggucuugugggacuagaauuaaagacgauugugacuagccauguagguuaugggaauccagccuggcuccucuggagugaccgagccauuucucccuccccuguuauggauuuuguuucuaucuucuaucuauuuucccccaaaccaggguuauucuguguaacagccuugguugaccuguaacuugcucugcagacuggccucgaacuccgaaaucugccugugucugcugaguaaaggcaugugcuggcauggugcuuuguuuuagucuguguaccuuccaggcaccuuuugggccaaacagacccaugaaaacuuagccacuuuuuucccaaugguuuguguuuggauagcugaguucugaaaaccuauacaugaccauuuggagcagccuugacagcagcauugcacucgagaauguuguuuuugugaggcaugaucuuuuuucuuuucuuucaagaauaaagucucagcuccaugauacuaugauacauucagcuauggcuuugaaaggccguacagccuucaacauacauacagccuuuaaaauaguuuggcaauucuaaaaaucaagcauagcaguuaaguguggaaaucacuugucagagacacucuacucaaucaaguauuacauuucaaaauuaaucuuucacuuuauggggaaagccauuauucauagcuugaaauaugagucacaguuuauagaaaauugacaugagccuuguggcaauauccagaacacggauaaguucaugauuuggaaguucaaaaggaaacuggccuccuguaauacaacugagccguauuucagguccgcauugaggguauuuucacugugauauaaucgaucauauuuauugaaaaccuaauauguauucagcauuacuaggaacacuaauggaggaacagucacggaccuguucuucagugugacagacaagauagaugacauucauauaaaagacacucuuucgggucuguggcuuagaugagauuuuaggauuaaaggagcauauuggaauucagaugagugauggaagcauuugcaaagggaaucuauccacacucaucacccacucacagacuuugguaucuuauuaaucauaaauugcuuacuuuacaucaguugccacagcauacuaguuugcugugaaguggcaguucggaagugcuauauuuaggagauuuugccaguaggagagacaggagucaauaacaaaauaaguuggauuugcauuguccucagagcugcugauguugaauacuuuuaaauguauuuacugaccaguuguaguucuucauuugaauaguaucugucauuugucccuauaauaaaaaauacugaaauaacauuaaaaauaucaguaauucaagauaguguaaaguccacggagugugcaaauauguuuuauggacuguucugugagugcuuuuauauuccagggaacuuuguggagaagugagauagcauguaauaaguaugggucccauuuauuauuauuuuuugaaacauguugguuguagggggcuguaggguugguuguagggggcuuaucuagcuuagaguggccuugaacucaugaucuuucugccucagcuuccuaagugcuaggauuacaggcuugcauaaccgugcccagcuucagucucaguuacaagcaggggaacaaacucugauggauuuuaaucaaaaagggaguuuauugaaaucauagugggguaggguuugguagcacaaaccuguaauuccagggaagaaaauggaguucuuagccagcccggaaaacagugaguucaaggcauucugggauauauagcaagacugacugggcagggugauuccaggggauuuggaggcagaagcaagugauuucugaguucaaggccauagugagacacugucucaaaaagaaggggggggggaggaaaaaagacugucuuaaaacagacaaaccagaaaaccaaacaacuccuucccccgaguagcaauaacaauaaaaccggaaaacuguagugggacauauuauauagucuuugaaaccauaauuccauuguuagauaaauacucaacauacaggcuuaccaguccaugaaagaguguuuacaucugccucugugaugggauaguuugggaucuuucuagcuguccaucaacaauaccacagaucuauagcaaagguucacccugacaucagaagcaguagacuagaaugauugaauugcagucauaccacagugaaucucacagguugaguggaaggaaacagaccuaaaagagagcauaguauguuauucugccuauaccacgccaagaaaauaagaggcaguagccaggauggcauuuuacuuuggaagaggaauaguagcugaauggagaagcuauaagaauuugggaauauagucagccuuuucuguccucuacagguuccguaugcacagauuaaaccagguguggaucaaaggauaagagagaaaaaguauacugaguauaaugaacuuucuuuuguacauuacauuuauuacauuuaugcuguauuauauaagggauccagagagguuauagaagcauguggaugaauuaugugcaaauacgguguauaucauuuuauguaagggacuagaacaucugugaacuucaguaucuucccaguguccugaaaacuguuccuguagguuccaacacuguacuuugcaauguucugcuucuuggaggaggguuuacacuugcccaugugauaaaaaaaaagcucugagcuguguauguuacaucucaguaacauuuugcuuuaaagugagcaagggcugggcauguaguugugugguagcacacuugcuccccauuucaaucuccugucccaaaucacaaaauaauguauaaaaaaagguucguaguauaucaguuuacuuagacagaggaagaacucuggucagguauaccaaaaccuaauaucccaggucaugcuacuggcuugcauugcuaugaucaagugaaaauaguuaagcuucuaccauuggcuagcauaccuuuuuucuggguacuugaaccugcucuuuuccuugcccauaggaugcuuuuucuguagcugguucccuccucagcucuuuuacuuuuaagucugaguggaguuguuagggacaguuuagcuguaagggagguuuggaaagcaaguagucaacauuuccaguuucuauagcagccaaugauguguggaccagcaguuagaaucauguugaaggauacaguuauuuuaccuuuacagccccaaaguaguaguccuuaaggugaagauuuaagccaucagaaggaaguggaucucaagugcuagaaacaguugaagugaagcugagugcaguguagccuuugggcccaguggaaaccaguucaaccggauuaaaggguguguucugggaaaauggucugaaugaugguggagcaauagggugggacaagauuaaggguuacuuugagagucaggaauuuaaauuuaguuuggaguuugggaaccaguaaaauuaagccugaauguuggagaaagaaguuguaucuggcagugcuuuuuagggacagcucagaggggucuguaguaauauaaggauagagugguagauugggaauagaaguaggaagaaaaugugaggccuuugccuuuguauuucauggugugggaucaagggaguccuuuuggaggaggaaguaaaaaaugaaucuggauuuuggaauuguuuaguuugagcugauaaaccuaugaguaaaagcaguccugaugaagguggacuuggagaaggauggcuagguguguccgaguccuggggcaucccucuguucucagucuuguuccaggauuggucaagauugguauccugaguuuggucgaaagggauacaacccagacucucuucuuaaagccuuuccuuuucgccauggcaaauugauccuguuacuaucuuccuucuuuccuuuaauucuuucuuuccuuuaauucuuucuuucuuucucuauuuauuugucuauuuauuuauuuuuuugagacaggguuucucuguguagcccuggcuauccuggaacucacucuguagaccaggcuggccucaaacucagaaauccaccugccucugccuccccagugcugggauuaaaggccugugccaccaugccugccuggccuuuccuuuaauucuucucuucucuucccuucccuucucuucucuucucuucucuucucuucucuucucuucucuucucuucucuucucuucucuucucuucucuucucuucuuuucuuuucuuuagacuggguuuugccuguagccuuagcuguccuggaacuugcucuguagaccaggcuggccucgagcucauagagcuccaccugcuuugagaacagcuuagguuaacuuuuuacccgccucagcaucuuuuuaaauauuuauuuuaauuuuaugugcauggguacuuuugccuccauauaugucugugauccauuguguuccuggugccagccuuggccagaagaggacaucagaucuccuagaauuggcgguaauguugguugugagcccccaugugguguugggaaucaaagucggguccucuggaacagcaucuaguucucuuaaccauggagucaucucuccagcccagcuugcauauccccccucuuuuucuuucauuccaguauuugagauuuauuuuuuaaguauauuaguauuuugcaugaauguauguuuguacuucaugugggugccuaguacccguagaagccaaaagaggacaugagauuccccccagaacuagaauuuuagacaguugugagcugccaugugguuacugggaaucaaaccuccauccucugcaagaacaagugcucuuacccagucagccaucucugcagccccgucccucaguuucuuggaugcugggguuguaagugugcaccauuaugccuggcuucucaauuacuuucauaauaguuuugagugguuuggguagaagaagaggauccuuuauuuuuaaauugauuuuaaguaacacauaaaacaaaauuguacacaguaaaaugagaugucaugauuuuuggaugcaugugaauaauucuaauuuuaaagaaucaaacuaaacauugcucccugguguugcucauuucuuuaugggaaaguuuuggaaaaauccuuuccuuuugaagugugcaguauacugcugcugugccgugcaguguguugguguugaagcguaucaggguugcuuacuccuaaguguccuaacuguuauuuaguuucucuugauuggcaugucuucaucccuucucauguacucugcccagcuucuuguagccacgauuuuacacucaacuucuaaagacuacagcaaaagagagaugcacacucauaccuguaauggauauagaugcaaaacucuuagaaccauagcaaauugaaugccacaacauauuaaaaagaucauuuaucauggcugaggaggcuugacaccagggguauaaucuggggaacuuuaugccaagcuuugagaucaagcacaggcaaaacaaaacuccagcugguuaggaauuggaaguuggaguucucagcagcacucuacagguagacuuggaucugcuuggcagcuccauuucaugucuaagaagaaaagaaugguggcaaaaaccuauguuccuuauccaaggucuuucugaaaugaaucuuugccaauacuuagucauuaucagccgccacaagcuuuagcauaguguuugggcuugcuaaggcagcuagggcucuggagcaugaaagguagccuuuuguguauggcuugaaagcgguugcugaggcaugcuggcuugguauuccucuuaggaguuuucucuuuaguuugauagcaugucucuaccuguaaaugacacuggcuugcuuggauagcauuaaagggugugcagugaucuuaacaggaagcagcguccccuuggguaauauauuagacauucaagacaauucucaaaagguugccaguuauuuauguugcaggugaauuugcuggcauauuuuccccuucuccauuaaaauauugacacuuuaggggcuugaguuuaauaggcgauguugcaacaaccuuuuuuuuuuuuuuuuuuuuuuuugguuuuucgagacaggguuucucuguguagcccuggcuguccuggaauucacuuuguagaccaggcuggccucgaacucagaaauccgagugccucugccucccgagugcugggauuaaaggcaugugccagcaccgcccagcgcaacaaccuuuaaguaauagaagauuagaguuagacaauaagucccaaagcauuucugccugaaaguuucucucuccauuuacagaaggagcagguugagcauguaggaagagauugcggguccaugagaacgguucaucaaacuucuuacucaauucagguuuaaugagaaaugaaguuaugaauucugcauuuguaaagauugaccuuucuuauggaucuacuaggcugcaacaacccuuugaguuguuguuucucuguuauugggauacauguguuuagaaaagcuaaaccugauuacaucagaauaaaaucauuuggcaagcucuccauguguccugucaugcaguuggcagcagaauguugaguaagaacaucagccaucugguuaaucaucagugcagagaaaguuucacugacuggguugagagaagcaggacuuuaauacaccuuccacacuugccccuacauuaguuacuucaaaaacuaagaaagcauuggauggagcucgcuggagugcuugccaaauguauggagcccuggcuuugauucacagcacugcaaaaccaaauaagaacagcaacaagacaacuguaaugucuaaaacugaacuaacaaggcaugaaugaauguagggaucagaugccacuaguuucugccauccgcaucaaggaucgacuaaccauuuccaaaagagaaaaugcuaccuuuauuaccaguggccuguuaaaaacuacaaagaaauauaaucaccaagauaaccaucuucuuuaacauacguguuuuauuuuagagcugguugaacuucagcaguaccuugaacuuauuuuuauccuguauauauugucuuuuuauuuuaggagccguucaguccaaugcauugauaguuaauuugacagauucaaaggguacuugccuuuaugcagaaugggagaugaauuucacaauaacauaugaaacuacaaaccaaaccaauguaaguaaacauaucugccuuuuuuuaagguuuauuuguuuauuauaugcacacuguuuugccugaaugggugucugugcaccauauucauacacugcccugagaggucaguagagagcauugaaucccguggaacuggaauuacagaugagggugagcugccaaguuggugcugggaauccucuggaagagcagcugaugcuguuagccagggagcagcuuuucuaguccacuagcgugagcaguuuuuguuuguuuuguuuguuuggguggugaugguacugggguuugagcccagggucuaguaggugcuagguaagcacuguacuacuuccagucccauauuugucuugaguuuucuaucagggauuuauuuacauuuaguauuuuuuguuugucccccaccacugcagacagggucucuguguagcucuggcuguccuggaacuaagauucuccucucucagccuccuaagugcugagauuaaagguguaugcaaccacguccagcuuuacauuuaaaccuuuuuuuauacccuuuacuuuuuaaaaaaaaaaauuuuauuguguaugccuguaggccagaagagggcaucagaucucauuacagaugguugugagucaccaugggguugcugggaauugaacucaggaccucugaaagagcagucagugcucuuaaccucugagacagcucuccagccccuacuuuuuaaccuuuuauacuggguacaaauaagaucucagguuaauuugccuaacacuuaaguccuguguuguaaaaguauucauauucuuacaaguauucugcuuaagauugcagaggauacuuugaauucauugagucuucggaguuuuccuuggagaugguuauaugcaaaugaggaaaggcuucauaguauuucaguuacaacaacuuuuguaauaauagaauauacugacauuaaaacuugaauuucuuuuuuucaucuuuaaaaauuauguuuuaauuuuuuuauguguguauaggguguauggguuuacauuuuuuucuuugugugucuguguaccacuugugugucuggugucagaggagggcagaaaagggcauagccucggcuggaacuagaguuacagacaauugugaguccauaauguggggucuauaaaucuaacccaggucuuccagaugaguaagcagugcucuuaaccacugagcuaucuuuuuaggcucccaacuucuaagaaagaguuugcuguaucuaccuaucguuuuguuggucucuggucuuuuuugccuuauuuucauuuuguuaaagcccuaucuauaacaugacuuaaaaaaaaacgcaauguguaagcugugaaauuguucacugguagaacucuuccccauuguguaugagacccuagauuuucucccgagguuugcugaaaugagcuaagagcuagagaagaggccgggugauuucucucuucuucagacauacaugagcuugcccagacaacugguguguguagcuaaagaaucugagauugguuuuuguagcacaccaagcaaagagccucuuggcuaaggggaaagugugauuuagcuaaaagugguacacccaacuggguucuccaggggugggcuuuuacugaugucuguuuuuuuuuucuucuuacccacuccuaaacuuuuuuuuuuuuaacuuuuagaaaacuauaaccauugcaguaccugacaaggcgacacacgauggaagcaguuguggggaugaccggaauagugccaaaauaaugauacaauuuggauucgcugucucuugggcugugaauuuuaccaaggaagcaucucauuauucaauucaugacaucgugcuuuccuacaacacuagugauagcacaguauuuccuggugcuguagcuaaagguaaacuuaagaauugcauuuauuuuguauucucuugcuuucauuaguaacaaaaaaugucaacaacuaaaauaaugauuauuaugccuaucugucuuccuaauaagagugaaaaaaaucaaguccucuuacucauuucagcucugaguccaugcauagaauuguguugggcacagagugauauugacuaucauucuggaguguuuugcucugcaguauuuuacugaguguacaguuuauagcaaccuugggaaguaaauaaaggggaugaggcuuggugacuuccccaaaggcucuaaauuuaguaagugagcaaagagcuagugauugcagccaguuuccugagauagagaguucguacacugaacucuuuuuaucuacucaguagugggcacucaguaaaugguggugagugagaaaacgccuuacuaauugaaaguguccaaggucaguaauguagaagaaaugucucaccuucagaucuuuuuacuauuacugugaaccuuuacuugaaaaguaaauggagauaaaguuaagcuguuugcuauuuugagacaacuuagguuaagaacaacuugauuaagucagucucgucauucuuaaacagucaugaauucaaauguucugaaagugugugugguggagaauuuaagguguuuguuuuguuuuguuuuguuuuuugucaagccaggcugaccugagauguuuaguccuccuaucagcguccuugaggauugagaucuuugguguuuguacaccaccauucucaguuugugaugcugauuuuauuagcgauguaauucucucccuuuuuggcccccuccagugauguuagcuuagcaggaugucuggaguaguuagcucucuuacacauaaugugucauucugacugcagaaacacuggcaagucagcgucaggcgcugagaucuggaguuaauaccacucuucgacuuguagauggaaagagcauacuuuaaagccauggagcuucuuaaguucaaggccauccuggucuacucaaaaaucaaacccaaguuuuaauucuacuaaucucuuguuuugagagaagaaccaaggcaagagguuauuaacagcuauuuuaagauauuuaucuuuggcuggggcaugguugcauugucuuuaauuacuaggauaaauuuguccuuggcuuucuguuuaagcgagaagacaguauauaaaucuuuugugacccugugaggaaaacucuagaccuuuuuucucaacaaccuaaagcacacaguaaauucagaauguaguaugcauuuuauaguuguaucuguggauccaugggcugagugccugcuuucugaguguucucaccagggguccugaugagaagcagagagaaaagagggauugggaacagaaugggagaagucaguguaugauggagggguaaaggugcuugcuucguccugagcugcaggcuuaugguggaaugaauguaaguggaagaauuggagcaggaugcuuccaccagggggagccagaggaugcacagcagucauuggagaguugccugagauucaggcugucuguguagcaggaggccaaccaagccaguuggcucaguacagcgggccucauuauaggggccugggaagccaagaaagagcuuuuagcacgauuaagguaggcacuagggaaaccgugguagguuuuucuaagccagaaaaugauacaagcaaagcauagagagugguuuauauauugcuggauuaauuuggaagugaggagacuacaagcagaagaagccagcuucagaaucuguuauaauagucgggaugauguaacccaucccucaaccgcggaggcaacuguuaaaggaagauggcuuuagucagacauguuagauaaaaucacuaacaugcuaaccccuuuccuugucuuuauuauaaacaagugguugacuuuuucugugacugucuucugaauaauaaaguaucaaaccuuuugaauuuaaaauacuuucuuuauguacacuuuagagaauugccuuugaaauaauuuaguaguuugaaaugcuacuuuuguuuugcuuugcuuugcuuugcuuugcuuugcuuugcuuugcuuugcuuuguugguuuuucugagacaggguuucuuuguacagccuuugcuaucguggcacucagucuagaugauacuggccuucaacccacagagauccuccugcuucugccuucggagugcugggauuaaaggcgugcaccaccacugcccugcucugaaaugcuaaguuuuaggcauuuaauaauugaaguaacuuugaagcugcuacuuaaaaaauguuuuuaugauuaaaauacauauuaaaaacccagagagaauaauauagcagacucacagagacuuauuacccagaauauauuuuuuauuuuuagagucucauuguauagcccuaccuagccuggaauucccuauggagaccagguugguuucuaauuuauagagaucuaccagccucugucuccugggugcugggauuaaaggaguaugccuggguuaauaaaucgaauuuuaaaauguuucauuauuuaaagaaacaaaacuuuacugauaaauuugagauacuccuugauuucauuuucuucucugccugcuagaggcaaccagccuuauaucuucagggugugauauuccuguauguguucauagggaauaguuuuaacuuauauaguuucauaguauaauccuaaaauguuuagaaaccuuuuuuucccaucaucauuuuuuguuuguuuuguuuuugaaacagcucaccaaguagcucuuguuuuccuugaacucaacuauguagacuaggacuggccucaaacucagagauccaucugccuuugcuuccugagugcuggaauuaaaggcaugugccacaucgccuggcuuccgcucauuguuuuuuaaggucugucuuuauauagcaaguucacaucuguuccuuuuugauaacaaggagacaauuuuaggaaaacauuuaaauuuaaaaauccccaaacuccaucuguccauuagggggugccaagaagcacuacguggcugccuuguuacaugauggagaugcauagaagaugacccauguuagggaucaugaauacauucuuuucugcuucgccaagaaaccaggccacuuagaucuguaugaguucaguauuuugcaguuucacuauaggcauuccaguaaaaauucuguucauaguggcauacauuuuuaccugaagauuucuugaaauggaaucauuuguuuuacguuuuucuucauuacacuuuauuuuugucuuuuugagacagcuucucuguguaauagccauggcugucuuggaacucacuuuauagaccaaguuagccucaaacucaacuagaucugccugccucugccuccagaauuaaagauuaaaggcauuaauuaaaggcaugugucaccaaugccagucugggacacagucaccaggccuguuacuucucugaaucaccucaguagccccagaaagaggaaggcucuaucacuucuaauguagcccagauggaccucuggcuagcugaagccaagcacaagcuugaagucccaggccuccaggcucucuaccucuggagcggcaggcauuuuagugcuggccuaugugccuccaccaccuuauuuucuggggccucugauaugcuuauagggcaguaacucuauccacugugcaccguucaaagcagccugccuuucuuacagucacuaagucccauccaguuacuguagaaaggcguuuugaacuugccuuugcuuuuuuucuuccuccugaccuucacuauaucucgaguuucaccuaagcagccauuggccuucuguuuccccugguaauuaaaaguuagggucacaguuuuuuuucugccugugguuggauauuuauuaacauuccuuaaaauaaauuaggccuuauuuccucucuuaaggcuuacccuaaguaggauugguaucuguugguaaaggagaucauuuuucuccagcaaaaauggacucccuuguguuguuguuguauguguauacaccuucuguuuugacacuuuuugucuuaccguucuuuauuuguuucaacucuccuugcuaugcucuugguuauuuugagagugaggguguagggagaggaaggaacaugaaguuggguggguagagagggucagggacggauugggggagggggaacaucaugacuuuguguguaggagugugugcugucaagucugacaaccccaguuggcugucuggaaucugaaggagagaaccaucuccugcaguuuauccucugaccccccccccccacacacacguguacucuccauaaccagcuugcacacaaguguccaugcacacaaaaccauaacaagagcaacagauauugugaaaaacagaagcaguuacagugaauuugucauuccugucaaugcuccacaguuuauuaccuuugacauggcaaggccuagaagaaaagggaaccuguauuuuguuaauauaaauauauuaguuucucuugucuuccuggaaauaucauuguuaaccuuguuuuauaggaguucauacuguuaaaaauccugagaauuucaaaguuccauuggaugucaucuuuaagugcaauaguguuuuaacuuacaaccugacuccugucguucagaaauauugggguauucaccugcaagcuuuuguccaaaaugguacagugaguaaaaaugguaaguaaguuccuuccuuccuuccuuccuuccuuccuuccuuccuucacacaggguuucuccguauaacagcccaggcuguccuguaacucucuguagaucaggcuggccucggacuacgagagaucuaccugccucugccucucuagugcugggauuaaagacauucgcuuccacggccugaccaaaaaccaugaguccuuaaauggacuuguauauggggcucuuauuuuaagggcagacuauaucagguagcauucacugagaucauugucugagaacauuucuuuuuuuuuuuucuguuguuuuguuuuguuuuguuuuguuuuuuucauuuuuuuuauuagguauuuuccucauuuacauuuucaaugcuaucccaaaggucccccauacccaccccccuaauccccuacccacccacucccccuuuuuggcccuggcguuccccuguacugggacauauaaaguuugcaaguccaaugggucucucuuuccagugauggccgacuaggccaucuuuugauacauaugcagcuagagucaagagcuccgggguacugguuaguucauaauguuguuccaccuauaggguugcagaucacuuuagcuccuuggcuacuuucucuagcuccuccauugggagccuugugauccauccauuagcugacugugagcauccacuucuguguuugcuaggucccggcauagucucacaagagacagcuacuucuggguccuuucaauaaaaucuugcuaguguaugcaauggugucagcguuuggaugcugauuaugggauggaucccuggauauggcagucucuacaugguccauccuuucaucucagcuccaaacuuugucuuuguaacuccuucuauggguguuuuguucccauuucuaagaaaggguagaguguccacacuuuggucuucguucuucuugaauuucaugcguuuggcaagcuguaucuuauaucuuggguauccuagguuuugggcuaauauccacuuaucagugaguacauguugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcgggauccuccgguaguacuauguccaauuuucugaggaacugccaaacugauuuccagagugguuguauaagccugcaaucccaccaauaauggaggaguguuccucuuucuccacauccucgccagcaucugcugucaccugaauuuuugaucuuagacauucugacuggugugagguggaaucucaggguuguuuugauuugcauuucccugaugauuaaggauguugaacauuuuuucaagugcuucucagccacugagaacauuucuuaaggugcagacuaaauauuuuuaaagugaucuaucuuccuuccucccuuccuuccuuccucccuuccucccuuccuuccuuccuuccuuccuuccucccucccucccucccucccuuccuuccuuccuuccuuccuuccuuccuuccucccuuccuuccuucuuuucuuccucccuuccuuccuuccuuccuuccuuucuuccuuccccccucucuuucuuucuuucuuucuuucuuucuuucuuucuuucuuucuuucuuucuuucuuucuuucuuucuuuuuuugugagacaggguuucucuguguaguccuggccauccuggaacucacucuguagaucaggcuggccuccuaucucagagaucuaccugccucugccuccuaggaucauaggcgugcacugugagcauaggcuuaaagugauaaccauucuuacagauaauuucauuugaaauuuuaugauauacaugcaaaugucuuguuucuaauauggauggugugugugaauguguguguguguaucuguaugagagaggaggugggagggagggagggagggagggagggagggagggagggagggagggagagagagagugugugugaaugagaauguaagcacuagagacccacaguggacuguuuaauggaaauguaauaauuucauauucauuacuagaaaacuaauacuuccuaagaagggauuuaaauaccaauaaccugcuagaggagugauagaaauaaaagauuccuuuguauuuaaacccuucaacgauuucaaggcuaguuuuuaguaccacuucuuuuuuuuauuauuauuuuuuuauuuuuaagauuuauuuauuauuauacauaaguacacuguagcugacuucagacacaccagaagagggugucagauuucauuacgggugguugugagccaccaugugguugcugggauuugaauucaggaccuucaguagagcagucugugcucuuagccacugagcaaucucgccagcccuuuuuauuuuuuuaaagguaugaagacuggcacaagaaugauuuuuuuuuuaagauuuauuuauuuaugugguugcugggauuugaacucagggccuuuggaugagcagucagugcucuuaaccacuaaaccaucucuccagccccuuuuaaaggagcuuuuuuuuuuuuuuuuuuuuuuuuuugguuuuucaacacaggguuucucuguguagcccuggcuguccuggaacucacucuguagaccaggcuggccucgaacucagaaaucugccagccucugccucccaagugcugggauuaaaggcgugcgccaccaccgcccuuaguaccacuucuucacagugguuguuacauuugaaggaaaaaaaaaacauuuuuaucuuggggguggggggugggguucuuuuuagacuugucucugaauuucucaucagagacaggggaaauucuuugaaauaaaggcauuugugggcccuagaaggaagauuacguggccacaguugaauagcuauaacuuuugauguguuccgaguuugucuauucuggucacaacucauaagagauuaucuguuuaugaaacaguaguuuaggaaccugugcuucauccacuuugaaaauagaccaccgaggucuucuuugcucuaauuaacccccuuggacugugagaagcuaacucaaaguaguuugcucuucccuggccaaauaaagcaagaucacccuagcuuguuuuguccuuuguuuuagaacaagugugugaagaagaccaaacucccaccacuguggcacccaucauucacaccacugccccgucgacuacaacuacacucacuccaacuucaacacccacuccaacuccaacuccaacuccaaccguuggaaacuacagcauuagaaauggcaauacuaccugucugcuggcuaccauggggcugcagcugaacaucacugaggagaagguaggguuuagugaaaccuuuuuuguaaauuacaucuuaaguaauguauagugugccaugcacuuaauaaccgauacuagacugauuuaaguuuaaaugcagagcugguguugacuugaguuuugaauaauuuggaaugaguauauccaugaauaguuaauaucaccaucuaggaaucuugaccagcagaaaaccugccaauuuacuaaaagacuucuuuacagcuuagauuuuauaagccuucaguagcucagcaauguaguuaaguuggagaugggagaagauaaaguucagggauagagcaguuacaucccaugcacaaggucugggcaccaccccaacacugccaaaaaugaaaggcaaaccaaagccuuugcaggcuuuuauuucaaccacacuguagguuggugcaaggcuauuugaugagucagagcacgauuauggucaaggccuuguccaguugcaauaccucauuuggacaccagagggagugccagugaacaaaucucauuuuucaggauccugugauugaaacaagccagacagauggcuuuugugcucugaaaaaaaaaaguguuuucuuuugacucauuacugaggaaacuucccucuuguuauuguaguugaaguuggcugagucauagguugaagucuugcaucaaguucucaugaaaguaagacaucaggaauucaaguguccacacaaaagagguuguguuguauguugacauugguuuuaucaguguaaagggcuuugguguugacuuuuacaguuaaucugcaccuccguucucuuuauucucccgaaggugccuuucauuuuuaacaucaacccugccacaaccaacuucaccggcagcugucaaccucaaagugcucaacuuaggcugaacaacagccaaauuaaguaucuugacuuuaucuuugcuguggugaguacugacuguuuucuaaagcuaagcgcuuucucugagaaguguaccugcaaguuugaacagugguagguguaugcggggagggggacgauauuugcuuuacuuaucccugcucaucuuggagucaacugggcuaucuauggacuggacucuuguauucauaaucacacaaaguggccauuguaccauuauauguacuucaguguagaaacaagaaugaacucacaguaaaagaaaacuaacuauaguuaguuuuuauauuauuuucucuauuauuagacaauucucaugcuaacacaccauuuuaaaccuuuuauaguuauauccuuuguuuguaaagauacauuuauuaugugcauuggcguuuugccuguaugcauaugugagugaaggcgccggaugccaugaacuggaaucacagauggcuguaagcugccaugugggugcugggaauugaaccccggguccuugaagagcagcuaguacucccaauggcugagccaucuuuuuuagcccucuuaacauucuuuauaguaucuguauuaguaauagccagcauuaaugaacaugguuagcugucuauuucucuacgcccuacauacaaccuugaaguaguguuagguaaaaaugucucaaguucaguaucuguggcagacauucuugcuuguaauacacaagacccugagauugaucuccagaaccacaaaaauuauauuuauugugaacaugcacaguuuuguuuuuguuauuuaaauauaaacaauacacuauuuuuauacauuuauauuuaaggauuauagguaauuuagggaugacuguaaguauacaggagccacauguaaauucuaagcaaauaguacaccauuuugaaagggggacuuggacuuccuagauuuugguauccggguacuaauccuuugagaaucuaaggaacaguucccuuguuaucuauguguaaguccauccauugacucauuaaauuaguugugauugugauguucugggguuccaucgucagcacuguaaaaauuacaaaauaaagaaaaaaagaauuagccucuucaauguguccaggacagaccugccuucccuuuucucuugcucucccucucauucucuuuuucucucucaauugggauugaauucagagccucacagaugcuaaagaagcaugcagcuaccuggcuauaugccuagugccaggccagauguuaacacaaagaggaagugaagagcuuuuaguucugaagguuuaauggaaaagaugacauuugagggcauucagggauaggucagaucuguacauacagaggugaggagaaguagaaaaguagagguuguccguggaugaaggaacauaaucagugccagcugggaggacgccgacgagcuguguguccagcugagaauaugaagggaguuagaacaaaguuaggagugcaucuugagugccaggcagagcauugucugaacagaggggaggguauaguaagaggacacaucaaguucuccauuacacuugcugcugaaaugucucucauuucauucugcucucucugccucaugucuguuuccagccaugguuucucucuucugggugguucaaaggccucuuaccuaagcucccccuuuguuuaucuccccuagauuaaucuucccaaagcacagcucuucccauaaaucuucagugauuguguuuugccaacaagcuaacaucuaaaggacagaagggcagcucaagcccuuuccuccacgcagugaacucugcucucgcagcuuggauuucacuccaugaaccuuccuucucucugcuuucaugcaauagcuugugaugucuaagagcacagcaguaaccaguccguauguuuggagccagacuuuggguuucaauuccagcucacugauugcuaauuggcagcagugggggaggccacuuagcaacucugugcuugagugacucauccugaacugggcauaguaacagcaugaguaguauaggguguuggagccaaggcugguggcacagcucuauacucccagcuacuugggagguugagggaagaagauugcaaauucagggucaguuuaguugaguugaguuuaguacuagucugggcaacuuagugagacccugucucaaaauagcaaacauaaugacugaggacauacagcucagugucaggaugcuuguccagugccugcaaaacgcuagggucaauuuccagugucucacacccagaaagaauaauggcuagcacuuaguucucaguuguuauuuagguaauguuucuuugugauugauuaccuuugcuuuugcucuugccaucuugaacauauccuugauccacuucuuuccuaaccagaucccgcccacccccaauuccccaccccucagcugacaugagggaugcaucuucccuuauuggagaugauuuucuugccaaauuucuaauuggccacuuucguuuuuuaaagacaggauuaacuuauuuguguaucuuuuuuuuucaagucaaggaacaagcggguuacaacuccaggacucauaaaugcugagcaagcccuccaccacugagcuguaucuuuaauuucuuauggaucuauguuuccucgcagauugcaagcacugggagggcaagauacaagucccauggagcagacauguuacuuuguguauacuaagccugcagacaauuagaaugacuggcugaucaguuaaaugcuuuagaaagauacuacggaauguaggcuagguagagggacaguaaauguuccauacuauaauagaaugacuaguucaaaauacccuauguuguauuuuaugaagaucuagaaaaggggacuucagugcuucaaauacaaacaguucagagccgggcgugguggcgcaagccuuuaaucccagcacucgggaggcagaggcaggcggauuucugaguucgaggccagccuggucuacaaagugagcuccaggacagccagggcuauacagagaaacccugucucaaaaaaccaaaaaaaaaaaaaaauacaaacaguucuaaggcaagaugaaugccaauugcccuuuauuugauuaguauuugguguaugcaugugucagaauaucacacugagcucgauuaauacguauaauuaaguacugggcaugguaguacagaccuuuaauccuagcacuuaggaggcagaggcagguggauuucugugaguuguaggcuagcuuggucuacauugugaguuccagaauaguccuggcuaugucagaaaaacccucuuuugaaaacaaaauacauucaauuaacauauuuaaugggaugugguagugcaaggcuuugauccagcacuugggagauagaggcagggggauugcugaguugagcuagccuagucuauauaguaaguuccagcuuaucaaaggcuacauagugagauacuguuucaaaauaaaaguaaaauauauguucauaaaaaaaauaaacuuccaaacacuugggaggcagaggcaugugagucucugagugugaaaaaguuccaggacagccagaggguauauaacagagagacccugccucuaauaaacagacagacagaaaggcagacagacggacagauaaaagcuuggcaacaugggucacuugcugccaagucugaugauggacuugaguuuucauucuuagaagcaacaugauugagggagagagcuaugaguugucuuccgaucuccauacacguuuaugcauguauacacaugaaaacuuuaauaaacauuggucugaugaugccuucaagccuguuacaugcaauaagccuuggguccuagacccaaaccacaaaguuuagaaaacaaaacaaaauguaaagguauuaaaagaucaggauggggggcuggugagauggcucagugguuaagagcaacgacugcucuuccaaaguuccugaguucaaaucccagcaaccacaugguggcucacaaccaucuguaacaaaaucugacgcccucuucuggagugucugaagacagcuaaaguguacuuacauauaaaucaaucaaucaaucauuaaaaaaaaagaucaggaugaugagccaacaaaagagcuaauaguagugaaaauuagagagcuggguggguuaaaagaucacauggugagcuggccaugguggcacuugccuuuuguuuuccaguaaguuauuuuuuauucacuuuacauccugauaguagcaccccuuccuccugucuuccuaguccuacccuuacaaauccuucccucuauuacccccuccccuucaccucaaaccccugccuuggguaccaccccauccugggccaucuagucugagcgggacuaaaugcaucaucuuucacugagucggaaccaggcaguccagguaggggaaggggauccaauggcaggcaacagagucagagacaguccccacuccaguugugcugggauucacauggagaccaagcugcacaugugcuuuaaauguguagggggccuggggccagcccaugcaugcucuuugguuggugguucagcuuugugagcaccagccccuuggcccagguuaguugaaucucuaggucuucuugucguguccuucaacccucuggcucacucaguacuacucccuacucuuucacaagacuccugagcucugacugauguuuggcugugggucucugcaucuguuuucaucugcugcugcaugaagccucuugggaaacaguuaugcuaggcuccugucugccagcagagcagauaaucauuaauagugucaggggauggcucuuucacaugggauaagucauucauuggccauucccucaaucucugcuccaucuuugucccugcacaucuuauaggcaggacaaagugaguacauaccauguucaucucucugggucuggguggccucacucagggugauauucucaaguuccauccaugugccugcaaaugucaugaucucuuuguuuuagcugucuuuguuuuaguugaacagaauucaguaguguacauguacucauuugggcagaggcaggaggauuucuguguuccaggccagccugaucuacagagcugaguaccaggacagccaggguuaugcagagaaacccugucucaaaaaaagcaaaaaaacaaaacaaacaaacaaacaaaaaacaaaaccaaaaugguuacauugugaccuaggcuagcuaauacggacucagcaggcugcaaaaagaauaugacaggagaggaugaauuagccuauuuccaaaacgccugacugcugcagucagaguuuagaaaugaaaugcauuggaaaauagauucgugacaauuaguguugagauuuuguuguaguuaugcugcuggccuaggucuuaugguuuguuuccucaucuguauaauggaacuagauuccuauucuguagauaccaacuuuuucuuuaggcaguugugauauguuauuaacuagaagcucuuuuucaaacagaaaaaugaaaaacgguucuaucugaaggaagugaaugucuacauguauuuggcuaauggcucagguaagcacagcauuggcuuggaggagaagaguggauuuuauggagggaaaagaaauacuaauuagcuuauggccagauugugucuuaugaaauaguagaugcuauguaaaaauauuucuugaucacagcuuaaaaucuaauguagaacuacaguguugucucccuugcagaaucaucuuuucaaagaaugggggguguuuguuagggaagcgacuagauuuuaggcuacugagagcucuauggaaagauucgagagaagugaaugagguggugcaugccugggaucccagccuugggaagcagagacaggaggccagccuggguuacacagugagcccuaggucaguugggucuauauagucauauccuuccugucucagaaaacaaaacaaacaagugaauuuauuaaugaaaacaguuguuuuguuuuuuuuuuugggggggugguguuggucagagccugacuccaaacucuuauacuuuacuaaaacgcccugaggaagggcuagggagauagcucaguuguucaagucuuugcagagcacaaagaucugaguaaaaaaacaaaccaaaagguagguauggcgaugugcacuugugauuucagugcuggggaggcagagccaggcggaucucuggagcaagcucaccagcuagucuagcuuauuuggcagcuuuaagccaaugaaagacccugucuucaaaaccaagauggacagcauaugaggaacaguacucaagguuguccucuggccaaccccccacaugcaugcacgcauuuacacacacacacacacacacacacacacacacacacacacacacacagccccuccaccuacacacaugagacacaacccuaaugacugccuuauuuuucuuguguugauacacuaagaaguuacuaaccugccuuuuuuuuuuccugcagcuuucaacauuuccaacaagaaccuuagcuucugggaugccccucugggaaguucuuauaugugcaacaaagagcaggugcuuucugugucuagagcguuucagaucaacaccuuuaaccuaaaggugcaaccuuuuaaugugacaaaaggacaguauucuacagguaagaaacaaaccuuacucacuccgcccuucugucacccuauagguggcuuuuccucugacucaagaggauucugugcaugaacauagagaaacaaaaaugccccucuugauucugauagaaaguucuuacagccuggaaccaauuguuuaacucuucauuuggcucaucauuuugcucaaagcagauacaguuuuugaaaaccugaaaauaauuugaaguauuuaagaauccuuuuuauggaacagguacugcccugggguugaauuuggguggggauggcacuuggagcagcagcuuuaaguaccuuacaucugccuucuugggaccaucuucgggaacauuuucauacccauaugaaaacaauuuggcuugauuuuucuuaagacccaagauacagagucauagcaaagccucacacccgugaauucaucuugcuagccagagugucauauagggagaucugcaaguacaauuuaguucaaauaagguguuuugaaguccuacuuuagaagggcaaaugauggccuucauuuggguuuuaaugaaauccucauguagaguucauuauacuguauuuguauggauacaaaagauguauuuggcauuguaagauuaagauuugcacgacagaaagaaaaguagagcaaauuccuuaagugacuuaugcuuuuaaaccaauuacuuaaauuggcaguuuguggagcagagcuuugcugagcagagcuuuccagucauugccauccuuucaaacaauuaauccagaggcuuauaaguaaacagagaugcuauguuuaaagugaauauacugugaaugauucggcugccuuugcagugcuagcaaauacuaccuuggcuuugcucaggccaaaagagaccuuuaccauucuuguggguagaaagguuaaucgcaacuugaaaaaauauccaagacuccauuuccuuugccagaaguggugacacgugcuuaaaaacauaguacucagcuggucaaggcagagucaucugggguucaaggucaucuuuggcugaaaagucacuuccaggcuaaccuggaguguaugagauccuguuucaaagaaacaaaaacagaauccaauuccuuucuguguuuguuuccuuauaacuuuaauuguuuugaucuuacaguagauuuauuuuugaaauugucuagcuccccuacaucauuauccuaauuuuaggucugauuuuguguuuaaaauguaaaaucauucuuacuacuauuugcaguucaggucuguuuuaucuaguuggcaguggccugagaugagccaauagucuuugccuaauuugaaagcuugggugccagaaagauauauaacauuuaauacugauauugaaugcaugaucuauuuauggaacuagguucuugguuguggguaacuauaaauaucacauccagguaaugcuuaaguguauucagggaggaaauagaauugcagucagguuggaguguugauuggauuuuauuagaucagacuacuugcuauaaauagaaaaaaauagccccuuugggcugcuauucugagcuagauugauaaaacauguaguaaacacacucaaauuaguaagagguccuaguuucuuagcucuuccacccacucaaaucacauauuuuaugccagggacagaagcuuuuugugaaaccguuccaacagugauuucucaagcuuugaggucaucucgucuguguggcaacuaacuguaccccugccucuguagcuugggaaccucccuaggcaguucauacagaugaguguggcuguguucuaguaaaacuuuaaggauaugaagauuugaauuucauguaacucccacguuucacaaaagacugucuuuuuuuccagucuuuuaaaauuauuuauguuauuuuuagcucuuuagccagguuuggcacuugggcuauaguuugcugaccccuauuguuaaugaacuccagggccagccugauuguucaguccaguaauacccuaauuucuauuuccccagagagagagauacacucucccacuuagauguuaaaaugguucuauagacauaggcuugguuagaucuuuucauuuaugauaaaguaauuuucucaucuuagaaguauauguaacacacugagugcauaugaugugauaacauuguuuauuuagagcuauaaauaaaucuggauuauucacacaaauaaauaucuucauauguauucacaaaugaaaggacaaauacacuuuaagauuguagcuuuaacuggucaucacuuucuauacuuuaucauaaaaauaugccugccuuuguugaaauuucuuuuauaagagcauuucugacuuuuaaaucagcaucuuuuacuuuuggauauuucuuuuugauuauacucauuauuuguuacacacuuuuucucaccuacagcccaggaguguucgcuggaugaugacaccauucuaauaccaauuauaguuggugcuggucuuucaggcuugauuaucguuauagugauugcuuaccuaauuggcagaagaaagaccuaugcuggauaucagacucuguaacacuaauccacaugugaucuguuacaaaacaauaaagcaaguacaaguucucgcaugcaauacuauugaagguacauuaguuacaguccugcucuuagauugggugguauaguagagcucaaauuaaaacaaaagaauuccaaauacuaucaacuacaaaugaaucauaugauuuugguuuuccugacuaaggaguuuaaaauuacuauggcaaaaggcauguacaaaauuaucugguucuguuucacuggucuggaauuucugaaugagaacguccaguguaggaaaaagccgguuucuucugccugcaugaaauugaguuuggccauccugauuuccaguggauuuguacuugcuccuuuugcauugcuugugacuuuuguuugcagguugacuuagcuacuucggccuuguuccauauuugaccuaugaaaaagguaucaguagauuugaacagagcccagagguaccaugcucuugccaguaaaauucuuuucccauguuuuugaauacauuuguauuuaauguggcugaaaugacaaaaacaaagguccuaaauuuuagaauagauguuaucuuuuuauuuaaucuuuaaaaaaaaaaacuggauguuucaaucuuuuaaauugcaagacacaaggcaauuccaacugggcauuucaaucugguuuuaggugcuuuagagauaauugcuaggcagugccaaaugaaggcauuagugcuuuguacccagaaauuggccucuacaugcagcacuaagauuaaugcagauuucucuugaaccuuccagucuuccuuguuggugguaaugugcuuuguucuuuccuuuuuuuccucaagaagaaauguuaguaugucuuagaaccuagguaacgaagugcacuuaugcucauaaaauugcuugcaccuaauccaaaagucauggucuugccuuaguccauuaacauggucuucauuuccaguuugcauugacugcuacagcacuuacuaauuuggcuuuuauguuuaaaugguucugugauaaucaaaacuuaaauaguuacuguucguucauugugguacuuuuguauucaguucuguacucagagauggcaccaauuguucauuuacuaugcaccaccuacugcuuauauaagagaacuaauaacucuuucagcccgauacuuaacacaucauguauuccuugcagcuucuaggacaucuuccauacauguauggauguguacauacauauacauguguacauacugguauggcccagcacauauuucuuaagcucugcagccauauauagaagguccuuguuauuuggggaggacagauuaaaugccuuucauucacaagaaaaugaagagcucucuggguuccaaaaugcugauguugaauacaugauauauaugcacacauauaggcacuugcauguuagcauguucaugucugugacugucuuuugaguuauauaggaguggcagagauugugucacuuuaacuuguugucgacuuagccugaaaaccuuacuaguucagaaucauacuccugacugucuucuggagcaacagggaacugcauggccaacuuaaaguacuuguuauaaaugaaccagaaaucugauuuuaaaauacauuuuucauuuuaauuguuuuugcauuuuguuuuguuaauccuuaaaggauggauugugcuuuuaagaauguaaguguuauguauuugucaugaaucaacaaaacagcuuuuaaaaaagacuaauuggaacaaguggguggcacuggcuuaaugcuguuaauguuucuaaacgauuuuacauuuagauuauauaucggauucauauugagauaccuccaaagcacuguuuuauagaaagaucugacuucaauaaauauuuuuguauuuuacaugggccaguuuauguaccgcuauuuacacuauuauuuccuauagacaauacacacugucuuuguaguuuuuguauuuuuguuuuguuuuacugguuuugcuucuugaugguaauauacucugucuggugugggauauuuuccacacuuuagaauuuguauaagaaacugguccauguaaguacuuuccauguuuucucuucaaauguuuaaagugcuagcugauguacguacgauaucucuucucagauauuugccugucuguuugcccaaaauugcuucuaaaucaauaaagauucuuuuauuucuuaaggaaauuugcucacauuuuuucccacugcuuaaaagugaagauuuuguauauuacaugauggcaauuaaaaaaaaacuuagaagugcuuaagaauagaaagagcuagauuguuuccaguauauguugucuguaugcuacucagucgaaagaaagucccauuuguaggguuugagugacacaaggauggcuauggcugcagaauaagaauuaccugaggcauguaucuuuaccuaggccucaggucuggaugacuuuauuuggcaagucuguuauaaggagagagagagacagagagagacagagagagagacagagacagagacagagacagagugagugagugagugaguguguguguguaagaaaaagcacuccuguggaaucuaacucacaaguaaauaguaauggaggauauuuauuucauagucaaaguuucagagcaucuucuugguacacuuuucuuaauucccaaauugagacuaacauuucauauccauaacacaaacugucucuuaaauuagcucacacuugcuuuucaauccccauguaauuugccagucauauuaguauguuuugcaagacaauguugcaguucaccuggcagguuuccccugagauccugagguaagccauggcacugcaguuaucacgguucucaaugccacugguagcuacugugggagacuuuguccaacuuucugaacuucuuuaggauguuagucucacagcuuucuucaucuagugauuguggggacuuuaaaauucugcuuuuucuuaccucuuugaguaaugccuuucauuucagaaaacuuaggcacacuuuugagucuuuuagaaagagucuucuaagaagccacauguuuuauuucaaacacauacuuaaacucuaugaauaauguaccauuuuacauugccugcauauugucaggaagaauucuuagaagauucaucuauuuugaauauuauaacauuaccaucuguuuguuuagguagauaaaguuacauugucuuggguucacgucucuucuacucaucucccuuucuucuaccuagaaaccaaaauccugucaguaaucauuaugucuugucuuugaaauuuguguagacauauauagauuauacugaauagcuucaaauauuuucuguauacacaugcauguacuuguguguguguauacuguguguaccuguaaaggcuacacaucuauguuaggguuuuugugugcuuuccaccuuauauuugauuuuuuuuuugagucagggucuuuauuaagguggagcuuguuaguuuugcuagaccgacuggccagagugcucguuggcuccagugaccuccuucccccagugcugcccugggauugcaggugcacacaguggaugcuuggugucugagcuuagguccucaugcuuacacaacaugcaugcacuuuacccacugagcuggcucuucagugucagcuucaaguaucuguucaucuucaugugauagauacacuugagauguuuggaauguagaucuaaaagaaaucuaaguacgguguuacauuauaggugagucaccaauuuacuguuuaaaaagcaaucuuaauuaguuuaguuugguuuuuuuuguuuguuuuuuuucuguguguguuuuuuuuuguuuuuguuuuuguuuuuuugguuuuuugagacaggguuacucuguauagcccuggcuguccuggaacucacuuuguagaccaggcuggccucgaacucagaaaucccccugccucugccucccgagugcugggauuaaaggcaugcgccaccacgcccagccuuaauuaguuuuuaagagaaguuuuauauuucuuuuuuuauuagauauuuucuuuauauacauuucaaaugcuaucccgaaaguucccuauacccuccccccccacgcccugcuccccuacccacuuacucccacuuggcccuggcauuccccuguacuggggcauauaaaguuugcaauaccaagggccucucuucccagugauggccgacuaggccaucuucugcuacauaugcagcuagagacacgggcucugggaaugguuaauuaauauuguuguuccaccuauaggguuggagaccccuucagcuucuugggugcuuucucuagcuucuccauugggggcccuguauuccauccaauagaugacugugagcauccacuucuguguuugccaggcacuggcauagccucauaggagacagcuauaccagggucccuucagcaaaaucuugcuggcauaugcaauagugucuggguuugguggcugauuaugggaugaucccugggugggguagucucuggauaguccauccuuuccucuuagcuccaaaccuuguuucuauaacuccuuugauggguauuuuguuuccuauucuaaggaggaaugaaguauccacccauuggucuucccucuucuugauuuucuuguguuuugcaaauuguauccuggguguucuauauuucugggcuaguguccauuuaucagugagugaauaucuaaugacuucuuuugugauuggguuaccucacuaaggaugauauccuccagauacauccauuuguccaagaauuucaugaauccauuguuuuuaauagcugaguaguacuccauuguguaaauguaccacauuuucuguauccauucuucuguugagggacaauaauauucaaauaauauucauaauauaauauaauauaaauauaccucauuuucuguauccauucuucuguugaggggcaucuggguucuuuccagcuucuggcuauuaaaaauaaggcugcuaugagcauaguggagcauguguucuuauuaccaguuagaacuucuucuugguauaugcccaggagagguauugcugaaucuuccauuaguauucuguccaauuuucugaggaaccuccagacugacuuccagagugguuguauaagcuugcaaucccaucagcaauggagaaguguuccucuuucuccacauccuugccagcaucugcugucaccugaauuuuugaucuuagccauucugacuggugugagguggaauuuuaagguuguuuugauuugcauuucccugaagauuaaugauguugaacauauuuucaggugcuucucagccauucaguauuccucagucgagaauuuuuaaugggguuauuugaauuucuagaguucagcuucuugagcucuuuguauauauuggauauuaguccccuaucagauuuaggauugguaaaaauccuugcucaaucuguugguggugucuuuugccguacauacagaagcuuugcaauuuuaugaggucccaguugucgauucuucauguuacauuacaagccauugcuauucuguuuaggaauuuuuccccucuacccauaucuucuaggcauuucccuacuuucuccucuauaaguuucagugucucugguuuuauguggaguuccuuaauccgcuuagauuugaucuuaguacaaggagauaagaauggaucaauucgcauucuucuguaugauagcugccaguugugccagcacuauuuguugaaaaugcugucuuuuuuccacugguuagguuuuagcucccuugucaaagaucaagugaccauagauguauggauucauuucugggucuucaauucuauuccauugaucuaccugucugucauuguaccaguaccaugcaacuuuuaucacaguugcucuguaguacagcuuaaugucaggcauggugauuccaccagagguucuuuuauuauugagaauaguuuuugcuauccuagguuuuuuuuuuauuauuccagaugaauuugcaaauugcccuuucuaucucagugaagaauugaguuggaauuuugaaggggauugcauugaaucuguagauugcuuucggcaagauagccauuuuuacuauaucaauccugccaaucaugagcaugggagaucuuuccaucuucugagaucuuugauuucuuucuucagagacuugaaguuuuuaucauacagaucuuucacuuccuuaguuagagucacaccaagguauuuuguauuauuugugacuauugugaaguguguuguuuuccuaauuucuuucucagucuguuuauccuuuguguagagaaaggccauugguuuuuuuuuuuuuuguguguguguuaauuuuauaucuagcuacugcacugaagcuguuuaucagguuuaggaguuaucugguagaauuuuuggggccacuuauauauacugucauaucaucugcaaauagugguauuuugacuucuuccuuugaaacuuguaucuccuugauguccuucuguugucaaauuucucuggcuagaacuuccaguacuauauugaauagguagggagaaagugggcagccuugucuagucccugauuuuagugggauugcuucgaguuucucuccauuuaguuugauguuggcuacugguuugcuguauuuugcuuuuguuauguuuagguaugggccuugaauuccuaaucuuuccaagauuuuuuauccugaauggguguuggauuuugucaaaugcuuucucagcaucuaaggaaauaaucaugugguuuuugucuuugaguuuguuuauauaguggauuauguugauggauuuccauauauuaaacuguccccgcauuccugggaugaagccgacuuggucaugauggaugaucauuuugauguguucuuggauuugguuugugaggauuuuauugaguauuuuugcaucgauauucauaagggaaauuggucugaaguucucuaucuuuguuggaucuuugugugguuucgguaucagaguaauuguggcuucauagaauaaaguggguagaguaccuucuguuucuauuuuguggaauaauuugagaagaacuggaauuaaggugugauagaacucugcacuaaacccaucugguccugggcuuuuuuuuuuuuuuugguugggagacuauuaaugacugcuucuauuucuuuaggggaaaugggacuguuuagaucuuuaaucugauccugguuuaacuuugguaccugguaucugucuaggaaguuguccauuucauccagguuuucuaguuuugaugaguauaguugugguaggaucugaugauguuuauggauuuccucaggucuguuguuaugucucccuuuucauuucugauuuuguuaauuaggauacugucccugugcccucuaguuagccuagcuaaggguuuaucuaucuuguuuauuuucucaaagaaccagcuccuuguuugguugauucuuugaauaguucuuuuuguuuccacuugguugauuucagcccugaguuugauuauuuccugcugucuacuccucuugggugaauuugcuuucuuuaguucuagagcuucuaggugugcugucaggcugcuaguguaugcucucucuaauuucuuuuuggaggcacucugggcuaugaguuuuccucuuaggacugccuucauugugucccauuaguuuggguauguuguggcuucauuuucauuaaacucuaaaacgucuuuaauuucuuucuuuauuucauccuugaccaaggaaucauugaguagaguauuguucaguuuccacgugaauguuggcuuuguauuauuuauguuguuauugaaaaucagccuuagucuguggugaucagauaggaugcaugggauaauuucaguauuuuuguaucuguggaggccuguuuugugaccaauuauauggucaauuuuggaggagguaccauguggugcugagaagacgguauauccuuuuguuuuaggauaaaauguucuguagauaucuguuaaauccauuuguuucauaacuucuguuacuguccacuugucuguuuaguuucuguuuccaggaucuguccauuggugagagugggguguugaacucucccacuauuauuguuugaggugcaaugugugcuuugagcuuuacuaaaguuucuuuaaucaauguggcugcccuugcauuuggagcauagauauucagaauugagaguucaucuuuguagauuuuaccuuugaguaugaagugccccucgucuuuuuugguaacuuuggguuggaagucgauuuuauucgauauuagaauggccauuucagcuuguuucuuuggaccauuugcuuggaaaauuguuuuccagccuuucauucugagguagugucuguccuuuucccugagguggguuuccuguaagcaacaaaauguuggguccuguuuguguagccagucuaugucuuuuuauuggggaauugaguccauugauguuaagagaaauuaaagagaaguaauuguugcuuucuguuauuuuuguuguuaacguugggauucuguucuuguggcugucuucgauuagguuuguuaaaggauuucuuucuugcuuuuucuagggugcaguuuccuuccuugugucgguguuuucccuuuaguaucuuuugaggggcuggauucauggaaagauauugugugaauuugguuuuaacauggaauauuuugguuucuccaucuaugguaauugagaguuuucuggguauaguagccugggcuggcauuuguguucucuuagggucuguauaacaucuguccaggaucuucugucuuucauagucucuggugagaagucuggaguaauucuaauaggucugccuuuauauguuacuugaccuuuuucccuuacugcuuuuaauauuauaucuuuauuuagugcauuuguuguucugauuauuaugugucaggaggaauuucuuuucugguccagucuauuuggaguucuguaggcuucuuuuauguucaugggcaucucuuucuuuagguuuuggaaguuuucuucuauaauuuuguuaauauuugcuggcccuuuaaguugaaaaucuucauucucaucuacuauuaucuguagguuuggucuucucauuguguccuggauuuccuggauguuuugaguuaggaucuuuuugcauuuuccauuuucuuugauuguugugcucauguuuucuauggaaucuucugcaccugagauucucucuuccaucucuuguauucuguugcugaugcucgaaucuaugguuccugauuucuucccuaggguuuuuaucuccaguguugucucacuuuggguuuccuuuauuguuucuacuucccuuuuuaggucuuguaugguuuuguucauuuccaucaucuguuugguuguguuuuccuguguuucuuuaaggacuuguaacucuuuagcaguguucuccuguauuucuuugaguuauuaaagcccuucuugauguccucuaccagcaucaugagauaugauuuuaaaucugagucuugcuuuucggguguguugggguauccaggacuggcugaguuggaagugcuggguucugaagauggugaguggucuugguuucuguuaguaagauuuuuacguuugccuuucgccaucugguaaucucuggagucaguuguuauaguugucucugguuggaucuuauuccuccugugauucuguuagccucugucagcagaccugggaguacagcucucuccugagucucaguggucagaauacucucugcagacaagcucuccucuugcagggaaggugcacagauauguggcauucagacccgccucuuggcugaagaugaaggcccgaaacagggccagucccagaagauguguugccucugcagucugcaugcucaccugcacagacugguccccaagggacaggggacaaaagauggcucucucaccuucucagguggucagagcccuccgggcagacacuucuccucuggcggggaagguaccccggaugucuggagcccgaaaaugggucugucccagaagcuguguugcuucuguaguccauacucucaccugugcagacuagucucugagggacccgggacccaagauggcucccuccccugcuccgaaagagcccucccagguggacaccucuccuuugguggggaaagugccuggauguguggagcccaaaaaggggucugucccagaagcuguguugcuucugcagucugcucacucacccuuugcagucugcgagcugaccugagcagauuggucucugagggacccgguacccaagauggcucccucugacaggacuuuuuguuuguuuguuuguuuguuuguuuaacaguguuuuuauuggaacucacucugauauggaacucaaaagauucucgugccucugcuuccugagugcuuucuguugcuccuguggucugacaccuguucacaaggguggguguuucucagugauaggacacuuucuuagcaugugucaggcccugaguucaauuugcagugauggaggugagggugcagggguggggguggagaaucucgacagucaggcacaaugcuacacacuccuuuauuugcagcacuugggacauaaccaggcagaucucugcaaguucaagcccaaccuggaauacauagugaguuuuaagucaaacaagauggcacagugagacccugucucaaacaaaaaaaaucucccaaauacaguuuuuuuucuaggaacauuuucauuguaguauuaaguguacauuagucaaauagcugcugcacucaaauuggccuacauaacgaguauuuuucuucaggacacacuccuauuaacaugaacuguuuuagugguauagcacauccauaaucagcacuuggaagguggagacacaucaggauuucugggucaucccuggccacauagcaaaauugaguuccauuuggacugcaugagauccuguuucaaaaacagcagagaacagaguaaaaaaaaacuuuuuuuuuaaaaucagauuuuguuucaguuaccuacaaauucuuucaaguugaauuuauaaaaucaauaguuauuauaaauuaguauuucauauacuaauugugcauuuuaaguaaaugacagcaucuagaaagaucuuuguauuagugaauugccuuuuugauuugcucugggaauauuugucuuacaugaaagccuuauuggcaguauuuaugaaagucaucucaguauuaggucaaacacccaauuugggaaagagaggacuguugagacuuuuugccaaaauaagaaauuaaucuacuaaugaauuuuuuaaaauccaaggcauaauauuuuaugguauaugccaccaaauaguuucuaggcugggugguaaugugggaaauugaaggggcggaguuaacugggaacucuuuaguaccaacuguccucaagucaaauccagcaucauagacucucuggauucuuaauagaacacaguuuaaaaugaccaucaauuuggcagccaaagccaaugucaaacuuucuauaaacucuaggauugcaucuuguuuucagguacuucuccagaggcuggcagucagaguagagcuugguacauuuugugauugcagagcauagucagcacugcauugcagccuccccuuucuuuuucuuuucucuuuccuuucucuccuuuuuuccuguauaugaguuuuugccugugcauauguauguguaccacuuguaugccuuuugaauaaagaagaaggcaucagauccccuggaacaggaguuaugaauaguugugagcagcuaccauguggaugcugggaaucaaacccagguccuccgaagaacagcuagugcugcucuuauuaacucuaauccucuucauuccuaucuuagcauaauccuaauaggcuuacuuaacuguguaauuuaccaaccucugguagaguccaaccccuggaagaaaacauuaagcaacaugaagcaagggaguggguaauacuaguaagugguguuucagcauccugauucucuuuguaugucuuugcaagugucuuaguucuccauccuucccuguagucauauuagacuuuucaugaucaguucuucuggaaucuuauuucuccuagguccuaggaaaccuucuaucgaacaucuucaacaugucauuauuagccuugcucuuuaaaacauuuuuuuuaacuaaauauaaguaucucuucaaacuggagaugguaauaaaagacccuaacuucuaaaaaccuccaaagucugcuuucauaaaggggagcuauuacuuuguguuauaauguauaauguauaauacucuguauuauaauguauaauauauaaugcuguucauuagccuuguucuuuuuaugaacauuuaucucaucuuacagacaaauuuaucucuuccagaugcuaccuuuucuugaagucccuauucuaagcaccccgugcugucuuuuucuuaaucuuaaauuuauaaagaagacucucuucuuaguccuugauguugugacugaucguuagcuuucacuugccauucaguugucucugcagcaguuugacucauaacucauccugcacauugcuagauccuauaggcauuguuuuagaauucucuaacauguuaaauucuucucaugacaaugggagcucuccccuuccugagcugugacaccaucuucuaccugccuuuccuacgucuauuuuuauaccuuagucccucaaauauuaguauucuuagggguuuucucucuggucccuuuucaguuuacucauuccaguuuauugauguuuuguuuggaaacuagaugucuuguuuucuuaguguuuuaaaaaugcuacacagacuauuucauuaugaugguuucccacacacucauucuugcugcugcuuuccccucccccucuccugcuuucacguuacauguauuacacuccuuccuuaaaaauccuuuucucagucugucaaucuaguuucaugacuacauacaaacuaaaauacaguaucugaguuucagaaauugggguauucgucuuugagucugccuuauuuugcucaacaugcuaauauuaguuugaucaauuugacuuaaaaugguaugauuucauuuuuauuuauagccaaauaaaaugcuauuguauauacacaccacauuuuaucuagucacccuuucauagacaucuagacuguuuccuacugugaauuaguuuacuacuauguacaaugcagcaguaaauacagauguacagguauuugugguaggauagaccccuuuagguauguacucacgaaugguauagcuaaggacacagacaucuuaaauucaaccccaaacugaguaucucccuuuucuacauacuuccuuuuaugaucuaucucacuuaucuucaguaacuauaaaugcaacaugacuaaaauucacauuucuuucuuuuggauucccgucauggugaagggcaccagcaucugcagaaccacugaaguguggaacuagaaaguauccuguuauugcagcccauuacacuccucacauucauuuuugccaauuuuaccuucuaaauggaucuguggucuccccauugcaccuacacgucauuaacccaguucaggaauauuggucacuugguuguuagcgauagagguggcuccuagcuuacuacuuguauagucuuccaucugcaacucugaaguguacccugcuugaauuccuguuuguuuguuuguuuguuuuuccauugggauaagacagaaccacugaagaguguacuuuugugagcuggucuuaaauacacuuuuucuggcuuccaucaauuguucuaugucaccuuccuuggcauugcuccugguguuuuuauguuuucuuacuguccauguuuuugucugcauuguauuuuguuugcuuuuauuuguuguuacuguuucuguuuuuauuuuuuuguuuuucucuacagguuucucuguauagcccugucuguccuggaacucacuagguagaucaggcuggccacaaacucagagauccaccugccucugcuuccugagugcugggauuaaagguguguugcaccgccaccuggcucucugcacuguuucuuacaucugcagugcccccacuaucugcauaguuaguuauaauuaauuaaugguuaauuguuugucuuagaacacaucaaauguugccuuuccaaagugucuuauuuaacuaagcugaguugaccgaaucccugaaauaucuccaugauucuuuguguauugcuugccccaccauagcacaucuugaauuuguaacuacugauuucuguguuugacucucacaccagauuacauaucuuauuuuuuauguuaucauacagcauuuuauuauaucauucaauauauauauugcauuauauguucucauguucuucuuccccaguacuuucccuguccuuucuuuccucuugcugcuuucaggucaucgaaaccuuuaccuguauaucacaucuguaccauuuccuuccucuuuagaagcucuuuuaccccucucacauucuccuuuguauuuauacacauuuaaaucuacauauaaaaacugauauuuguguuauucuggcuuauuuugguuaacauaacuucauuugcaguuuuuccagcaaaugacacaauugcacuuuucuucauggcuauauauauauacauauauauauauauauauauauauauacacacacacacauauaugcauauauaugcauauauguguguguguguguguauucaguuuccuuaucuacuuacuuguuggacaucuggguuaggucuugauauaucuugugacuagugcuggaauaaguguagaugugcaaguaucucugaccuugauuucauuuguuggauaccuacucaggagugggauagcuggcuuauaugguaauucuauuaguaaggcuuuuguuuugagauacuaaauuauuuucucuggauacauaaguaguaguggaacuccuagauugcuauauacauguuuuuucuuuuuaauuuuucuuuucuuagauuuuguuucuuugaaaacuugaaauaccuauauauucucaucagaacucucucaccuuuuauuuuccucccauuccuaucaacgugccuucuuccuggcuuguccuuuuuccagauuccucuccuccccuccccuccccuccccuccccucccuuccuccucuuccuccuccuccuucuccuucuucucucucucucuccucccucccucuuucuuucuuucuuucuuucuuucuuucuuucuuucuuucuuucuuucuuucuuucuuucuuucuuucuuucuuucuuucuuucuuucuuuuuuguuuuucgagacaggguuucucuguguuccccuggcuguccuggaacucacucuauagaccaggcuggccucaaauuuagaaauucgccugccucugccucccaagugcugggacugaagguggugccaccaugcccgacuucuuccuuccuuccuucuuucuuucuuuuugaggaaacuugauacugauuucuaugguugcuaaacuagaacauuccuaccaguagugaauaaauacccuuuuuucccucaacuacauaaacagcaugaagccagcagggccagauuaaucaucuuuccuuauuacuaagugagcucacauucuaugcauugagcucugugucugcuuuauauacguguuuauuuggugaguuaguacucucuaauaucgaggauucaaugucauaguuagcucuggaagcuccaggcugaucaagggaaagcaaauuucuguaagaagccugggagugugugcucacuauacacauuuuuccccccaaugacugcuuuuuaugaaggggaacugcauagaaguacuuguuuuuuguuuuugcuugaaaaaaaaaaacuuuuggugcaacaucucaugaaauaucauaucacuacugauaaugaaugccaaugacuugccauuuugauguaaaaaucuguaugcagggggaaggguugucauuuuaacuuaaauugagacauaugaaaugccauuguuucuguucucaauuguccuuucuccacauccagcucaagacugcagugcagaugaagacaacuuccuugugcccauagcggugggagcagcucugggaggaguacuuauucuaguguugcuggcuuauuuuauuggucucaagcgccaucauacuggauaugagcaauuuuaguaacugcaaucugauugauuauauuacagaauacauacaaaaaaacaaaguugucuuaccugucaguguaugaagcacuuugcuccuuaagacagacaccuuggaacuuucauucggaaauuaguccccgaaguuugagauaagucuuuuuuugaauuuuuuuuucucugaucugcuuaaaaugcagauuggcuuuaaaaagaaaagaaaacaaacacacauaugcaauguuuuaaggucugucuuaagaagcuuuggccaaauugggauccuaaccuaagaugccuuaaacuuauuaacaugaccauuauaagaaaagauauauggaguuguaucuuacuggaauuaauaaacacugcuugaccaccgguguucuguuucaauuuguaacagcuguccuaauuuaaacucaccacuacuagcuuuugcauauacuuaaaauaccuaucagauauucacagacuugguuuuuggagggaugaaguagagaguccguagggccauccacaguuuguuuuuguuuuuuguuuuuuaaauaagaacugaagaggaaccagagaguguuuguuuguuugguuuuuugaaacaggguuucucuguguagcccuuguccuggaagucacucuuuagaccaggcuggccuugaacucacagagauccaccugcuucugccuccugaaugcugaaauugaggugugugcuaucgccacccagcuaaguauuacauuuuuaaagguuaugacuugaugucuuuugaguucaaguuaaauaugaaauugauucucaaacuugugauuuuuuuacauagguuaaaaacaggcucagaaaguuauaacagagcucagacuggcuucuuaauuagaagguuuuuuuugggggggggggugguguuaaaagaauuugucuguagcucuggcugaucugguaguugcuauguuguccgggcuggauucaagcucagauccaucugccuuggcuggcuaaauaagggucacaggcauguguuaccaugcccaucccgggcuuuuaagaaaaugguuuuuuuuuucagcacuacagacggaagggguucaaacaguuaaccguuccccucgcucucguccucuuuggaugccugguuagcacugaaggauagaggauucuaugaacuaauuaggacagauuguguuguguuucucuaccucaucuuguugaucucuggagcauuaaaaucuauuuaguguugucaucagacugguacuuaugaaauguaagcuaacagcaaucucagaagggaggcaaugaagcacagcaguuaugcucuugcuucuccaagacagccgcgguggggcacagcucugaggggguggagaaagaggcuguuggcauccaaaugagcuaggcagauaguccagauugaaacauuuuccugguaaaagugaagugcugauggaauacauaaauaaaucaagggauuuaacagaugagaccauguacacacugaaaugaucauuaauucauuuuaauguguauauuggcuugcucagaguuucugucacguacuaauuaacagugaaaauguguuuagguauccagcugucagugucuguuaaggagcuuucugaaaaacaguaguccuccaaaaaaaaaauaggcuaauuguaguuauugaaaucgacauuauguuuucagaaccaugacaacguuugugugagugacaaaagugugagagaaaaaucucagauaacacaaaacauuauaauuuauucauggcucuagccuuguacugaaaagaccuuagugauuagguacuccuuaaguccagagcugugugaaaagggaugugacuuccucaauguuacauguucagcagcaaugaaaccguuaguauuuggauuaaauucucaauaaaauguaaucauucaauaguaaaauguugauugauuaaaacuugagcuccuggguccaaagguggcauuuugagagcugacuugcuucagucguuuugaaauaaugaaugcaggccuucucagucguccacuaagacacaacuguuaggauuccuguguugucaaaacucaagccucuuuggaucauacacacaggaggaaaagggaaggggcugaguaauuguggcucacuugcugugacccagguucuuuaaaacauauugaauucucaaguacuauauaauggaagcauucguggaagggagggaggcccagcuuagauaacuuggcaguuucccuaaguuaguuauuacuucagagucugauuuccaauucaguuacgucugggggucagaguuuaguguccacauugcucaugcugugcucuggugauuccauaggacggacucacaugccuuugaugcugcuauucuucaccacgaccaucaguuaguuggaaagaauuauuuguaacccgugagcuaccuaaugcuuauguggaaaaaacaaaacaaaacauuagcuggagagauuacuaagcauauuuauuuguuggucuuguggaggaccugaguuugacucugagcacccaccuguaacuucaguucugcggaugagaugcccucuucuggccuccagggcacuagaugcaugugguccauagccauacacauaagugaaauaccugcauaauaagaucaaauaaaucuuuaaaaagcuagaacccaccuugauccugucuuuuacuugacuagaagcccccaccccacccccaugugcuugguauggaacccaagagccuuaggcaugcuagacaagcacucuagcacugagcuagcuucucuuucccacuuaacacuuuaagucuagauguggcaggggggaaaggaagaggagaugcagaggcaguaauuucccuaaugccaucaggcaacucugaaguuguauaagcaaguacuauaacucaauauuguauaagcuuaauucagaguuugaaccauuucccaguuucccuuucuguacugagaauuuuuuuuuuuuuuacaugaaaaguuaaacaguggucuugcugugaaauguucggguggauguugauuaaguaauacuccaaagaaaaugauagcacgugucucugcugucaaugcuucauguuugcuucuuccucccauuguauucuuuacuaauuggcucucucugcugucucucuguucuuuucuaacagcugaggaaugugcugcugacucugaccucaacuuucuuauuccuguugcaguggguguggccuugggcuuccuuauaauugcuguguuuauaucuuacaugauuggaagacggaaaagucguacugguuaucagucugucuaaucaagccagucucgugcuuccauuggccaaaagccaggaauugcugugcgauaaaucggauccacagacugacuucagugaguugcaagcuggcuugggcaugaguagaacuuuaaaaauggauuaggaccagucuuuauuucugccauuuucuucucuguucauuaagauguaauuuaaagaaaacuuacaacuuagacugucuuuuuaaaguacauaauuuuaagcaucuggauccaauuuuggaagcauuucuaccgaaguauaauuuuauauguugcacuuaguuguauuuugcuacuuugauguuauuugcaaaaucagaacugaaagaggaugucacuugcuucccaaaauaaguuuugaaacguuauaguucaucuucuuugaagacaaacauaaaacuuagcucauaaaaggaaugacuuucuguaccuucuaaggagaauuguuuaaaucuguguaauucuguuacuuuagaaaggggucucggggcuggagagauggcucagucauugaaggcuaggcucacaaccaaaaauaaaaagaggucugggauguaacccagugauacugcaugcauauaugaaguucuggguuccagccucacaacuuaaaaguagcaucuaaaacagacuacacucaacagaaaaaucugccuauuucuccauuacuuucagagcuacuauauuuuaagaaggaauuguuugcuuauuuuuuuggcuuuggcaguuugggguguauugauuauauuaaaccugauauuucuacugcaagaugaag

SEQ ID NO: 9460 - RNA, 3922 nt, Mus musculus
ucuuuaagcuguuuauucuguuccguggacuggaccguccuuggaacaauacuguuaugaaaacguuuuuaaaugaaagaaaugaaagaacaugcuccuuuuugaugaucuuuugaugugucagcaaggcuaauuaaccaaccuaaaacaagccuaguuacugugaugguauuguucaauuguucuugaaguucguuaaucuguugacuuuaaggaacaggaguuaugccaggugaacuguggucagagugcgacuaguucaaagguauuuagaaaagaacugcagcucccugaagaagaaagacagugagugggugggccaaauccaacucauuggcauuuuugagaacggaagcuccugugagaaucugauggcagaaggggcuccagcagucuaguugagcgucgcaaugguccgaaucuacuuugcuuuugucucccuggcaaguacuuaccugagacucuuuuccaaaugcccaaaccaguaaggcaaagcaaguuguugguuaaaaugccauguuaaagaacaugcugguguggcaggaaugguaggaugugcuuggaguacuagcuagucagggcucuccggcagggggauuucuuggaccuaucuaacauuucaaaaagccagucuggacaauggagugagaccaggucucaaauaaauaagaaaagagaggaaaaaaaaaaagaaaaugugguguucugagguacaacuuucauacuaaccacaugagucugaugaguguggcuuaaaaauguauuuguuaagccuuuuucuuaugcuagccuuggauuucugauaguccugcuucagacuccuuagugcugggauuauaaucaugugcuaccaugcuugacgagaagauuaauuaauuuauuuuaaaaauaaauugugguaaagcuauagaaauucaguuuacagagcuauuuaaacacugggguccugggagggagguagaggcagcucaagaccauccccaguggcccuggcuguccuggaacucacucuguagaccaggcuagccucaaacucacucuguagaccaggcuagacucaaacucacucuguagaccaggcuagccucaaacucaaaaaucccucacagagauccuccugcaucugacucucuagugcugggauuaaaguuguuuaccaccaggccccgucaauauugucuuuuuuuuuuaaaucauaaauaacauuugugauuuauacacacuaauagacuucagugugaccuuuuucauacauucguagggcacacuuugauuauauucacuauauucacagggucucucuuuacaugauucauuguccuaauaccggggaaaggguuuaucagugaucuuccagucaggcuggauugugcacacacuuaaucccagcacuggagauggaggccgggggaucucugugaguucuaggccagccuggucuauaugagauccaggccggccagggccauguagggagacccugucaaaaacaacaacaacaacagaaugcagauuugugguuaugaauauuuggguuggagugggggacugggguagaauuaacuaaaucuauaaaguuccacagaaaaauccucaccagugucucauggaauuucugagaauucacuaaacugcccccacaaaucucuucuuaagcuuauuuuuaaauagagccacagauuaaagaucucccaaacugcaugacuuugaagcuauguuuuagagcuucucuuugucuuuuuauuuguuuguuuguuuugaaacaggguuucucugugcaaacagaaccuggcuguccugaaacuugcucuguagaacaggcugaccucaaacucacagagaucugccuaccucugccucuggagugcugggauuaaaggcaugcgccaccacggcuuuuaguacuuuucuaagugcaguucaugggccucagcaucagaaucaccccagguguuuguuuaguaaaggaauaagacaggaugggaggagaaacccugcaauccaagcuacuaggcaugccgaggcagaggaaucauauguucaagugccaccugaacuacagcuauacuuuaaguguaaggucaaacuauuaggcaacuuagugaggauuaaaccucaaacaaacaguaagcuuguaggaaaaagggcauuuguuucagagucucuaaggcaucaucagguaaaauaaacaaaacaaaaacuacuuccaaaaucccugagaagagugugugugugugugugugugugugugugaguguguguguuuugggaagcaacauuugaaggucauugcuuuauuccaacucuggaguuuuacguuaauguuguuuuccucuguuguuuugagacauguuuguuuacuguucacuuggcaagcguacagaauacggguuaguaugaacucauuagagaacauuaacuguauuuguauuccagauagaaaaauaucugggaguuuauguauuuuguaaagagugucucuggguaguaaugggagugaucuugauuuccuucuauucuuauuucucucucuuuuuuucuuccucuauuuaaaaauaugcuuccucuuucugacuucaauuuccccaucaaggaaagagaguguuauaacuuugaacuucaagagcauggucugaucuggucguuaaugacuccauacccccuagcuucccuauccaccuauaguauaaacuguguagguggucucuauacuugaauaaucguguauuauuuuuuacauauauuuucauauauaaauuuacauacauauauaucuugagaggccuagcagccguuuuguugccagaaaaaaugaugcuguuuguucucaaggaccuagaauagaaauaacccacugucuacaagcaucaaaguuccuccuuuccugcuagccuuaaaaaaaugcccuccucgcacaacucuuucuaguuuaauaauggcugugaaccaaaaagccagggcguggccacgccgcccuccugcccggacaucaccgccucccucucaguuucuaagcaugcugauuggcugaaaggaauaaagaaccccgccccuggucuuaugacuccagcugaagcggcgaguccaggcuuuugcggugccugggugccucggucgguggucucucgugcuuucgcuuccgcagggcugcgaggggauucguuggaauugucgguccgguggucgccuggccugagggaucacgaugugccucucuccgguuaaaggcgcaaagcucauccugaucuuucuguuccuaggugaguuuucgggcccucuggugucuuugagccgggcccgggggaucggggaguuucaaaggccacaaccugaaagacuggucuuugagaaggcuuugagagaccgaacagcugacacugggcggcggcggcccgaggcggcggcggaggggggacgcgggggggccgggagggggggacacacgaccuggaggaaggccuggccgugggauggcccgccaggagggccucugagaguaacagcggggcaaguaaggggacgagggaggacgacgucaagggauuaggcaagaggagcgcagaguucuagaccucugggcuagagagagcaacuuggaaaaagagucggggagcagacaccggggaggcuugguuuccuggaucaggggagaguuuuaaagauggugaaaaaaaaguguagagcgagaaaugaauuuggaacggaaggcgcuguacccucgugaaauuauuggggagggggagggcauagggggguagguagauaggacaguagggcccaagggacagagacaccguuuugggagcuuuguagguaggacuugaggcugggagaagcagugauugaagagcuaaggaauggccuuggaguuuugagagugaagggauacacacacacguacauacauauacauauagugacu

SEQ ID NO: 9461 - RNA, 6028 nt, Mus musculus
ucaggauuuucuaguucuauuugucuaagaacuucauaaauucauuguuuuuaauagcugaguaguacuccauuguguaaauguaucacauugucgguaaccauuccuuuauugagggacaucuggguucuuuccagcuucuagcuauuauaaauaaggcugcuaugaacauaguggagcauguguucuuauuacaugauggaacaucuucuggguauaaugcccaggagagugguauaucuggauccucagguaguacuaggcauggguuuuugaaacuccaaagccuacucccauugacacaccuccuucaacaaggcgacaucuccucucccaaaauaguucacuaauuugggaccaaauauucauccauacaagcacauggggcuauucuuaacuaaaggagcacagagagcucaacuucagcaucuguugucugggaugcuaccucuaggcaagcuuacuugcuucccugaaacucagugggaagaagucaggucucccacaacaaccuguauccuugguagucaugcuucacccaugaggucccaaaauaacaaaagugucuccauguugugagccagggggcaugaaagcaggggaaagcuucacggaguggacuggauugggaaggaacccucagaaggaggacaggaauuaauuccagcugagucuugugucucaggguaucugcuaggaacuuuguuauuucauuucauuuaauacucugcucacaaugauacuacaagauagauagcugugccaccaaugauaaugacaaaauaaaauaaguacuacuuacuucauaguaccauauaucagguaccauuccaaccuaucaacacuaucccuuuuaucuuguuugacuuguaaaaguccucaaagauggggcaacuucacucugaugacacucacuaacuagccccucccaauccccaaccccauacccacauaaacuggaauccucuaguucuuuggagaguuaguuaugucaaacgauguuuugcuggggcacacaggugaaaggacgucuugcuaaggcaaacacgugaaaggacacuugaugaaggaguauaaauaugcccccacagaccagugggagaugagcagugagccuugguuugguuugcuuucuucgcucaagacacgaaugcauuggugucaccuuacacagugcuguugagcugagcuggugauaacgcugccauugagagaaacucacccaagaauggcucaugagguuccucgccgccucuguggccucuccuaaagccagaugaagagccuggcaguuucuucaggauugaacuacagcugccuggcaucugccugccuagaggacgggucugccgcugcugagucaugauguuugcuacaggacugaaaugcugcccaagaagaccaagcuuguccccaaagaacuauugcugaacagguccacuucccccuauucuaauaacuuuugucuuccacuaccucuugcuggguggugggcuagagaagagguugaacccuaucaaaauuagguugcaaaaaauucaugccuacagguggcacccaacauggcuuaggcauaauggguaacugcuuuuuuguuguuugcuuuucaaaucauuuucuauucuugguuuuuuuuuuacaguacuacugucuugcaugcaggugaagccccagaccuuguguaugguugggagauggugcccauugucacuguccccuguuccaugucaguguuuagaucuguggcaggaagggaccagccaacaggcuccacacaacucaaggccugaaggaguggaccaggcuuucuguccuggggugccuggguacauugcuucuccacaccuugucaggacccauggcagaaaugguccagaggccuuugcugaagguguuuccuugaucccauuuccucauuucuugggucuaugaugcuagggugagcaucaguggugcucagcugucucucuguccucgaugugcccauaugcacccagcuagcucagagaggaggcaccaggugucugggguguaggguuggccacguuucugcucuugggggcaccagcggcuggcacccggaccugcuugcucugagccccugcuggccuccgucauuaccuucuuugguacaaccaagccugccaacugugcuuugcugcacagggccucuguuuuuccucuuggucuuugguaccuugucgaggauggcugugggguugggucuuacagcugccuguggucgggaagguggagccucauccucugagucagaguccuccggaagccuucaaugacaagccuccuccagcaaggucgcugucuccugcuuuucuuccuccuccugcugcugucaccacugcuccugagacaggcgguguugccgcagcauggccucaaaguccaugugcgccugccgccgguucaggucucuugcagguuuuccagcacuuccaucuccagcuuggaguccuucguccggaucucuaggaccuucaugggguuguucaguuccucauccucucacuccuucugcacgcgcuucuccuccucuuccagaagcuucccggccguugcgcguggccccgugcucuaagguguaguccguguucucuggucugucuugaagaugaucucggccaagcagcaugugcacuugauguagaaucggaagauuggcaggcccaguuaugccucgcucuggacuguuuccuuuugcguguugaacuucuuccccuuguggauguauucuccacaugucuuaaaccucauguugaagagggccaucagcugcaccacauacugccgguccuuugguagcuugaguuucaggaucuucgcugagucaaagucagguggguaguauuuguuuaaaacuuucuguuccaacaucuucucuuccuguucaaugaacaagugaagaagcuguucucuuaguccucggggaguuucuccaaucacgguaccucugcuucuaaugagguagagaaacagcagauuaugagggguuagccauguugcuuaaagaaaauuggcaagauggcagcuacuguugcugggguggucuccuacucuguuccccuuggcguuuucuguuuuugcuuuguacuguucacauauacuauucugaaaaaguuuagagggaaagcugaaaacucaggagguucgcucaauucucuucugcuagaaaagauugcagaguuggcuaugcacguagagaguuugcgacuagaggucgaaaugcuugggaagcaaaaagagccugggggagcaggauaacagaguucaggcauguauugcacgaugaaaaauaggguggaagauaaaaugccaccugcccugcuccacuuacugucacuuccaggugcccaaagcaccugggugagacaaggcgcaaggcacaaaggguuaaugugcaaccaaguacaccaccagaggauuugcuggguuuacaaagccaacuucagccuuccuaguccuuguccagcauaugucugcuaaugaugguauuccugucuauaaugaacugaccuggcaucaaauagaaaugcuagauuuaaagcauuuuaaagagucuauuguuuuguauggguuacauucccucuugucaaaguuauuuauaacugggcuacacagcauagggugaucccauaagauuggaagggauuggugucagcuguucuagaagcuggccaacaauuacaaugguugaccugguggaggcacaaagccacaaacguagcaugauguaauuuagcaaggggaauaaauguuaccaaagacccaucugcuuggugaagggcauuaugcugacuuacaugaacaaaucagauauuaugaugguguaaauugaacaaugucauguugccacuuuauuugguugaggaaccugggaaaaaauccaucucccuuacuaaaauaauacaggauucuggagaagcuuuuacagaauucuuacagagguugaguucagcugugaauagaaccauaucagacccugaauccagucacugauagaaauauuggccuuugagaauguaaacacugaaugugagagcaaucagaucauuuaaagcauguggagccccuguagaugaauggauaaggaaaacaacugauauugguacucagggcgggcacccugagaaugccaauaucauaugguaaauuguagcuagagauaucagaaaucaaaaugcucgauguuuuaauugugaucaauuuggacauuucuaaagaaaucguaaggcuaaaagauccagagccccaaaagacagguacauugauuuuagagaauacgguaaucagagaagugaacaagcugguucugguuacuaugagucacaaaggcuuccaagcuauuauagucgcuguggaacaggcaaacauuggucagaggacugcugaucuaagacauacgaguuaaccucuugccacuggggaaagaaccaagugaccugucagcucucagggccccacaauaaaaucuguuuuccuuuggucagucaggagguaccaagcagaaaagaaaauuagguauuucuggucuuauccauacuauagaaggaagugcagcuuuagauuuggcuacagauaccucuuuuacacuauccccaaaaguugaauguuauaaguuaaccacuggugugcauuguucccuuuccuucagcaauggugagaauaaucuugguaagaaguggauuaauuucucaaggauuuauuguaugcccagguguaguagauggagauagcaaggaagaaauaaaaaacauggaaaaugugaaaaaggagaugcaauuuaaagcaggggauagauugcucaauuguuauuucuuuacauuaaggggcaaugccacucuaauacaacaaacaggagcuuuugggagcacuaggaaacgaggauacccaagauauaagauacaauuugcuaaaugcaugaaacucaagaagaaugaagaccaaaguguggacacuuugccccuucuuagaauugggaacaaaacacccauggaaggaguuacagagacaaaguuuggagcugagacaaaaggauggaccuucuagagacugccauauccagggauccaucccauaaucagccuccaaacgcugacaccauugcacacacuagcaagauuuugcugaaaggucccagauauagcucucucuugugagacuugccggggccuagcaaacacagaaguggaugcucacagucagcuauuggauggaucacagggcccccaauggaggagcuagagaaaguacccaaggaacuaaagggaucugcaacccuauagguggaacaacaauaugaacuaaccaguaccccggaguucuugucucuagcugcauauguaucaaaagauggccuagucggccaucacuggaaagagaggcccauuggacuugcaaacuuuauaugccccaguacaggggaaugccagggccaagaagugagaguggggggggguaggggaggggggacuuuugggauagcauuggaaauguaaaugaggaaaauaccuaauaaaaauauuaaaaaaaggaaacguguucugacaaacaaugaucaaugaucagagacccaaauuaauguuacaaaugaaugguguggacauagaaauguugguggauacaggaauugauguuaguaugcuuucccaaaagucuuggaaccuagauuggccacuucagaauguuuacacacaauuuauaggaauugguaaauuaucacaaauaagacaaaguguuccauggguuaccuaugugggacuggaagggcaaacagggaaguuguauuagucaggguucucuggagucauagaacucauggauagucucuauauaguaagggaauuuguugugaugacuuacagucuguaguccaacuaaugggcagcuguggaugggaaauccaauagucuaguaguuacucaguccuuugaggcuaguuguuucaccuggucuucugcagaaguagauuccaacagauguucuggcaaguaaaugcaaacagagaacugug

SEQ ID NO: 9462 - RNA, 454 nt, Mus musculus
aacgcuucuuccagcuguggaggcacuaacaauggacgcucagaaagauguucaaccaccaaagcagcagccaaugauauauauuuguggagagugucacaccgaaaaugagauaaaguccagggaucccaucagaugcagagaauguggauacagaauaauguacaagaaaaggacuaaaagauuggugguuuuugaugcucgaugaaaugugggaguucagaaguaucuucauucauacauuugccucauugauguuucucuuuaauguauagcauuuggcuuaguuuacuuaaugaaaacaacuguaugccuaugauuucauuuagaaauacaauuguauuuuaauacuuuguauaaaggaaauuuugguucaauauauggcuuaauuuauugcuuuuguaauccgucacacagugaagauuaaaaguguuuccucaaaaaaaaaaaaucu

SEQ ID NO: 9463 - RNA, 693 nt, Mus musculus
auuuucacacaugauugauuuuauugucaucaucuuaugacuaucauguuguaaaauuugcccaugauaucaugaugauggcucagcuccuagacccauucacugauguuucuuaggucuuugaacccacguagggccauggagcuagccagguauucauuaggaacuagagcuuuuuugaggugugauagaacuucuuuugugaggucaaguuggccgucucauucacuuacugguaggcgguuaauucuugagcauaaugacaaguaucuuuaacaauccuuaguuugaugguucccuucacuuuugaugccaguugaaaaacucucuuucccuuuccuguuaucugaaguaacaacauacuaaagucacaagagcacugguuuggaagaaagauagaauguggauggggauuugugaaaaggggcagagguacaugggaaauuuauagcaggccugaggaagucuuagaggaagggauggccacagaagcugaacaaugagcuuagcuugggaccucucaccucaccacaacuuuugcagcauaaagcauguugguucuugauggaauacuugcacuuaagacgacaggaagccuuacauuucuuuggcuuggauguugcucgugcauaggcaguaggcuuagguguucucuugaccacacgugccauacuggugcucuuccuucaacug

SEQ ID NO: 9464 - RNA, 125685 nt, Mus musculus
aggacaucauugcacuuuagucauacugcacuugugacacccugaguuugagaggacacaucaccacaauguguggcaagguaaguaauaauguagcagaagggaacaauuuugccuucuagaugacacugcuguguguguguguguguguguguguguguguguguguguguguguguuuuacugguaucuaguagacugaaccuacagauguucagcauccuacagugcauaggacccaccuccaacacacacacacacacacacacacacacacagaaugauagcaccuaaaauguagaugaagcccaaaguuggaaagaucucuaaguuggagaggagaacccuauaacagacuauauagagaaauaaccauaaaaaaauuuagugcuuccugucacauacaaacuacuccauaauaaugacuucaaaaauuaacaaggagaauaaugauacacgaagauucacaaccucacaaucuuuuuaacuuuguguauauuuagguuuuuuuuuucaugaaaaugaaaucugaagagagccaaggguauucauacuuggacucucuuugaaacauagaaauuuuuccuucuaaugagcccaaguuaugaaauucaaugcuauauagcuugcuauugagcagcuuuccaacuuuugagucagauaagacauuaagagauuaguuacagguauaaucuaaaacuagauaauagucugaaaucuuuccucuucuguuaaaguucacugcucucuaaaaagauacagcuaguggaaaagaauauacauauuuugauuuucuucagacacccuuugaauguagacuguucuucagcuuauuagcacuaauaaacauggaucacuuaauaaaaccugcuaaauuuagaagaaacaacuaguuauaaauuuccuaugucagaggcuggugauauagcacagcagucaagaaguuaagccuugggggcuggugagauggcucaguggguaagagcacccgacugcucuuccgaaggucaggaguucaaauccuaccaaccacaugguggcucacaaccauccgaucacgagaucugacucccucuucuggagugucugaagacagcuacaguguacuuauauauaauaaauaaauaaauaacucuuuaaaaaaaaaagaaaaaaaaaagaaguuaagccuggggggcugauugcaaucugcaggagccauguggugguuggagggaacugaacacauuguucucugacuuccacauaugcacccauguacacacaauaaaacuauguauaaaauaaaguccagcuauuaauaugucuaguaaaauuuauuuucuucuguguauuaauaaucuuucugucaaaugugugcuuuuuuuaacaucuuuauuuaugaacagguuaucagucuaccucccugaucccaaauauguguuuuuaaaacccucuauauuuuaaaaaguuucacaaacagaaagguaucucuguauguuuuuuuuuuuaucuugaauaagaugacuauccuguuccuaauugaacugauaaaaucaaauucaaugauucaacuaaguaugaucuggaaccuuauaugcccucuuuauaaauuauuauuacuauucgaacuggggcuaugccccucccccacaccccgaagccauguaaaaagccagcugugguaguauaccuuuguaacccaacugcugaugaagugaagacagguggcuucaagggcugcuggugagccagucuaaguaauggguuuggugagagaccaguuuuuaaaaaugaagugaugggggaaugggaugaggaagugugggaggcgggguggggggaaagaauggcuaaaagguaaauaacuaaaauaauuaauaagagaggaaguagaagaggauagugacagcuacucaguaccuaccucugaucuuuaccccuagcaugcgcgcgcgcacacacacacacacacacacacacacacacacacgcacacacacccucauuggacaggcaagauggcucaguagguaaaacccuugccuugcaagucugaaaaccuaaagggggugguggagaacagacucccugaaguugcccucugacuucuacaugccugaauucacacucacaggucaaacacaggcuaaagauuuuuuuuuuuuugagacacgguuccuccacguagcccugggucuccuggagcucccuauguagaccaggcuggccuugaagucacagagauucacaugccuucuguuucccaaaugcuaaaaugaauggcaugugcuaccacaccugguuaaauuucucauuuugauuaauguuuuagcauauaaaagaauguuuccuuguggcauuuucauaauauacacauuguaguuugguaagauuuacucucauuagugucccugauauacccuauuccuacagucuccuuucugcuuucaugcuaaauauacauaugugugugcauauagauucucagugagaggaaaaacauacaagaucugucuuguuuuuucuuuuuuacgucuuauguuuauucauguauuugucaacugaaaucacaaugcuauucuucucagauaacgccuaaugagucugaugacgagaauggagaagucugugauuugcuccugauuaucgagaagaugagcaccauuggagccauuacuguuuuaauucugaaaugugcauuuggucggauagaaggaggcgugagagcuuugagugaugcagcagaggcuaggcugcauucucagguagaacauauacuuuuagacauguuauuuuuguccgucgcuuuguugauuauuuacauccauuucugcaaaacucugaggcaggucauucauuuucuguaauuuuccuugucugugucccguguuccuucacaccauuagugauucacauccuuugcgugguuuacuugagccuuucucugacugguauuucaucaguacuuugugagacuuuucccauacauuuggcccuuuuccuacagugacauuuuccaggaccgauuuucuuugcuucuuugccuugaauaaguuuuuuuuuuuuuuuucguacauagugagaucagaaaaugaauacuuucagccaggaccaaaguguuugacgcuauuaugaacgggcuaauggagauagcagagaggggguaauaucugugugcuaucuucagcaaugugaaggaaguaggcacuaacuuuggcguugagcucagacuccugccucucacuuguguaguggcaauagaggagcccaauuagguccugcaccauggcuggcacucaucauaguugucaugguuuuuggcaggcuguuccggcucaaauguaguggguagaugucuauuuucuugcucgcagguguucucaguaacccuugccauuaaauuuagaauacccauuaaacacauuauucggcuacagagggcacugcuccuggcauacagauaauauagacugcuuuugagaacucucuugaagguucccccucccccuuuaagcaugcuuaauaaacuuaguuuuucuuaugugaauagccuguauggcaacuccagauaaagccuggauucccugcacagggaaucugaugguuaaagacuuccugauagggagauuugaugaauuugguuucuuuccugaggucaagggucagauugcuguaggucuuggagauggccuuggugaaauugucuaggguagcagugaagccauggugacauguggaagucauaaauacuagccaugagcaguaguuucuugggcacuggagcagagacaaugcuagugugucuagggguagacaugagacucaccagcacagagccauuacagccugucaccuuacauggaauaguguggggcuugccaaucuuguuuucucuguagccucucugcacagggacaaugaugagcuuggccaaugaugauggccccuggaaugccaguggcaaccuucuuggggcuguuaauacucagacaaacaugacauuguaguccccaguguuaacaaaacucuugaaucugauuugcuggcuagccugagucugcuucugcacuggcaugaccaaucuuucgacccucauccuuaagggauuuguccagaaaaaaaguuaauaaucucaacucuuugaugggcagggagaauagguagaucucauucguggacuugauucuuauguccuugacuaggcugcccagcuuuaaugacagaaauccacuucucucuggcuuugucuccaugagcacuguggccuuagccugauccuagaagaaaguccuuggcuuccccagccuggguuacacagguccugaacuggcaucacccacuauuugguguuuuccuugagaagcaagggaauuuaaacaaacacccuacccccaaaccagggucuuguuguagcucuagcuagcuucgaacccuguguuuugugcugagaauugcagguaugugacuccauacucaucacaacugguucuauuccucauccucauaaauugauuuguuuuaaauuccugaguugauaacuuguuauucauuccacugaauacuuucuguuuuaaaucuggcuuuguccguuuuuuuuuuuuuuuuuuuuuuuuuagaguuguugccuaccaacuucucaaguugaugugauagcaacuggguguguauauaguucugagucucaugacugcaucccugaauuucuaacccacugucuucaggccugugaggagguuagucuucucuagguuaacaucaugaucauugagagccaucuugcacauuuuccuaucaguuuugguuacuugggacuauuaaauaugacccagaaagauagguucuuggauuauccaaagaaggucaucuuuucugguggccaguugccuuaaagggcucauuucuauuagucaaaugauuucuccacaucaucaucuugaaguugcuucuacaucaugcaccuggguggccaggggacagaucuuuuaaauagugguaugggccgcuucauacacccaggucccugccucuaacuacucucuuggauucuaaggaaccaguguuccucuuguccagauccacuuaguuuucuuuucccagacucacccuuguacucauuccuggcugcucucugccuuuugcuuugugaccuauaagcagauaaaccugguaaaggcacccagguguacuggaaguccccugcugggaaggugccauuuuaucuaccugcuguaucgcccucauucuuuugucuccuccuguucuauacaacuagaaacccucacacaguuucccaucuauuuucauguuaucuaucuaucuaucuaucuaucuaucuaucuaucuaucuauguaucuaucuauguaucccucuguguuuacacauguacauaaauguuugacuaaagcuucuucuucuaugauaauagagguauguauuuuuguuguuggcuuuacuagguuaaugaguuuuccaugcagaugauccuugccaauugaacaauugacaguuuuuuuuucagccaggguuauucaaagagggcuccucucuguuauaauuucucaagcagggauaguccccagggccuguaaacccagugcucaggagaccgaggcaggcuacucauugauggucuagcuauuaugaaguaaccugaauauuaaaaguaugauaucuugccgggcagugguggugcacaccuuuaaucccagcacuugggaggcagaggcaggcagauuucugaguucaaggccagccuggucuacagagugaguuccaggacagccagggcuacacagagaaacccugucucaaaaacaaacaaauaaacaaaaguacauaucuuagggguaauauuuucuaaaugccuucaauuaacauuccuaaagugaugacuuuacauuugcuuagucaaauugaaauccccuuuaacccccuucccuccaagaaacauguuugagaauaaguugaaaaauguguuauuauuucagagagauuuuuuggggggggagguugguugcaguuuucuaguaacuuuggucaaagaagaaacuacagggaagaaauuagauuucaguaaugucuuucuucuuuuucuuccucccuuauugucuuaguuaggguuuuacugcugugaacagacaccaugaccaaggcaagucuuauaaaaaaacaacauuuaauuggggcuagcuuacagguucagagguucaguccauugucaucaaggugggagcacggcagcauccaggcugucauggcgcaggcagaacugagaguucuaugucuucauccaaaggcugcuaguggaagacugacuuccaggcaacuagggugaggaucuuauacccacacccacaguggcacacccauuccaaccaggucacaccuauuccaacaaggccacaccuccagauggugccacucccugguccaaggauauacaaaccaucacaccuauuuacuguuagggugaaaggggggugguaaaggaugggaaaaaugagaacccacaaaguugcaaagaccagcuauguauagcccuaagauggcuucaguuugaggagccuucuggccucgccucagaguacuggaauuacaggcuucugccaccaugcuaggcugagucuucuuuuucauuauuuuaaauguuuuuuaaaugucucccuuccaugaagcccccacuccaucccccucuccuuugcuucuaaaagggugcuccccuacccacccacucccaccucaccccucuagcauuaauagauggaaguagaaaauaucauccugagugaggucuuguuucuuuuaaaagauuucuuuuuuuuuuuaaacauuucuguguguguguguguauggaugcuucauccgcauguaugucuuauacaauauaugugcacugccaucaggggucagaagaggguaucagauccuuugggguuggaguuacacauuguuucaaaucaccacuuggcugcuggaauccaaccuguguccucuggaagagcaaccaauucuuguaacugcugagucauugcuccagccaagucuuguuucuuaaaacagaauuguauacauauuucuguaauaaguaagaacucaggaauauuggagggggguguguuaugcacguggagguuuagaagugacccaaccauugagcuguaaggccauauuaaaauaggaggcuucacuugugugugaacccagaacauuggggguuugggacgggguggguagcaaguggugcugcugcuaccacugggacgauuugaguagaguuauuuggauucaguaacaugauacaauauuauuauuuaauuacagauaccccaaugaagucaauugugccaguaaugcccuuuauagcaaaagaaaaauaugauuuuuggaggggagaaaaucccuuguauuucuuguuuccauuaaucuuuuuaaaaaagucuguauguaaucauuuggcaggcuuggagcuugcuauguagauaauacuggccugugacucacagagauccuucugccucugccuccagucuucaaaaaucuggaagaauuacuaucuucuaagagcuuggcaacuuugaaaaguacaggguaguaauuuuguagauucucucucaauaaugguuaugacugcugcccuacaauauugaauuaauauauaaaauuuggguauuaacaauuuuuaaaauuugaguaguguuucuucuagcacuucacaggcauuucacgggcagucccaugguguccgucuuuucacuugcuugucuaccuugcauuaauuacauucaggccaaugggaaguugcuauguuccugccucagguucccaaguguuggaauuauaucuguggaacccugugccugguucacuugcucuguuucugagauaauuuagcuuuuuccccccaguagugaaguaccaaagcagagccugguucaagguaagcaagugcucuagaccacagcuacaggguuuuuuuuuuuuuuuuuuuuguuuuuuuguuuuuuuguuuuugguuuugguuuuucgagacaggguuucucuguguagcccuggcuguccuggaacucaagcuguagaccaagcuggcccggaacucagaaaucugccugccucugccuccccagugcugggauuaaaggcgugagccaccacugaagguauagcucuaacccugguggaauuuauuuucaccaacacagggagauaucuuccauauuuuccuacaguaacguuuucucuuuguaauaagaaauauuuuuuguagagagauuauaacaccuuaaacaucguuucucggcauaguaauacucccuaguuugacagcucaaguaaggaguuaggauuuggcggagcaugcgguucccagcuuuuguccauuaugugugcccuguccguauuaauuuucuauuuagucguuaguugagauauuucuuaucucauguuccuuuuuuuccagaagcucaugucauggcuuacaguuccagcauccaccaaugccuaacagaccgagugauugaaaaauuacgaguuugaauuaguggcuugggguagagauuacgggagaucauaaaggccacagcggccuggcguuuuuguuuuuuguuuaauguguauauguucuaaagggaaguaggggugagagcuguggcacccgccaccucuuugucggccuggcccaggacuuccguuugguggggaaguagguggggcgggaaaucuaaacccgaguucgcagcuuccgucacuccccgugggcggcgcuccccuuugaccccgcgcucgggagcuacacauccgggccacuguuacuagcgaggggaagauggcggccgcggcuguggugguucccgcagaguggauaaagaacugggagaaaucagggagaggcgaauugugaguguuucugaccgagggaaggcgccgggccgcccugaggucggggcgcugggcgcagucggaagugggguacaggggccggggggcagcggcgcccccucccccacccgcacccgggcggcggaugaggaugguugguugguccggaguuuccacuuggcugaggagcggagccgggagccgccacuaucgccgccgccgccgcugagcgucuugccuucccuccgaccuccccgaaagccccgugguccccgggagccccgcuuccuuuaggucucuccgcagaacuuccgucucguccccucaggucccccugggcuccugcccugucgcuuuuuugucugucuggcucaucgucuuaacucagcucgcugggcucggcuccuuuucucuccguggcuucgcagccggagcuguguggguccgccacuugccaugucucucacugucccguuuuaucuucuuauuuuuauuugucccccccccccccgggaucuaagacgacucccgcacuuugguucccggccucuccugugcccgaagucuuaggagggcgaacugucccgaacucucugcuccucgccgcugguggcagaggagcccggggcgucggggacagccaggcauggcaccucugcuuucucagggagcggcagcuugcgcugcccuggcccugcgguacucgggaaaguguggcagggauugccgcuucuuuuugccaagucccugccggcgugucaccucgccgugguuucgggaugggauucaacuuuuccugguagaagguuuagggaacuccauuuuggccugggacugcagcgagugcucgcccuccucgaggcuuuucuaguacuuuaggaugaucucuguguccuuuaagucauaaacuuacuuuguaccgucaccgguaauuuccuacaguagcggcuuucgcgccucccaguagccaccccacccccgacuccccguuuaaguugacagaauuaaucacugauuaaaaaaaaaaaaguuguaauuucuucuucugagucgcucuggaagcuuagcagucaauccuaugugagauuaacucucuuuagcugcuugaguugucucccuccacacucccacacucauccaguaucagguucccaguugcucacgggaagauaggaaucuuuaaaacuuuguuacuucaaagaaacccgguacaccaagcucuugugacuugacuuacucccacaucccuuugcuguucugugaaacguuaacagcgugaguccuagaauuggauugucugaguaaguggcuagcuuagcccacuuaaccagcugagugaccuuggauaaauucguaaccauuuggggccguuuccccuugaguaaauugggaauaagaagcguucuacucgaaggauuguugagaagaguuaaugucuauaaagcacuuggguuauaguaagugcgcaagugauagcuauuaaaaguaauauuauuccagcuuuuagaaauuuaaaguucucgggacagcucuuugcuuggcgauuaguuggccucugacauccugcauauuuacuuuuguaugcuaaugaguugagaggcccuuggagaacggggaugucaucucauuuuuuuuuuuuuuuuugguaggacauguccuccaguauauacuuagaguuccuucgaguuuuguuaacucagaggucugucucacaucuaaaagaagcauucauguuuacuuuuuaugugcuguuuaaccagcuaccuguuugucgagugcugagaaggcaggaugggaagcagcucgagggaacagggccagauuggagggagagccuccgcagacaguucaguccguccuuauuuagcaucuaaagcggauucauuugugaacugucguguuuguggguuucucagcuuccuucuucuggauggauuucacuguguguauggaggguagcaugugcuccaucagugagcuacauccacaggccuagcugcuuuuguuuuuguuuuguuuuguuuuuuuuuaacaguuuaauguuuuuacuuccacuuuagaauaggaggaggagcccugccuaacuucugacuggcaauagguggagaaaaacuaagugguguaugaagccaagaauauaaagugggauuuugaguuuauauguguuuacaugauccaugcuaccuaguguuaaaagagcuacuuaaaaacuguacuuaggauuuucauguauuuauuguauagcuuguggacuguggguuugaaguacaguagauucaaauuagugugacaguuuaaugauuauauaaauauaauuucuguaagagaacuuaucuuaaaaaaaaaaagccaggaggcagaggcagggggauuucugaguucgaggccagccuggucuacaaagugaguuccaggacagccagggcuauacagagaaacccugucuugaaaaaccaaaaaaaaaaaaaaaaaaaaaaaaaaagagagagagagagagagagagagagaacguaucuuuuuuuugagacaauuaccuuguagcucauacugagagagagagagagagagagagagagagagagaacguaucuuuuuuuugagacaauuaccuuguagcucauacugaccuugaauuuauuaucaucuuacgcaugucccacuacauuagcugagaauuuaaaguuggauggcacagcuugauguggugucucacacuuguaauccuagcacuugggaggauaaggaaggagucccgggaguuugaggucagcagaggcuacacaguuaacuuuguuggaaacaaaacaauaaaaggcaaaagaaacaaggcuugagagcugucugggguaaggaguuaggaaccuuuacuuacuucaguucuuaggacccacaucugauggcuuauggucuccuguaacucuaguuccaagggauaaaaccucuggucucacaggcaccuguacacacacacacacacacacacacacacacacacacacacaccaaacacauacauacacacagcuauacaacuaaaacauaucuaaauaaccaaaaaacugaagcuguuuaaucuaacgaaauauucuaagguuugccuuacuggugaaugaaucuagaggcuuuguacauauuaagcaacuacuacuacgaaacuauaucuucagcccuuuacaaaauuauuauauuagcauacagaguaauacauuuuauuauggcauuuucauacaugugucauaguuuuaguuugcugguuuccucccuacugcuuuccucugcccacuucuugcuggcccuuuuuuccuaacuagaccugccauuuucuuuucgucuuuucucuuuuuuugucuucucuucuucuugucuugucucuucuuugacucuguagccauggcuggccugggacucacuuuguagagcagacuggaaaaugcugggauuaaaggcauacauacauacauacaccaccauggcugaccuucauuaccuacucuuuguuaauuaauuaauuuauuugguuuuucgagacaggaauuuucuguguagcccuggcugcccuggaacucacucuagaccagguuggccucaaacucagaaauccgccugccucugccucccaagugcugggauuaaaggcgugugccaccauugccaccuauuuuuaaucuacucuuuucuuucacuugaauucucuccuccucucucauuguaccuuucuauuuucaugacuuacacauacguauauguacacuuagaaaugugguuuuuggcaugcuuaaaauaauaauuuccuguuguaucuguaaauauauugauuuuauuuuccuuuaugccugguccauuuugcugucaccuucuuuucuuccuugucuucuucuuccuccuccuccucuuccuuccccuccuuccccucuucuuuuauucuuuuggguuuucaagucaggguugucucuguguagcucuagcuguccuggucugccucccaagugcugggauuaaagguauguccccaccacaggcaggcuuccuuuuuuaaagacggugucucuuguauccuaagcuggcuuugaacuguuguauaacugagaaugaccuuaaauuugugaucuucccucuauuucccaagugcuggaaaguucuaggaaggcgaaccacacccgguuuauucacucccggggauugaacccagggcauaagauaugcuaaggcaagcacuguaccaacuuuuuauucaguccgggggauugaacccagggcauaagauaugcuaaggcaagcacuguuccaacagaauuacauccucagaccuuuaauuuucuguuuugagauagggucuuguucaguugucuaggccagcauugaacaugaaaccaucccauccccauuccauucucucaaguugcugggauugcaggacugcacugucagguccugucauaaugaacuauuuuaaacaaucacuauuuagauauuguaaacacaucaucauccucuacucuguuuuuauucauuugucuucuuuuccuuauguacaaacuuuguuuaauagagcuuaauuuuagagguuuuaaaaaucauguuacauacauuagcauuuucaucuuguuaaaacaaauaauauuguuauuuggaaaaaaugucuugaauaugaacuagcaacuggaaaugcuaaaaugagggguagagugaauacauuugguuuuucgaguaugccauauguaaaguuauuucuuaggauuuuuuccuuuucauuuaauaauuuuaaauguuuuugguuuuuagagauaaggucuuauguagcccacccaggcugaucuggaacuugcucuguacuccagggugaccuugaauucauuaucuuccugcuuuagccuccucacuauugggaucucaguggcuagcugauuauuucuuuauaaaacagcaacaagugcuuuccagcccugaauuuuuuuaaguauguguuguguuccaugagauucccaaguuuguauuguuuguagcaucguagcaguauauagcuauugugagaguuacagggucuguagugauagagaagcaacaugauggugagaauaagcucagugauaaagcaguuugcauaguguagcuggucuuugcuauuuucuggcuucuucuuuuucuuacccuuuaaccccaugguuucacccccuaacacuaguuagucgagaaucaaggagagaugggaagggaaagagaaggaggaagaggagguggaagaggagauggaagaggagguggaagaggaggaggaggaggagaaagagaucccugaauccaguuucuuuccguuguuucuuugaccaaaccccaucgaacuucugggugggggugucccuugaauuuauguacccuuuguaaaguucccagaauuccaaaugucacacaauggcagaaauuaucugcagcugccaaagcuguguuucuucuagagcacaaggcaaauauuggucaccugcugcagacagucugaagcagccccacaucccuucaugugggguuaagccaaaagcacauuccuauaaaaagaaaccaaaaguccagaauucucaaaaaugucacuauagcaugcucugaguuccccgucuucagcacuuaaaaaaaagaaagaaaagacaagaaacagaaaaagaaaaaaugaaagacaaaaaccacaaacuguauagggcauuuuauaauuuucaagcaaguaauuuuuuuuuuagugaaauauuccuuaauuuuuuuauuccugguacuacuaccacaauuuucagggcaguauaucugauguaaugaaaagacagugcuaaggcagagacauuaggaauaaacaucuaauuaacauucuacugcauuaaucaauauuaaucaacaguuucuuucccccccuaaacugugccucuggcagucuaagcaagaaagguuuccuauuuaagcugcuacuaggaacuuuuggcuauagauuaucauugcuucugucucagacuuuuacuuccugucucaaaguaaccugcaguuccccugacaacuccucaucaguuaauaauuguaggccuuuuccuagugucuuuaaaaagaacaaaacaaaagaaaaauaaccccccaaaaccuucuuuuacuguguccaccacaacaaggacuuuaaaaauauguuucuuuuauuuuuugaaauuauaauauuacaucauuauccuuucccuuuuucccuucaaacccuuccauauauccucuugccuucuuuuaaauuuaugacuaacagagcuuuuaaugacaacuauguacugugcuccaugaaaaccaguugucuauuaucagaucaucuuaacuuugaggaauaagcuuuguuagguaauauuucaccuaucaaaacaguccaucccucauauaccucuacacuauugguuucuagaguauauguauaaaugucacuuauguuuuuaacauuuaaauguguguguguacuuaugaaugcuaggacgaaggacagaagacaguucuugauaauuguuaucuuuuuuuuuuccuuccaccaugugagaccaggggauugaauuuaggucaucaggcccaauuggcagcaagcaucuuuacccacuaauacacuucucuggcccaccaaauauauuuuuagaugauaaauuauguaauugauagggcuggagaaauggcucaggguaagaacauguacugcuuuuccuuaggaacagaguuuuauucccauugucuauguuggggugacuccuaaccaguuacaaaaaguaauucuuaacugcccaggaauccauccccucuggcauccccagacaccuauacaugacauguacacacucaaagacacacaaacacauaauuaaagcuaaucaaagucaaucuuuaggugcuggagagcuagcuuagcaguuaagaacacgugcugcucuuagaccuggguuuaacugccccaaacuaggucuaggagauaugucucccacccucuuuuaauuuuguguucacauggugcauauacauacacuuuaaacacacauacauauaccaaaaaauugaacaaaucuuuaaaagguuguaaaacuuguaucaugaguuuuuuccacaagagguauaaaaacaguagagggcuccugaagguuuuaauuguuuuauugauuuauucaguaauuuguaaguauuguucaagcuggccuagaaugucugguaauucuccuacuucagugugcuuggucuccagccccugaaccuuguuuuuuuguuuuuuuuguuuuuuuuuuuugagacaggauguccaagcuggucuugaacuggcuguguagcugaggaugaucuugaauuucuaaucucacgccuucacuucucaaggacaaggcuuccauacagacugaugauaucacaccuaguuuaugugccacuggggauuaaacauaaggcacagaauacauuggcaagcacucuacccacugaacuacaucucugguccugaagccuugccuaauuugauuucauauuuuaaguuguauucaugaauuaagugcaaaucuuggucuguuuuucuguuaaaagaaauucauucuucagaacauguugaugcaauguuaggaaguuauuaaguuacuacuuuguuugcuaaguuauuuuauaaugccgaaauagagacuuugccauuaaugaaacugcuuuuuccuacuuaacaaggguaaagcuuuuguuauuuuguuuuuuugugaccuuucuuguuuucuucauaaguucauguuucuacaagauaaaaugguuuuguccucguauuuauuuauuuauuuacuuauucuuuuugguuuucugagacaagguuucucuauguaucccuggcuguccuggaacucacuguagaccaggcuggccucgaacucagagaucugccugucgcugccucccgagugcugggauuaaaggugugcgccaccacgcccggcucccucguauuuauuuuuaaggguaguauuuuuguuauaacauugagaaaagagacaaguaaguacuuugcuuaaacuauuuaaccuuucuugcuauuuuguuuuuaaagacaaguagaagcacaggugaguaucagucuuuuauaugugaaacaagcuugcagcugugagcacaacuacuuaggucuuguuuguguuuccuuuuugcugaaaauagggauaaguaagauggaaagcuaaauauucauguuaaaaagacucauaacauccuucugaaaucauuaaaagaacauaacucauucauucacauuuucacagaucuuugauacuggauuucuguguucucagggaguugaggcagcauuuccauaauagcacaaaacuauuugacaagaggaaaaacuggucaacuuaaauauugagggaauaaauuaauacugauguuugugcugagacagaauauuuaaauauuuuuaaggccauauuacaaugggcaaguauuugagguccuuuugucuguuaucuuucuguaauguagguuaguuuaucagaaguguuugacagauuggauagugaccaauuacuuuuaaggauacuugugggccuacuauuuguggacauaguuaaacugauacuuaaaaacaaaacaaaacaaaacaacuuuuugagacaggguacuccuauauccaggucugccuuaauauuuccaucuuccugccucagguuguaaguguuuauuuuuguuuuaaguacaaauaucuauuaugcaagugacuugucugaauaugauaacccauuaaugauuuuguacacaauuuuagcaaaucuuugagaugaugacaauauuuauuaucugcaggcuaauaaaugugcuuauggcuuagugacucacaauauaaacugacauuucaguuauuucuuuuuuuucuuuuuuuuaaagauuuauuuauuauuauauguaaguacacuguaguugucuucagacacaccagaagagggagucagaucucauuacagaugguugugagccaccaugugguugcugggauuugaacucaggaccuuuggaagagcagucuggugcucuuaccugcugagccaucucaccagccccccaguuauuucuuaguuauguaaugaugacuaccauagguaggaguucagaacacugacacagccucucuucagucauuggaaggcuuauugaaaaagacauguguuaccauugcugaaaguaguggaagaugaagcuggcagaaaugcaagggaacaaaggcauuuguaauaaugaagaauaaaaagaaaauucuacacucucucccuuugagacaggauuuuauucuguauuccauguugguuuagaacuugugguaacccugccuuaguauuucaagaguuugggauuucaauugcaugaauuucgacaguuccuuccaauuccauucuuuuucucccucccugcuacccauccuucaagguaucauacaucccagguacaaagcuugauauaguucagguugaucuugauuucugaucuuucugcuacuguaucccaagcuuuggaauuacaguguaugccaccauaucagguuugugugcuccuaggaaucaaauccaaggcuuauguaugcucggugaucacugagccauauccugaacccacagugaguauuuaguacauguauacaaagcuaaguauacccaauauguggaagguggaggcagcaggaucaggaguucagugccaguuugaacugcauagugaguuugaggucaucuuugguuaugugaacuuugcuucaaaaaccaaaaccucaaaccccuccaacaauaauacauguauacaguguguaaucacuagaccaggguaauugccauaucuauuaccucacauuagccaugcgcaaccuuucuaaugcugugacccuuuaaugcaguuccucuuguuguggugaccccuagccauaacauuguuucauuacuauuucauaacuaauuuuccuguuguuaugaauuauaauauaaguaucugauaugcaggauaucuaauauacuacccccaaagggguuucagcccacagguuaagaauugcugcaucaaauauuuaucuuuugugcugagaauacuugaaaaucucucuacuggcaacuuuuuugagacaggucuuuuucuacugaaccaucuugcucgcccugucuaguagaauacauuguuuaauaggugguggguguuuaauaguuuauaauggagauuuucaauuuuuauauagauuuaguaacuguuuuuacauuggccuuuuauucuuaauuuggaacauaauuguguaacuugguuagguguaacuugagauaguuugugguuugccugggcuacagagugaguucaaggcuagauugaacuugucuagacuguccaaaggaaaacaauagaagagggauaagggucuaucuuauugauagagugcuugccuagcuugugcaaggcuguggguucaacugcaggagcaaaacagcaaagaaaauaauaauuuauaaaugaauuauggaccagaagauguuuauuauuuuuuuugccaacaaauggaguaucaaaauaugauaccgaggcaagguguagggauguggguaaccuauagcauagauacucucuguuagugaugaucuuguggcaucauauuagcauaagauagaauagagaaacaaaaucuauaagcuuuuuucccccagugcugaggauugaacucuaggcuuugcauguucaacccacucaaaaguuggacaggagugaaaggugcugacaggaguuggaggugagaaaggguagaguggaauugauguaaauucaguacucaugaaauugucaccacgcccagcuuuuuuuuuuaauuguuauuuugguuuuaugauuuuuuuguuuuuuguuuguuugcuuuuuguuuuuguuuuuuuuuucgagacaggguuucucuguauagcccuggcuguccucccgagugcugggauuaaaggcgugcaccaccacgcccagcuuccacaguuguuuuacaacauauaguggccauuuagaaaaagucuuucacugaauuaugcaacucuuccaaauauugaaaaacuucauuguaugguaucagauacacuuuccuuagugucuccaccaaagaugaucagggaaaccucuaugacaguagucauccccauaguggcagaaacgaauuuuucaaaaugauuuuaucaaauacuguuuuccuugaagugacaaacuugguucauuguagucauaacuuguuaguuguuucucaaguggaaaaaugguguucuauaaaagcaagauaguuaagucuacaguuaaaaaacacuguuauaggcuuguuggugacuaccuauaaucccaguacuuugggugguugagguaagagaauuacauugaauuagaggcuagucaaagcuacagaguauaucccaaccauaaauaagaagacccuguuuaaaaaauacagauuuacagguaguuuucauguaggcaacuguuaauaauuaaauauuggguagggauuguuuauucaaauuucucauuuuauggggcauuaaaaugacauuuuaaaaaaaugacagcacuggauaugguguugcauacuuggaaucucagugcuuguggcaccgagguaggaggaucaagugugccaggcuagccugggcugcacagaaagauucugugucugccaaaccaaaaagccaggccaguacucuggaggcaaaaucucugggauguauaguaagacugucucaaaaagccaaaccgaaccaaaccaaaccaaaugacaacaaaacccccaaccaacuaaccccccccucaaccccaaauauuucagagcucagacauuuuuuuuuuuuuugguucuggagauugaacccagagccuuaugcaugcuaagaaguggauuaccacuaggcuauaccccagcccugugcucuggauuuacauauauuaauaauuaauacauuuuuuggugcuagggauuuuauucauaaacaacauuuuuuagacucuguugcagaugugcugaaagaugauaaccuagauauuaagguugauuuuuuuuuuuugucucacauggcuacuaaggaucugagugagaaaauccaguagcaguuauaaauacauuugguguacagguaaaauuggagguagauagacuuagaaguggguaagaucacccagugugugugggaauaaaguggugcugcuaagagcaaaagcaaucacauaugaggacaaaugcacuugcaagcauaagagaugauuccacugaaaaggaaagggagggagagaagaggauuuggacaucccuaagcugaaacuggaaaugcuccaaugucugaaacuucuugaguacugagauaccacuaguagaaacuuccauuacugacaggcugaaagaacacagcuuaggaacaugguuuauuuaguguguccaacgaaaacaagguccuguuagucccuuuaagcuacaauaacacuuuuucugagcauguccagguucucacuugcaagucugcuuucuaaguaauagaauguauugucacuguacaguaaacuguugagugcauaaaguuaaaaauauauaagauuauugguaggggguuguagaaauggcucagcaguugauagcacuuaacugcucuuucagaggaucugaguucagguccugggaccuauguugggcagcucacagcugccugccuguaaauccagcucgagggaaucugaaaccuugugcccuccacagacaccugaacaugguauacacuaauacaaauauacacauauacaugaaaacaaaucuuauuauguguaagguauaugugaaacaaaauacauuuuguguuauguuuuaguccucagacauuuuagguacauacaaauauuuugaacagaaauacgaaaaaauuaaauucuggaguaguuuucauuguaagcauuguagauaagggacauuccucccuacaguguauuaauuugcauccugugggcugccccuuuugguauuuugauuguuuuguuuuuauuuuggguugcacaaacauuuucuaguuugcaguuuaguagucaccaauucuuuaccaaucuuguuucaacuauaguucccuuuaauuauuuuauuguuuuauauuacuuuguagcagguagcauguuaucuauaguguuauauugaagaugagaauguaguauuucuuugacauucugauuuuauuuucucugggugguguauuauuucaucuguagcugggacauaaugcuuuuagucugcuaccauggugugaaaagccacugacagaugguggauuuuuuuuuauuagguaucuuaaaaugaagauguucuaauucugucauuuuauuggcauauauuauuguacaaaauaaugggucucauuaugaucuuuucauuucuguguacaauuuacuguggucauauccaauccuauucauucccucuucucucugccugcccaucgcggugcuccguuuauguuuuagccauugucaaaaaaagaaaaaaagaaaaaaaagagaaaucuagauuuuucauucaccauucccucuguuggcugaaauaguucaaaauggagacauuugauuuuauagaggguaucaaauuccuaugguagcagaggcugcugauucuccuuuccuuaccucuuaaguccuaggauuacagucauucaccacuaugucaaguagugaugaauuucuuacuuacuuauuucuuacuuacuauugaguuacucaguguuuauaaugagaggcagaaacauuuuauguaagagaugaaucgccaauauuuagaaagaugggucgauugaucucguucugauguguuagaagguuuugugucaugaucauagguauuuaaauacaucuggggcauuucuauauacuuuuuaggagauaaaacuuguuccuuaggaaucaacuguuuuuaugauugaaaauugauaguguuuuuguuuuaaauucuaguuuacauuuaugccggauucucagugaaaauaaaagccaugacaguucgaccuacagagguaugauuuuuuuuuuuaaaaaguaucauagcuaucauuuuugguuuguuuaaaguuauaaaucuugauuugauuuuauauaagagugcauguaauuaagaccuuauagucaguaguaaaacuguaguuacaguaagacaucuuggauauacacauuuugucuguuugacuuuuauaauaguuguauauuuguuuaaauuucuguaguuagcuguaccaaucauaaaugagagagaaagcuauccuggaaaaaaaccuauuuuggucauaguugcacuagaaaauuuccaccaaccaaguucaguguuuuugcucaagcugguuguguucaggugguaucuggggagcuuguuaaaggcaguugucauggaaaauauaagcaaaggaguguuugcugaauucacagauaggauauacuaaguaaaaaugcuccauaauuaagaaggauguagauuuuacuuuuauaggauuuuaccauuuagcuuucauuaauuuaaaacuaggaacauggauuuggcaaaagacaggccagaaagcaauugugucuuuauuuauaauguuuuuacuuauagcuuucauuggagauaauauuguacguuuugguaugaaaucaguauuuuuauaauuaauaguuuauuuuaacaaaauaaauauauaacaauuauuguagagacauggcauugugaauagaugauuaagaacaguguuuuuccagccaggcguggugccacacgccuuuaaucccggcacuugggaggcagagacaggcggauuucugaguucgaggccagccuggucuacagagugaguuccaggacagccagagaaacccugucuugaaaaaccaaaaaaaaaaaaaaaaaaaaaaaaaaaaaaaaaagaaaaagaaaaagaaaaagaaaaaaaaguguuuuuccuauagaaaaacuuauuuugguuuuaccaaaaguugaguauuaccuuaauuuaagagaauauauuuauuagauggaacauuuggaggguuaaggggaaaguauuuuuaacaaaugaaauaccaaguuuugguuucuguuauuuuaggaagcucuguuuuaagacuucacaucucagcuggguuugguggcacauuccuguaauccuagaacuuuggaugcugagaugaggauugugauuucaaagccagccugggcuaugaagcgaguucuaggccaaucugagcuguauaguagaacccugucucaaaaacaaccaaucaaauagcaaacagaaaaucaaaaugucuuuuaauaggucuaucaugacacccacaaauacuagauuuuuaccuuguuuauaaaguaauauaauugggcuguauaaauguauagcucagcaguagagcacuggccaggcaaauuggaagcccuguuuuuuguuucuaguauucuaguaaaaucuguauggucacucauaaugacuuucaagugugugugugugugugugugugugugugugugugugugucacaaacacauauuuguuuuguuuugccuaaguauaguugacugcuggaaauuuaggaaaguauaaaaguguauauguguauaaaauucuucucucauauuguuaaguuccucugccuccguuccucccaauucacccuccuaccuucccucuccccgagaucuacuccuccucugucuccuuucaaggaaaaaucaaaacaaaacaaaacuaucagauucccagggauaucuacugaacaugaacauggccuaacaaguuacaguaggacuguguauaauguauaaaccuucauaucauaguuggaaguggcaguccaguaggaggaaaaggauccuaagcacaggcaaaagagucagagacauauucuacucccacuguugggagucccauaagaauaccaagauacauaaccauaauguauaugcagcggaccuagcucaucagacccauauagggucuguguuguugcuucagucuuucugugagccccuuaugagcccugcuuaggugauucuguggguuguguucuuguauccucauucccucugguuccuacaauccuucuucugcaggauuuccugagcucugccuaauauuugucugggggucuuuguuucuguucccaugaguugcuggaugacaguugggcuaggcaucaaucuaugaguauagcaaaauaccauuaggaaucauuucauugauuuuucuuuuucuguuucuuccaaguugugccaguaucccugucuaguugcuauccuuaaaacugcuuuuccuaaaauguuagcacuaaugugaaguauuuacuaaaauuuuuucauguaugaggguugaauguuucccugcacauugugaauguaaguguaaaguuuuccgacucuagcuggcuugguaguuuuaaagcaucauuuucuuaggguuucuguugcuguaacaaaacuccaugacuaaaaguaauuuggggaggaaaagauuuauuucauuuuauagcuugcagucuaucauugauggaagucagaacaggaacuccagacaggaagauggaagcagaagcugauguugaagucguguaggagugcugcuuagcuaggccuaccccucccucccugcauaccugggaucaccagcucaagggucacagugcccacagcgaacugggcccuucuauagcagccaucaaaaaucagucaugaaacuguaccacaggcuugcccacaggccagucuguuaggggacuuuuucucaguugagguuuggucuucacaagugauucuaguucuugucaaauuagcauaaaacuagcuagcacaauugaccccuugucagguugacacacaaauguuagacccuaacauuucuuuuuguucauccuccuauuaauguuaauauuacaauauaaaauauuccaacuuuaaaagucucagucuuuaaagauucaaacacuuuaaaaguucagucucuuuaaaacagcuaaagucucagaguuuaagcaucuguaaaauauucaaauucuccaaaauauccagucuccaaaauaucaaguccuucuaaaaauuccagucacuuuaaaaauucagucucucaacuauguguuccugguaaaacaaaaaaguuccauaguuuuugacuccaagaggaaauaaccagggcacagucaaagcaagcaaaagcaaaguucagcaguggacaguguucagugguugaugucugggaccuacucuuuaucaucugggcaucaaagggcuagaauuagcacuccuugcucugccagccacagcuaguuuccuaggcucuggauggcuccacuccauagcuucgcuguccuuggcauucaucuggcuucuccaaaaugcuggggucuccugcuauaacuagguugcaucuucaccacuguccuuucuugaguucucuucagggacucugauucugccacaaggcaugaagccuucuuguuuccaugacugcuucauuccuggggcuucuguuucaguugaggcuauacauucacccauggccugucuuggucucgaauaaugucaagccucagcugcucuccauguccucuucaguccugggauuuacacugcugcggaggccagacuuuuaccaauggcuucuccuggccucugaguguugcucuucauaauucucuaaugcagcgcuucucaagcugugggucaccaccucuugguggcucaaacaacccuuucacaggggucacauaucagguauccuacauaucagauauuuuacauuaugauucauaauaguagcaaaacuacaguuaugaaguagcaauaaaaauaauguucugauugggucaucacaacaugaagaacuguuuuaaggggacuuagucuuagcauuaggaagguugagaaccacuacucuaaugccuauaaaaucauuaguaaacucuucaaaauuacuuaguucugccagcaugagguauaaucuugacccuuccuggaccacagcuuuuguuugcuaacuccaaggaaauauuucccagauuuugccucacugaugcuagucucuuccuccucuucuuccuccucuucuuuugaggcugcaacauuuuuuccauuuuuuguuaauuuuuaaaaauuauuuguuucacuuuuauuuuaugugcauugguguuugaauaugugugaaggugucagaucuucuggaacuggaaguauagacaguugugaacugucgugugagugcugggauugaauccggggccuuuuugcccuuucucacuucuccagcugcugugacaguuuucauugagagcaaucaggcuuuuuuauaccuuuaucagaaagagaauauaauggcaguugccaggaucaauacaguuguaguugccaggauauaaugugugcaagcuauucagaguacacaagauugucuaagaccaagucaagcuuacauacuuccuugacuucugagggaauauacagagaaccauaaaguggccugaacccuucacugucugagggaguguauuagucuuucaggaacugcacaacauauugugcuccaugagccauggacucuaaccugaaaaccugugaggcauaugccucagggcagcuaggccagucaaagucuaugguuucccucccugcaagucagcccaauuagaguggauaauaguggaucuuugcuuuauuaaaggaguugcaaaaaagaaaaauguccauggcucccacaucccacuugaaaccacucaagccagacuguauugugugcaggaagaaagggagucucaugucucacauauucuuagcuucaagaguauuugauaguaugaaaauaguaggcaucauagaauucuuagauguggguacuuauuuuucuguugaaagaggaaauauauaagaagauagguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguggagcccagauuaaagguguguuccaccacaccuuuaaucccagaugaaaggcguagcccagauuaaggguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauaugccuaacaugauauaacuaucccucguacaaucgcuaacgcauuaguaaauuuacaaugggcauucauauuacuuuauaauccucguuucugcaacugguuacguggccuuaauugguauuuauaacuaccuuccucuacuacccauucuguauuuccuucuccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguaggagcacucccuucucuggagccaaaacuucuaggccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcaucuucaaaaggccauuccaucuuucuaucagcccagcugcuucaggaugguggggaacgugguaagaccagugaauuccaugaucgugggcccacugucguacuucucuggcugugaaaugaguuccuuggucagaagcaauacuguguggaauaccaugacgauagauaaggcauucugucaauccaugaauggugguuuuagcagaggcauuacgugcaggaaaagcaaauccauaaccagaauaaguaucuacuccaguaagaacaaaacgcuguccuuuccaugaaggaagugguccaauguagucaaccugccaccagguugcuggcuggucaccucgaggaauggugccauaucugggacuuaguguugguuucugcuguuggcagaucuggcaaucagcagcagcuguagccaggucagcuuuggugaguggaagcccguguugcugagcccaagcauaaccuccaucucgaccaccauggccacuuuguucaugugcccauugagcaaugacagggauggcuggggagagaggcugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagugccugaccauccagccaauccauuggcuacagcccaugagucagugaauaaucguacaucuggccauuucuucuugcaaacaaacuguaauaccauguguacugcccgaaguucugcccacugugaagauuucccuucaccugugucuuucaggguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuacuaccugauuuaguuuucgauaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuucccaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuaggaucaccuugucucuggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccaugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguggagcccagauuaaagguguguuccaccacaccuuuaaucccagaugaaaggcguagcccagauuaaggguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauagggcuaacuaauuucaacacuuagcccacaacaaucaauaaauccauuuuuuuguuugaauuccauucaugucucuguuccuuacuuuuacuuugccuuucuuacauuuaaaaaaaacuauugauucuuugugaaugacacauuguauacccuaauccuauucucccagucccuccauagcuggccucuacccuugcaaccuccccuccaaaacaaagcaaaaacuaaaaaauaaaaauuaaacgaacaaacucccaacaucuuagugugaaaggugugguaugucacacugugucacacaguauaccuuuuugcccaaacagcuuuacuuguaaacguucuuugcaaugauucauucgucugguucaaggccucuggcuucugcuaccccaucaauacuggauucucaccaggauuguugcccugagucauggagauuuuguagcuuugcuucuguaggacgggcuccuucacauacuccagcagcucauagaugggauagauggugggcugggccaacucaaggcucuggaucugggucuggcugguagcugaguuggucagcccacuagcucucauguccaagccacuaggccagcucucccguguuugccuagaugagggguggaacuagcucuccugagugccagagcuuggugaggggcagaacuagcuuuccuauacuggucucuucuuccuucuccuccuccuccccuuccuccuccuccuccuccuccuccuccuccuccuccuccuccuccuccuccuccuccuccuccucuucuucuucuucuucuucuucuucuucuucuucuucuucuucuucuuuugugguuuuucgagauaggguuucucuguguaucccuggcuguccuggaacucacuuuguagaccaggcuggccucgaacucagaaauccaccugcuucugucuccagagugcugggauuaaaggcgugugccaccacugcccagcuuacuggucucuuuuuaaucaccacauauuucucugcucuagccaacaagcaucaauugccaugggcucugggcucuuguuaaucaccaguuaucucuuccacucuagcugaccuacagaugauuaacacaaaauauuacacaaauggcccuggucgagucuuugcuucccuuugaaacaucaaacacccaaccacuauuaucugcauugcuuucagcauucuuaucaucuaagcucccugaucucugaacucuaagugucuuuuucagcucagauuguaaaugucgaaacacauggucaagucugucauagcaauaccucaugaucugauaacaauuucugucuauuucugucuuuaggguuucuauuaauaaaauaccaugaaaccaaagcaacuuguguuuaccauuuccuuaaauauaauagagguucaugaucauuuauaaauauuuacucagaaaagcugcaaauuagaaucuuucuuggcuacucgguggucuauaauuuggcucauuuuauauuucauuuguucaacaaaaugaccugggucacuuuucucuauuuuaaucuuuugugguuaagauuagaauccacagaguuccagugaacaguauauaacauacuccaagaccacaauuaaugaaaaccagcuguuuuguucuuguaagugauugcuuaaaaaagucauguggauaauuuaaaauaaauaauauuguguauuuuguaagaaauuuuguuaacguaagugaaaaauaaaauugaccucauuucuauuguagcaacaaauguuuuucuuuguuuauauggcuuauuuacuuuuaaacacagugagggcauagcagaauacuuaaaauaauaaguucuucaugaagaauugaugucauauuuguuuagaaaaugaauuuauggacacauuuauuucacugcuaaauaauaucuuuauuguuuaaaagaagauagacaguauauuuugauuuuauuuuguuucugcuuuaugauuaguacuuacaucgggauuuuuuuuuucuuuuuccaauuuuuuuuauuagauauuuuuucauuuacauuucaaaugcuaucccaaaaguccccuauacccucccccccacccugcuuccucuacccacccacucccacuucuuggcccuggcuuuccccuguacugggacauauaaaauuugcuagaccaaggggccucucuucccaaugauggccgacuaggccauccuagagacacgaguucuagggguacugauuaguucauauuguuguuccaccuauaggguugcagaccccuucagcucuuggguacuuucucuagcuccuacaucggggggcccuguguuccauccuauagaugacugugagaauccacuucuguguuugccuggcaaaaacacuggcaaagccucacaggauguuccaacugguaauaaggacacaugauccacuauguucauaggagcccuauuuauaauagccagaagcuggaaagaacccagaugucccucaacagaggaauggauacagaaaaugugguacauuuacacaauggaguacuacucagcuauuacaaacagugaauuuaugaaauucuugggcaaauggauguaucuggaggauaucauccugagugagguaaccuagucacaauagaagucacuugauaugcacucacugauaaguggacauuagcccagaaaccuagaauacccaagauacaacuucuaaaacacaagagaaucaagaaggaagaccaacgcuuggauacuucauuccucccuagaauagggaauaaaauauccauggaaggaguugcagagacaaaguuuagagcuaagaugaaaggauggaccauucagagacugcuccacccggggguccaugucauaaugagccaccaaacgcagacacuauugcauaugacagcaagauuuugcugaaaggaaccugauauagcuguuuccagugaggauuuuuuuuuuaauuuuauuuuccauaaaaggggauuauaacuaggcuuuauuuuaguuucuuugagggugaaaugguguggggcaggaucucauguagucagguuggccugcaauuugcuguguagaugagauggcuuuaaacuccugcucuuccugccccugcuuucugaauucgugcugggacuauggacuggcuguacaccaccauacgugguauuucuauguuuuagaggaaguuuccuuugaguacuuuucuauuucgucauccuggggauugaacucaggaucucagcaaugcuagggaaucacucuauguugagcuacauuucucuagcuccuaggcuuuauuuuauauuuguguuuuagguuuuuuuugagaaugugucauguagcccaugcugaucuggaacuugauaucuggaauuugagauugacugcagaucugucuaccucuaucuccuaagugcuugguuuacaggcuacuaugcccaguuuuaugucauguaggaaauagaauacagagcuuuuugcaugguaggcaagaccuugacaaacugauucaugucaguaacccucuauuaaugguuuuuagcacuccuuguuuuucaacuuuagugauuggaaggagaaaaauuauuauacagaaauaaaaaaugacucgaagguguucagucaacuucuaacuccccagucaauaaaagacuuuuuguugaggaaaugaggcggugauaauagcaugguuacuuguaguugacaauucuuauaaaauagcaauuuuuguuuguacauauauauauuuauauauaucuuuauuuuuuugaauucugauauaaauugaagagaaaaagaaguuuagauuuugggagaaauuuccuaccauauuuaacucuacuccuuaggucuuauuguagccucaggauugaauugaguguacucugaauacauuuaggcaaaucugugaagguggcuaguggggagaugguuaauuuuguuuauaucuuguugggguacaguguacucauuuaaaauauuucugaaaagacacuggcaaaaugcccuaaaauguguuagugggucaggugugcuaguacauguccuguaaauucaguaccugggaucuugaggcaggauuguccuucacaaguuaaugagacauugucuaacauuaaaaguggcuggugauguagcuuauugauagagcacuugcuuagcacacauuaagcuccagcacuaccagaagaaaaggaaguauugaagaggaauaaaaaauauuaaaugauguccauaguaaaugugugaauaugugaaauuuguagccauggaaaaaagagaagggaaugcuuaaccucuaguuguauuacaguggagaacgaaugguuaacuuuucccaaacccauuaauguuguuuuuuguagaaguaaaaagauaugcuccuacaguaaacuuauauuagauauauauaucuuguuaccgauguuuuguaauuaugagaaauaaagaauagauuuuucagaguuugccuuucuuguuaaagauacuaucuuuacacugugucuuuuauguucaacagauuuucaacaagcucuguaugaguugucauaccaugucauuaaagggaauuuaaagcacgaacaggcaucuaguguucuuaaugacauuagcguaaguauaucuauuucaaacaguaauuguuucguaucuccucauuuuugcuacaaagcucuuugacguguauaacauguacuuugucaaaauaauaguuuuaaagguaauauugguaagccauuuuugcucuacaaaaaucgacauuuuagucuuuccuucuguuuguaaggaagaaaagguuauaaaaacuggcuugagcaaaacaaaaguacuggaaugacgucaaagccuuaacuaauauuuugacucuagaaauaaaguauuuucuucaaauaaugauacuuuuugguaauuaugacuauaauuuuauuuuaugaauuaaauuauuuuaaauugcaguugcauaauccugacauuaauuuguuuguaucuacuuccuacuuacuuuuagaaaauaacagcuagauuuuuuuuuuaaaccuucaaguggccaguuugguuuuacuuacauuuauuggaggauuuaggcuagauucagagcaaauacuuucgaauguagauucaauguagauugcuaaugacucaggcuguuugauaauuugaacuggaagagggacuguuaauuguuaggguguuuauuguaaacucauaauuucaaguggugugcuagucuguugugagacuggucuuuagauuuguguaaauuauuuguccaacuuuucuaauaacuauugagaugguauucgggaacuuaugugaauuuucuguauguuuauguuucuguaguucuuuccugugggaguuuggaaugugcuucauaugauuuuugugcuuuucuuggguaguuuuaauggaaguuuuaaguuuagcuguugugauacuccaccccucccgaaguacauuugagcaggacgaauuuuaauauauauuucucuuccuuccugaaacugucuccaguuaacauaaagugguauauuucuuuggaaaaaacccuugcaucuuucuacuucuguucuuuaauuaaucugaguauuugcauucauaacccuugaacaacugagagccacuaagauaauuucauucuguaaauugagaguugauauaauuuuagucuguaugcagaauugacuacaauuauuuuuccauuuaugaaaauagucuaaauaaacauuaucuauacuguguuuuuagaaguuaguguguccuauauuuugaauacuuuauuauauguauauacuucuacccugcauugccuuugucauggcuuuuccauacuaauauauauuuguccaguaucuuaaucacacauauggauuuauaugacuccuagcagcugccagcuuuuuuucuuugaauuucuuucuuauagucucugaaaauagaugaauuuuaggguugcuauaguaccagaaaacuacuaauuacaguaacugaacugugauccuuacuaaugggaaauggcucuaaaauugaucauggaaguagcaagccaagaaauaauuguggacuaaugcuggugcuuucauccagaaacaagauuuugggucagccccccccccaaaacuauaaacaaagagugaauaaacaaaauaaaaagaaaaauugauaauuaugucaucuucacagaaucuugaauuauagaauaauugcuuuuaauugauauaaauuuuagauuucugaucuucugacauaugauuuuuuuuuugagauagggucuuacuauguauauguagcccuggcuaacaagggguuugcagacauacugacauacugcagacaugacugacagaagccugcuugccugccugccucugccugucuguacugggauuaaaggccuguacacaugcagcccaaguccuuucuucuaacugaucgacauucuuauacuuaugaaccuuaccuuggagaauucuaauguagacaugcuggacuuuaguugacuucuacuugauugaugagaauuguuuugaaauaauaacacuuuuuccgugcuauucuggaacugauuguaaaucuuuaauguaggaauuccgugaggauaugccuucuauccuugcugacguguucugcauauuagguaggugggaaauguuuauuuugcauguaacaauuuugugauaagaucagguuaaaugcuuuuuuuuuuuuacaaacgugcagauuuucugcaaaucuucaaucauuuuuaacuuuacacagaauauaguuuuguaaaucaaauauaauuacuuuauaaauuuuauaauuuaauuuaacaguauacuuuuuugauugauaauguauauuuauguaaguuugagcuaaaugggcuaauuucaaguaaaaaaaaagucaaguuuucucacauuugccugcauuucugcaauuauaguaacuacaucaugucauucaaugagauuucucugaaucucaaacguucccuuuuaagucuuaauuuuaaaaugaguaagauuagucaaagucauuaaaaguacauugguuuugaggauaaaaaguuuguguuguauuuauccagaauucauauaagaauucauauaagacuuuuuucucaaaaaggaauaauucuuugauuuccaauuaaagguagugucucugaggaaaacauggauuuacaaauaauauguuuugaaaauuuauuugucuaaucuuagcuauugauuaaauaacugagcauggcuuccccaucaguuuuguucuuucuguaauuuugaguccaaacauauaacauugcuagacauauauuaccuuuaaagcaagccuuaucuucaaggguuugccaaguuggaguuacuucaguuuauuacuuuuaauucccaggauuuggugaguuaauuaaauggcucacugaguauuuagaguuuguucuuagcuaauaugaauuccuuugguuuuugagaauguuucaaguuucagaacaguggcaauuuuaggaacagguuaaaauauauuugagcgagugauaaaugugaaagaaaggucacuaaugagucagccauguguccuguuuuuucccccuccuggaaaaaucauuaauagguaaauaaaauuaauaaugaaauaaauaaauaaauaaaaucaguaauaauuuuuuacacccaacuguccugguuugaaugauaaaguacaucuucacuguauuuaacugauugguuuauacaaaaugaaaaaagauacuuaauauuugaaaaugaugcuaacaaauauuuaauacacaacaaauuccaauguaaacacaauugucuuuuuccacaaauuauauauuuaggaaaccaauuucuaggagcuauuuuuuuauuuuauuuuuauuagguauuuuccucauuuacauuuccagugcuaucccaaaagucccccauacccccucccccacucccacuuuuuggcccuggcguuaggagcuauuuuugaaagauguuguccuuaguaguguugucuuucuuuaguacucaucaguuacuagccuuuucgcucucuucgauucuucaaaucuaguaguuuuuaaaaaguugacuuauuuuauuaaaauaauaccuuuccuucauuuuuuuagccaagugacucuuucuacaggucauugcauauuauuguaacauagauucaugauggugauauauaguuacuuugggggaaauuuauuccauacuacccaacccauuuuuacaggcaugauuugaaucccauacuugauuaagaauauccuucaucugcccccucgugcacacucacucuaggcaggaaaaaaugauacaaggaugacuccagaacaaguagagaaauuaggauuaagaaugugaucuagggcucuagagauggccuagagcuuaaaagaguagauagaggcugcucuuucagaggucuaaguucaaauucccagcaaccaaaggguggcuugcaaucaucuacaaugagaucugaugcccucuucugaugugcaggcaucccuccagacagaacacuguagacauacuaaaaaaauaaauccuaaaaaaacaaaaaggaaugugaucuagcuggcugggaaggcucaguaguuaguaacacuuguugcucuuacagagaacagagauuuaguucccagcacccacauggcagcuccucauccuuagguccaguuguagaggaucuuaaccuccauagguaccaugcuuaacuguguauuuguacauauacauacacacaguuaaaacucgugcauauaacguuugcaagaccagugggccucucuucccaaugauggcugacuaggccaucuuuugauacauaugcagcuagagacacaagcucugggggguacugguuaguucauauuguuguuucaccuauaggguugcagaccccuucagcuccuugagugcuuucucuagcuuuuccauugagugcccuguguuccauccuauagaugauggugagcauccacuccuguauuugccaggcacuggcauagccucacacgggacagcuauaucagggucccuucagcaaaaucuugcuggcauaugcaauagugucugcguuugguggcugauuaugggauggaucccugaguggggcagucucuggaugguccauccuuuugucucagcucgaaacuuugucucugcaacuccuuccauagguguuuuguucccaauucuaagaaggggcaaaguguccacacuuuggucuucauucuucuugaguuucauguguuuugcaaauuauaucuuguaucuuggguauucuaaguuucugggcuaauguccacuuaucagugaguacauaucaaaggggaacgccagggccaagaagugggaguggguggguaggggagugggggggaggguaugggggacuuuuggaauagcauuggaaauguaaaugaagaaaauaccuaauuaaaaaaauugaaucuauaaaaaaacucaugcacauaaaauuaaucuuuaaaaagaaugagaguuauguguaauaaugaugaugauacuaauaauaauauggcauaggugcuauuuuuggaacaccuuucauauuuuaggcaucauguuaaaguuuuucaucuuauaacaucuuauaucuuaaucuuauaacaacuauaugguagguaugcagauaggcaaaaugagguuuagugagagggagccugaguaacuugagaggcugauucugaaguaacaugaugcacugaugagaccuuggaggugggccaguuggcugaugauguagaagacaggaggaggaggaagcugagggcuuuuuagauaaucauaggggaaauuaaaaaagaacguacuaagugcuaauuaaggauacuggacggaauaagguaugaugaaacauuuauuugaaugcuguuuugaguaagaaggaaaauaauaaugaaaauagaggaaguauaauugggauaacuacuaaacuguguguugagacagguuaacuaacagauuuccugagguccuguucaguauuacuaccauaaucacaagcugagagaauaguaccuuaaucaggucagguagcuacgaggacuugagcaccaugugccugaacuuaaggaccuuagugaugucaucuuaacaacuaacucagagauaacugggaaccccuggaaaaauuaaugagaucaguuaagucuuugagaaaacaccgcuaaacguagagauuaacugggcuuggggguauaugcuucuagucccagcacucuggaggcagauguagguagaucuuuaugagcuugaggucaucggccugguccacauagcaagguccagacuugccagggaugcauuaugaagccccaugccaggaaaaaaaaaaguugagauuguauuguaaguuacauugcauaaaucauacccuaaauuuucuguuuaagucuuuccugugugcuguaguguauagaacccaugaucucacagauucuaagcaaguacuuguaccacuaagccacacccuuauccccuaaaauuuucuuaauguacuugugcuaacuuugugcuacaguugcuaggauauggguaaauggcaguugucaagaaggaauagugaagggucaggaaaacauuugauguuauaaauuuccuucucuuuugauuuuucauguugacaguagaauguaaacuaaaguaaaacuaugguaaaguugcauuauuucggaagaucuacuuagagguacuaguuauuacuucaauaagacuaaugacauuuauuguacagucuaaauuaccaguugacuuuaaaaauaaguaauucuaagcacuugguagguagaagcaagaggaucagaaauuuaaggucaucuuggcuauuuagugauuugacugcaagagacucugucucagggaaaaaaaucaguuaaagcaacaaucugaggucaaccuuuguguaauucugcuuaucuuauuugaaaauuuugauguuuggcauuuugcauuaauuguuuuauuuuauccacaccucagaucuaagcuuggauacguuuucugaacaauuuuuaaaacggagggaagucuguauuuuuacacauuucaguagaaauaaaaugccaguguugaguauuuuuauuuagugacuagaauuagucaaaacaggauuuuaaauauaccuuuuaauacugacuuuucauagacuuggugacauuagacuucucaacuucauugauaagugacucuuaagguuaggaaacauuuuuuuuuuggugccagcccuggggaaacugagaaaagagaauugcuguugauuuaaaggucagccugaaguucauugcagguugaagacaagccugugcuacauaaugagaccguuuuguuaaaaacaacaacaacaacaacaacccuccccaacaacaacaacaacaauaccccccuccccaagacagagagcugacuuaguggauaaagccuuuugcuaaggcaugaggaucagaguuugaauccucagcacacacaagaaagcaggguaagggccauguggcuguacacauacagcucuagucccagcacuagggagguagaggcagguggaucuuugaguuagaggucauuuguauuacguagugagacuuugucuuaaaagggggaaggggucacuaugguggcuugccugugugagaaacggacauaaucuuuggcaagcuggcuaguuauguuagcuaaauuggcaaacuuugaguucagugagagagacucuuccucaauaaaguggagaacaauugagguagacacucgacaucaaucauccuauggccuccauacacgccaauguuaacaccacacuccugaguaugcacagagcacauauauacccacucaaaaagggguugggagacaaaacaaccaaccaucagaauggcccuuuuugcuguuguuguuacaauacagaaucuuccuauuuaguccaggcuggucuugaacucaugauccuucugcuucagccuucugagggcugugauuacauuuguguaccacaaagcccaacuaauguggaagagguuuuuucuuguuuccuaguucaacuuggccauuauggaaugagucucuauuuggcaccucugacgaguggucauuuaaacuuuguuagaauuuuuuccuuuuugaaaauaguauuuuuauuucugaaauuguuuucaguguuucuugugauacaaacuuauuuauggaugcaugcuauaggcuacagggucagucaucaguauuaagagaaauuaagguuuuaugaguguaugaaagauauauuauuacaguuuauauuuuuuccagauucaguaagaguuauuuuuaaucaauuauauuuauuuuugagacaagguauuucuuuguuccuggucugaccuggagcucauacuguagacuagguuggucuguagcuucggagccuuacgcccccugcuccugggugcugagacugcuuacagguguguacuaccguaccugacacagaaagcggcauuuuuaacuaaguuuuaaagaagacgaaucuuuuaguaggggagaguauagaaaaaugaaauuuguaucucuuuccuucccauucuagauauugaaacaaauuguuuagaagaaaaaagcaagagagacuauuuuacacaguugguauuagcauguuugguaaguuuucagauguauuuccccuucucaaauuugcauugaauaaguauaaucauaguugauaauuuuaaaugaaggaugauacugacauucauuugacuuaaugauaaggugagauuuagaucuugaaauggaauguuuugugaaauuagguauucaauuucuguaaaauaaucauaauuuuaaauuauuuaaucuauuaccuauaaaaacccuuagugauauuucugacccagucaguuccuaauguagaaauuuuaagcaacuaugaacuaaguagaauuuguuguaguuuguucuuaaacugauuuuuuuguaaacuuuauuuguuagggauaaaaugauggaggcaguuuaagaagaauaacuauaaguugugcuguggaugcgguuuaguugauaaacuugcauacacgaaacccugguucuaccccuaguacccuauaaacccggcauggggacacuugcuuguaguuggagguggaaacaggaucagaaguucaagaucauucuuaacuacaaugaguucaaagacagccugggguucaugagacacugucuuuaaacaaacagcaacaacccuuccccauaaaaauagaagucacaauugucuaguaagccacuucauguucguaaaauuagagccaaggaaaaguaccauuacuaggauguagaagaacguccuugucuuuguuauauuacaguuugguuuacuguagaaaauguagaaugcugaaguacuuuguuaagugaaaacugaguuaagauaggcucaauguaaggaaauuuuuuuuucucgaggcaggguuucucuguguagcccuggcugugcugaaacucaacucacucuguagaucaggcuggccucaaacucagaaauccaccugccucugccucccaagugcugggauuaaaggcgugugccaccacugcgcucaauguaaggaaauuuaaucuguaguuuuacucuaagcuguguauagcaaacauguaauuuuaaaguaauuuuugaaagagcuauauaauuuacuuuucaguauuuggagggucauuuuguugaauugaaauuuuaggcuuauaaagagacacaguuuuauauucuuacauuggaaagauuauuuugaauauauuuaagaguguguguacauaguuggaaugcuaaagaauaaauggucuuuaauauuuuuuaaugcaguauuuaguuucagacacaguuuugaaggaacgauuggauccagaaacuuuggaaucauuagggcuuaucaaacagucacagcaguucaaccaaaagucaguuaaaaucaagacaaaacucuuguaaguauauguggcuuauguuacagaucaaguagcugaauguauaguucucauuuuaaaucauagcaguuucuaaaggcuccuugaagguuuuuuuuuuugaaauuaacuuuauccuuuuaaugauauuucugauuucaguuauaagcagcaaaaauucaauuuauuaagagaagaaaaugaagguuaugccaagcugauugcugaacugggacaagauuuaucuggaaauauuacuagugauuuaauauuagaaaauaucaaaucuuuaaucgguaagccauaccugugucuauauaauauguguuauuaagacaagcuuuaauuuuaacuuuuagaagauauccauaaagaaaaaauaaaucacccucaguuguauggugaguuuguggacaacaggaaaaaaaccaaagaacucuacaccugggauuauauaacuuuuaauuugaguauuuuauaaauauuuauaaaauuuaucaugaucuuuaugaaaaaugguuuugucauuguugccuguaugauuauucuaauguucucucuaauucuucugucuguaaauuuuaacuauaucucagacauuuucauagaggguaaaaauaaaacuuuaauaaauguuuacagaaacuugauaaauaguuuuuuugaacuugauuuuauaaauacaguuugugacuuugauaacacauuuuaccuuuauuucugaaaguagcagaaguugcaaaaauauagcagaaaauauuuucucuuuaguuuuaaaauagcauuucugucacauuacuuuugucuugagcauuugaagagaguagcugacaauggacaggaggaaugaauagggcaagccugguuuucuaagauuggcaagaauuccugguauuauauaguagguaguguucuaaugagggaauauuuuggaguuguguaaagucauaguuuuugugauuuccaggagaaauauuauuuccuaccucauugauuacaauguagcugccauuuacccucaauugcuucuuguuguuguuuuucuuucuuaaucauuccauuuguuuacaucucaaaugauaucaggggauaucccuuccugguugcuuuauuugaaugccuacacaaagcauuaggagaagggaauaaggaacauaaguuuggcugaauccuuauucccuucuccuaaugcuuuguguaggcauucaaauaaagcuggguuuacuucauucuuccuuauuuggcuuggcauuuggugacugcaagugcacaagcuaaggcuacauucaguuuaaauuuaccuuuuucuuugaagucagguuuugguagcugaucuaguuucuuuuguacuuuuguccuauggugauugaacaucaggugagugagccucuagcccugaaggagucuugcugucuucuauggccuugacuaugucagugaccuguuuuuaaaacuccucuaguacagauuucuuuucuuuccagaacaggcugugcauuuuucccugcagauuuuacccucuuuuaucuagcuugugaagcuugucaguacugucauacuguacuguuuuuucuuccuuguacugugucauguccuuacuuaagauaguguucucucgcucuugagaucucauguuauggagagccucccagcauuugcuuucauuuugucuccuuuuaugugcacaacuccuuuuucucuuuuucuuuucuucuucuucuuuuuuuuuuuaauuccuuucuggauucuuaccuuuuuuaugccuuuguuauuuuaggagcauuacaaagacuuuucuuaaagguaugcuuugauguaacaggaaauuguauacuccucucuccuucaacuuugcucuccuagaaaaguuuauuaucucuguugaccaacgugauggcaucuucacuuuaggcucaugauccacguggaugaucuauaauuaaaacaacuugauuucuuggucugcguuuauuuuaacccaucuggcauccuguaaagugugguagaccagauagacucagauugcaucuucuuaaggcuuuccuggcuaucauuuucagcacuccuuaguuuucucagguuauuuuucuuguuaacacuuaaugcuguauugaguauaguugauucucuguuucuacaagguugaaaauauucauggaagaaucuguuaugaguauguuguauuaguuauaauaacuaaucuuucuguguuaugaaguaugcaagaucauauauaucaauuauaugcacaucuuguuccauuuuauauaagaggcuguagcaucuguugauuuuggcauccuuaaggcagucuuggaacaaacuuagacacugaguuuuaugucucuaccaucagcucagugaggacaauguuuuuuguuugcuuuguuuaguacccaauucuuaaggguugguuggugcuaaauaaauaacuaaauggaaaguuaaugaauauucugcccauuucuagugucuguagugauuuuuagucucucuuuucugacauggaggcauuuagaaagcuuaacucccugacucuguuucuuucuggcuaaguaaccuuuuguucccucugguugguugagaaaggaacauuuuauguugaaauugaggauaagaauuuaauuucauuuaauguuuuuuaacauucaaauuaauugugugcacuaugaguacaacuccauuuaggucugaccaaaugcuucagcuuuacagcauccugguuucuacgacaucuuuggcuagguuucuucauguucauuuccacuauugucucuuaauguguaaucuagggagguaauacuucauauaaaacuaucuuagcucugauguucauuagccguugugagaaacugauuccuaguuuggaagguuugcaggcuggguacaguuauauucagaugcacugaucuggagaaauccucacuuacacccuuuaagauucuggcagaugaaagucuauguaacuguuuagccuguguuguguauuaguaugcaaguaaguacagaagcagaguugcuaggauuauguggugaugguugcuagcuaaagugugacaguaaaugggaauaacuuacuaaguagggaugaaaaaugauuacuagacuacuaagaaauagguccuuucaagggaauuuuaaaucaagguggcagauauaauguauauuuuaaacaucaaagaaaaauagaggugggcucguuuuuucugaacuaaacuauuaacguauacccgucuguccuaaaaaaacaaaaaacaaaaaaacauuuucaauaccuuaaauauguacaauaaaauaugauugcaauaguuucaucuaaguuaguauucaacaacauuucuucuuucauuuuucuuucuguuuuguuuuaucuuugagacagggucuugcacaucauucaaucuugccugaaacguugauucucuugccucaaauucuugauuuuuuuugcagucuuuuuaauuguuguaguucauacauauuuuacuuuacuaaucucucauuugauacuuaguuggcaaagcccucccaccccccucccccaccccguucccuguucuguagacugucuuuucacucuggugaucauuuaauuugcugugcagaaucuucuaaauuucauguaauuuugucugucaauucuaggaaucauuuccuguuccauuggaguccuuuacagaaaguccuuguuuaugccuaaaucaugagguauuuuccuguagcauuucaaguuucaggccuuauguuaaaguuauugauccauuggaauuauuuuuguggaggagagagaugugggucuacauucuuuuccacauugauauauacuguuucccaggcacuauuuguuggaaaggcuaucucuuuuucaauauauguuucuggcuaccuugucaaaaauuacauagcuguuuuuuuauuucuggaucaucuaguuuauuuguuuguauacaguauuugucaaugugguucuaugguguaauuugagaucagguacuauguugucaccagcauuaguuuuuaugcuaaggauugguuuguacuugagaccuuuugugcuuuuauaaugaaguuuuaauuuuuguugugagacagagucuuccuaugucuuccugcugcuuauuacuugcucuguagaucaggccagccucagucucaaagagauuggcuugccucugccuccugugugcugggauuaaugguguguaucacuaugccuggucauguguggucuuacucuaauguguucuugaauuugguuuguauaugugucuuguuggacagauuuuccaccuauguuuuucagggaaauugaucuguuccuuucauuuguuguugggaucugaccuggcauuucuauuagguuaguguugauuuuguaggaugacuuggcuaucuuuucuucccuuuagguuuuguggaacaguuucaggaguaucaguauuaguguuucuuuaaauaauugguaaugucugggaguuauuuuuuucaguuguggcuuuucuuuucugggaggugcucuuuuguuucuugcucauugcuguuacggaucuauuuaaauuguuuuuagcuucuugauuuaauuuugauggaucuuauguguuuaggaauuuuucuuuuagaauuucaaguguuaaauauaaguuuugagaguauucuauaaugcucaucugaauuuuacuggaauuugcuguaaaauucuccuuuuccuuucuauuuuacugaucugggccuuuucuuucuucggcuuguuuuauuaggguguuaaucauacucauuucaaaacacuauuuucuuguuuuguugauucuguauuuaucuccauuugauuaauuucugcccccaucuuuaguuuuuuuuuuuuuccaccuacuguguuuggggguugucuuguucuuguuuuuuuuuuuuuucucccuacagcauugggaguauaucauaaggguauuuauuugaaagcucacugauuuaaaaaauguaaauaucuaguuacaaucuuuucucuuaaaacugcuugagguauagcucauagcuucugauaaaguugugcuucuacuuuucacuuugaaauuuuuauugaacuuuuuauuuuuuucuuauuucuucagcggcucauuuuaguuauacaagaguauauuguucauuuuccaauccaaguauuugugauuuguguaauuucuuuugcuaucaggugcuuguuuuguuccacuaugaucugaauaaagaacuuacuucaguucuuuugugugugugaagacuuguuuuauguuguauuucuagcaggcuucauugauugcuuauaagaauguguauucuguuugauagaauauuuugcagauaccugcuaacuccacuugaucuaugguguaguuuaacugacauauuucuauuagagaaaacagaacaaaaagaagcaaccaaacaauggcaccugccuugguuguuuauugcucuaguucuguggcaccuagcauuugcauucccauucuugugguccccuauuuucaggcacccaguauagcccaguuuuaagcaaaagguaaauucugaagaugaugcugggucacugcacucuugagucacuucugccuauugcuguggaggaaucugcuauuuuguggaggaaucacuuucuucaaaaaucugcauccggauuugaggcuuuugaggucuguaggcuugucucaaaguaugccugccagucucuuuugagcaggguagccuaucucaccuuuuuaauggggcuucugcuuuccuuaacuucaccagggaaccauguggcuguaucuguguguguuugacuuggcuucuuuucaauguguuaccuguuuuuuccuugauaguuuguagcuguuuagugagagcuguugaauuuccaaagcuuucuacuuuguuguuuuggagcaguguauucuuuuuacacuucucaucucuuuaccugggucaucagaugcugcuuucagucuggugucuuaccacaguuuuguuuguuguuaucuaagcuugaagauuugguguggaaaguaggaugagagucuuuuccaaucucauggguucuuuuagucacauuacagugugaccagagaaauacuaaaaagaaaauuaagugucaagccgaacaauucuuugaaagauuugaggacauucaacuccuuagauuacauuauuuugagagugcuuaguauaaccugaauauaaaauuuauucauuccagauucauauugucacuauaucagcuuuuuagaaaaaucucuuuaaaagggaagucaguuggcuuuuuucuguccccuaaaccuuuucuuauuauagucacaguacuacaaaccaccaccaccacuaauuaauaacaacaacaacaacaacaacaacaaugaauguuuucucuguguaucccugacuguccuggaacuagcucuguagacuaggcuggccuugaacuuagagauccaccugccucugccucccaagugaugggauuaaaggugugugcaacauuauccuacacacagguuuuaauucauugguucauucauucauucauuuuuuucacacaaagcaucccauaucuauccauuuauucaaccauuauuucagaaaauauauacccacuggagccaccccucccuccacuccucccaguccccauacuacccccgcucucucccagauacacugcucauuuguuucccuucggaaaagggcaggcuucccaauggcaucaacuaaacauggcauaauaaguugcaagaagacuaguuaaaguccacauaucaaggcuggacuacucagagacauaugcaguugacuauaauuugaaguuuccacccccuacuaugcaaaagaagauaguuauuaguguucucaagcauaccuuuuaaauuuuuuucagaauaaugauacuuuuaaguauaucuucugaaucuugauccagugauucuugcuucaagaugugcuuuaucauguuuuuuucuuuuuauauaagugauauuucugagacauugucuacuguagauuauuuagcuuguuucuuucuuugucaguauuuuggagagguguguugauguguguguaccuucauguguuuucauuucuagagguugaacucaggaccuuaugcauccuaauuagacacuauuaaacugugucuucagccuuauuaaccuuuuuaaaaaguaauucuuccugguuuuuauuuuuacauuaaaaccacaauuuccucuguguucuaaggucuauccugccagcaacaugauuauugaaucuguaaucuuguuuacacauggacaccucuccuaguauucauuacaguauuaccuugguuuguuauuuccaugguaagaauuucaguuugggcucuagagagauggcucagcgguuaagacugacugaucuucuagagguccugaguuuaauucucagcucauuacuaucuguaaugggauuugaugcccucuuaugguguaccugaagacagcgacagugcacucagauauaaaugaauaaauaaaucuuaaaaaaauguuuggcuucauuuuuacaacaaucauuguaaacuuaaucauauuuuugcuuguaacugguugcauuugcuguacuauacuaucuguccaucuuuugauaaacuccaguuacuuucaguacaauuucuucaaugaaaggcauggacucucuuuaaggauagaagagguaguguauuaauugugcaucacaaggucauggcauuuagugcauuggauagcuauguacacauuagauggaggaauaaguucauggcuauuucaugucugucacuugcuuuuccacauguucuauuccagaaugauuuucucuuucuccaaaggcauaaagagcucucucucucucucucucucucucucucucucucucucucucucucucucuccccucccuuucuuucuccuucucccucuccuuccucgcuccaucucuauuucuugcuugcuuaauuuuacugguaguugagagcuaggauaaacaaaagcauuucaggauacuuaaacacaagagugccuaaguuccacacagcaaucauuuggaaaagaauaacuuugaauauugaagcuugcugauuguuuagaguuuuacuauuauauagaaaucuaaaguuaaaauguuucaacccuucagugugacgucuuuaaacuauuacaaaugcuaaagguacuuucuuucucugguuauuucuauuuucauguauaaaguauguagcuuuaaaaaagcuucuugagaagauuguccucugaaggaggggauauaaacuuugaaaauaaguuauuaaaauauuuuuaucuugccauauauuaucauuguugaugacuuuaucagagaugaugugauuucuuuugaacuuauauguaccucuucuguuccaggaugcuuuaaucuggauccuaauagaguuuuggaugucauuuuagaaguguuugaaugcaggccagaacaugaugacuucuuuauaucuuuauuagaaucuuacaugaguaugugugagccacaaacacugugucauauucuuggauucaaauucaaguuuuaccagguaaaaauguguguguguguguauauauauuauauauauauaauauauauauauauuauauauguguguguguguguguguuuggaucagugucauaauuuuguauguauaguuuguuuuaauuuguguuguauuauuuacuagguucaucagaugagauagagaaaugaaaaguuaaugauauguugugaugagcgcuauguuaaaaguauaaaugauuugaugagacaguagaggaaagcagaauuaaauuuugccucaggagacagggucuaguaauacuuggaggaguagggauguguugaaaauuuucuaugcagaaauaaacugcaagacuaaauauugguggugugggaauauauaacugauugaagaaauagcugguugucacuugccuguuuuguaacgugaggaaggagugguagaaaauugucucuagauggagagcuguguauuagauugccauagaccuuugacugcauguuauuuuaggauuugauuguacauaugaagggcauuagaauguuuuggggauguuaaguacuucaagaauauuucacuauuaaaucaguauaguagcugaagacacccuauuucuguguuucucuuuuagucugccauauugcuacuguuguuuucuaaaagauuugguggggaugccugacuacugaaaagucauuucuggugguguuaagcuuuuauuaaaacauuagccacagcugcuucucauuuuccuaccaggaaccugagaccccauucuuauuauagggaaguaagucaaagugucuuaucaagaaaccaauggcugaaauggaaagguagagaaaauuuaacuugguccaagauuaauacuuucagaucggauaacauugaagauugaugacauucugaguaacauuaaguuaauuguuaguuuuagaauuaaaaguaguuuuacaugaacauacaguuagugauauaaccaguguaaauuugggacuaucuuauaauauuugaauaauacuuuuuggauauuuuaaaauauauauuuaauauauauuuuuggauuuuuuuuaaguauaagaaauacuuaaguguuagaaacaacuuguucuuguaagaaauaccucuauacugcucugugugacaaucuuucuuuuuuacucuugccaaaucuaucuaguuauugugagaguguagucuuaugacugcugaaagaaagaggaaauugucagagauuuuaaauaauuuguggucaugugagggaaaguaaggaaagcuguguaaaccaagucuuauuuaggagauguaaccacggguguaggcucuuaggaauguguaggcagcauguauauuggucucuucccuaaugcuuuuguucucuccaaccaccaccugaaaaugcuaacucccucuuuuuauaacucacauaugacaaaaccacuuaaaguggaaggacacaaauguguagguacaagacaguuuuauucuauuguagcuaagcuguuaauuaaaucaaaguaacuuuuuccuaagucuaaaauuuuaauuguaaugcugaaaguacucacuaagaaacagaaaaggacaagaaagaaauccaaauggcacacagaccaaagaagcuauugggaaugaggagcaaaaaucacagcaaaaggcccagaaagucuauccuucauauuaauucuucuaacuguaaaauugaucucucuaauuaaaagucagguuuuggcagaguacacuuaacacaaaacacaaacaaaaaccaaauaaaaacaugauccaguauuaugcuagguaaaagaaaacaauauucaaagguacaaauaauuagaaaauaacaaucuagaagccgguauuauauuugcaugugggagaaagcucuggugcccauaucaacagcagauaggguagaauucaggucagaaauuguuaugaaaugaugauaaauggccuguaaagacugacaguccauguaaugauuuuuaaauaguuuauacuaguuauaaacacaaaucagcuaagcagcauaaccucuaaauuuaugaaguagaggaacaguuuauauuugacccgagaguauaaaaguuguugagaugaacuguuuagaauaggauuaagggaacagugcaaguggucauaauauauucuauucaggaaucucagaagagauuagaaguuaaagaagcuuuuguauauuugcucuuuaaccagcuauugccaauagacuagacugauaugaaauuuauccugugauaauuauucaccuuuuguguacccugaucuuaaucaaugaucaaauuaacuagacauguuaaaaaugaugaguuucaccuguaauccagguacuugggagguugaugcaaaaacaugaugagucuuacuugggcuacauauugaaaccucucaaaauacaacaaaacauuaaagugaacugggucuaauacacacauguggaaaacuccacccaacaauaccaauauauuuuucuuuauacaccuggaacauucuccagcguaggccauauauuuagaauuuagaccacagaacaucuugaauuacaaaauacuuugugaucauaugcuaugguauuugauuauagcuauagugauggacaaugaugugaaauuuuuugacaucaguuaucuaaauugagguuaugagacuagugaaugugguuuuaguauauucaagucauguaucucaggacagauuaucaauaaguucaguaagcuuuguuuugguaucaaacuuggaccaauauuuguuuuuacugaaaauacuuuaauucaaaauauccauuuaugugcaaauguuuagaaucaagaaccuauugcuaaguugaagacuuaucuauuguuaaaaaauacaacaaaacaguaucuucuuuaaacaacacaacguaguuugguuaugguuauauuacacauaccaaguguggcuaccuguacuuacagacguuuuauuucaguguuguaggaaaucuguaccuuuuuuuuucucugauauccacuuauuuuuuuuccauuuuuuauuagguauuuagcucauuuacauuuccaaugcuauaccaaaagucccccauacccacccacccccaugauauccacuuacuagugaguauauaccaugcauauccuuuugggucagaguuaccucagucaggaugguauuuucuaguuccauccauuugccugcaaaacucaggaugucaucccagggaugcaagguugguuuaauauaugaaaauccauuaacauuuucauaguuuauauaguggauauaauccacuauauaaacaaacuaaaaaaaaaaaucacaugaucaucuccuuagaugcggaaaaagcauuugacaaaauacaacaccccuugaaauuaaaaguguuggagagaucaggaauucaaggcccauaccuaaacauaauaaaagcaauuuacugcaaaccaauagccaauaucaaauuaaauggagacauacuugaagcaaucccacugagaucagggacaagacaagaauguccacucuccuauaucuauucaauacaguacucgaagugcuagcuaguacaauaucacaacaaaaagaugaaggggaugcaaauggaauauucuuaugcauuguaaaagaugcuuagucucaaaacuguuuucuuguacuuaucugaagauguuuugggaugcuggcaaaagucuuugucccacuguucagaucuuugauuuuauaaugaagaauauugaaguguauuacuuaauuuuauugaugaaugguagagaaaagguaagauuuuaauuuuacucuauaccuuaaggaauucuuccucuuuuaggaaccaaguggugagacgccaucgucuuuauacagaguugcagcaguccuccugcaauuuaaucucauugaucuagaugaucuuuaugugcauguaagucaagugcuuuguuaagaguuuuucuuaugcaucccagggguaaggaagaggguaagcaccucacugcuggcucuagacuuccagguauuauuuuugaaggcauuauauauuauugccuugucuaaaucaaaaauagaguagauuuucuucuuugauaaacaauggaagguaacuuccucuuagucacccuuacagguuucaagauuggauauauagcucuuuuuuaaaucauugccagugcuuagcucauggggagaaaggucaagcacuaaacaaugucguuuuaggcuuuuuuauuuuuauaugaaacuuguaggaaauaggggacugucuagaaacuucuagguagguaaucauugcuguacagcuuuuaccucuaauguuuacugguuguuuauauuagccuuagcuauuugaauagauugugcauuuuacagggguuaaaacauuccuauuauagcucacuguggugccuaagucacuuaaaaaucuuuuuggcuguguuuuuguuugugucagguuuauuauuuugaaaugcuuauaguaacaauccuccacuuggacaagguagcuagaucugagauaaucaacccucaacgauggaauugauacugauuagaaauuaguuugugauuuaugagauaccaacuuauuaauaguuuuuauaauugaaaauuagaacauuuaaaucuauucuuuugacauauaugcaguacuuuguuucguuugaaguuuggcuuuuaaagguaaaauauguacuuuuuauuuuggugguauuagaggucaaauaugggguguaguuugcuggacaaacuuugcuuuacugcagagcaccccuccuccugguguuuucaauggaguagguauauauuuuagguauauuuauaaauucaaugguaaacaacucuguaguaugaauuuagagcuuuuaaaauacuaaagauaaaaaaauauuuguugcuaugugacuuuaaaauguauguaaaacucagguauucaccuuuuaaaauuauugggcaauaaggcaaacuuauuuagaaagaauucauauauaugaauaaacuagccuucuuauuuauagauguacuaauugagcaauauucugcauuuuauauaugcaagcuucuuguauuaacuuaugaaauuuuaaugaucuauuuuuagcuccuuccugcugauaauuguauuauggaugaauacaaacgagaaauuguggaagcuaagcaaauuguaagaaaacucacaaugguugugcugucuucugaaaaacuugaugaacgagacaaagaaaaggacaaagaugaugagaaaguugagaagguacaucccucaggccagcaagacuuaccuuguuuagaauuaugaccuuucauuucucaugguuaaucaccuuauggaguauguucucuuaauuuugauuaugugcaauuugauuuagguauuauucauuugaacuuuaauaugaaugauaccuucauaaagaaaacucuuuuucuuaugaauuucaaaauaaaagaaaaaaaaaaucacaaaauauugauuuuauuuuucuguuuauauacuuucuuuuuaauccuaaagggauucucaaagaugaaugaauucuagugucucuuguaugguauagcauuaaguccaacuuaauuucauauuuauaaauuauaaugcauauguauguucuaaaugggaaaaugcaacaacaacaagacaauaaaacaaaugcccaaaagaucauauuuuguuuuucaagucacugaaauuucaggcaauuacuguuaaguuuccuaacuuuuuuugauguacaguauuaugauacuuaggucaaguuuuaaagagaaauaucuguauuccaaacaucauugucauguuuguucauuuuuagccaccggacaaccaaaagcuggguuuguuggaagcuuuguuaaaaguuggugauuggcagcaugcacagaacaucauggaucagaugccuccauacuaugcagcuucacauaaacuaauagcucuugcuauuugcaagcucauucacauaaccguugagccucucuaccgaagguuuguuauucuacacuaagcauuaagauacaaauaguuucagguuacuaaaaagaguuguguauuacuaucuuugaucuuuaaaucuaguaucuguuacuauauuuuuucaaaacauaagaacuauucacaggguaugucagucaugugugcaugacuucuguccuaauuucccagucuucuagaaugugugcugcaaaauaugaaaacuccaaguuaaguuucuggagccuguuugcauuauugagagugaaaauaccuuucuucugauuuugccuuucuucuugggaagcagaaaguuuccccuuuaaaaauuagccuuaguucccuauucccauuuuucuauucugguguuaaugguucugacugaagacauuaccauucugacaggcugccuuuugggggaaauuacuaguuuaauuccuuuuauccugaaugugucaacuaguccuguugacaucagccuauuuguagagugcuuaggagcagcauuagcagcagcuguggcuugaacuucauagauuagagccugcuucaaaagccacaaccuucuugacuuguguguagcugcugcuuucauuguaaccuaggguguagacagugcaggccucuucucaaagauagagcccugagacuuaaaguaagaccucuacuuacucuacaugagaaaccucugggcaugcuguccuuucuacuaggacaacuuggauuggaugguuagcuugccugcuacugcuuccucauacucaguauaggaaaacaguagauccuagauugagacauguuugauuucaucuugucauacaucugauguccaugccguauucuccauuccuauaaccgcaggcucuguguuggucaagcuuaacuuaaacucauauucaauguuacuugagaucuacaccaagaguuccuuuauguugcuaguuugaaccauugucuuuuugaguuuugcuuucaugcuuacugaauuuauuuuuguguuuugccagcugagaauuauuuacuguaauaaagugagugaugauuagaauaguuaaagcaaauaugaacaagaaaaugauugugucuuauauuggagacuuauauauauauagugcauagauuucuaaaucuugcuuuuuuuuuaaauagaguugguguuccuaaaggugcuaagggcucaccgguuagcgcuuugcaaaacaagagagcaccgaagcaaguagagagcuuugaagauuugaggagggauguauucaauauguucuguuaccuugguccucaccucucacaugaucccauuuuauuugcaaaagucgugcgcauaggcaagucauuuaugaaggaggucaguaagguuuuucuuccuaguagaaaauuaaaaauugaaaugaaauguugugaauauguuuuccugaguauuucuagaaacaaacaagcaaaaaguaaacaugaguuaaggaaaguuguguugaguaaacucauuuauggaaagcccuuugugucucaauggugauuaugucuauguaucaaaaccccagaucuagguauacgauucaaguaccucccuugagaaacucuuugcuugauuuccauuguaacuugcacuugugcuuacucuucuuuucccuuaccugucuucuauggauuuucuuucaugcaguuuugagucauuauuaaauguuuggaugcuuuccaacuucaaacagugcaggauuauuauuguauucuuuacguauuuugggaauaaggauugagcuuggggcauuguguguuuguaugugcucuacuuuggagcuaugauuccagcucauuuuucuuuauaaguaaaguuuuuauuggaauuaauuaugugacagaaaaauauauaaaugcugaauauacaguucagugaccuuuuuaaaacuaaacacucaugugucuaccaccuaaauuaaaccaagaaauugaauaguaccaguaguggugcuaccucauuuguaaccacuuagacuauuucaaaagucugugguguagaauguucauuugcuagaacaucuccagccuuagaugcuuaauuuucaacuucugauaaauugucugucugucugucuaucugucugucugucugucugucugucucucucucucuaguuuauacccauugccauaaucaccauaaauaauuacuagacuauuuucaucauacuugcuguuaacuucugccacuucugucacuuuccccuguguugcugcuuucugucacuauaauuuugcuuuuucuaugaucucauauaaauagaauuauauguucacucuucugauuucuuucacuucaugguuuuagacucauucaaguuauugcauguguuaguaguccuuugcugaguaauaauaucgcacuauauggaaacauagaguccuugauacauuugucaggugaugaauauuuagguuauuucugugaguagcuagcuauacuuuugggaggcauguuuuuguguugucagaagugggauugauuagugaaauacauaaguauaacugcaaaauuguuggauguugugauacauacuuuuaagcucaggacucaggaggcagaugcagucaggucucuaaugcgaguuaugaguuuguggucaggccagccaagccuacauaguuaaacacucucuuaaaacagaaaaaaagauuguaaaaacuguuugacaguguuggcaauguuuauaguauuuuauauuuuugagaacaauuauuugagacuucuagaugcucuacacccucacugacacaugguauuguaauacuuaaauuuuuguuaucuuaaugaguugugguaucuuauugugggucuauuucuugucaugcuaaugacuaaugauguugaguaucuuuucauauguuuauuugcuacuuauaauuauuuuuagugacguuuguucauaucuuguccauuuuugauaugacuaucuuuuuuauaugucuuuguauauuguuauuucuaaggccuugaccauauaguuaguuuuugaaaaagucuuucagucugguuugauguuucaguuuuaaacugucuuuuauaaaauuacguguauguguguguguggggggguggggggugggguaguaggagguuugugcaagugggcacaggugccaggagagaucccuuggagcuguaguuacaggugguugugaaccaaacuccucuccucuggaagaguagagacuauugaacuaucucugugacaucuuaaacaucccuuauaugcacauacccccacacagacucauacaacuaaagauaauaaacaaacaccuuuuuaaaaggaaaaauuacaucuuaauaauuucaguuuauuaauauuuacuuugaaauuuuucguuuuguacucccaugaaaauuuuccucaacccaaugcuuucaagcugcaaagaauucauaauuucuuuuuaguuauaaaacagaacuacaaaacaauauuuagaaacauguaugagcaccuauauacauauauuguuuggugauuacauuuuuaaucuuagacaauacuagcuguauggaaaaacuaaaaacagcucuuguuaugaaucuuauaugauaccugaaauauuugacuuggcuuucaauacuuauuagcugguagauuauuuucucuuuuuuucaauuuuuauuagauauuuucuucauuuacauuucaaauacuauccugaaaguccccuauacccuccccucacccugcucccuuacccagccacucccacuucuuggcccuggcguucccuuguacuggggcauauaaaguuugcaagaccuaggggccucucuucccaccaucuucugcuacauaugcagcuagagacacgagcucuggggccacugguuaguucauauuguuguuccaccuauaggguugcaggccccuucagcuccuuggguacuuucucuagcuccuccauugggggcccugagauccauccaauagcugacaaugagcauccacuucuguauuugccagucaggguccuuucaucaaaaucuuucuggcauaugcaauagugucugcguuugguggcugauuaugggauagauccccgaguggggcagucucuggaugguccauccuuucgucuccgcuccaaacuuugucucuguaacuccuuccauggguauuuuguucgcuguucuaaggaggaaugaaguauccacauguuggucuuccuucuugaauuucuuguguuuugcaaauuguaucuuggguauucuaaguuucugggcuaauauccacuuaucagugagugcauaucauguguguucuuuugugauuggguuacauacucaggaugauauccuccagauccauccauuugccuaagaauuucauaaauccauuguuuuuaauagcugaguaguacuccauuguguacauguaccacauuuucuguauccauucuucuguugagggacaucuguuuuuuucccagcuucuggcuauuauaaauaaggcugcuaugaacauaguggagcauguguccuuauuaucaguugggggcuuacuaaaaugcagauugugaccccuaacuucaguuucugaucaauuggccugggcuagaaggugaaaauuugcauuucuaacauguucccugguaauauugaugcugcugguccaaagaccagauuguucuucuaauauaguaaguauauuugauccuccuuuuugugauuagaggggguggcagugacuauuaaucuaaaauauguaccaagagccacuacuauacuuucugcuccagcauccugggcauuucuguccuuaacauacugugugaagacaaaaccucuaugaacagagaaacccccgaguguaccguacuucaugaaagguuccucgguaucaggcuucuugagugagaaugcugagauucccaaagaaugcacggcaguucauggagugcugauggcucuuuuccuguuagcagcauauguuucuauugccuuucaugauaagcuuccuuaggaagccaaaaaaaaaaaaaaaaaagcugaaaaacaccuguagcacauauauccacucagucuuguuuauuuccaaaauucaagggcagaaaauaguucuaauuggacauugcgugugaaccggucagaggaguuauucauauagaagcaaauauuuauguauucauuuuuauuagcauacaaagaaggagguuuauuauaguauuuuaaaaacaauuuguuucuguuuuuuuuccuguucauugaaauuauagauuuuuucccucacacaauauaucgugauugggguuucccugauucuccuccuaauccccccucagcccccucccauucacaucugccucuuucucucauuagaaaacaaaaggcuucuacgggacacuaguaauacagaauaaaaugugauaaaacaaaaacuacacauaaguauuagaccaaacaaacagaaggaaagagcccaagagaaggcacaugaaagagacacacucacuuguacucucaggaaucucauaaaacacuaaaguagaagugauaauauaucugcaaaggacuuggagcagacccauacaugcuguuucagucucucugaguucauaugagcauugauauguugauuuagagggccuuguuuucauggugucuugcauccccucugugucuuacacuccuuuugccucuucuucugcaggguuuccugagccuugaggggagggauuuguuauaggcauugcuuuuagcacugaguauucuaagcucucccacucuguguauaaugugugacugugggacucugucucuguucccauccauugcaggaagaagcaucucugaugauggccgaaaaggccguugaggauagcagaguauagcuauuaggagucauuuuuauugcuuuuuuuuuuuuuuuaauaaaagcccaguaguauuugguuuucccccaagucucugaacuaucuaucuagucucugguucuucaucacccaagcaguguuggguauggguuccauuguacuagcguaucuuacaugcaggacacuguuguauacccaaaguuuugugacugggauggugguuguuuuucuuuugguaguguacagauuauauucuuguacuaaagacacuaaaauguagaggugaaggcucuauuuagguacuaguuugacuucuccauguugagugaguuguguagauauuucuuuuagcagugagggcuuacugucgauuuguggagaacaaccuauauucuuugacaacagccugggucauuuggggauuuuuaugggacccuaaaggacaauuggauguaacccagucccagcacuggaaguucauuuggcaagaaauggccguuugugacucugucuacuucauuauuuggcuauuucauuuagauuacccccaaauauguacauauuuuacaaagcuucuacuguauuaggguucuauacugccucucaaaugacccuuaauuuuagcuguuucuccccauauuccuucccucauucccccucccauccugaguugauccuuuuuuuuuuuagcuccccccauucauccauaauuaucuguucuauuucuauuuccuagugagagcugucugucccaaauccguuccucuauacccaaccucugugguucuauagauugcagcuugguuaccauugacuuaacagcuaauagccacauauaaguggauacauaccauauuugucuuucugggugugggauaccucccucaggaugacucuuuucuacccauuuaccucuagaauuuauuauuuuauuuuuaauggcugauuaauacuccauuguguaaguguaccauauauucuuugucuacuaauuuguugaaggaaauggaaguuguuucuguuuuuuuuuuugcuauuaugaauagagcaacagugaacaugguugagcaaaugucucugcaguaggaugaagaguccuuugaguaugugccuaaaggugguauagcuggaucuugagguagauacccuucuuccuguuugcccccugccccauguucuuuacuuccuuucugaagaaacagacuuuuuaugacauuuauuuuguguuugugugugcauaagcguguaugccacaggacuguauggaggucagaggaaaacucgugggaguuaguucucuccuuccacuauguagguuaaaccauggauuaaaccaagauuaucagcuuugaugacaaacaccucuaccuaauaagccacuucaccagcccaagaauauuuuaaaaacaacuaaaccuuucauuauaguuauuuccaaguugauacuuaucuucaaauagaugcuuguuguugauaccauuuguuguaccuccuacuguauuuuugcuguuguaauaauuuuauacaaacucagaguuagagaccaaguucuguuuguuuuuuuuuugucauuuugagauuuuauuuuuguauacuuuuggguguuuugccugcaugcaucucuaugcaucauguuuaugcagugcucacagaggccagaagaagagauuggaucucuugcuaccaguauuaaagauguuugugagguaccauauguccugggauuugaacccagguccuuuguuagagcagcuaauacucuuaacuacugagucaucucuccccaaguuuuuuguuuguuuguucucuuuuuuccuuuuuuguuuauguuuuauuuauuuuggugaggcagcauuucacuguauaucccuggcuguccuggagcuuagagaccagguuggucuugaacucauggagaugugaauccuuugccucaaaagugcugaaauguacacaacuacacaugaagagagcaaauuuaauguaaaacaguuccgcuuuucaaugauccugaucagggagaacuacugaaauauuuauauuuacauugucauuuauaauaguugguuugaagcucaccucauuuccuucaugugacaguguucagauauauuuagagacuggauuacaaaccaaacuuuauguaccauuuuuguucagcauuaagguuauugaggaggggagcagggugggggcaucaguccuucuuggcuacaaccaaguaugucuucauggcugccagcaaguaguucagcucuucuuccuuucccuuggugcagaugugcuagcccacccuuuucuugaugaacuugagguagugcuuguucuugaacaccuugaacaucuccuugagccacuugucaguugugaagccguacacuuccuggaucaugucccacaugaacuuggugugcuguaccucgauuugcugauguucuucaguauguuguggccguuguugaagcaaugggcuugcuagagggaugggauagggaauggguucgggggagggcuuuggcugcugcucucugauggcaaccaggauaggaagcuuauguagcagguuuuuuuuuaaaucuauuaauuuuuuauuagguauuuucuucauuuacauuucaaaugcuaucccaaaagucccccauacuuucgacccacccacucccacuucuuggcccugguauuccccuguacugaggcauauaaaguuugcaagaccaaggggccucucuucccaguaauggccgaguaggcuaucuucugcuauuauguagcaguuuuaaccuuagcuauacuuccuagguucagauacuaaguaccaauaggcaaauggcaauucuauaugaaugguguguaacuuaguuuuuaggagacuuguuuuacuaagagugggacuucagguacaaagucaauuauauccuuccuaaacguacauuuccauauaagaaaaagguagauaauauuuuuaacccuugcuacaucuuccaauaaauaaguuuguagauuugaguaugggugcuugcaugugugugcaugugugccuguguaugugcguacgugcuggcacugcgugugcucaggugcccgaaaagccagagaugauaucagauccccuggaacuggaguucuaaugaauugugagccacuguguagaugcuagaaauugaaccuagacccucugcaagagcagcaagugcucuuaacugcugagccauugcuccagccuucaaguacuuguuuugggacaacaaucuuugaaguuaauuucaagaaagaacaauuccaaauguaaagaacugaaguaacauuugaaaauauuugugauacugcugaccugugagaagcuguguuuuguuuguuuguuuguuuguuuuuguuguuuuuuaaagcucaggacauagcaaaugcugucauauacuauuuuguuccaucaaguaguuauaguuagcaugagaucugauuuccucacugauuauuccugggauccagugcuauacacauaagguaggaauugccagggaacuauuaucauaguccauuuccucagcuuuuuaaaaaauauacuuaugcuguguguaugccugugcauguauguauacauuuacauaccacagagcacauguguagaucagagaauaccugaucucggggucuguucuuuccuuccacucugcggguucuggggaaucaaugucaagucauuagcucuguuugcaggcguuuucacaauacgccaucucauaggaccucugcucagauuucagccaaugaaagacaagaaucgauugucuuaaacacauuucuagagacucggaaccuguugugguauugaaccuuuuuaauccacauggccaguuuucuauugcugcuucuuaggauuacaugccuaggaaauccaaacgaaaauguaagagugcguuucuuuaaauagauuuaaugguuaagccauaauuuguucaaaaguuauaugcacauguuauuuuuuguuuaugauggaaacuauuuaaauguagccauaucuagugcuggaaaaaugugaaagaauuucccggugucaucaccauuccuguaacucucuuucuauaugaguuaguuuuuuuuuuuuuuuuuuugucuccacccccaucgaguuagguauaucuuuuaguauagaauaaaauuuauuuaggagcaugggaaggggcguugagaagggaguagaggcaagaaagagaagggacagugaaggaugggggaggggggccugccaggaacauauggagugggggagaggaaguggaggagggagaaagggcucggagagaagagagucagagagauggggaagggacagagcaaguuagauuuuuaaacuccaaauuauucuuauuuuaucuugauaauuagccugggcuuguuuugaacucaaaauucucguuccucuagaucacuggauuccagacauaugccacuucccucagaauuucuaaauuauuuuauuuuacuuuuacuugauuauuuuaaaaagucuggauuuauguguguggguguuuuggcuccacuuaugucuauguagcauaugugugcaaugucugcagaggccagaaguaggcguuggauucccuggaauugaaguuauagauaguaacuguaacaggaguuauagcuagcugccucauggaugcugggaaucagaccugggguccucuagaagaacagucaguacuuuuuuaacuguuauaccaucucucuaggucagugcagaaggauuuuaaugggaccugcuuuggauccucucuagcaaaaauguuuuucauagaauaguuuugaggcauauuugagguaguuuuaaaucuaauauaccauaccuacgaaauacuuaauaauuugguacuuaguauaaagaauaugcaaguaaaaauaguaccauaauuuuuuacagacauuuuagucaaaaaucuuaaguguuuuuuuccucagagguacuguauagucuuaagcagcauuugaaauauucguggguuaaaggcacugaauuaguucauuagucauaagaagcuguuuguuuaguauugucuauaauuccuucuuuauuucccaacucucucaagacugucuugaugaaauaccuaucacuauuaauuuuuggugcugaauauuguuguauagugccaucauccgcacugccuuucuagagugauauuggaaccucuuaguucauuuugaugauggccuuuguaaacauagcuaagugcuguuuuacuuaaauuuaaaauucaaaugcugaaaguacuucagaguugucaccucaaagaugggagggaacugugucuucuuucuguucaaaaggucagugcauggcacuugguaaacaacgaccccuuggaccuacuuccaugugucucucuccuuuuugagugugguguucaugguggcauugagcagucuauguuaccccugaccuaaaaaugaaguaaacuaaaagaaaaagaagcuauaaaugcugcagaauauguuuaucuuuaaaaauuugcuuuuugauuggcaugccccccugauuauuucuguuuaauccuuguugucgucaguguuugauaguaagguuuacuguucuucuagggagcuuuguuuucuuuuccauauuaaaacaaaucucuuuugcuuaugaaauauuauggacauuugcaacucacuugaguuacucaggaaagcaaaacagcuaaguaaguuacugugaaaauuuggcucguuuaaauccugguauaguaggaaaagggguagccuaacugccuuaaaugguaauacacaacaaagccuaguuugucccauuucugcccccuguuauacauuauauguuaccugaauuaccaguucuuuaucacaaagaaaacagcaacaaacaauagcuguuacauuuuuuuuucuuccaggccacucuucuauaauugaauuccuuauuugcugucagaauacauguugacucagcuguagcuguaaaagaaccauauuuucuugaaccugccaauuagaaaaagaaaauauguuguuaugcaucucgaauuaauuguuagguaaaaugaagcacuuagaugccuuaauaaccuacucagaagcauacagaaugugugugguugcguccuagcugucuccuucccaugcaugaguauugaacuaggccuuuccuucaugucuagauuguccuuagauaucaguucuuuguacuuuugguuuucuaccuuuauacacauauacacguauaggcaccacuaacuuuguuuguuuguuugagacaaagauccucuguguagcucuagcugccuuggaacucacuauguacagacaaggcugaugucagucuaucagaggucugccuuccaagugcugagauuaaaggagugagccacuuugcuuaccuuucagaguauuguuguuaagugacuacacaguguugucaaacaagucacuucaagguucagccugcauugggauaguacagacccaggaugugauuuuucuuugucagcaguguccugaauauuuuggacuuacuuuuuguugagugcuuugguaagguugaauuauaaugcaacuaaaguucauuuccauaguuuugacuuuugguuacauuaguauuuuauuuuauuuuauugauuuuuugcaaaacaucaguuaucugggccauggccauuggaaaauacauauuuccaauggucuuaggaacuuugauaccacuuaguagcaaaauuacaguuauggaguagcaacaaaaaucauuuuaugguugggggucacuacaauccaaggaagaguugcagcauuaaggagguugagaaggacuuggauugaaaauacauuagaacuaaaugaccaggaugguuacaguuucauuaaguuuauuuauuaauaggaguuuuaggaagcuuugguuuauaaggagaaaaaaauuggcacuuaaaauugauaacuuaggguuagagauguagaucagcugacagaaugcuugccuagugaaucaagcccccggcuugacuuucagugguggcacacauuuguaauccaagacuaaguucaaggucaaccuggacuagauuuggaaaccagccaggacuacaugagauacccuucccgccccccuguguuugugugugugucucugucucucucuccucccuucccuucucccuccccccucucuuucucaaacaaauacacacacgcgcacacacacaugcaggaauaacacccuucccuggauuuauacuugaaauuuauggaauuuuaaauuuagagguuaaaaauauacauggaaauuugaaauacuuauauuuagugauaaguuauuugaaauauacaugucuguaaaaggcaaacaacuaaguaauauauaacuuuuuucagauuauaaacuaaggcagugaucaacuuucuaacauauuauuguuuuaaauuuuaguuucagucugauggaagcaaacaggaagauaaagagaaaacgguaagagacugaaaaaaauuaaauaauggguguguuugucaggauauagcaugccaaauauuuuacugugaacaagacuuagcuacccuuagaaauaguuauuuuauacuuuacaugcucaguacagcauuuggcaacucauugaacauuuucuuugaagauuaauauccucuuuuugaaaauuccauguguaaaaagguuaagccucucauugccuaguuaccuucucugcuucuuuuacuucauuugcuaucuuagguaaagaaaaggcaaugauagggugaggaguguguguguguguguguguguguguguguaugauuuaaaaaugauaauucuuuuaaggcaucucuauuuuggguguauugaaauaaaccuaaugaaauaauuuuuuuguuuucuuuuuaggaaguuauccuuagcuguuugcuuagcauuacugaccagguauuacuuccaucucuuucuuugauggacugcaaugcuugcaugucugaggagcuguggggaauguuuaagacauuucccuaucagcauagguaaauacuuauucagauuguucacuccaauuaauucuaguauauuaacuucuaagcauuuaauauuuucuaaauuuucaucucauuuucuuaaagauaucgacuauauggucaguggaagaaugaaacuuauaauggucacccacuuuuaguaaaaguuaaagcucaaacaauagacagagccaaguauaucaugaaguaaguuuaauuuuuuucauacuuaccucaaauaugucuggauauaauuuacugucuuucagcuauuuuguuuagacugccaguuuugagaaagauuauaaauacuuagagguauaguugauuacauauugcaguuagaaugaguuuuuuauguuuuauuuuuauaauuuuuagguuuauauaaguguaugggggauaggaguaggugugugcacgcuauaguaugcgcauggaggucagagugguggggaugggcucucucuacuucauguuugucccaggaaucaaacucugcucacaagauugauagucaugccgcuuucuuauaaaguuauuugaagcuuaugaaaauuguauauuucaugcaauuauuagucuagauacuaaaaacucuucuauuuguuuucaacaaggauuuugucaguuguccaacauuuuauaaauccauuuacaguuauucuaauuaaaguuacauuuucuuugguuucacuaaguauaauaguuugaagugauacuguguuugcccagugacauugucuuuggacauuggcuauugggaaaacaggcaugaacauggucauaguuuggcuuauaaugaggugugacaauagacagaaugaaauaucuaauuaaguuaauaggggaagaaauuauugcuggagaggcuauucaguuugaugaacccaagaaaguuuuagcuucagaagccuauagauacaguaucguuuuuuuuuuuuuuuuuuuuuuuuuaaagcacacuggacgaucauaguuagcacuuggcagacuucuuauuuauuuacuuagauuuauuuauuaauuuuauguuaugugaguaaacuguugcucucuucagacacaccagaagaggguaucagaucccauuacagaugguugugagccaccaugugguugcugggauuugaacucagaaucucuggaagagcagucagugcuuuuaacugcugaaccaucucuccagcccugaauuuacagccaucccucugacuuguggaagucagaucagguuuugucuauauaucugcauauacauaugaucaggucauucauauaugcacacauacacuauuugugcuaggcgcugaguugaaugcuuuuuaaaaauaauacuuaauacuaauuuucuugauucucuuuacucuguaagcacaaccuuaauucuuuuaucuggaauaguauaguaacuugaauuauuuucuuauuucaaaaucuccccaccuuuuguuuuuuguuuuggcuuuauggcauggugcugugagagauacuccuugaucuuuccuacuguauagccuaccucauuuccuuccuaaugaugacacuuuaagcucuacugaacuuacuuguuuccugaaauacaccaugcucuccuuagccuuacuuccuuuguauguguuuuuugcuuccuuuauuuguacaaauuuucccuuaucuugccuuuccuucuccaucuggugauucaucuuagaaagugugcaugagugccagcucuccgaagccuccacaggacauacugacaaacaaaguugauuugugccaccaguacacuuuaggcaaauuaugcuagcauuccacuugugcacauuacuaugauaguguuccuuuuuguaaguauauaaaaucagcagaugaaugaauauacugauucuacauauaaaugucauuauauagcaguucuuucuauucccagcuuaguucagguaccacgguguucuccaguuuuguccauguugugaaugacagaauuuccuuuuuuguuuguuuguuuuuauuuuuauuuuuuauuuuuauuuuuuugguuuuucgacacaggguuucucuguguaucccugguuguccuggaacucacucuguagaccaggcuggccucaaacucagaaauccgccugccucugccucccaaguacugggauuaaaggcaugcaccacuaacacccagcucuuguuuuauuuuuuauuguccgguuuuucaagacaggguuucucuguguagcccuggcuguccuggaacucacucuguagaccaggcuggccucaaacucagaaauccgccugccucugccucccaaguacugggauuaaaggcaugcaccacuaacacccagcucuuguuuuauuuuuuauuguccgguuuuucaagacaggguuucucuguguagcccuggcuguccuggaacucacucuguagaccagguuggccuaauuugcuuuuuuuaaagugaaaaaggacacuaguaggagaauuauuggggaaaagagggauuugaaggaaaggagaaauguugaucaaaggaugcaagauuuuacuuagauuuaagaaauaaauuuuacuuacauauuauacuuuguggugaccauagucaacaauaauaaugccuauugcaaaauuuccugaagacuaccuuuuaaagauucauauuacaauaaaaaguaaguauugagaugaaaaagucauaauuugcuugacagauuuauucuauaaugccuauauagauuaaaaacaucacauugugcucuuauaaaguauacacguuuuuaaaaagguguaugucccguucuucacacacucaguucucucccagagaagaaaaguaaaguaaccaguauuuacauucuuauuuauccucccaaggguguauauaaggcaauguagauauauuauuuauacuuuuuaaaaaaaagauuuauuuauuauuauacauaaauucacuguagcugucuucagaugcaccagaagagggcgucagaucucauuacagaugguugugagccaccaugugguuucugggaauugaacucaggaccuuuggaagagcagucagugcucuuaaccucugagccaucucuccagcccuauuuauacuuugaauguuauugauuaaauauaagugcuguucugaaacuugauaccuuuuuagaaagcaaauuugucaggaaugguaagguacuucuguaguccuuguacuugggaagcugaggcaggcggugaugacucuggcccugucuuuacuaccugagacgagacugggucagaaaaagcaacagacagacaaacagacaagguaaaaacagaaauucuaaaaauacgguuuuaaauuugugucuuuaguuaggccaggcuugagagcaagaacugcucuucauuuuuauguucuuaaugccuaguguuuugucauaguaagcauuaauaugaaugaaugcguacaugaaugcauauuuuuauuuaguguagaauaauauguguagaauuuuuuuuaauauacuuggguuuuuguuacauuuuagcuguagcucagcuguugcaccaaacuucaugaauuuacuacaacuuuuuacauugacaguggaauauuuuaggauauuauuuguauaauuuuauaauuuuucaagucauucauucuucaaaugcucacugauuguguuuuauaugucugacauucugguagcuugaagguaggacacugucuggagaauauuuguuuaauuuugcuuauucucgcuucaggguagugaagagaaauggaauagaauaaaacguguacaguuuugugugacugaggcgaguaggagagccaccuggugcacgcuucgaaauagggaaggguggugcuaaguugaaggccgagguggcuaugguuuccgauguaaaaccaauggucucuuuucuccaucagcagggaacaggagaaacugagcucuaggaaaccagaaggggaagcagcugaugauuacaccauuuuaauucucacaagacgcuucggaacauaguuauauuauuacuuuacaaaugguugcaguccuugaauuacaaauggaacuucauuauuuauuucuaauguuuagugcuguuagauguauauuccuuuuagaaauguucuuuccuuuguucacuugcugcuguuuagagucucuguuauguaaccauccccaaaacacuuacguuaaucuuuagcaguucacuguuacagaguuuuagaaucuuagaaaacauaugcugaucacagaagaaauaaaaaaaaugaaagaaauguaauuuauugauuuuaaaaauuguguaucuugaauaagaaaaugagagaacuaauuucugaacugauaaaugaaaccuuguaaaucuaaaauacguaugaaucuuuuuaaaaaguuuucauguauuuauacaguaaaauaaguuuuacucuuaguagauaacuagcauuuaaacucugaaauucccuaagagaguccaccuuuugcuacagaguggaugaaaaugcaguuguuugcauggauccauuugauguauuugaguuuuccacauaguacagcaaagcuuaucagcauccugaguaauuguacuuaauacugagccuuggcauuucucucccuuuguaggcgucuaaccaaggaaaaugugaagccuucaggaagacaaauuggcaagcugagccacagcaauccaacaauuuuguuugauuauguauguuuugaaguuaauauuauuuuaagagauuucccuuuugauugucuuuauaucaguacagguggaaaugaaguaaaauuuaaaauguuagaaaacagcagaugaaauaccacuuuauaguaaaaacaaaacuuuucauauacaguauuucacaaauugaucuguuuucuaguaauguacaacagaacuauuguuaaacauuugaauaccauuucacuuugauucccuuuuagcaguguuaccuucuuuuuaacauuaucauuguugaaauuuucauacaguauauuuugaucauauuuccccucccacaagucuucccauauccuaucuacuuuccuaguuaccaaaccccauguuuucucuuucacuuggaaaagcaaacaaacaacaaagacagaaauuagguacccaggggcuggggugggggaaagcacagaguccauuuuagaaagacucuaaauaacauuuaaaacaggacuagccauuacuauuacaaaauacaaguuuagaccucuuggaaucguuuccuagguagaaaauguagccuugggaaaauacucuauauagcaaugauaauguaauuuuuuuuuuguaaaauguuuuauauagaugcaaaccagagaaacuuuguuuucaagacaggguuucucuguauaucccugguugaucuugaacucgcucuauagaccaggcuggccucaaacucacagaaauucuccugcuucugcuucccaagugcuggagcugaagucugccuggcuggaaccacuuuaauuuuauuauuucuaauuuuagagaaguaugaaccuuacuuagcauagaaguuuuuuuauuuauuuaaugcaacuuacucuuucuugaucuuccagaucuugucacaaauccagaaauacgauaacuuaauaacaccuguaguagauucauugaaauaccucacuucguugaauuaugaugucuuggccuguauccuuucauguggagcaaaauauagauuucaugugucccuuuauuuaauugcugaaugauuaauuuuucucugacuuucuuuaguaaugaucuaaaguuggucuaauuggcugaucuguugucagcccaaaguauugaaaaggaaauuguguaugugugcauguguaugcaugcacauauguuagugcuuuguguuguauaaagggagagacacucacuuuaucaagcauguugauacagguggaauguuacuuguuaggagaugggaaagaggguugauaaauaaugaguauaugguagcuauuuucauuccucucugaagauguggggguuuaagggucuuuauuacugauguucugguauuuuuuuucuuaauguaugaaagauuguaucauugaagcuuuagcuaauccagaaaaggaaagaaugaaacaugaugacacaaccaucucaagcuggcuucagaguaaguacuuucacuuuucucaggaugguaguacuaguagagacuaaggagguggcaacugccaggcuuucuuuaccugccuaugcuuucaggcuuguaagugcuuauuucucaagagcucuugacaguaucuagccacuaagcuuguucugcaaagugucagagaccuugggucuguauggagauuuuauuaaguacuuacuaauuuucuuuacugaagagacuauuuuauuuuacuaugauagaauuugaggaaguugucucuggccauaccacccuggacuuguugaguaucaucugaucugggaaguuuagugcaauuggucuggguuaguauguaaauaggagaauuuggggaaacauuuggaagcugacauucacuuucuuucuaacuuacuguuauuuagaaauuacacucuuuccuugucuaauguauaugaaucugaauuucccacuguacuuaagguccuuaagucagaacuuaaaguuuggucuaauuauuuacauaauuagcaaauaacuuaaguauuauagaugauuagauaaucuuccucuagucuucacuuccuuuccaggaaauaauagggacuauugguuaaaauuggucuucuaagguuggcaagagggcucaauauuuaaaagcguugacuggucuucuagaggacucugguuuuagucccagaacuuauguggucacucaacccuuuuuaaccccaguucuggggaaucugacacccuuuucugaucuuggugggcacuaggcauauacaagcuacauaaauguucauauaggcaagacacccauacauacuacaaaaaagcauucugcuucuagcaaaauuaccuguuucuuuugcuuuguacaacuguaguauguuccuagauauaaauaauaauuuaugacucaaaacuuuuuaggggugggcauuuaguuguuugaguuuacuugguauucugugugguugaguccuaauuggucagggugcauaguuugaaucacugcuuuaguuuauauugugccuuggagcaagucaugcgacccuuuuuucccccaauuuaccucaucaguagguuuauacuaaccuaagucaguuauugauauaauuaaucaauguaaugugcuugcuuauguaugcuuaauaaguauuaccuauuacugugguaaaaguccauucaauuguacagucaaauguacagggcuggagagacggcucugguuaagagcacuggcugcucuucaagaagacccaguuucccagcacucacauggcagcucauggucaugugcagcaccuguucaggggaucuaauacccuuuucuagcucuuccuuaggcacuugguaaugaacaugguacacauauguccauguaggcaaaaauguauacacaugaaauaaaaauaaaaauguuuuaagaaauuauucauaccucauuuugcuuuagaaauugaauuuaaugaaauuauacuuacuauauuuuugucugauaaacuauuuuuguuuuugauuucauguaggucuggcuaguuucuguggugcaguauuccguaaauacccgauugaucuugcuggucuucuucaguauguagccaaucaauuaaaggcaggcaaaagguaaauuauauggaaaugaacuucaauaacucaagcacuucuggugguuuugaaauguugagauuacuguuauuuugaaagacacauagauucaacuuaaagacucacacacacgggggggggggagggagagagagagagagagagagagagagagagagagagagagagagagagagagagagagagagagagagagagagccaugugccauccuggaacucacaaugagauccaggcuggccuugaacucaaggagacccaccugccugccucugucuccugagugccaccaugcccauauacaggaaaaauacuuuuugaauaugaauuugauauguaagauuuauguacaucuuuguaaaugcugaaguuuauucugggccaguggcagugcuuagguuuuggauaaauagauuuguuaaacauuaguacuaguagauugauuauaaucaaauauuuuaggugugcugugagguagaucaucaaggcuuaaggguguguggggcaacagauuuuucagcaagaaacgaagaggaugccugccugccugccugccugccugccugccugccugccugccugccugccucccucccucccucccucccucccucccucccucccucccucccucccucccuccuugucuguguguuugucuguguuugugugagauacaggugcgggaaggaggguguggagggagugaugagagagaaagcaaaagagacacagagacagacagacaacguucugugaccugccuccuucagcuagacuucaccuaaaguuucaagaaccuuccaaaauagugccaucagauugggaucaaguccuuaacucaugaacucuuagagaacauuucuuacuaacaaucaaaacaggagagagguagaggugggguguguggaggaagugaagggaaguacaaaugaaaacugaggaaaaauacaugaagcuuggguaagggagaaggaagauguuuucaauaauuuuuauuuuuguaucuuauuccaagcuucaaauuaauccagguaaaaauaaaucaaagagaaacaugaaauauuuuuauuguaggucuagaauuuauguaacauuuauuuugaaaauaagauaaaaaaaaacaagcccugcuguugucucucauuccuucgucuaaguaaagauucucaggagacuacuuauuauguauuauuauuuucauacuuaaaguuuuaacuucaaauacuuuucuuuugauuuuauaguuuaauuuuuguauuucuuuaaaaucuuguauuaguuuugaccuacuaauauugaaagaagugguacaaaaaauggcaggaauugaaauuacagaggagaugacgauggagcaguuagaagccaugacugguggggagcagcuaaaggcugagguaaguaaggacuuauuauuuguggcuuugucuuucaagaugucaauuacuccugcuuagccacaauucaaaauuaaagagaaacauauccauaaguagaugaauuauaauauuuuacuuugagacucauuuuauauagaaugauaaaaauuuuugcccuucuugcucacuuuuggcacauaaguuaucuuuuuggccaucguauccacaguguauaagcuacucuuaagucguagaauagccaucuuuguuuccauauuggcuauguggagaguaguccugguucucaguuggcuauauugcaaaauguuuauaucaaaguaaccuuugcucaaauuucccaauucuucaucacucugccuguguuguuucauaucauuaagaaugucaaugcagugcaguaauauauuuggggagugaccauauuuauguaacuuuuauuguaucguugagauuguuguauuaauugcuguugcuaauuuuuuucucuuuacuuuuuuaauugguuauuuuauuuauuuacguuucaaauguuauccgccuccccaguuugcccuccacaagccucccaccccacuccccgugccgcugcuuuuaugaguguuccccgacuuuccuacccauuccugccuccccgcccuagcauucuccuacgcuggggcauugagccuccccucccauugagccugacaaggccauccucugcuacauauguggcuggagccaugggucccuccauguguacucuuugguuggugguuuaguccccgagagcucugggggugaggucuaguugguugcuaauuucuuacugugcuuaauuaagcuuugucauggaucuacaaaauaucguuuguguagaguuucguuccgucuacaguuuucauuuauccacugugaguuguagaacauaacugccacagauaagugugugaugauaguauagaaccuaaacaguaucuaauuacccaaagcuaaaugucaaagucauacauguucuccucuuaaaaccacugcuaccuucuuuuguaagagcugugaaacacuaguaauuggaacuugaaaacacgcaaaaguauaaaagacaauaacuuauuuguacugaaaagauuuuccuugauauuuccacuggaauaaaucucuaucacagucuacuaaaucuuuucacugaauaaaaaaauaauccuuugugagauuuuaccaaguagaaaauggaaacaaugaguugcacaauugagcuaccauuagccagauuauaguaaacaguaguaucauuaaaacuaauuuguuaaggagaauguuuauagguuauagaagugcuuuauuuuauuugguguugcuuuauauuaagccaggcaugucuucuucuuauucuguuuuuuaaagacagaguccuuucuacucauuucaagcuggacucaaacauguguaguugaggaugguccugaacaugcaaucaccuugacucucuugcccaugugaauggaugauaacuucuagcuccgaaauauuuuaaagauuaugccucaauuuucuugugugucuuuucccaguaagacagcauggaauacauugcauauagcaauaauuuuugucuucuuuuaugcagggugguuauuucggccagaucagaaacacuaaaaaaucuucucagagauuaaaggaugcacuacuggaccaugaucuugcucuuccucucuguuugcuuauggcacaacagagaaaugggguaauuuuucaggaggguggagagaaacacuugaaacuuguggggaaacucuaugaccagguaagugaaagaagcuuggguguugaggaaaacuuuuuuuuaaaucucaauaaaauagaaauugugaugucauuugaaacauaccauuuguacacauaaugugaaugucuggcaccucuaaugucaaauaggcuuuccuuaaauagagccccuauuucugugcauacuauucuauuuacaagauggguguaggggauguuauauauaaggucuucaguuaaugagacauuccaucaugaaaggccaucaucagauuguuugccuucuuuuugaucuuuggaaauuuguaauuuucauugcaccacaguagauacuauaucuuauuucuuaguaauaauauugcuaauacgcaaacccauuuuguuggcuaguaauguuuuugugguuaauauuuuuuauccuuuaaacaaugacagucacugacuucucauugcaugcauacacacacacacacacacacacacacacacacacacacacacacacaguuuuauaggauuuuaggcgaguguucugagaggcucuuguugaacuguccuugacuagcaacucaaaagguggcuuuucaaccuaguguuaaguuucuguuucauagucuauggcuuuuaggagacucuuaucaacucagaggggaaauuuucauuuacacuauguuuuaagcacugacauguauuaagagcaucuuuauguaaauaauugauagugugauuccuugacucuuuugacaucuucacuguuauuugacccuccuccccucuucuguauuucccuuccuccccacuccuguaauaaagauuaccuuguuuucuccauuguucccuucaagucagcugucuccuguuauuucccuuuccauugccucccucaccauaguguucccuuugcacuuuucugguuucuauaguuacuacaguuuuuauacucacagcugaagauguaguaguagguuauagauauguaucacuguucuuagagcucacauguucucucucuucuuuuggaguccauaaagaaaaauauauuugaccgauuacaacuaugugaauauauaauauuuguuuuaauuuagaauuuuuauuugauacguaguaauuguguauguuuauaggguacauugucauaauucagugcauguauauaauguguaaauuauaaaauugauaauuucuaucuucaucuuuugaaacauuuauuauuccuguugacacaaauugcuuuaagccauaggcagucuauguuggcugucuaucacuugagcuuaugucuccuauagaaaugcacuguguuaccccagcuccugcaucucucugcccuuuccagcgacgcucgucgccucucagagcuacucuucuuuuuacuuuugugauggcaacauuuuuuuagacuuuauguacaagugggaauaugugaaaauuaucuuucuacccuuguuuauuucacugaacauaguguucuucauuucugucccugccuaaacuauugaaauuuggauucuuuuuuuuuuuuucauuuuuuauuagguauuuagcucauuuacauuuccaaugcuauaccaaaagucccccauacccacacacccccaauccccuacacaauauguacucacugauaaguggauauuagcccaaaaccuaggauacacaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagagacuuccauauccagggauccaccccauauucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaucugcaacccuauaggcggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggagauuggggguggguggguaugggggacuuuugguauagcauuggaaauguaaaugagcuaaauaccuaauaaaaaauggaaaaaaauauagcauuggaaauuuggauucuuaauugucaauuaaaauucuguuaaaauaacauauaucuuaaucauuugagaaagguuuauguugguuuuggaaaauguuaacaucuguuuuuuguguuuguuuguuuuuugucuuauuuuuucuuuagugucaugacacccuaguacaguuugguggauuuuuagcaucaaaucuaaguacagaagauuauauaaaacgagugccuucaauugaugugcucuguaaugaguuucauacaccacacgaugcagcauuuuuucugucuaggccaauguaugcacaccauauuucgguaaguaugaaugucuucauugguguucaagaguaauucugaaugauuuacacaaauauuugauuuuuuaaauacacgcuaauuugauaaauacagauuacucuaauuuucuauuacuauucuugucucagcaguaaacagugaaauguuguuuuacaggacaggucuuccuauuacuuucuccauagucaauucauagagacagacccagcauauccuccgguuuguuaauuuggagucuagcccuucaguucuucuuuuucuuuuuuauucuauaguuuguggcuuccaguccaauuuguggagugaaaucauuuaauucuauacugugugugguauuuacuccagucauuggucccgucucuuaaacuaaguuuuccuuuuuauuuccuauaaaauuucuguuauauaguguguagcagaaguauuuagaaagacacuaggggagaaauuugacauucauuugaucauguaauugagaauacuguuaguguuuacauaugaacaacugcuucagucuuacuugauuuaaugaccacuucacuggcguuaugcagcaauuccuuuccugaauauucuagaggguuaauaggaacaaaaauggauuuuaaacuccuuuaaugucucccauuccagagaauucacugcuguauguaguuaauguuuuacauucucacccuaaccacaucaaaaaaucucauccauagaaacauaggaccugauuuuuucaagaaccuagguagaagaaaugcuuuaucuaagggauuucauaucauauuuuaguaauuugaaacuggacacccuaaucaguaaugaguccuagcaaaugaauaccugauugucugaaauauuccuggucaaaaaaaugacauaucuuuugugggaugaaaguguuuucuuuuaagagauauacaaucuaaucaaagaaauggcauuuucuucucaggguuuaagaauaaagaaauauaucguggcauuuauauacucuaggcaauaauaaagugcucccaacccacuuccuauagggcacaugccucuuuggaaagggaauuccucagcagccuaggaugcaauugaaugggcauccacacugcucuaacuuugucucuuaggugaggucuuuagugagcuuuugaugaaugagagagaauguauaagaaagugaugagagggcuggagguaugguuuacacagaaugcuauucucuggcuuccacagguagucauauacaugugucacacacacacacacacacacacacacacacacacacacacacacacacacacacacgguggggggggcggggagagagagagacagagagagagagagagagagagagagagagagagagagagagagagagagagagagagaaagaauaugagaaugaaugaaucauuuuuuaaagaaugagagaggaaaugggauaacugcagauuccccucaggaaauuggcuacuacaggccuucaaugaaacacugcucagauucuuggccugacagaaagcuuuuuggacauaaaucagugguacuauauuauucucuguuuguuggaagauguaaacuuaagggcuggagagaugguucagagguuaagagcacugacugcucuuccagaaguccugaguucaauucccagcaacugcaugguggcucacaaucaucuuugaugggaucugaugcccucuucuggugugucugaagauagcuacaguguauucauguagaauaaauaaauaaauaaaucuuuuaaaaauuaaaaaaagauauaaacuuagguauuaguuuaauuuaagagaaggaaaauuagcauuguagaugaaguauaaccaucuuuuugauuaagcuuaguuuucugacuagauacuaguagcaggccuacaaacuagauucauagauucaagaccagagaguugggaagauuucguauuauuggugcuauuuaguuuucucauaacuauaagguaauuuucacuuuuaauuauugauacucaaaucuugaaacagaucuaaaaggaagguuuuccuuguucuagcuauucuagacuuuucccauucaggagucagcuugucauaugcagguaauuccagcacuguuuuaucucaugccugguagagcauuagcagaugucauuucacucaucuagauucauauuaguuaccuucagcaaaaucuauuuuuuaaauuuaaaauccuuuucacccccauucuuagucucugauagaauuguuauacuuuccuguagcuaacguuuuuguagcuuuaucaauucuauaguuugaguaguuaucagccugcucucuagcauggcuaucaaaauaaauaaagaguucuacuucuagaauaauugcaagauuccuggauuuugcuugacauaacauugaauguaguagauuguacacuuucaguugagucagcuuggaugaagcccagucagucucaaggcagcugagacuauuaccaguguagaacucagaaccuuugacugaugaucaucuugguauauacuuaggauaaacugaaguauuucaaugcuuuuucuaauacgaagaagcagcugguugcaagacuucucuuagauucaacuuaaggaucaugccuguuuucuuggcaagaggucuuucaucauaaaauggcugaaagacaugagauaguguauuaauuuucuuuguugcauuuagaaauaauuaugucaguaucucuguacuaauagauucauuuuuaccuuauguaacugaaaauauagucuuccucccaauucucuuucuauuaggacaaggcagucaggacaaagaaacuguagcaucacuucucacaugguuucaauuuaauuuacuucagguacuuauggaaauuuucauuuggcuuggcaguaggcuacaguagcugauugcuaugucuggaauguugucauuuucagcauugaaguguucauucugggaccucuaagucuguggcaaaacuguacauuuaguuucugagguagucaucucagcgccuuuuuauaaccuuucuuaguggcaguccaacuuacugacugacacaugcccuauuggagauaguaggucaacuuuuauugacaaaaacuaguuaagaacauaaaauuaagaauuggaacagauuucaaagguaauuuaucuuaaaauaagugcuuuugguaagaaacuagaauugccaugaucauuuuguacaaauauauaugauauguuuuaacuuuuuaucuacagucaaaauacgaugaacuuaaaaaaucagaaaagggaaguaaacagcaacauaaaguccauaaauacauuacaucaugugagauggugauggcuccuguccaugaagcaguggucuccuuacauguuuccaaagucugggaugacaucaguccucaguucuaugcuacauuuuggucauugacaauguaugaccuugcaguuccacauaccagcuaugaaagagaagucaauaaacuuaaaguccagaugaaagcgauugaugacaaucaggaaaugguaaguuuugauguagcgaugcaaguauaguugcgucauuuaugcaguauuauccauauuuuguaauuauuuuaguuuaagauucuuccaucuuguuccucuauaauauuuuaaaguuauuugaugguaacaucucaaugguuggggcaggaucuuaggaaaugguuagaaaucaugauuaaggaauaaaagacaugcaugucuuuucuacugaauacugccauugcagcguaauguuuuuugugugguuuuuguuucaagaggaguaggaauucccaaaguauuauuauuaucaucauccacaauauguauauguauguguauguguauguguauguguauguguauguguauguguauauguauauguauauguauauguauauguaugcauaauccagcaaacacagggaguaguaugggguuuaaggagacuuccuuuacucuacuugaugauguauuuaaaaagucagguugguaaaaaauuaggcagguauugaaaguuggauagaauaauaaauaugauauaauuaaagaacuaauuuagauaccuuagcugugaaauaacagguguaaaaauggaacuuuaaagagauuaugagaguaauaugaagagugauuuugcuagggggguguuauuuagucugagguuagagaccagcuagcugcgugucauuuagaguacuuuguuaugagauacugagaauauaggcuaugcuagagacaguggcaguccauauggcuuuuaaacaaguaggcuguaggaaugaaggaaagcuaaagauaacuugauuuuugccucagauguauacuaccaggguuaggaagguaaccuguuccgaaggugugugaggacucugugauacugauuuggaugugcugaaugggaagagaaguauacacucaggcauaucuacuggacaaucaugccucaauaaucauagaguauaagcacuuuucucuugacaauuuuauacaugaaaggagauaauacaguuagaaaacugacuuuacuuuguagccuccaaauaaaaagaaaaaagaaaaggagcguugcacugcccuucaggacaagcuccuugaagaagaaaagaagcagauggaacauguucaaagaguacuucagagacugaaacuagaaaaggacaacuggcuuuuagcaaguaaguucuugggauugacuauuccugcugcugcugcuaaauugcaaaagcaaacauuucuaacuuuggcaguguucaagugauuaugcacauauucugcuuuaguuacucauuaccacagaaucaaccucauguauucacugaagugacugaugacaguuugcuaacgaaauaaaauuaguuuguguaaagauaauacuaauagcuuaggauuuaaauuuucuguacagggucauaguauagauacuauauaucuauaauaugaacauuauagauaaauguccacagaguaguaauaggaaucuuuaucaccucauuugugguuuuauaacauuguguacacuacaguuaaaauguugucauguuugguagccuucaggcacuuuagggagaagauaacugcuuaauauguucuuuuauuuuuagagucuaccaaaaaugagaccaucacaaaauuuuuacagcuguguauauuuccucgaugcauuuuuucagcaauugaugcuguuuauugugcucguuuuguugaauugguacaucaacagaaaacuccaaauuuuuccacacuucuuugcuaugaucgaguaaguucuuaucacaaccuuaaaaaaaauccacauaaacacagcuaaguacuauaaacucuagaggcauuauguauacagugaauaacaugaucuuaaaagccaaguuugugaccuugaauccuaacucuacuucuuuaaaacuauaugucuuaggguucucauugcuguaaagagacaccaugaccaaggcaacucuuaugaggacaacauuucauuggugcuggcuuagagguucagagguucaguccauuaucaucauggcaggagcauggcagcauccaggcagucaugguauagggacuagggaaaacugaguucuauaucuugaugugaagacuccuaggggaagacugacuuccaggaagcuaggaggagggucucaaagcccacucccacaguaacacaccuacuucaacagggcgacaccuccuauuaguaccacuuccugggccaaacauauucaaaucaccacacuauaucuuucacaagguauuuaacuucucugugccucaguuuucuuaucuauagaaagggacuugcuuuguaagauugaucugaggguuaaauguguuacuauauauaagaacucccugaaaugguaucuuugcacucaagguuaaccuauucacucaggcuuugaauuuaauaaacuuguaacuucauuaguggggccuuucucuauucuuuaauuuuugcuccucaaaauaaaacuaaaacaaucuucuacccaaauaaaagccuuuauacauuuacaccacaugaaagcagggaaauucuuuaguuucauauucaugaauuuuccaucuugcauuuuuucuuauauuaccauuauuuguggguuuaaaauguguauuauaguuuguuugcugcauauuucuaaauuuuaucaccuuuaccuuugccuacuaucuauucagucucagucaugaaugacuaagucuccaagaagcauuauguaauaaaaugauaauaauagccuuuucuuuuaucauuauaaauuagauuucuucaaaaaauauacuuggauucuuuaugauugcuauuuuuuuuuuuuuacagaaucuagaguugccaaaaaauaaaaucucugcaggugugaauauaauaggagaaaguacuuuuuuuuacuaaauuuaucuguauauugugauaugcuuuaauauaguuuuuaauauuuucaguuaguuugauuuuuucgaacguuucuucucuagguuuuuucugacauaauuuacacgguugcaagcugcacugaaaaugaagcuagucgguaugggagauuucuuugcuguauguuagagacggugaccagguggcauagugauagagccacauaugaaaagguauauaauuaacaaauauguuuauauuuuacuuguauauguauuguauuacuuguauuacuuguauauguauuguauauguauauauauugcuucagauuggucaguuuuaaaagaauuuaagacucagcuauaaagugauacuuaaaaucauaauauaucauaaaaaguauguuuuuuauucuauuucaacuugauauuucaaguuauuaucauuggguaagcugaaccauucuuuuacauaaagagucacugaucuggucuuauucuccuauuuugugggaugaauuuuaccucuaaaaaugagaaacuuauuuuucuuaggaauguggaaacuauccaggauuccuuaccauauuacgggcaacuggauuugaugguggaaauaaagcugaucaguuagauuaugaaaauuuucgacacguuguccacaaauggcauuacaaacuaaccaagguaaaauauaguagauauuuuucaaagauuuuuuuuccucuucaaaccuguauuuuaugauaaucguucuuucaacaucuguuauaggcaucaguacauugccuugagacgggcgaauauacucacaucaggaauauauugauuguacuaacaaaaauacuuccuugguacccaaaaguuuugaaucugggucaggcuuuggagagaagagugaauaaaauaugccaagaagaaaaagagaagaggccagaucuuuaugcauuggcuaugggguaacacaauuauauuuuaauguaacuuauaacacuagauuacagaaggauucugaagaugugaaaauguuuuacaauguugaagucuuaucuucugcuuuacuucaggagauuaugggagauuaugcgaucauguucccacaggcuggugagaguugucacuucugauuaucaacuuccggucuauacuggaugauaguuucaaagaaauauauuucuugauggggggagauauaauuuuuaauaguucucacaucuugaguaacaaaaagaaaaaggcucucuaguuaaagaauuaguuuaauuugaaagaaugacuaaguuuuuagaacacucuaaagaccuugaggaauauacugaaaagugguacuuuauuuucuagaaccaaguggcagagugaauaauuuguaaaauuuuauuugauuaaacuccauauuuauguuuuuuuuuauuuguguacguguauuuaaacacuuugugcgacuuucagcuacucggggcaguugaaaaguagaaagucacacaugauaccugaaaaugaauuucaucauaaggauccuccuccaaggaaugcuguugccaguguacaaaaugggccugguggugggacuucuucaucaucuauaggaaaugcaucuaaaucagaugaaagcggugcugaggagacugguacgcuuguuuguagacacuucuaaauaauguaucgaaauauuuuauuacaugauaauuacaaugcuaaccccauauugcauuuuauucccuaguuaugaguauguaacuauuaagaauuaaucagccuccugggccuuccuaauuauccacaaaucauuuugcugugaagucagaauuuguauuuagaguuagcuaacaaaaaccuuguuuuuauuucagauaaaucaagggagagaucucagugugguacaaaagcuguuaauaaggcuucuaguaccacaccaaaggggaauucaagcaauggaaauaguggcucuaacagguaugaacacugugccauauguuacaauucuaaacccucguguguguguguguguguguguguguguguguguguguguguguacaccauggguguguauaccauucauguauauguaaguaaguaguugugcaugguugccacaauguguguggaggucuaacaucagauguuacuccacaccuuguaccuuguuugaaauuggauccccuuugcugcauauccuaggauagcuagccuguagacuuugaaagguucucuuuucucugccuuccauucuaccguaggagcacugggauuacagaugaggucuauugugcuuguuuuuagguggguucugaguuagguggguuuuagguggguucugaggaguugaccuugcguuauuauacuugcauggcaaguacuuuacaaacauagccaucuuccuaacuccagaguucucuccuuuaaaaaauuaucuuauaagugagcauacagaguaauuguggcauuuccauauguaugucucauuauacuucauucuaauuugcccuuacccccgugaccucccuugcucucauugucucuugcuagucuccgccuucuuuccaaauaaucucuuuucuguucuuaaaugacacauguauucuauuaucuuccuuucugccucuuguuccucuuuuaugagaacuguuuuucuuucuugguuccuuuucuacuuucauaauguauaugguauuuacauacuuacauauagguucugcacaugguauuuuccuauuugagccuuucuaauuucaaguacuguaaagauuucccggugaauccauuuccaucaaaugccaucauuucaguuuucaguuugguugcauuucauuuuguauaaaucccauacuuucuuuauccaugaaucugucaauagauaaauaggcuggcucaauuucuuuuuuuuuuuccccacagaaaauuccaugauuuuauuauucgugcaauccuuucaguuuccccccccccuuuuuuuccauuuuuuauuagguauuuagcucauuuacauuuccaaugcuauaccaaaagccccccauacccacccccccacuccccuacccauccacucccccuuuuuggcccuggcauuucccuguacugggacauauaaaguuugcaaguccaauggaucucucuuucaagugauggccuauuaggccauuucuugugaauaguaaaacaauuaacaaaaauguaaguaucuccauguuauguugaauuagagacuuuuggguguacccccaggaguggaacagcugagauauucuauuaguuuuugagacacuuguauauauacugacugcuauagugguuguaugaguuaacauuuccacuagcaaguuauaaguauaacguuuuacccacauucucaccaacuuuuuuucuuguuuauucucuugaugagagccauucugacugguuaagagcgguuuuauuuuuuauuucuauggcuaagauguugaacacuuuuaaaaguaucuauuggacauuuaauuuuaugaccuguuuaugaguucauuacuagccuguuuauuaggugaauuuuggagaauuauuugcaauucuuuuuuuauucuuuuuuuauuagauauuuucuucauuuacauuucaaaugcuaucccgaaagucaccuauacccuucccccgcccugcuccccuacccacccacucccacuucuuggcccuggcauuccucuguacuguggcauauaaaguuugcaagaccaaggggccucucuucccagugauggccgacuaggccaucuuuugauacauaugcagcuagagucaagagcuccgggguacugguuaguucauaauguuguuccacauauaggguugcagaucucuuuagcuccuugggagcuuucucuagcuucuccauugagggcccuguguuccauccuauagaugacugugagcauccacuucuguguuugccaggccccagcauaaccucacaugggacaguuagaucagggucccuucagcaaaaucuugcuggcauaugcaauagugucugcguuugauggcugauuaugggauggaucccugaguggggcagucucuggauggucuauccuuuugucucagcuccaaacuuugucucuuaacuccuuccauggauauuuuguucgcuauucuaaggaggaaugaaguauccacauguuggucuuccuucuugaguuucauauguuuugcaaauuguaucuuggguauucuaagucuuugggcuaauagccgccuaucagugagugcauaucaugugaguucuuuugugauuggguuaccucacucaggaugauauccuccagauccauccauuugccuaagaauuucauaaauccauucuuuuuaauagcugaguaguacuccaucguguaaauguaccacauuuuuuguauccauuccucuguugagggacaucuggguucuuuccagcuucuggcuauuauaaauaaggcugcuaugaacauaguggaacauguguccuuauuacauguuagagcaucuucuggauauaugcccaggagagggauugcuugaauuuuggagaauuauuugcaauccuugucacucuccugucugagacauaauuugccaagcuuucccucaguuugcaugcugucuauucacucugaugauuguuuccuuagcuguguagaaacuuaauaucaacucuaacaucgagguauuugaucuuugaauugauuuugagcagaaugaguacuagagaucuaguuucauucuuuuacauagcaguauucagguuucccaaugcugucuguuguauauacugcccuuuuuccaaucuauguuuugauacuucuguugaaauuuaggugaguguagcugugcacauuuauuucuugcuucaauauucuauuccaaugaucuccacuuauccauguuuguuccuguuccacuaccaugcuguuuuugucccuaugaaucgcuaguauaauuugggaucaguuauugagauaccuccuagcauuaccuuuucugcugaguauugcuuuggccauuccaggucuuuuguauuuuuuuuucaguuuuaggugugugcauguguacuuauuugugugugugcaugcauggccuccucucuuucugugugugugugugugugucugucugucugucugucugucugucugucugucucucuguguguguauguaauucuguaaugaagaauuuccuuugaauauuauagggauuauguugaauauauagauuacauuggguaauagaacuauuuucacagucaugauucuccuaacucauaagcaugggauuucauuuuuuuuuuuaaauuuuauuuucaugguccagucaguuuugcuguuuaaaauuuggucauuauugaaaauauuuuuuuccauacaguauauucugauucugauuuccccuccccaucucuuccuaguucuucuucaccucccuacucacccaaaucuauguccuuucuuacucauuagaaaacaaauaggcaucuaaaaauuaauaaugcugaaauaagauaaaauuaaagcaauauaaguugaauaggacaguaucuucuucaguuagucucuuuuuaauucucuacucucuuauuuccucaggacaauuccuaaguauuuugcuuuuuguaaaguuauuguggaugauuucuuccucaacaauuuaaucuuuaguaaauagagcuuuuaauuuucauguuacuuuguagccuguuaauuuguuuaauguguuuauuagaaauaaggacuuucugguguauucuucuggaccuuuuuaaggauaggcucauguuacauuuuaaauagauaugguuugaaguuuuucuuuccuauuaucucuuucaguucauuuucuuguuuacugcucuagcuaagauuuugaguacuauaauaaauggguugagucugauuuugccuaaagugcuuuugaagguuuguuauauggucccuguauuucuaguucccuuaggguuuuguuuuuuuuuuaauucauggaaggauguuguuaucaguguuucucugcaguuauuggcauaaaauugugauuucuaauccugagugugucuaucuacuguauuauauuucuugaaccauucuuucaugccugaaaugaauugaguuugguuauggugcaugauuuuaauguguucuugaguucuguuuacaagauuuuaagaaguuuugcaucuugaacuagagagacugcucugcaagguuaagaacacugacugcuuuuccacaggacccagguuuaguucccaaaacccauguggcagcuaacagucauuuguaacucuaguucuaggggaucugauaccuucuucuggccucugggcaucaggcauuuaugucauacacagacauacauacauacauacaugcaaggaaacauacauucgcauaaaauaaaugaaacaugaaagguuuuuucaaggauuuauuuauuuauuuuauguauacgaaugcaccauugcucucuucagacacaccagaagagggcaucaaaucacauuacagauggcugugagccuccaugugguuguugggaauugaauucaggaccucuggaagagcacucgcuacucuuaagugcugagccaucucuccagcccaaaaguuuuuuuuuucuuuuucuuuuuuuaguuuauuaggcgaauuguccauaguuuuguucuuuuacuguguauuuauucaauuuggauguauggguaauuacugccgugaacagacaccaugaccaaggcaagucuuaaaaggacagcauuuaauuggggcuggcuuacagguucagagguucaguccauuaucaucaagggggaaacagggcagcauccagguaggcacagugcaggaggaacugagaguucuacaucuucauuugaaggcugcuuguugaauacucuuuuccaggcagcuaagaugaggaucuuaaagcccaugcccacaggugacacacuuuuucuaacaaggccacagccacuccaacaaggccacaccuccauauaguuucacucccugggcugaacauacucaaacuacugcaguaguguuacuuuacuuucuauuuuaugaaacacugaggaucuuuggcauuggcacuuuuaguugaucugaaugguucuggcuuucucuucugucuuguugcuuguuauggaucuauuuaaauugauuguauucccuugacuuaauucugauugaucgugugugugugugugucuguguguguguaugaaaaaauuuuacucauuuuuucuagauuuuucgaguuuucuuccuugaugauacuggauaucauuggaauuaacaguaaauuuauccuuuucaucucuaauguguauuaacuugagucuucuguuuugacuaguuugcuuagaccguuacaauuuuuuauuuaauuuuuucaaagaaguaagucucuaauugguugauuuucaauauuguccuuuuagucccuguuucaguaauuucuucccugaccucaauuauuucuuguuauuagcugcuuugugauuuucuuuguucuuguuuuuuuaagauaucauuagacuauuucagacuuuugauuuuuuuauguaaguuuuuauaguuagaauugccuuaguuguauuugaaguaguaucguauguugugcuuuaauuuucauuugauucuuggaauuuuaaaaguuucuccuuuauuucaacuacccaguagucagucaugaguguauuuuucagucuccaaguacuuguguaauuucucuugcuauugauuucucuuauagucuacuaugauuuaaugagauagaaaaaaucauuucaguucuguauuucuuaagacguaguuguggucagaaucaagucucuuuuagaaagcagcagccuaugggcugcugggaaggaugugcauucaguuucugauggauaaaauauucuccagauuaucuguaaaguccauuugcucuuugguguaguuuaacuuugcaguuucuuuguugauuuuuagucugaauggauaucuaaaguugacauuggaaugucaaaaugaucacuguuacuauaucaacaccugugugacucuauaugaacauuaauguuuguuuuuaugaaauucacaggucuaacauucagugcauauguuuuuugauuguuacauauucuuuuuuuaagauucauuuuauuuuauguauaugaguacacuauagcugucuucagacacaucaaaagagggcaucagauucuaauacagaugguugcaaaccaccaugcgguugcugggacuugaacucaggaccuccagaagagcagucagugcucuuaaccgcugagccaauucuccagccuaacuauuacauauuuuuaaagcauucauauauagcuauauuauuaaacuguuaucaaaaaguuggauucuacuuuguuagcuacuggaagagcuauggcagcuugauuuuggcugauacucacuugguagauugaccucuaucucuugaggcucacucugugguaucucuagcagugauagauguuucuuggaaacaacaaaauaauuguaucuaauccagucagccacauugccuuuccuuauugguaaguugaggucccuacuucuaaggcuacaucucccucauuuagucauacagacugacagaaugggauuccugucuauuuuucacccaccugcuauuggugucauuuuuuuuccacugaaaucuguaaguagauuugaugguaaugaguguuaucacuggaguaaaacuuauuccccuucccuuuuucuaucccucuuccccuccccccuccccguguguguguguguguguguguguguguguguguguguguguguguuaguguuaguuaaacugugaauggaguuuacuuuuuccuugggcucaucaccuaccauuuuaccuggaaguucccuggauucuucuuuguuuauccgugaguggaaugguaaaugguaguaauuuagcaguacaauagucauguaugcuagacuuugaaguuuugcuuacucccauuuuuauuuauuuauaacuaauuauaguuuacauaauuauguuuuguuuuuaacagccuuauuuguccugcagagagauuggauguucagggagauauaaauggggaaguuuucggauacaguucuuguuguaggcaguuugaguaaggcugguuaguauaagaaaagcucauaguaauuuugaaaguagucaguacagcugaauagucuguuuacugauagugccuuuaauugguuugcgccauuauuuuauuauccucaaaguuuauauauaagauaaucuaaaauuacuuauuauuaaucauuguuuuaauuacauauucaugaauuaguguuguuuguuucacaugaagaauuacugacuuauccuaaagcccuuauuuaucuuucugaggauuccucuuaguuucauggaauuuuuuaagucauuggaagcccuuucugauauuuuauuugcuaauuuguuugucugucuguuugcuugcuugcacgucaacauaggauuucuuuguguauaggccuggcugucuuggagcuuacuccguaggccaggcugccuucaaauucacagagguccauccaccugcuucuaccucccaagugcugggauuaaaggcgugcaccacuacucacuuaugauuuuagauaugggauauauuugaugauuauuuuuuaaaaaauauuuuuuuuauucuuaagcaacaaagcuguuaaggaaaaugacaaagaaaaaguaaaagagaaagaaaaagagaaaaaggagaagacuccagcuacaacuccagaggccagggcacuugguaaagauaguaaagaaaaaccgaaggaagagcggccaaauaaagaagacaaagcaagagagacaaaggaaagaacaccuaaaucugacaaagagaaagagaaguucaagaaggaagaaaaagcuaaagaugagaaauucaagacuaccguccccaucguagaaucaaaaucgacucaagaaagggaaagagagaaggagccauccagagaaagagauguagcaaaggaaaugaagucaaaggaaaauguuaaaggaggagaaaaaacaccaguuucaggguccuugaagucaccuguuccccgaucagauaucucggagccugacaggggcaaguguaccuuuuuauauuugguuacuuuuuggaccuaauuaugcuuguugguuaucucugugucuuguuaugguagugauuuuguuacugcaacaaauacuuggucuuaaaaguuguuaauuuuuugaaguguuuggaaugacuagacauauaccuuauucugacuauuucuuuuuguccaaacagaacaaaaacgccgcaaaauugauagucauccuucuccaucacauuccuccacaguaaagguuaguauagccugaggaaggcagcguccguauuaggcucaccuguuuggaauaccaauguccugacuuccuucaagucuugugccaaguuuucacuggagccacuggagguuuuauauugcauuagaaaaugaaauuuuucuguauugguggacugauuuuuccuauugaauauuuuucuuauaaaaauguuaaaacuucaaggaccuagcacuaauuuuauuguguuucaaagugcaagagaaauuuuacccagaagugccucacugcuuuaagcaguccuuuuuggagugcaaugguagcuacaagcaaaugaaucuuuucagcagaaugaagcuauuuuucggcauaaauguugaagauuauauagcacugaagacuuccugaaugauacaggauaaacaagauaccucugaauuuaucaagcuucuugaugagcaucauaccgaugugccuucuaagaaggaaucuugaaaggaguuccauuuuaaagucuccuuggugaucaguucuccuguaguuguguuuauucagugagcaugcagcuucuguuguaucuucccuuggagguuuguuuauacccauuggguucccaacaaguugaaccuugcguuacgauaagagcagauguggcauccaguccuaccacccagcaaagagaaaccccaggcauucaacugcagcacaauaucguggguguagccuucuugaagacucaggguagccauuccuugcuccauauuuaauuuuaauucuaaagucaucuaauuucauggaaucuuugaauuugcaguacguugaacuuuuaaaacuguaaguuaauuaauucuucauccagagcacugugguggaauacuauaguugguuucuuuuucuuuuaaaauuuuuuuuccuugugagaggcauaagauugaauaaucaugguacuuuugcagcaaaauauugauuacuguuuuauagaauauuuuuucuucuaaugccacugaauuuucuagccagaauaaaauguuuauauuuauuggaguuguaaaugaauaaaauuugaacucuuuuaauuagaggguaacuauaaaaauauuaguuauuuuuuucccaugguaaccucuacuguucucaacuuuugguagagaaaaauguuuugccuuuuuauagccucuuaauuauuuaaagcauaauaugaaauauguggcaucaacuuuuauuuuuuuuuaauuuucaaucagaacaaaauuuuaauuuuuuuaaaauuuaauacuuauuuuuaacuuuacaauuccauuauaugguuuugauuuuuguuuugauugcugauauucauauugauagugauuuccuggaauuuauccucacaagaaauagcugguuuguuuccagguuacagauauacuucccaaaguuccucuggguucugagaacuaugccagcucaccugucaucuccauucauuuucuacaggacagucucaucgaucucaaggacucuucagcaaagguuugagucuuuuaaaaucaugccuaaguacaccagaaauugcuaaguuccuuuauuuaguaggggccaccauccuaguaaacuuugcaugcuaggauuggugagagaaagcacuccguuuauauagaauuaccuuuaaagauuuugaccacaaacaaacacagaugacaaccggccacauagacagacacauuguuauaugugugauauggcaguauuuuuauauauuuuucuugcuguacgacguauuuuucuuuuaugauuuagauuuaggaaaaggagaguuuugcugguuuauuugggaugggugguagauagacuuucauaguuccacagagcaaacuuuccaguuuuauugcuuuguuuauagauaacucagaagaacaaaaaaguaauuugcugcauucauagaacuuuuaaaaacucaauccauaaauuucuuuauaucucccucugcugaaguauccuuuaguagguauggcauaauaccaagagauagaguaaauauagaauaauaauucuccuggaaggacccaacuuguugguuauguuuauaugucaguaauaauucucaccuuuuuacacuauucuccuggguauucugauucuuaaaaacagugugcaguuuguguauuuucuuauggaguucauuucaguauuauacuugaauugucuauugacauuuugucuuacuaugaaaucuguacccucuuuacuuugguuuuucuacuuuauguuuucuacuuaugcuaauuaugauucuuauagauuaaauggaauuuugaaaugucuggauucugggcaaacauuuacuaauuauuagugguuaaaauagccuuagugccugugucuuaaaaauaugacauuguuuuuaagauaaacucuuauccgaaaguuuauauacuuuaaaaaauuguacuuuuuuucuuuuuacuaugcuaaacuacuaguaguuuauuuuaaaguaaaaccuuuuuauuggcuauuauaaagauguacugcaguauaguaggucuuugcagccaguuuaggauugcauuugguagucuuaaccaguagcuuguguggguuauuuuuuauccaugggcuuguaauaguuuuaauuuguuaguauuuauuuauuaaggcauauguugaaaugguuugaaaccugauguuaagguuaacuagauuuucuuguuagugaugaagauuacgauuucuugcauuuguugugaagauuguuuugucaguuuuccaugucuagaugauauauauuugucucaccucauguuuauaacaguauuaugaauuaaauagggcagaugauagugucuuuuugacaaaugaaagacugagcuauccccaguggcauacaauuugucauuacugaaaaugugaguuaaaucuugcuggcauaugcaauagugucuggguuuggauauagcuggcaaauacagaaguggaugcucacagucaucuauaggauggaacacagggcccccaacggaggagcuagagaaagcacccgaggagcugaaggggucuacaacccuauagguggaacaacaauaugaacuaaccaguacccccagagcucuucucuagcugcauauguaucagaagauggccuaguuggccaucauugggaagagaggccccuaggucuugcaaacuuuauaugccccaguacaggggaacaccagggccaagaagugggaguggguggguaggggagcagggcugggggagggcauaggggacuuucgggauagcauuugaaauguaaauaaagaaaauaucuaauuuaaaaaagagagaaagaaaacaccuccauaaaaucuggcuauaaggcauuuuuuaaaauuagugauugaugggggaaggcccagcccauuguggguagggccaucaaaaaaaaaaaaaaaagaaaaaaaaaaagaaaaugugaguuaaaauuaagguuuguugguucuuaacauucaauuuaauaauaguugcuaaaguuuucuuagcuccuuuagugugcuuguauuacuuuuuaaaugugguguuucaggucaauuuuccaacauuuuuguacaaguuuuuuugugggcacuugaaauucaauagauuaauccacauggaaucagaaaguuuaaaaaucucuuuucucuucucuuuucuucucuucucuucucucucuucucucucucucauacauaaacacacaauuaaagacuaugagauucauuucauuuuucagauccuuaccuuggcaugggaucuuagaguaagguuuagccacucaaauaccuuuaaugauccaaaguaguauuuuucuauaguagcugauuuuauaauuuuaaauauauagaaaaucuacuagcauuugaaugacuuggguuaaaguuucuuggaccuugagcaaguuauauagccuaacuguuucuggggcagcuuuuacuuccuagagguuuuauuguaagauaugugucugucugucuuuuauguuaccuuguuucuuauacauacaaaauuguuuccuugauuuuaguuugauuuuuuuaaaaaaguuaugcuuugcucccccaauuuucuuucuuaauaauucuuggauauauuuuacuuuccaauucauaguaaaguaaugcauauuuuaauuuuuaaugagauuaaaagaugacuaaccuaacauaggauucauauauuuugucaguucccuuuccacacccauuucugccucacauaguucuacuucuggucaguuguguuugggauagcaguacuagcuauauaugaugaagagaguacuaaagacaugcuacuaugccaacuaaggcuugauuuggagaguuggcuagauuccuuuauuagauauuaauggucucaaucuaaagaaauaaaaucaagccaguaacaaaaauccuacaguguuauauauagauuguccugucauaucauuaaccuuauuuggccaguaauguguuaaacauuuauuauagacguauauaaaaauggaaaaggcaucuaguuggagauguacuagaaaugauugugggcagaaauaaauagguugagauuacuaagcaaaccccguuaaggaguggcauaugaauaacaauagaauacgaguauacuggaaagugaaucgcagagcugagagauaguuuagggugcugauggcucucaagcuauuuuuuuuaaaccugagaauuuuaagauaaaauaauuauucuaguaagguaaaaaagaugguggccacagaacuuuagguugcgguaugcuaggauauaauugugaugauuaugcagcaugcuuagaaugcuuaaacaaagaaguaugaauucuacucaguaggugaugcgguaaaaggugcugucacaauuauuagaaagacagggaggaggaaauaaauugcuuuauuucuaaaccuagaauuggauuguguaucaguuaacuauuugacauugaaugccaauagugaaauauuucaguauuaaugccagaaauccuagagaaguuucuuaauuccuuacaguacagaauucaaguagacauggaaaaaugucuuuuuugguguguguguguggguacucuaguaauaggagaagugaaacaguacuuuacggguauuguugaguguuaaauaaauuauugaauuuaucuuaucuaguccauaaauauuaaaauaugggaaaagauguaauaaauuucacaauuagaaaaauuuuaagucauuuaagucacaauuagaaaaauuuuaagucauuuaagucacacccaguaaaaguaucuuuuaguuaguacuuagacuauagauuauucucucuuuuucuuuuuugguuuuucgagacaggguuucucuguacagcccuggcugucuuggaauucacuuuguagaccaggauggccucaaacucagaaauccaacugccucugccucccgagugcugggauuaaaggugugcgccaccacgcccagcucauucuucagcuuuuaaacauagauuauuuuaaagccuccccccccaaaagaauccacucuguugcuuugauaacauuucuuaagcaaucgaauugaaaauguuugguggcguuuaaaaauaaguguuuaaacuucaaauugaugguucuuuuucuuccauuucuuagauuaucauaggauuccuuacuguaaacuuauuuuaccuugcauucacuguucuguuucuuccuaggguauaucuagaauuagguagcuacauaaugaauucuguccauuauucuuuuaauguaucaaaugaaacauagacuuacuuguaucacaguucuuuuuuuuuccauuuuuuauuagguauuuagcucauuuacauuuccaaugcuauaccaaaagucccccauacccacccacccccacuccccuacccacccacucucccuuuuuggcccuggcguuccccuguacuggggcauauaaaauuugcguguccaaugggccucucuuuccagugauggccgacuaggccaucuuuuguguaucacaguucuaaaugccauaaaguuaggcaucugauuauuuucugacuccuuucuaaacauucucuuuuauaguggauuucuauauuuccaacuuucagaagcaggauuuuucucucauggaauuagaauagccuuaauguuuggcuauuuuaucacuaauagaccuucuuacagagaguauuuguucugucacuuuucagucuuccaagucuagucgccaucaggagaugguguccugggcuguuuagaagcagugagauagaauucacaguugugauuauuugauagagcugugaaagccgagaguaugcaucaguuuuuauauugucaaacuguuugagauaaucacugccugcuuuauaccuaugcaaaauggauguaguagcaaaaucauggcuagguuuuauuuauaacuuuuuuguccauugucacugacugcuugugagacuuuuaaauaaucuugacugcauaggauuugucuuuuucagcagaggcaguguagucuuuuacauaugaacuccuauauacuggagugacaaggagaaugauaguuugugaauuuacuggaaauguuacuugaggcaguaaugaacugaguuaaaaugggaauccuuauaaggccuaggauuaaaaccuuuguaaauguguuauauucuuuuacuuuagcuucuauaaaacaaguagauaacuaguuuugacuuuauauauaauuaccuguuaucuuuuguuuaguaaacaaaaauaccaaaggcugucaauacuggaaaacuaauaaucuuuaguaauauugccuuaauuuuaacagcucuacauuaaccauaacccuccaccacuguccaagaguaaggagagagaaauggacaagaaagauuuggacaagucaagggaaagauccagagaaagagagaaaaaagaugaaaaggacaggaaagaacggaaaaggguuuguaauuuuuaaaaauuagcuuggaaagcuuuauuuuguguauaguaauauguuuuucugcuuuuagaaaauacugcuuuauuccacagcagucuguuucaaguuuuagcugguauuuucuucuuaaaguguauucguaucuucuacaguaaauaaagaacuucaguguaguaaucaugccauuuuaccaaguacgugguacugcaaauauccuccagugcuaguuagugaugucuuucuuauaugaaaguaauacuucaaaacaaaauaaaaacuauaacccuugaucaauguaguucacaauucuugguucuaggaucauucaaacaaugaccgcgaagugccaccggacauaacaaagaggcggaaagaggagaauggaacaaguagguagacuuacuaauaccuuggaaacagucaucagagugaacuggaaaaaccuuucauuauucucuuuuguaauuuuaguggggguuucaaaacacaaaagugagaguccaugugagucucaauauccaaaugagaaagacaaagagaaaaauaagucaaaaucuucaggcaaagaaaaaagcaguagugauucguuuaagucugagaagauggauaaaaucucaucugguggcaaaaagguaaauuaggaaugcaaaggaacuguauacuuuucagaaaagauguauuuuauuauucuuggaggcugucauagaugaguacuuuauuuacaucauuuccaccucaaacuccggauucuguuuuccugugucuucccccaacuuccucuaaacuucaugaccucguuaugauuauuacuauuacaccuaucuaugugucuggaaguaucaccugcugaguccauuuagugcugcucauguguauauguguuaggacugacaauuugggauuggagaaccauucagagggcuuguccuuagagaaggcuggcucucuuccuuucaaagcagccauuaauugcauguggcuccucaucuugggguagggccuugugaggaaaauacuuaccccuauaaauuuagugcuucauuguguauguguguauauucuugccagauaauaauuuguuaauuuuggaauggcaacaggaggauugggagggaacagguucccugguuagaaaauuugagcuagaugugcucuaaauuacugugaaguuagaauuaguauacuuuugaaaguccuuuucucucccuuucacucauagugcuucaguuccuuuuucuuuccuuuucacucauagcacuucaguuccuuuuucucuccuuuucacucauagcacuucaguuccuuuuuuuuggggggggggguuguggggagguuguuucucaguguagccuuggcuguccuggaacucucucuguagaccaggcuggucuugaacucagagauccuccuagcucugccuucccaagugcugggauuaaaggugugcacuaccaccaccaccaccaccaccaccaccaccaccaccaccaccaccaccaccaccaccacuaccaccacuaccaccauccggcucaccacuuuaguucuuuauguuaaccucuauccacaguucuuuguuuuuaguuucuuuuauucuugaaguauaucuauauauguauaaaguacauucuguuauauacuuaggauugauauucaaaccucaagcaugcuccauuaaaauaguugauaagccacuaaguuguaaacuguuuauaaagcauuauuauaaauguuacaaauuuguaguguguucauaaguuuuaaaaagcaguuuuagaaaaguaaaugguagauaauuuaauuuuguaugcuuccaaagauaggcuguuccuuuuucaguugagauaaguuuacacaggauaacagaaucaugcaauuaaaucaauggugcuuaacuuguggguugcagaggcccuuuugcaaacccuuaucuccaaaaauauguaauuuuuaaagauuuacuuauuuuauguauaugaguacacuguaguugucuucagacacaccagaagaaggcaucagaucagauggcugcaagccacaaugugguuacugggaauugaccucaggaccuccguaagagcaaucagugcucuuaacuauugagccaucucuccagccccuccaaaaauauuuauauuacuacguauaauaguagcaaaguuauaauuauaaaauaacaaaaaucaucuuauaguuggggucaccacaacaugaagaacuauauuaaagggucacaacauuaggaagguugacaaccacugaauuaagugguaugcauauuugcaauauuguacauuugguguuugcuuccaaaacauuuuaauugucccaaaggggaaguguagacucaugauacauuuauuccuuacuuugccuuccccaguccuuggcaaccacuaaucuuucugucucuguggauuuaccuauuuuuaguguuucauauaaguagaauuauaaaauaauacagucuuuuguuucugccuucuuagaaugauuuugagacuguucuuccauauuauaguaucuaccauuacuuaauaucuuaugaccaaagaauacuccauuauaugaagcuaucacauuuguuuaaucauuuguuaguugguggauuuuuuguuauguuuugagacagcgccucccuuaguagcccaagcuggcuuggagcuuccucaguacuucagccuacccucaaacuugcagucugucuuccugccccagcgucucuagugcuaagauuacagggguaagccaccacaaccagccaauuguuggauuuuuagauuguuuccgauuuuugguuauuaugaauaauauuaugacuguacugauaugaaguaauuccuuugacuaccuucaauuuucuuggauguaccuaggaauagaauuuuuagguuauuagauaauuuuguuuagccuuuuugaauugcugcuaaacuuuucacaguggcuauauaguuugcauuuccacuagcaauacaucagggugugcaauuucuauacaucguugucaacacuggcuccuuugcauguuaguuuauucauagcuauccuacuggauauacgugguaacucauugugguuuuaauuuguauuucuucagugacuaaugguaccagaugucugucguuccaugucuuuauauaucuucuuuggagaaaucucuucacaucguuuucaaaaugagucuuuuaugacauucacuuuuaagauuucuuuagauauuuuggauaugugacugcuauacauuuuuugcaaauaucauuuccuguuucauaagcugucacacuucccuaugguuuauguguguuuucacuuuuggaggagugaguugaauauucuuuucuuuuuuuuuuuuuuguuacaugugguuuugaagucauauuaagcaaguuuuugaagaaaaauuauagcuggugguugauaaaagggaauuucaagcugcuauuuaaaaauguauuugauuuuuccuuucccaacuaauuucaucauuccucauaggaauccaggcaugauaaagaaaagauagaaaagaaagaaaaacgggauaguucaggaggaaaggaagagaagaaacaauauccuuuucauuuuuauauuucacucgcuguaguagaagaauuugguacuauucauguuuagaaugaaaccuuucuucugugugaucuaaauaugcaggggcuuauuagcuuuaaagugauaucuguaguuaacugucaguuuauaaucugaaaacaggagguuugaucuucaugacuuuuaaaaaaaaugauucuguagugauggagauguuuuaugacaaaaguuguauaggcucccuuuuguauuguuaccaagaggaaaaagagaaacagagaaucccuugguugggggaggauggugagaagugcagaaugaugggacacauaagcagagcucucaguucuugagcuuaguagguugaucagagccaauuaggcuuagaaacuuaaggggucguagcaaaagagaggacacuauucuuccugccccaagcuuguuuucccuuaauuuguuaucuacucauaaguccucugacaagcacagauaaugaucaauuucaaccaaggugaguauauucuccccuccuuuucauuuagagauacaccuaaaggagaucuggaaaugguaaagggacgcgauccauuuugcaggauauagcuacuccaauuuuuaccugacuauaacacagugacguuuuguguauagauauaaaauuugcaguuauuuuaaagcucuuuucacucuaagcuugcugauuaguuaaucuuaaaccaucaagauguauuuaaggaaaccuggcuuucucauugccaccuagucccaucguuucuggaaaauuaauuauguuuuaaaagcaccuguagcccaagaagugguggugguauuuauacuuuacaggaaaagaaaggaaaauucucaaagguugaagcaggucacagaggcauuagaaaacagaguugacacuaagggcagaauuucagugguuuuuguucuuugugccuuucugccacugcucacauuuauuuauaaagucagaaauuacguucuguacuuuuagcuagauuuuaaauaggcaaacuuguuuucaagguaauguauuuguuuucugugaugcauaaaaugcuuuaaauaucuuauauaaaucauaugaccaccauaguggacagacuaugcauauucuaauauagccucuucuuuuugaggacuuaaugccagcaucugaguaguuacuuuuggaugguuuagaauuauugaaguauauaggaugauuuuuuuccuccauuaaugauuccagguagacauauuugaaguugacuuuccuuuauugcucauuuuuuuugcuuucauugcaauuguuccuucuuaauacuaauacagagacacccacuauuuauacuuuaucuccaaccugagcugcuucuaauaauuuauagaaccugauacauagcaaacucuacuuaaugcuacuuaggggugaauaaugucugggagcuauuucaguauaugcuuuacgauguugguugugucaucuuuaguugguugcaaugcaggaauuugagguuggcagauaggugaccuacugaaaggcgugcuugguucaguguuucucccugccgauuucugaauaguagagugggauaagcaagaguauuaaggaacaauuaacauuuaacauuuuuucuucuuauuuugagauaucucacuauauagcccugacugaucuugaacuugcuauguagaucaggcuagccuugaacucacagaaauuucccugccucugaccucugagugauaggauuaaagguauggacuaccucgccugacuaagucuuuuuuuauuucuuaagaaggaaaauuauaaaagaaauaguauuauucagucuucuaggcauccuuccaauuaauugucuucccuggggaaccauuauuuauauacauguauuauauauaguauauauuuuuacauauauaauauauacugaguacuaugcauaauauauauauuuuuuauucuaauccuagcuuuuuaauuuguuuuuauuuaacauccuuucuaucaaauuuucauuuggaacauaucaaccauggacacugacaacuuucacuaugaucuuaugcaucuauuuucucucagagcccaaguuugcuuuuuuacacaugaagguuuugauacagauuucugugaguuauauuuacauuggccauggaguauccauugggaacaaaaggugaggggcaguaggauuggaaaggacuagcuguuuggcuacuggucuuauaguaaaucuagaagcagaugaguuuuuacauguauauuuagcuugcugacaguuaagugugucccauuuacuuccuucuggaacagacucuuacucuugcaaggcuaugauuuauuuuuuucuccugguuauuuucugguugccucuguauuugagcucauucugugguuggggaagcauuuccauuuuucuuucuuuucaucaaaaaccuuaucauuuccuaugguaccauugucugucuccagagugugucaaaaucugcuucucuuguuccccuguuaacuuguuuccuaaucuguagaaagaagagcugcuaacauauuacauugccaugauuuuaugugcucacuaauuuuaaguuaguuuagggagucagcagagaaauuacauugauuuguuguaccugucacccaagugcagacauauuaaaguggguacauuaggaucaagagacuaccguacauaaaugugauuuagauuacuuuccuuuuagagucuuuuguccuuucuccuauuuguuaguucccaaacuccugugcuuuauuuuuaccugcaaaaucuuuuuucaaauucuaccucuccuugaacaucacuagcugcuuuugccuuuaacauuuccuuuuacuuuaaucuuuaaacaauccaugccugaagcucaagauguagcucagugguagauugccuaguauguacaaggccccgaguucaauccccaacaccaaagggggaaaaacaaaaacucaugcuaauuaaaucguuaucuaacaaccauucugugacuuauuucuuauuaccugguauauguggcccacaacucauacccuauucuguccauacuuuuaguucauuguauuucuagccugccauucccacaagccccaauuucuuuuuuuacuuuuagucucauauauguaaccuaauucuuuuauccuguaagucugauaccaaaaguaucuaguccuugaaaagaaauugccuuguuagguaaggccuuagucuuauccaagguuuagaucuagaaagcauuguuuuauuuauuuguugguugguuugaaguagacucuuacucuguauuccaagcugguccauaauucacuguguagccuagguugauaucaaaucaaugguacccucagcacacauaccaguucagccucaguuauauauacauguaccguucugcaaaaauucuauaucuuaauauccuuuagcaauucagaagaauugacuacucagaauuucaguuucauuugaggaauugaaacauuugacauuguguuuugauuucugcaugguagcagucaaacuuugaccuacaugcuuuccccauagaacaaaguuuuuguggagaaggugguuaggggaggaggaggcaggcuguuuacuccagaauuccauacaugguuaauuuuguuugguuccauuauaucuuagcccucguagacauugauuuuauaauucuuauucuagccuuuucccccuccuguuuuauacuugggagcauggccuccuaagcucucacacauucuuaacuugaggaaugcauuggcauuccaaggcuugucugaauaugguaguaacuccucuuaggaaauagaguauuugaugaauuuacucuccagaacuaguuauugcucacaugugagcuugucuuaguuccugguucccacauuuguaugagugugcuucauagccacaugcuucgcuugugauuuguguugaacaaaugaucuuacccauucuuuuaaucaaauaagcaauuauuuuuuauuaucugugauguuuagguaguauguuaacuguacauggaaaucuguauacagaaguaguaacugcaaugugaagugauuuaaucaauaaaaacuuuggugaggaacaaugcuagaagaaaaaaguuuuuuccccccugcuaucaaacaagcucaguuuacuuauacuguuugcuagaggggaaaccauacuaacuaaccauugcuuuauauccuugaggauauuuauaguuuuuuauuuugguuuacauauagcaaucauuuaauaucuauaaagcuuuuguuaggaaauugaggugauagucacaacuauuuuuucuucauuaccauuuauacucauuggaguacuaguuguggguucuguaaaccaauagucauaaggcacuaaguaguugaagcuagaaagaauucuguacuuccuugcuuuuccucuucagguagacacauucacuaaagugcuauuuucuuuugcaguuucaaggucuugauauugggauaggacuuauaaaagguucuucucucacaauugcccaugugugugacuauccucauuguacauuuuucauucugacaggcaaccccguaugcaauuaaguuucagcuuaaaagauucucaacuuuaacuuuguguuacauuucacugacacagaacaucccagagacuguguuugcuguaaaaguuuguaagggugccugcagauggaaugcuagaucaggaugccugucccuguuuuucuccuuguaacuucuuccuugugaauauuccuuugauauucuaaaugucaacuucacccuuaugugcuucagcuuuggagagggagagggauaaacauugaaggggugagucaugaaaucuucaaaugacacuuaaccaggaguuagcuacuuuuggggcagguuuguauuuuaaaguuucucuuaauuuuuuuuaauaucaccaaaaaggcuauuuuuagagacaucugaacuauucaaucagauaaaaagaauugagaacauugagauaguuacuaauauaauauaaaaugauguuuauacacguaaucuucuuagaagaauagaaggaccccuuuguuugacuguucuaugugauauuaagaauacaguugauagcuucaaaagaguauaugugugagagggauagcagacugaacugagcaaaaucaacaaaauccuaacugggaaaaagauaggguucugugacaccuuagauuuauaaguuaaucuugcuuauuuaugauuguuaacaugauguacauuuuaaaauuagcauuuaaaauaaaauguaaaagaauguugcauaugauugguauaaguucaguguuaaugacaauaaaauuguaaauguauggaggacaaaauucaaacugugaguucuguacuauuuuguuacuaugccuucuuaguguuuuggggauuuuagagacagcgacucacuuuggagcuguccuggaauucuauauaguacaggauggcaucuaacacauugcaauccuccugucucaugcucucaaaguucuaggguuauaaguauguuugguacauugagcuuuggaauggauuuccaguuguaaccccaaaccucaguauuauugaauaagacuguguggacacuauugagaugguguggauaacacugaguaucuuuccacuugcucuuguacuuguugauuugucauuccaggguguggacagaccccuaagcugaacguuucccgaggaggaugccaaagcuccaugagucacucucagaaugacaucucccauauuuaagagcuucuggugcuguccauuuuaugggaaucugcuuuaagucagaagaugcauacauaccaccauccuuuugacaagacauuccaaagucacugauuuucagaacauuauuuucaccugcaggcaguuucuuggaacaagguccccgugcauacaauuuuaugugggacacaccauccagaagcagcaucuaaaggaaaauucacuaacugacuuuuaguucaucuuucuuucucagaaaggagaggaaauugccuccuggaagcaauuccuuaaugauguagauagguugccuuugugugugaauucuguaagugugaaaacauuggggugauuauguugcuuggaggguuuuggcuucuuauaaaauuuuaauuccaauucaugggaaagaucuuuguguuuuaacagcaaaaacauuuuuauuauuuaauauguacccuuaaauaugucaucaaaaguuuucuuguccuuaaggaauucucauaguaugacaugaucauaauugagaccccauuucuuauucugguuauugucauauagauaccaugauguucuuuuucuuucccauuucuuauuuucaucagcauggucaugugaauaccaugaaguucuuuauugaaacaucauucauuuucagucuaaaauccugagauauagucaacauuuuaaaguggauaauucaguggucuuuaguacauugacuguguggugcagucuaaucucagaacgugcagguuagcagucauucuuauuucucuucuuucuucagccacuggaagcuacugacacauuuucugccuaugaauuugccuguuuugggacauuucauauaaauggaauugugcaauaucauguccugggggccaggguucuuucaacuaccaucuuguuaucaagagucauccaugguauagcaugugucaauaauccauuccuucuuaaagguuaaauauuccauagaaugaauguguaccauauuuuguuuacccauuuauucauugagggacagaaacaauuacacuuuuuaaguaauaaaauuagaaggucaacaucaguguauccaaaauuauaauugaugaugucaagauuauacaugguaugcacagaaugcuguguagaaaugauguguaaauuauuugucagcauuucaugcaaguguaauuacuuucuaaggcccuucuagcuaugauuuuuuuggaacugugugaauguaguauauucauuaguaaaguuuaaugcauuaagcauuaauuuaaaauuugagaacaauguuaggcagauaaauuauuugccacaugcuguaauggucauguuuugaauuuauuucguuaugcaguauuugaaaaaugucuacauaaaggaaaggaaaugaguauaauugagucaauauauuuuuaaagcaauuuuuauaauuuagcagacauugcaucuuaauauaauucacuauuaaaauguguccuuguggaaauaucgaugucauuuucuuucuauuucuuuugauugaucuuguaaaauagguuccuuuccuuuguuaaauguucuguuuauuuuugauacauuauucuuugcaccuguagaauguaccuguuacucuuuaaccuuuuucucuaccccagaauccuuccauccucucacacauagaaaauguuucaauguuucuuaaaauucauagugucugaaugguuucuaagaauagacagagacacagaaauauuuccucauuuucugggaacauccuccaggucuuuguuauugauagaauucacugaaguuucuucccccuuucuuuccccuccaucacucccuggccuuuucucucuggccuguucuugccuugcuuuggccuuccuccucauuuucccucagccacuccuucuuuugucuaucuguauaaccaguuuguuucuuuuagguggaaaaaaugaaaugaaaucauacagcugugaccugaauuguauuuuccugaguagauuucugagaauugugaaugaagcgggcccauuuucaguuaccugcuuuauugcuccaugcagaaaaccuaaaacuguuguguuguauguuauuguacuuuaacuuguugcuuaauuucuacauguuuauuuucaguaauggcugaaaguguuaauuauuccauauuuuagcacaaugugcugcauauacuucccaauaagcaaauaagguuacauuuguacagaauuucacuuuugauuaaauacugccuggguuucaagucccuucccccauuugaaaugcuuccuuuuuaauguugaaacugaaaauaaacaguuacugaaugauuuugaauuuaccucaucuuagaacucaguuuuaauuuauuuggccuguuuuuaauauuagucacuaaaaauaaaguggagcacugucuuaugcaacgccuaagaaucguuuuauauaguauguguacaacauuaaaauauguucuacaaagaaaaauauaccagcgcucacuugucccuugccauuuuuuucuuguaauuaggaaaucuugggggggggggguagaagggaauaaaaaauuaauuguguuuuaauuuuacagcuaccagagcuuuguauugcuaaacuuacaucuggaaaaguuucacgugacauuuuuaagagaauuuuuuaucuacugaauucuaccaguguaaccauuuuuucuaaauaaacaauaguuuucucaaaugacuauau

SEQ ID NO: 9465 - RNA, 2118 nt, Mus musculus
ggaaugaaacuuauuuucugcugaacaaaugaguguguguaaacuguacuuaaggauuggguccacaucuuucugaguaguuuauauccuuuccacggaauuugagaaacaaugucuaacuaugucucuacuacuuaaaaguugccauuucuccaggagacaaauuucugaacagaacaguaauagcucaggcacuaaaaucaacaaucaauaaauggaacuucaugaaacugaaaagcuucucuaaagcaaagauuuuaguguacagaauuguuuuaacuauccuguuuuuuuuucauaugaaauugagauuuguucuuucaagguuuauaaagaauuguguuggaaguuugaugggaauugccuuauucauaauagccagaaacuggaagcaacccagaugucccucaacugaagaauggauacagaaaaugugauucauuuacacaauggaauacuauucagcuauuaaaaacaaaagcauuaugaauuuugcaggcaaaugcaugaaacuugagaauaucauccugagugagguaacccaguuccaaaaaggcacauaugguauguacucacuuagaaguagacaguaaguagccuuaaaguucaagauaaacaugcuacaauccauagacccaaagaaacaaaguaauaaggaggucccaagggagggugcuuaaaucucacucagaaagggaaacaaaauaaucaucagagguggauggagaggaagugaggauaggaagggggauggaauagaguguggggagaacagcaggagagggcuugaagugagaauggaaauuguugaggugcaucucugggacuagcuggagaccugggacaggcucuggagaaucuaagggggugauccuagcugagauuccuagcagauggggauguggagacugaagugcccaccuccuauagccaggcaggacuuccaguggagggaggagcacaucaauccacucacaaauccuucaaccccaaauugucauuucuauaaguugugcagggauaaagauggagcagagacggaggaaacagccaaccaaugacugccccaacuugagagucauuccaugggggagagccaauccaugacacauuuuuucccgcuuauuuauuuauuuauuuauuauuuauucacccacuuaaauccuguucgccagcugguccccccucacaagucccucccaccuuacccccuucuccuuugagaagguggaggucccccuggguaucuauccuccaacccuggcacaucaagucucugcaaggcuaguugcauccucucccacugaggccagacaagguaggccaguuaggggaauggauuccacaaacaggcaacagcuuuagggacagcccccgcucaaguuguugggggacacucauaaagacugagcugcacaucugcugcauauaugcaggaaaguagguccagcccguguaugcucuuugcuuggugguucagucucugagagccccaagggucaagguugacauuauuaaugauacugugcuuuucuuacagacaagaaccuagcauauuugucucucgagaggcuuuauccagcagcagauggaggcagaugcagagauacacagccagacaucaggagaagcuccaggugccuuguggaagagugggggauagaaaugaucaagccagagagaucaagaacacccaaagaaaaccuacagaaucaacuaacaugggcccacgggagaucacagagacugaacuacuaaccaaagagcagacagaggcuggaucuaagaccccuacacauuuagaguagaggugcaacuuguccucauguggguccucuaucaauuggaaugggggcugucccugauuguguucccugucacuggauccucuucuccuaccuugacuaccugguugggccucagugggagaagaugugcuuaguccugcugggacuagaugucucaaggcagggugguacccuagggggcgggguccacuucuuugaugcaaagggggaggaguaauggggggagggacuuacauggguaggacugggaggagagaauuaagaccggcuguuaucaggauguacagugaaaaaauagauaaauuaacca

SEQ ID NO: 9466 - RNA, 3003 nt, Mus musculus
aaaaaaaagcaaaugugcaaaaugaagugugcauagaugaagccaagguuccucuccuggaaaauuuugauuuggauacauaccuuuguagaaggacaaguaaauauaaaaucacauuuaaucauuuuaaacuuaauuuaauuauuaugaugcugaacacauuuuuauuuuuuuuuauuuuuuuuacaauacaucacauacuaaaaagugauccacauaaaauaacuauauauguacccaauacaaguaucaacugcacucacucugaccauugcaaauggcuaauuggacuguguuucuugaauguucaggaaauguuaauuccccaaauaccuuuccaauuauccugaaaauuuaugucagauuucauuagcgcugaacaucuuuaacauaaaugguucucaggaaagcaggucacaauacaguacuuuaaaaaagaaggcuuuagggcuaagugugguuaugcucauguuuucugaauuaaaauuuuguugauuaguaguuugaacaauauuguauaauuccaaaaauaaaauaauacaucuuaaaccauuuuauacucccacaauguucaaauccacuacugaguuuuccuacauucaaaugaaagacacuccaaacaguuauaaucuaaaacuugaaguacauuaaaaaaaaaaaaaagaaagaaagaaagaaacuuugauuagagcuuuaaauauuuucugagaucaggccaacaaacauuuuaaaacaucuucuaucaagaugguauguccauggacuauucaaaugacuugaaaaaaauuauuggaacgcugguaaaacucuagugcugaauucacugaaagcaaugacuacauucgccuaaagaaagaaaauacauaaaucacugcaaaaaaaaaaagauuaaaacuuuuuuguaugauacagcaaaaauguagugcucugagagaaagugcccaagucaaagcaaguuuuuauugcuaagaggauauagaaaucucucucucucucucucucucucucucucucucucucugucucuaucucugucucucucugucucuuccuucuguuccucuuccuccucucucucuccuuuuucguuuccuucugugauugagcacuagaaaguugggucaacuccacuuugaaaauaaaucacucacacacacacacaaucaggcaugcacauaccuauauuacacaaaagcacauaugcaaagaauguaaguuugaacuuaaaagauaaaucuauacacuuucccaagagcacagugacuuuagcuccagaggccugcauaguugccauggaggccugaagggagugggccuccacccacaaagagcuucaucucaggccaguuguagcagugaguguagagugcguuggggaauuccucaguaccuccaaaguaguuuacccagaguucaucuugguugagccagccucugccacacgugaguuugagcuuccucccugugcgcccaagaaaagagucuggacuggcugaggcccuuuccucuaggaacuucugggcacgaaugucauagaagagcagagagccauguccagugcccacagugaugaugugcugguagaaacucagagaacgcacaccugugccucccucucgggaacacaaagguuugauguucugcuggcguugucuuggauccaggaaugaaacgugagacugagaacccacugcguagagggacaacucaucacaguagguaagacacacauucucccugcaguaaggcagccucagggacaacagccuggacagggagcuccgggcuuuccacagguggaaguagccauccagggacacagcucccagcuccugguuucugccacugaaugcaagggcucgcacuuugcgguuaccuggguuaguaguugcccuuggaauggcuuccaugucccuuggacgaaugugugaauaccguggaauuccugaauuauugugccagggaaugcugccauugaacaugucggaauccacccgccagagugccacggugccaucacgggagccacucacagccacgguaucacucauccaggcgauggcaaagauccagucccuguggccuuggcggucaccuaagcacacagggucuaggguggguagcugauagacugcuagacuguuaggguuuucaccuccuguagcuaggagggucuuugagggauucagcuggauggcguggaugccacagguggguugggcacggguuuguccuggcccucugucucgcaucaggggaaugcgagugauccggccagucuggacaucaaccacgaagagcguguuacacuuggugccacacacuaccugccuggcauugagccacugcgaugcgaacaccuuauugagggggccuagggucagcuggcgcucccucagcagcucgggcagccugaggaccccauagcugcgcagaucgcccucgaagcccgcuacccccggguggccaucagcgcccagagcacggcccuucaaguagugcaccaaggagcggcgagccacgggccgccgcggccucuuggccagcagcaauggcccauccgcuuggcccguucccgccgccgcagccgcccucccaggcaacgaagaagucccagcgcccugcucgaccuccgaggcuuuccgcuuccugcuaccuguuugcuguggggccauggugggcggcgggcggguugcagaggcggcggcggcgcggcugcggcggcgcguggcacccgugguggccgugguggcgguggggguggcugugucuccgaaucagcggggggugacacugggccccagggaccaggugacugagugaucccuagggcaccgagcguccugggugcuuugguggccaaagaggcgaagguggcagcguggcucugcaaggacugugagcuuggaaggagcaguaagcacugcguugagugugguggcagugccugggacuuggccgagggcgggaagugcugccgucugggagguggugaagucagug

SEQ ID NO: 9467 - RNA, 743 nt, Mus musculus
cguggcacccgugguggccgugguggcgguggggguggcugugucuccgaaucagcggggggugacacugggccccagggaccaggugacugagugaucccuagggcaccgagcguccugggugcuuugguggccaaagaggcgaagguggcagcguggcucugcaaggacugugagcuuggaaggagcaguaagcacugcguugagugugguggcagugccugggacuuggccgagggcgggaagugcugccgucugggagguggugaagucaguguggggcuagagaguaagcuaagagaccugagguugagaggcggagagagugggaggggcuguuggccguggggugcuggguagcacaggccagucugaguggggguugggaagaagcagaggggaugggcgcggaggaaggcuguguggaaacucuggggagauuccuagagggcugagcuccaguuagcucaguagcuaacacaaguuuuguuuuuguuuuguuuuuuuucuuucuaccagucucacagcagcucccaacuagccuuaaaaucaaaaccuaaaauguagucaagcaagggaucaaaaggagcauugagcuugacgcgugguaagaaauaaaugugcacuugguauuaucagaggacacuucgacuaagguuggucuuugaacuggacuaggcauagaggccuuucaacgugaccucugugguuucuuucugcgauuucugugaaagccccucugc

SEQ ID NO: 9468 - RNA, 3635 nt, Mus musculus
cuagucuuuaucuccaacggacucgucgcucaaggcccagaaguccacacuccugagcugguuggcagcagagucuccacucucucucuagccgcaccuucggccucagcgccgauccucccgagcucgcucggcucuuuccgcccgaccucgcguuguucgccgggucacgccgccaccaccuccuuugccgccaaggcucuccggacucgguaggcuccccgcugaucgguugaucgcucucucacuagcuccuuagccuccagcucccggugauaucaugcgucaggccgacucccagacgcagcccucucccgcagagcaggagacgccgcagccugcagggcccuccaaccgcucgccgcccaccaugggcccgcagcaaacagguagcaggaagcggaaagccgccgaggucgaucagggcgccgggacuucuucaucgccaggccccgcagcgccgauggcgacagcuggggagggcaacgcagagggguccaugcugcugaccaagaggccgcggcggcccguagcucaccucuccauggugaacuaccugaagggccgagcgcugggcgcagauggccacccggggcucgcuggcuucgagggagaucugcgcaguuacgggguccucaggcuacccgagcugcugagggagcgccagcugacccuaggcccccucaauaagguguucgcaucgcaguggcucaaugccaggcaggugguguguggcacuaagugcaacacacucuucgugguugaugucaagaccgaccacaucaugcgcauuccucugaugcgcgacaggguacccgaccugucucguggcccgcccuccuguggcauucaugcuguggagcugaaucccuccaagacccucuuggcaacuggaggugaaaaccccaauagccuggcagucuaccaguugcccacucuggauccggugugccuaggagauugccaaggccacagggacuggaucuuugccauugcauggaugagugacaccguggcugugaguggcucccgcgacggcaccguggcacuuuggaagguggauccugacauguucaauggcagcauugcuuggcacaaggaugcaggacuaccuguguaugcucacaucaguccuacagauauggaggccauccccaaagccacuaccaauccagguaaccgcaaagugagagcacuugccuucagcaacaaaaaccaggagcugggagcuguguccuuggauggcuacuuccaccuguggaaagcccgaagcucccugucuaggcugcuaucccugaggcugcccuauugccgugagaacgugugucucaccuacugugaugaguuuucccucuacgcaguggguucucagucucacguuucguuccuggaucuucgccaaggccagcagaacaucccgccacugugcuccagagagggaggcaccgguguucguucucugaguguccaccagcauauugucacugugggaacaggccacgguucucugcucuucuaugacauccgugcccagaaguuccuugaggaaagguccgcggccaauccagacauguuuccugugcccucuggaaggaagcucaagcucaccuguggcaguggcuggaucaaccaggaugaucuucuagagaauuauguugcugguguagaagauuuccccaaugcgcucuacacucacugcuacaacuggccagagaugaagcuuuucguaggcgggggaccacuggcgucaggccuccauggcaacuacgcaggccucuggagcuaagguggacaagauuccuucucagaguauggguuuuaucuuuuaguucaaucuaauuguaauucauguugugcaugcuguuuuaacucuugucuuuuucuauuuuuuuuucuuuuuguccagguggaacugccccagaguauccagugugcuucucagaagaaaaagagauggaacccccagaagucggcuuugagaguuuucugggucuccccaccguucuuuggacuuuucaugcauauacuuuccacuaauucuuagcuguguuguuuuugagugagugauccauguagucuauuacggaagaaaauccuguuaugaaguuaaaauuguguaagucuuguguuacuauuauuagcaguuuaguuuucaucaugugugagauauuaaggauauuuucuaauaaacagaguuuggacauuuguucaggaauacuaaucauaguuuuguagacuuguuccaguguuaaaaaaaugaaaaaagaaaaaaaaaacauuccauguuccaguuugccuacuuuuggaaaugugucauucaugaauugugaucaugguguauguauauaguuuguauguuguuggugcgaaacucacuuuucuaaaaaguuuauuauguggaaauaauugucguagaaucuuguguuucuaucaaaaaucucagaugacgaggaugguuuagguauucaaguauucugcucauuugaguguugaagaguaauccaaaacucaguguuuuucuuucaagccuuauuuucauuuuuagucucugucuucauauugaucaaagagugcacuuguuuucacuucuugccuuaguacuaucaagacuuguggauauauuugaaugcugucauuugaguaaauuucacagaguuucagugccaucauucgacacagggauauuaaguacauaaauguagaauguauggcagacagggcagaaaauauacugcucuaagguauagacuggauauuuuugcuguugcuauuuuuaauaccaaauguuauauuugagcauauuuuaaacuuucaaaaucugcuugugaguuaaauugaaagaaaaaaaaagugcaaaggaagaagucugagccuauccagcucacugugagagaaacucccccuuuguaagcuccaaauguuuauuuugugaacuugaaagauucauacuucaaguagaauagaucuguuacuaaaccucugguucuaugucuugaaaugugauaauaugggaucuugacaaugcaguauaauuuucaaauagaggagcuggggauuaaaaagauaggucugauuaaaggacugugcaguucagauaaauagagauaaugggaugccgugcggauagauugguuuucucccuaggugagaaggcugaaaaugagaaaggagccaggccuugcuuaaagcugguuaggacguguuaacccuggauugguauugggucaugauuccuuuuucuuaaacaucaaacauguauuuugcauugguguugauacacuacauguuguucaguccuaaaccuaaauuguugaaaggaucuaaaggugagucaagaauacacaauggucagauuuuugguuuauaaagauuaugcaggucuauuucauagaauuauaaaguuuugcaacuaaucugugcauuuucuugcuugcauguauguuucuaucucugcugcaaaugauuuaaaagcagagauuguaaacugcccucuuuucuuuauuuguauacuaaggccgaacaaaggcaaucagugauuauuugaugauuuuucuuuugccaauggaaaccugcacuacacauuguaauaaauauuugcuguugcauaauaaagaaccuuguucuguguuccccac

SEQ ID NO: 9469 - RNA, 508 nt, Mus musculus
ucagguuuugugauuuuauuuaaacauaaaauaugcacacaagccaucuauucauuuucuucgcugcguagccuggcguugggauuggagacucugauagccagcugugcugcucuuucuacaauggcuucucgguucuuagaggacacauugugagcaaucucagcacaguaagauuuguuacacaugagcagcacuuccagcuccuugacaucguggaccaggaacuugcagaagcugcugggcagcaugugcuugguuuucuuguugcuccuguaacugauguugggcaucaggaucucgcccuugaaccuucuccgaacccuguuguagaugccucuggguuuccaccaguuuugcuuaauuuucacauaucggucugacuggugucugaugaacuucuugguccucuuuuugacgaucuugggcuucaccagaggccggagggcagccaugauuccacaaaacagauggcagccaccucguaggcagcgccgaggaagaagcc

SEQ ID NO: 9470 - RNA, 53436 nt, Mus musculus
ugaguuuucacacaacauauauuuauucauaaaauugcaauaaauuauaauaaaaaagaugacacaaaauacagaaccccacuagcagcuuugcguagugaccgagacauuuuuuuuuuuugugaaauauaacaaagaacuacagauuaagaaucagaaagggaaacuaauguaguaucagccaauagacuggaaucauuucuucccgaagaugcuaggugcagucuuucacuaccaguuaaaccugaaauccuuaauucagagcaacuaugaaauaguaccuuggaggaauuaggaaugaagagguugaggggcaggauaggcaggauagggaaguagguuucuuccaucggaucuguuuuguaucccuuuccuagagauugucuaaaacccucaacccuauagacaucccaggcugagcuggacaaaaggccgaggcagugaagcaacuuggugcuuuggccugaugaaggaagggcacuacgugcaugcuccacagagcccccacuaaccauaaucuugcucaucuaaagacccaagcuuggcgagguauuauaaaaugggcacaggagaggcauuccccuguggaccaccuugcuccagcuccuaccaucugcuucuucagugauuacuuucuggccuaauagauaugacaaaauucuucugcucuccgucuuccacuaaucaacuguugacccaaucagaucuucagugagcuggcaccaauacuuugauuccgauuucccaacucccaauuauuuaagggcuuaacuacugcaggauacauaccuuuuguucucccaagaacucaauuuugaagagaugagggagcuggaaaaccauuugaugguggauguuuuccuggcccucuccuuggaugguacaagauacuacugauggaaucagugcccaagauuguacacacagccuauaugagcgccuuacaucagauguuaauaggcaagaaugacacgacuuggguugguuuggugaaugaaaccaagcaagucaauuucaccaggcaguuuugcagccagaagcuggcagcugguuugucagucaacaaaguaauuuuuaaaaaguuugucugucccacaaagcuugaauaaaaugaaaaccuuagagucauuucaaguggaagagguaauguguguggcuggucccacggaccagucucucuuacacagcacuugauauagugucaaggagucaagggcagucuuuuuaagucuuugcuugaaggaggcggauguggagcucagagugagcccuguugagagaggccaguaacuuuccccgacacuuuaggagauaggagaauggguucugaggguuacccucaaugcuugguuuggagggcgaggaaagcuccugggaccucacuugaggugcacagacuucucuuuugacugugaugcaaacaugacucuggaaguggguuucuagugggggagauggggaccaacaugcaggauugcuccgcaugucaaguguggauaguagccgggcacggggacugggaagcagggauguuuucauucugauauacucacagugcuuuccucgcuguugugauguuucucacaucagugggacgccaucucuauaguccauaaaauuauguaacuaaccauggucugagacaagggaaucgggcuccaccaagugugguuccccacgaaggccaacauuacagugacauacagauaucauuguaguagaacugcacaaacgcuuguaacaaucacauggagacagugaacuucacuguucaggacacccacagagucacuagccucauccaggcuuccuucaaagugagagcauggaggaagugugcaaaguagugacaugaggagaggguggguccaaagugcaucauacaaagaacuguagacaagucugagcuauagcaaguaguacuuguaggcuuagaacaggaaggccucucaauccaggccuaggguauuaaagauaaucaugaggacugggaagcagggcagaaaacauaccccuagguaaagguguguaaauacagaccucuuugcuuuacaaagaguaaacacaaaaacaccgaaauaugguaacuuuggcuuggcaauauaugucuaaaaggauuuugcuguguaggauaugguaaggaaggauuaggaaaacucuucccuuuguacuacuaacagaauguaagauccuacaguagacccuuuuugugugauaacuuuucagaucauuuugaaguagucggagcccaaggucuuccuccucuagaaucucggauaggaaaagacuuagucuuccucguucccaagcaggaagaccaagaggaacuggauggcaugcuggcggucauuuggagucugucuugucaugagguuugguggaggucuuaggagaaggcuacugaacaggguagcuagaggguggaagaaagaaaaggggaagcccacugucagacauuaccuaagcaaaaccucaaggcucggggugcagggaacaagaacagcaggagggaagggacugccauguucccaaaaaucaaauaugguacacauuaugcacaaugcauccagauucuguccaacaagcacucugcacagacucucucaugaagcccccuuaccaaucauguugguguugauauuguuguagucagagaauuuuaagaguucacgaaggaaugccaucaaguagcggaaaacauuucuauggcaccuuggaagcugggaaaugaccuguuuuuuagagacgaguguguaagaagguuaaauggcucauagggaaugagacuccaaagcugccauaagaacaauuuguaacccaacuguuagaagccccauuugucugucacuacccucuauuaucauaagcaguauuuuacgugccagauuaugacucuggaguaaguaugguuugguuucucucuauucaaagaccaggccauguagucagcacagagucacguucacacagugccucaccagaaggaaaguguccaucuguuauuuuuccuuuuccccucacagcaaaggcaucagucaacuuguuuuucucuaaaaugccacuuggcgaugauggguaccuccuaccaacacucacugaugugauucauagcuaggcucagccauuguggaccacaaucuuugcaagauccaaaacacaucaagaaggagagaaggaggagguggcgguggcucccaacugucaucuacccuuucagcuaaugacaacuagaacugcacuuacaauucauuuugcaaucucacuccagggugagaaguauccaccucacuauguuuuucuguuaacagaaauaggcaagcuagaaaauauucgaaaauaauacuaccuaaauucaacuuuacucauuuaggggggguggggcuggggaggggccauguggagaucagagaacaacuaguagggguugauuguuuuucuuccaucacuuguguucucuggaucaaacuuaggucaauaggcuuaguggcaaguaccuuuacccauugaaccaucucacuggcucccucaaggaucuuaauuuuuagcuaugguguccuaucauaaauaaccgacccaggcccauucuaucauagagcuuuguaaaacugaccguuucucuaugggagaaucugcacugagcauauccucagagcaccaaaacucaccuguuugcagauccgaggaucaugagcagagucaagacaucgcugauacagcucauaacagaugacuggcucuggcagagcuuccaggaaaaugagcagugcuucagccacagaaugguuauugccagcugaauuaccuugaguuaaaggaagaggaacccagaaaaaaagccacacagacaccugucuggcucccuuccucaagccucuacagggaugguuuuucucuucucuuucggcacacacuaucccugauugugguuuuauagugguccaggugcucugcagcugagucgguacagaauuucccagucccuugggagguuucacuauaacuagagacuuggaaaacauagccugcaccaugacaggguccacuggauggguuauaaacuagcugccaguguuuccucucauucuucuuccugcccucugaaagcacauggcugggaagguuagcaggaacgaccaacuggcagaagaacacuccuggugcuagggcuccuauguccagugcucauuagaauuuguuguuagguuccccuugaucccucuuagucuguuuugacacaaagggagacuaaacguuccugaaaugucuugagaaaacaaauggauagucacugacuaucuuaaaauaaggcaauggaaaacauccggguagaaagacaagcaucaaguacaggggagaaaaaacuuugcccaaguaucuguccauauucucaagcccugggcagaaaggauacgaauugucucaggaaugcugguauccaggcaaucaaugaucugcuguaacuccuccugcauuccagggguuuggaacaaguccuccuagcaaagaaggaugaaugaaggggacaagacaagauagccagccccaguucugagcugguccagaaacuaggagagcaacaggccaaaaagugaaggguggcacauguauuaacacuuagggaaggaaguuugcucauaguauugcuuuccuuuaguauuucuauaauccaugugaaauguuauuucaagcaagaaaaugaccugucagaaaaaugacauuucacucucuacuugauaaggcaagagacuagauggccagaucaggaagcccaguagugcaccaaggagccucuaggaaacacaguguacccugcacaagugcagccauugacaaauguggacagaauuggaugaagggaaaagugugaauggcacauucaugauacaacuuggcuucugaguuauagugcucuuaguagaucugagaacaucacccuucaauuuggucaaagaaaguucuauuuuuaaaaagaggaaugaguugggaguagcuaggguuuuagcauaggguuuaaaagaaaacccaguguucuguuaaagaaaugggcuugaagucacuauaauagucagaguacucaguuguucagagcaaagcguauaagcaaggcauggacauucucaguucuguuccugccucugcccucagacucagaguuagcuuagcuuguaugcuuuagugcucggacauuauagccacauggaggcuuccuggcaugguuaaacgcacuauguggauaugaagcuuaauuuccuauaugauucauauacacgcugcaguugcagggaagguuuucccucacuuaccuggugacaugcauauuugaacaagugaucuacuagaagccagaucucuuuggggacuugaaggggucgcucacugguaccuucauccaaggguaccaucugcagaagggauuucuccuaacagaugaaaagggauuagaaucaaagggccucagaagaaagcauuacaucuccuucaaaaccuucucgaguggauacaaugugaucuuugucucuuuuuuuaaauuuuuuuauuagguauuuuccucaucuacauuuccaaugcuauccuaaaagucccccauacccuacccccacuccccuacccacccauucccacauuuuggcccuggcguuccccuguacuggggcauauaaaauuugcgugucuaaugggccucucuuugcagugauggccgacuaggccaucuuuugauacauaugcagcuagagucaagagcuccagcuugagucuggcgccuuggaccacuccugacacacccgugaucuuugucucuuaagcuuuugccuuuuuuuuccucauaggagacaugcaugcuuagaaggcacucaguaaugauugcagcaguuaaaacaaucuccuucccaaaaugcuuuauucaauuaguaagcguuucaucuguguuuauggugcgcauccucugggugcauuccauauucuuuuuuuuuuuuuuuuaaagauuuuuuuuauuuauucaucauauguaaguacacuguagcugucuucagacacuccagaagagggagucagaucugguuacggaugguugugagccaccaugugguugcugggauuugaacucuggaccuuuggaagagcagucgggugcucuuacccacugagccaucucaccagcccgcauuccauauucugacgugagaauacaauacagucauaguacagucugcgcaugaccaguagcuggaccaugaugucacaauugcuaauagaguaccaugagggacuguauuuacacuuagguuucaguugauucgacacuaauuccauuucaggucucaucacaaggacuacugggauuucucauugcuucuuuaacugaauugcuuuggcucucaggaauuaaagacaacucugcacauuagaugcauauauauggauacuuuaggcuugauccaaguuucuaaucauaagccccaagaucuaaaaguaauaacgaggaauguagcaaccgaagaacuagaauaccauaaauacucaagggucugcuuuuagaaguuauuguuuauauuaaaagcucagcaaagacuuuuaggggcuacuauuugucuuacauaccuuucuauuguuacaagucuucugaaagaauauaagacaaaaauccagaagugacacauaccagacaaauaacuaaauucaaaguguaaaauaaacucaauuaucucccaacacucaaaaagaaauauguuaauuuaccuuagguuuauaguuucaaauguaaagaauaugaaaaaaacaaacaaacccgcacaucuaaaauaggcuguauggcaucugaaggcagucuucagaagaaccccaguggagaaagccacacucauuuuuuagcauccucuuccauuugcuaccucuaauuuauacuuuauauauuguuaacuuucagaaauucuugccugacauuguucuaucuauaaccuccagccacguagcuuuaagggagaaaaaaauaaagcccguaucacuauucucacagagaccacacauacuccagcggcacccagggaucuuccuaacacgguauucuuuaauaaguacugaugcuccgucuaagcugcugcacucuucucagggaauaaggagaaggggguagugaucauucuuugccauuuuaaaucucucuacauaucucuuuucacauuuccuugcuuucuuucucugcgaugcuaugucuugauauucauauucuguauaguugcuguaaccucuauugcugucucacccacugguuucauucuggcuauauguauuaccucaagacagccaccugauaucugagcccaaacacuucauaaugaauucuacuaacuugcuggaccaaacagaacacauguacagauucuuuagcagaugccuccaaacucaccauauauauaacauuauucaucacugacucauauacuuucaaaaaaucugacauccaacugaagguuuuuccuguacuaaggcauuaagacaacacaaggcacuguuuaagcugaauagacagaacauggagugcccuuaacagaaaagagcuaagaagcaaagaugucuuaagccuuaguaguuuaaaagguuaauaaaaugucaguagguuauauacagcaucuauuauccacuuccaaauucaugugugauaaucagaaaugucacacuuguggcucugaagucuagaaaaagaaacaauaagaaaauggagaaagaauauuuacaaaaaauguugugcacauuauugugaacuccuaauguucaaaggguaaccaagacccucucucugccuuuuuucaacaggacacucugccuuauaagcuuucacuuuguaaucuuaaugcuaaugguuagagcagcuuucucucucucucucucucucucucucuuucuuugucgagacaggguuucucuguguagcccuggcuauccuggaacuuacucuguaguacugcccggcugcagcuucacuuucaaaguguauucaacuccauccaauggagaggccccucaaacaauaugaaagggcuguggaaugucuguccaacuccuuucucugcauuuggcaacccugaggggaaccuggccucuucagcugagggggaaaaugucaugagguacuacagaagggucauagcacuggacacucaggaaacaguacccacccuacauucuggugcucaggagcagugggacuuuuuacagcauuuucuaccuuucugggcuuugagccuugucuguuagaacacagaaaauaucuuuugcuguuaaaaaacagacagcuagauuagaugauuuaugauuuuauuuaguuccacaauucuacccuuugcucuauuucuugaccguaucugggcauucuccggguaauuagccacuauuaucaaggaccccaaaaucacuuguugugugugugguccauguguauguauguauauaugugugcaugcuggcuagggguugauaccacuugucucccucaaucugucuccaacucucuuucucucucucucucccucccucccuuucacucucucgacaggcuuucuaauugaacauggaaguaacugauucuguuuggcuggccagggaguaccaggggccuguucuucagcacugggauuauagacguguguuauugcaccuagcuuuuuuguuuacacuacuguuggaaaucugaacuuaggcccucaugguuacaugggcaaguacuuuauugccugggccaucuucccagcuuccaaaucacuguuuuuuuuuuguuuuguuuuguuuuguuuuguuuuuuaguuaaaucauuuuauuugagaaaagaggacacacaaacccugccauucuugugggagagguggugguaauauccaguggaaccugaacaugcaaguggcaccacgaauucauggacgcuaggagcuccaaauuacuuuuaauguaacaggaauaaccaaaaaaauuauuuuuugguuuuacuaccaacucaugaguuuucagauaagauuuaucaagacaaaucugggcuagagauguaguuucauagugcagcacuugucugcaaauuaaaaaauacaaagugguguggguaguguguuugucuagcauguguaaggcccuguguuuuaucccuugcagcauaauuuagugugcaaaagcaugcaaacaugcaugcacacauacuaguagcuagggauauagcaguuguaagaaugcuuaucuaucaucuaucacaaggaccaaguuugauucucaggacugaguaaaaccaggggugcuguaaucucagcacuggggagguagagacaggaggaugaaaaaaauuaaggucacucuuugcuaccuagugaggcuagccuauaguacaugagauccugucucaaaaagaaaaagaaaauagacccuugaguuuuauuucuucuacauacagaguaucaauaacgucucagaugugucgauguuguuccuauauuuugagcauacuucaagauaccuugcaggacaucagugguuauuaggaaauucucaccgagucagaggccucugauaugagaaugcuuagggacaauuuccagggaccacaguuaaguguuaaucaagcacaaggaaaccuucauuaccaccaauggauugaauuaccuuuucuagguagcugucuucuuccugagagcagagcaggagaaaagucauuggcagacaaacaauggucagaguuaauucacaguauuagaaacagcucagucuugcaugcuugcuagacacauaggcucugaacagucccgaguccuucaaaggauguacacugaaaaugaaacccauuucccacaugcaaaguucuuggucacaccuagugcacuuaguaguucccugagaucaucacuaaggagccauccuucucuaggccuuaacuauaggcaguguccucuggaagcugccucaggccccagccaagccuggugcugcaugucccugcucaucuacugucagaugcagcucuuaccucguccuaauauugcuuccguggaagaacucagcugugggucugagaauggagacucagaagugggguauacuucuugccuaguucuacuuuuacucccauauacuccuugcucucacuauucucaucccagcuagccucccgagucuccaagagccuccuugagcuucuucucucaccuuguacccacccaccuccucaaaagugauuagacuccccagauuugaagacugacugaaauguaaaugaauuugaucucagagcuuuguggaucagggucuccaucaguuccucuaauuuccugguggauaugaaagacaaaggagaagcaggggcaauaguuucauuguccuugcuauuuuugcacucaucacaacccaguuaagagagagagcagcagccaugaucaccaucaccagaggaaucucuaccacguaacccaugcaaaggguguauacacaaugccacuuuaucugcacaucaaugugaaguauuauuuccauuuuacagaugaagaaacugaggcuuaggagguuaaauuauuugcccaaguucaugcauagguagguaauaagugacagaaucaggauuggaacccaggucugacuacaacucugagaggacaacauuggugcuuccaagauaggcaggggaaagcuaugagaguacuccuaugaugggcuaaggagagugagacauguuauucacaaggcagcaugguuuaugcagaguagagguauugaugccugcguauaagucuuccuucugccuugguugagagcccaggcaauuuacccaauuuuguaccgucccagucucuucaucucugaagcagguaaaacauguuccucguagcgacagugaagccaucuaaagccaggaaucucugccccagagacucucaacuggguucuuccugaucccauuacagagcacugagaaaucaaguagaaaucacaucucaggccugguaggucuaaggagaaauccaagucucccugucagagaugcaagagcgccugggcugugagugaauguguauucccugacauucuaagggacuauucugaaccuauugucccaagcuguucuuacauauggcaauuagggcuuuuaguauuguuagauauaucaugaauuaaaccugauuuucugaguuuaccuacauuuaaauaccacggggaaugaagaugucagaauccuagguaugcaucguucuauccuuaugauacuucuaaaugugaaguuaguucugagugccaacaaucuaauuuaacaaaagccugugcuauaacauuuuauuaaauuuagaaacacuuguuaauaaauuugauagacucugccuuuguccucugaugaguacaugcccaugauauaacaagcaaaacaacgcagggaguuggggugcuauugugucugucuaggcccugaaagaaguuuccuuugagcggugagcauggacuggcaccugcugaggagggcagggacaguuaagaacaaauaaaggagaaagaugcgcuuggucccuaacccugguuuccaacugaaucugaguccuccuuagucuuagcauuuacaaccugauauucuuauaauucguauguaaacggucccacuacuuggcuacuuauuaguccuuaaaaacaacacaggauuuuuuaaaagcuggcauuaggacccagagcuauaugcaugcugggcaaacggucuacuacugagccacauguaagcccuuaagccgcaggauuuugaggacaggauuguggaaguaagccaggagcagaguucucauaaaugcugaggucagagccagucuagaaaaaacagcaagacccaugcucuaagaaaaggugggagaggccgaauaaaacaaaugcacagaaauguuaaaugauacggugaauaagaaacacguacucaccuuguugugagaaacagaacuaacuagagaauguugaaagaacagugagaaacaaaaugucacaccgagugacaacuuaauaugucugcguugucugcagcaggcauuggggagcaaggacaaaauccccucccccagcacuauuacagaauguuuaaucuggcagaucuaaaugggagaaaaugaagugcagaaacagagggaaccaugaaauggauaucaacauaggccaagcaggcgaaaagaaacaccuuaaaacuaagaugguggcccaggaaacagcugagcuguuugcuuccaagcuugaugacgcaagguaaauuucuggaacucacauaguggaguuaaagaaucaaccccacaacacuguccuccgacuucuauaagugagccuggcugugcaagcacaagcuaaaucagucaauggaacaauugauguacuaauauggggccuggaagcuggcucacuugauagaaguauauguaugcagaccuacuucaaucccuagagcccacaagguggacggagagaagcaacucccaagaguuggccugaccaacacacaauauauauuuuaacuuaguggacagacaguaucuuuuauuaauagaaugcuugucuggcaugaaugaggcgcugaguuccacccccaaugccacaaaccugaggaauggaaaagaagaaacucuuaaagaggaauccaaaggacugcgaagaugcuaguggagaggcagcaaacggacaugcggaguuuauuucuuuguggcugugaugacggcuccaugguucauucacuugccacacaagugugauggacucucgauccccagaaccaagaaaaugccgaguggaugugguagcccgccuguacuucuagccuugggggauaagaggcccucagaguaagcuguguaugaagacuagccauaucacugaggucuggguuuaucugagaaacuuccccaauguauaagguggugggcgacaaauggaaaaugauucucagcaucaaggaacagggcuucacacgcaugcaugcauaugcgcgcacacacaaguauacauguacaucacacacauuucgaaguguaaaaaggaaaaaaaauacagugaucuuacuucucuggauguaggcauaaagaaaacaaauguaaauuacacuuaguccaaugcuagauugaauuagaaguagaaaagguuacuucuucccugagugaccugacaucuaagcagcauauugcaaaucauuccuuagccuaauaguuacucuacgaagaacguucccaguagugaauguagauaaaacaauauaaaagaguucucuguaaguagaagauccaguugauaguggcaaggauuaaacccagggccugggguaugugaggaaaguguucuaccacugagcugcacccccagccccucugcccacuuuuuagaguagacaaagcuugucaaauuucccuagcuagccuugguccugggauccucccgccuuucaucuuucaagaagcuggauaaaaagugugugccaccaagcuccaccagaagguucacauuuaagaauaacuaaauggaaaucaaagcucucagaagaaauaguucauuugacauagagaagaaagaaaucauacaugcaagaggauaagaaaggcgucauuagaucaguaagauaaagagagagaaacaaucacuggcaucagcugagucagcacguucuucucucagacuuuauaccuaucccucuccucauuggcauggucuccacccagcuuuccucuuuuuucauguuuguacuugcagccaaaauccuuaaccagcucuggcacuucaagccuggucucuuuuucuauuagcucauucuaugugcaacaucagaaggucccuucuaauaugccaacuuacaacuuuguauuaguccucaaagucuccugaagguucuagguaaucucuggcucaagcagaagugcaucucuugaucuccagaccacugccugccucuacccuacagaaccuacaaaaaggcaacuauugugaauacaaauuauaaucuccacaacauucaguuuaagucauuucccaaaauauugacaaccaaauauagugaacauuagccaaaugaucuugaaugaaacuuucuuuuaaccaugauuuaggauuuagcuagacugugcaugcaaggauaccuucauggccacuaaauuacagaaacucacaucaucuccacacuacuuuauauccaguauguaauaaauauugaugauuauucucuaguuaacauguuaguuaaucagaaaaauagaccuuuguucugaaaaagaauaaaaauagucacaacaagccgggcaguggugacgcacgccuguaaucccagcacuugggaggcagaggcaggcggauuucugaguucgaggccagccugguuuacagagugaguuccaggacagccagggcuauacagagaaacccugucuugaacccccacccccccaaaaaagucacaacagcaaguaauucuuauccauucccucuuaagcuaauuccuacuauccuaggcauuguaggaucuuucuuauuaagaaugguuggaagaacaaaaagauucaagccaaugaucucauuuugaauucgguaguucuguaggaaguaaguggaacauuggaaucauuccgaaacaguacagggagacagagcacauguacugaacccacuuccggcuccaccaugaauuuauagcacacaauacaauagaggacauguacuaguauuagaaccaucgucucaugggcuuugaaauauccugucaaguccuggaaaaaccauaagaccuaaggaaguauucuggacuugaagcaagaggaaagguguucagaaaaggggugugacuauuuuagauuccuguuuacugccucuuaacaauauggcuaauuuccucauugaugagauucaauaacuuaauaauacugaaacgcaauaagccgugguaagaaugagaacccuaaggccuccaaaauacaaacuuucaaaauaagcaaaugaucaugaauacauaauuuaauuaaaaaaaugccagccaggugugguggcacacaccuuuaaucccagcacacggaaggcagaggcaggcgaauuucugaguucgaggccagcccggucuacagagugaguuccaggacagccaggacuauacagagaaacccugucucaaaaaaaccaaaacaaacaaacaaacaaacaaacaaacaaacaaacaaaaaacaaaagccaaaaacgccauucuguaauuauagauaaccaagauucuauuucuuuaaccuugaaccaauuaugucuuagaagagggaagauggcucuauacagagccaagauucuucuaauaguuuuauauacuuucuauuuauggggaaaugugauugaauugccugauaauauauuuaauagauaguaagagcuuuuaaagcugguugagccucccagucauucccagaacauggaaaaauuauggccagggcacuauaaugcugcugcugacuuugauaaaaauaagccuuuugucucauacugcuuugagcaauuuuuuuuuguucuacuggucuuuuaccuguauauuaugaugucugugugcuuauggcuuuuguuuguauguguuucuuguuuuuuuuucuuuaaaaaauuauagucuguuuugucugccuacuuguuuguuuucuaaagacagagagaaagaaaggguguggaguuaggugacugggugggguggaaaggauuccggaggagcugggggaggggaagcacgaucagacacuacuguauaauuguuuuccauaaaaaaauuggugguagaagaaaaacaauuucaagaaauagcagaaugacaggauaugaauuucugcagaaaagggcuuucuuucaaacacagguaaaaccuuccaucaugagagcucuauggaaacaaaugacauuccagcgcuggaaugugcucucugagucacaggugcaaggguuccauggcaaccgcacagauuacauucagacaagccagcaggcugcggcagcucuaacccuuccugauggaccauacaaucacuggcuauucccaggccugagcaccauugugauuuuauauacaaaugguaacccuuggcucuucccuucauuauaucuggaggaaaaaaaaagcuaagugccaaucuguacacaaaucuaacaauaguuucauuuagcagaaaaauuuuuaauaggauggcuugcuauucaaucuuuuuuuuuuaaacugaaaauaauaugcuuuucccacauaagaauagagacauuaucuaguagcuuggcuugugaaaggggguggauauaauucuuuuuuuuuucuuucuugagucacacacauuaagugaagaagcgucaguacauguuauacccaucuauagacugaauuuauagcucaguugguagaggcccugccucacaugcaaguagcccuagauuuaguccccaauacuccauaaaccagauauggugggcuauaccugugaucccacacuggggagguggaggcaggaagaucagaaguuuaaauuaauucucaguugaagaggaaauucaaguccagccaggguuaccaaagggguaaaaaaugccgacuccuagguuccaugucuuaagauucuauuaccaguggugaauggggcaggggagagccucuacuugcaguaagcaccccuagggacuaugauguaagcucuguaagcauccauaacagccucugcucucaucagcagccgaguuugauauacuguagcgaggaauacuggaguuugauauacuguagagaggaauacuggaguuugauauacuguagagaggaauacuggaguuugauauacuguagagaggaauacuggaguuugauauacuguagggaggaauacuggaguuugauauacuguagggaggaauacuggaguuugauauacuguagggaggaauacuggaguuugauauacuguagagaggaauacuggaguuugauauacuguagggaggaauacuggaguuugauauacuguagggaggaauacuggaguuugauauacuguagagaggaauacuggaguuugauauacuguagggaggaauacuggaguuugauauacuguagggaggaauacuggagucagaaaaucugggucugucacuaacucaucugacuaugggcaagugaaucccuugggccucagucuuccuguaagcacaaugagaagaauaaugcauggugcaccuaccacaccuagcauacaugccaauuuauguaagugugaugagcuuagugagcacagcuuggagagggggccuuugagcucauuuuggaaguacaauauauuaucuauuauggucccaacaagacuuaacuacagaguagacuuuccuuuucccuccuaggcuuaauuuaaucaaaguagugcuuagauaaagugacauucuccucuaucauuugucaguucccaugaccccagaagaagagagaaggcacagaaauaauggggcaaaacaugcaaauuaaauguaaagaagguugcugucugaggaugugucucaccaggucuaugaguuuggugacaggaacuucucgaauuggucuuuucauucggcacaaagccuccaaugagguuccaaagcaacuugggagguaauucccaccgauggucaagaaguaaucuuugccucgauccaaauggaggacaagaauaucuucaaucuuaucuucaccggaguucaggaugguuacagagucuuugcugacguauacaucaagggagaugucuaaggucucgucugaaaugaaagagauggugcaucguagcacagaucuuuccuguggaaaagcaauucugcuccaaagcaaaaaacagaacuaccaggcaacaacagggaagagaugggacacacaacagagguaucaccaauaucaggacagugcaggugagagacaagugauuagagaacaagaaguuaauuuaagccaggguugugggaggcuugaggaguuguguguggcaagaagacagugguaaaggggaaacucacuuggcuccaaguagcccucaaaagguucagcucgaagccauggcuugcaguauuggcugucauuaagcuuagggaugaaagaaaaauggcagggaaccuguccauuguugcugaucuggaacuucuccuuuugcagcugccgaaacuucacauucucaaaaaaaaacuggggaauaacaaacagacagacacaaccaugcaugcggaguaggggaaguaaguuggauuauuuguagacaauaugaaucaagaauaagguaaucauuaaucagauauauaacuaccacauguacucauagaccgagacaacuuccuagcauugacucucauacaugauuuagcucaugccagcagagaaggcguuaggcaacuuuugacccuguucaaggcuacucugauuguuccagggauccugagaggaacaugaucauguccagggugcucauucuuugacugagcucuguucccccagacauaugaacuaagcaccaaauaagauggccuccaagcugcuaggugcuacuguaagagcuuaucauguauuauuuaacucaugugauccagaaaggggagcugaaucucugagaaggugcagcacuucaugugcucuugcaucuaccaaacugcaaaugagacuaggacgcagacagucugacacugaugacgaugauuuuaaccuugaugcccuuugaaguaacacgguuuucuuagugcugacuagaacggacaggagacaggaagcugugcaguucggcucaccucucuccugcuaaguucuaaugaaggaaggaagucguuuuccauucuguccauaaugcggacgauaucuucaaagaccuuccgauaccuccgcucauccacaaccuucaccuaauggggaugaaggcaccauuuuuagcuucauauguacacagcucaucuccaucagagauuaucuaauaaucuaaaacugggcauuaugggagcagcuugaaaauaaacuauaguauguucaacgcccucaaaaacuuuacuaaccugcuucauccauaacucuagcuuucacucaaagcuccggaguggggggauuaaaggcauggaccaccaccaccuagcagucucuagcaaauuuuaaaagucacuaaaaagaccuaaauuaauaggcauuauauagauaauaggcauuauaaaaaacacuuuaggggaaagguaagguuaauuagcuaaauuucuggaaaaguccaaucuguaagaagcuugauaauaguacauauuuggcaaggauuuuucuuuguuccauuguuaauuaucugacuguggagaaaaugggauaauugcaguaaaaaugauuucuugcagugucuaaaaugacagcuaaaauacauucacugcuauuuucuuuuauuuuuuuaacaggcauaaaauaguaaaagugcagaaaagugugauuaaagcauuuaaguccauccguggccacagccauuugcaggaaucagauaauugcucagacuacagaaaaggggcugcauggcgcuaguaagugcaagcaacgagcacuuuagacaaaggacaccacaagauguccuagaguaaaaccauggcaacagacaagugauuuggacuaaagaauggguuaagaaaguuuucagaucacacaggacuuccaaugaccugauauaacuguuuuuuuuuuuuuuugguuuuuugagacaggguuuuucuguuuagcucuggcuguccuggaccucacucuguagaccaggcuggccucacacucaagugcugggauuaaagauagaugcugucuugaaagccccacaaagaacuuuuuaaaauugcugugucauuuaaaagaagaaacacagaauucaauuaaagauauaaaaaaauauaaagaacccuugaaaaauuuaaaauaucuaagugggacuuaggauggagguguaauaugaaaaauauuccaaggaaacacaacaaaaauccaaggaggccaguguuugggaagagauauuuuccuuaaauggauuaggggguucacgugaggaaaaagaggacauccuggacauauagacgggacuuugauggcuuaaauguggcuucuggaggcauguuucaucaggauuuuagaauuaugaagccacuacgcagaggugaaaagaacacagauauuggaguuaaacagacuaaagguuugaaucuuagcuaucuuccuaguugaacacucucaaggaagugauuucuaaguccuuggguucuuauccguuccucugugaaguggcaagucuuuaagugagcacuguugugggaaguaagcguggugcaccaagagcccagcaccauuucuuuuuucuuuuucuuucuuucuuucuuucuuuuuuuuuuuuuuuuuuuuuuuugguuuuuugagacuuuguagaccaggcuggccucgaacucagaaauccgccugccucugccucccaagugcuggcauuaaaggcaugagucaccacugcccggucuagcaccauuucuaguacacaacuagaaugugggauuaaacccaaggcuagugucauucuuguguuaagacuucaaaguggggugagaaggggguaggggugaguagaacucagugguuagaaggcacaaagcccuguguuggauuccuagcaccacaucaaaaccaacugcagagaauagagggagagaaccaauucuugccgauuugucaucugaccuucauacaucccauagcacgagcccuucaguaaacauauaauaaacaaaaaccaauaacuacaauccaaaaguggacaaaaacuguuauugguuguuuugaacuuuuuuuuuuuuuuuuuugagacaggguuucucuguguagcccuggcucuccuggaacucauucuguagaccaggcuggauuuaaacuuauagacccaccuaccucugccuccuuuguuguuaggauuaaaggcguguaccaccacgcccagcacuaucuuaaacauuuuuaaauagagucuaaaacaaccaagaacuaauuuuguuucccaaggaaaugcccuaaaggugugugugugugugugugugugugugugugugugugugugugugcugugugcuggagggauggcucaguaguuaggagcacugguugcucuuucagaagaucuggguucaauuccuagcacccacauggcagcucccagcugucugugacuccgauucuagggaauccaauaugcucucacggacauacuuguaggcaaaacacuagugcauauaaaauaagaguuaccauaagauacaugggugagggcuggagagauggcucagcgguuaagagcacugacugcucuuccagagguccugaguucaauucccagcaaccacaugguggcucacaaccaucuguaaugggauccgacggccucuucuggugugucugaagacagcuacagugaacucauauauacacauaaaauaaauaaaucuuuuaaaaaaagauacaugggugauacuuaugucagcaguccuugaaacugacguaaaaaaaucuguccuauuuugcccuuugcauacaugaauccuuacgaguuggucucaucaccggcauacuuuguaauggaggagacugauacaugacaggaggaugcugaauaaauugucuauaguccuacaauuacaaaguaguugaccuugaacgcaaaaccagguaguagacuaucaagucauccuaguaagaaccacacuagccauauccugauagguuacaagaccacauguguagaaaauucacuaggaagaaugcaaguauaagucagcaagcuuauaauuuacacacucauaauauagcuaaaaaugagaaaaaaugcauuuacaauagaggcaaaacauaacuggcuauaaauucagcucaagauccaaccaaguucaaagcaacaucaaaccuaugcuguuugagaggaagacgucacuguagaagauggggcuguaucuccuaaauuaaggaguagaucugguccuauugugaucauucugugccuccauagcauaaaauaccuauacaucaguaaaaagacuggacugugcaaagaucuaaggauaguauuugagaugggugagggagugcaaccacucaacucuaaaugaugauuuggcuagagauuauuugugacaugcuggauucugaauccacucuaugucuacacaguguucuggaaguagcuacuuaacacguaagcaaaugaaugagcagucaacuauuuaccccaauauggaacagggcgcuaacagguuuguggucacuaguuuugaguuccaugugacuccgguaaugaaguugauuaacauuuauuccucuccaaagaauucggucacaccaggcgggaacucggcauuucccacuguaaauaaaggaaugagucacaaacaacauaccacacaagaguaacagcacacauugguuuugaaucacauuaagccucuuuuuaugugcccccagugaaccacacuucuucccagaggaccccuaacaucuucuuuccuacacugcaagcacuaacaaugaauggccugugccagcuugccagccacugaacucccagcacugcugcccaguacaaaguaugugccuaauaucaucuaaagauugaauagauggguuucccuaaauuuaggucuguaucuuagacaaugucaccaugggggaagguggaacaacaccuuccuaaaauagccuuauaaguaaggucaggguuccauucugaacauuuccucuuucuuggcuccacuugacugcaaugguacuucauaauagacagcuaauccaguagaaaacugcaauccggggcuggagagauggcucagugggaaagagcaccgacugcucuucugaaggucaugaguucaaaucccagcaaccacaugauggcucacaaccaucuguaaugagaucugaugccuucuucuggugugucugaagacagcuacaguguacuuacauauaauaaauaaauaaauuuuaaaaaaaagaaaaagaaaaaagaaaacugcaauccucuguuccuagagugggcuuaaucucuggagaagaauaaagcuuuuucuucuaaaacuggacuuucauggacacaucgauuuuuuuuugauagagaugaacuaacauguacacauauaagcaugaacauagaauaguccacagaugcucacaguaagcuauuggauggaacacaggguccccaauggaggagcuagagaaaguacccaaggagcugaagggaucugcaauccuauaguuggaacaacaauaugaacuaaccaguacccccagagcucuucucuagcugcauauguagcagaagauggccuaguuggcuaucaaugggaagagaggccccuuggucuugaaaacuauaugccccaguacaggggaacaccagggccaagaaguggguguaggggguaggggaacagggagggggaaggguauaggggacuuucgggaaagcauuugaaauguaaaugaagaaaauaccuaauaaaaaaauuggaaaaaaaaagaauaguccacagaauacugagggcaaggaaaauguauucaugauucauucaaauuagaaaggccuuguacauuugaucucauaggugacucaaauauucuuuaucaguagcucuggagcuccaucuuaaguggcagaaaccaagcaaaguaaacaagaucccucauugucccuuuucaauuguggacuggcucccuggguacaugggacaaccuucuguccgcugcugccaauuccccuacuccccaccccuacccuaucuaaugaaacccuaaccucaggguuugcaggagcugaguaugaccauggacucuuuugucuuucaaguuccugagucaccuaggaaacuaggaaaaagaaagaaacauaugugguggacaggcagguaagcaggauuuccugauagggucccucacuacuuuucugggggaaaugaggaaaucaaagggacuccaaggcguaguuuccuuuuccccccaacaacagcagcuguaaguccagacauuaggauuucuaagaggucaccaaugaauuauuuuuaaagauuuuuuuaaaaaaauucauuuauguauacauauaagcagguacuaucaaaagccaggagagggugucagaucccuuggaacuggaguuauugaacuuggguccucugccagagcacuaaauauuccagccacugaguaaucucuccaggcccuaaccaauggauucugguguguucucaggaccaagaguaacugugcuagaagaacugcuugugacucuuaguucucaccuucugguauccaaaguuaaguagcagaggaggaguguaggagaaggagcuaagagcaucagcuaagaaggaaggguaagauuagggaggcaaaacuccaagcuagugugcagagugauggaaccagggugcuggaggcagcucacaaagugucaccagcccuggcaucuaauuaauacucucccaauauaagcucaguuugaaauacucuucaguaauaacacuaagccauucgauuuccuucucugcauauggagugauaaaaacacagauccuagccugucaggagagacauggaaggacauagagaagggaugaagcuuucagcuuucugugagaacauucucaucacuuuaccuggaaucccaucugucaguuuucgaaucauauuuguacgugggaacgaaauuaauuuccccuucauugaaauccgcaaaagcuuuuuucugugugcgcugaauguuuaacuacagacagaaagaaacaccacauaaacagaucaacguaagugauagguugacuggccacuguuuccguccuaaguauucaguucuacagccuuucaaccguggaaaaacacagauaagauuucuuaucuuuugaauucaaugucaacauugccauagcaucugaacucgccuucuaauaacacuuauuagcauacugacauuuauucccaguguggccaggauaaaauuauggaaacaagaauucagaauaaucccacauuacguagaccugagcaggaauggucuugcauaauuauaauuauaacaaaaagcacacaaaccuugaaaggauaauuuugagagcaauuucagcaaauaauuaaugguucuguucuuaaugggugaguuggggcuacagagauggcucagugguuaagagagcauacugcucuuucagaggaccuggauuuguuagauggcucccagcuaccuguaacuugagcuccgguggagccccccugccuucuggccucuguggguacugcacucgaguacugccccauacucacacaugcacauacacagugaagcuccagucuccaccuuucccugucagggcuggggcuaugggugcacauggccaugcuuguuuuuuuuuuuuuuaacucagauauuuuuaccaauguuauauacgagacucagaauuuauuuaucccaacuguacccuuucugcauacaagaaaaagggagaaauacaaacaaauuagcuguucaacuucaauauaaagguagauagccgagaaaggcucacuauaaaaacuacuguacugcaaaacuccugaacuuuuacugucuuuaaagggcaaaaaagcucucgugaggauuuaaagccauuuaaaucaagucaagacaucgucuuuccuuauuaagaagcgucuacauucaucccagcaccaugaaguucuggguccauaaucaaaggaagugaagucagcauaccaaagagauauguauacacguuuacuguggcacuaucauaacagccaaauauaaggaaccaagagaagugccugcuaauagugacuagauaaagaaaaugugacauacacaaacacaguauucaaucacaaugaaugaauuacugucauuugcugcaaaauggaugggcuagacaaaauuaaugcuaaaugaaauaaaucagacauagaaagacaaaugguacauuuuagcucucaggcaugaaaacuaaaagaaaucaaccugaauagagaacacugaucaucagaaagcgggauaugaggggaaguugcauaaaagcaggcuggaugauuucaauggcacuggagaucuccccacagcaguacauggauuaugcaaauguuccaccacugagcaacaucccccagcuccaaaaagcuggauuucauuauuguauucucaauauacuugcugauauaucacaacaaacacaauaacugugugcaauuaauauguauuaaccgaauaugagaggacaugaagaaacauuuauuuuuauggccaguaccuauauuccauaacaaauuauuuuuaugaucaagguguguugacaccuacuugcagugccagcauuaggagaaauggaaggaggcccauaauuucaaggccagcucuacacuagacagcugguucuaaucuaggauaggcuuuauagugauacccuggcucaaaaagaaaagauaaauguaugaacauugcaauucaauucauuuaccagguuuacacaccaacauaguggcuuauagacauagauacuagcuucuuggcuaucagccuuugucugagcacuacaaaaccaguuguuuucccacaggagguuuuguuguucuucuuuguuuauauguggguagguguccacgugggaaugugcagacaucagagggugacaccaggaugcuuucuucagucacaucucuaccugaucuuuagagacagguccucucauugaacaaggcgcucacugauuggauuagggcgguuggccaguaagccuuugagauacaccugucuucaugccccagagcucaggccaaggacauaugcuaccaagccuggcuuuuaugugggugcugaggagccgaacucaaguucugaugcaugugcagcaaagacucuauccaaggagccaccuucucagcccuuuacacugcuguuaacaucaacugcuaacuaccaguugacaccgacuuaucacucaguuccuauuagauuauagcuugugccauucauuccaaaucaacuuuuuuuuccucaguuuuccagucucuuuuauagggccuccuucccucuuucaucuccaagcuguugcccagccugccaagcaaucauagaacaauuuucuccauucgauuugcuaaacuacaucaacacagcagaaggccaguuuccucgaggaaguauucuccaguuaacaucacccauucuccagcccauggauacaaaucucugaaaucucugccugauaaugacuuacuaaaggaaucuuacauuugcuuuuugucaccaacauuaucuccauugaaucuuagcauccaaucaaggcgcuccaaaucucuauauccccagacaccauaucuuucaagacaguaugacuugucaucucuuucuaguauaaaccaugccuaccaugugucuaucuuguaauccuaacaauaucggccacugaaacaucacuuaccuggucaaauuucaacagcuuaugaagcucauuuuuauuaauaagacuuuucaccucacuggcaucaggcaugcaaagucuguaguucaagucucccagccaaaugacaacacugaggaccaagaaauagauuaguacagacuagcaauagauuagacuaacaguaauuaagauuaaagucaaucagagggggaacugagagaagaaaguggguagauuacuuuuaaggaucuauuuaucacuaacaagaggcuuaaacuauaauuaauucuuuaggggcaaguacugccaauaccuaggaaagacaagagauucuaaaauaccugggaaaauaagcacaacaacauaaaagcaaaugaaaaugggguuacauagucuccauccaggcucuggaagccaaggaguuaaaagacagaggcaugcagcuuguuugcaggauuagcuuuugucuggcugccugccagaccucugggcaaagagaaucuuaaugcguuugcuucccagagcccugagguuuuguagccucuuuguaggaugggaaugacugaccgaggccacuaggaaaaugaaauucuagaucucuacuguagccaaccuggcaccuaaauccucacucucagcaccagucacuguaaguucucaaaggcaacagcaaaguuuuggauucuugagaaauaaauuuaugaauugcuggggucuucaugggucaaaaauuucaagaccuugacuuuguccccgugaagcagaauucucuaggaucccaguuuuugugacaauaugggcacacucaaauaccacuauuguacccauucuucauucuguccccacccacaccauuccuucaaugacccucuacuucuguccuucucaaggcucguuuuuacagacccaccauugccaccccuccauuaaaucaccacaaccauuaaaacgaauaauguagaucuguggacacagaguuggacacagagauaaauagggcaguaugcucucauauaaguaugcguggcuacauauguauggaaaaaaucuagaagagacuguucagugagaugauacaugucuccauagccuuuuaauuuuuuaauagaugcacuuagaauaugcaaauaaaaauaacuuuuauuuagcucaaugcauucaaaucauuaauguaugauuaauauuuugcaaauuaggguguuccacauuuucuccgugcaaacuucaaaauccaauccagcuuuugcuuacagaucucucaguuugacuaaugacuuucaaauacccaacagcagaugcuggcuaucacaucagacagcacagcucuggaaaggcccacccccaaacgacagccaaagacagucuucuauggagagcaggacuggcuggggagaauggaagacaaauaaaggacucuaaagcauguuuauucauuuuaucuuuuguuauuauacuuacagugaccguuuuuuguuugaauuaaaaaaggacucuaggccuuuaaaggcgugguggugcacgccuugaaucccagcacuugggaggcagaggcagguggauuuuugaguucaaagccagccuggucuacagagugaguuccaggacagccagggcuacacagagaaaccuugucucgaaaaaaccaaaaaccaaaccaaaccaaaccaaccaaccaaccaaacaaaacccccaaaaaagacucuaauuugcagauuccuucaguguuauuuuagaagcuacacuaauagaaauuuuuuuucuccuaaugcccaaccuaauuucuuggucucaaugaaucuguuauuucuaacuaacacucucuucuuugugacccaaauccuuaaaugguaaucucucacuccucacagcucuauaguauuuuacccuauuuaaucacuguucuauccuuauccaaaggccacagagagguagcugcuuacucaugcuucaugauguucacuugcgggacagucugauuggggacugaaaaagucauucuugcacagaugucuuuauaauccugauuccuucguucgaacucuuccacgugggcggccaggugcgaauugacaaugcagaaagugguguuguggaauacaaaucuuacagcuaccccaccuuuguuucccuguuagacaaaguauaauguuacuuagcacaaggagcaagugaauuuugcauagcuauaaaugauaaucaaauuaauugccaaaggaacucaccauuuuccccaugauuccaguuccaguuguuucuguagcaacaucucggauguauugacacugaucuuuucuggcaaauauaagaagcaucauccccacaaggcggaccaguugaaccuaugaauuccaggaaguuacuaacagcuaacauaagcgucccuuucugcuacauaacuaacuuccuaggaugaccaacaaggugauuacugauguccaaaccuacaucugcacccucuaauuuccaauaagaccucauaaauuggaaacgacgauucucuguggaagcucuagucugguuuugauuaauaagaguuaaaagucuugagggauaguguauaagucucaguuuuucucucuccccacuuuucucucugucucuguaucucucugcuucuauuuaucagugcugaggaucaaauagagagccuugagcauguaauacagcuaucuaccacugagccacauccccagucuuagaccucuaaaucacauuguagccuaucgagaguauauuaaaagcccaaauaguaguguauaagccauuaucccagcuuguuccccuuccguccuaaagagcaacccuuugaauuuugauucuuuuuaaccuaaaguugagcgagagagcuguaacauccucaagaguuaugcuaccuacauaaacuguucaaaaccauagauuacuuugagcuugggauaauagucuuaagaugaaaauaacucuccuaguagcuaaaugccccuagcagauaucuucuaaagaccaccaauuggaccaccuugcuaaagccaaguuuauacuugaccuacaaagcaguucaggaugugcugaauucccacaguacugcuauucuugcucugaaucgaaagcacacucucugcgccccacauacuccauacugcuuuucuuguaggcauuucauucuggccaugccagaggacagucuuauauuuuuauuacacagacagaucgguuagcuuauauuuaauuauuuggauuacuaaugcaaaaacaauaaguugauuucuuccccaaaccaucuaaaggaugaaaaugcaugaccagaaagcuuaugaauuuuuuuucucagaaguaacuacagcagauuagucucauacagcacaguauuucauauggagaagucaauuauuuaaaccuuuuggaagagguucaguugauggaguaacucccagugaggccuacuucauucuauacugaagagagaagcgagcgagcgagcgcagcuuacuuuucuauacuuggccuucgaaggcagcccccuuuccacagccaaggaccacucuugcucuuucacagacucgaaguagaaaaaggcuucggugcucaaguccagcucuuggaaucugagggaacaaauagaugcaggcacuauacacagccacaauuuucuuuggcuacauccuuucccauuugcugagacauuagaguaaagaaaaaaaaaaagaguacgagauaaauuuuauaaaagacaugucgguuuucuaaagacucuccauagguuauagaaaaggaaacaauaacaaacgcuccuagggccaguggugagaccugucuuucccaaccguugacuaaucacuuugagcacugagcuuaucuguuccugcgaugagcaguucccuauuaggagcuucauuaacgguuccuuuugacccacaaaauuaacccgcacacagagugcacagcaaguguuuaccaaacaaguauguaagaacaaauaugcagaucaaggcgggggaaaugucccagucaguaaagugcuugcuagaucaagugugaggacccgaguucaaaccucagcauccgugcaaaaaagcugucugugcgggcaugugucugcaaugccagcaccggggaacaagggaugggaggauccaucucuagggguucagugagagagcccaucuaaaaaaauaagguaggugccaggacagccagggcuacacagagaaacccugucucgaaaaaccaaaaaaaaaaaaaaaaaaaagguagauaaggccuuucccauagaaguggguggcagcuaagguaggaauucauaacuggccaaagugcugagauuuagugauggcagagcacucugccacuaugggccauuuacaucacacucagggaauaccuuuaagaggguaugaaaagaauguaagagccagaagauggggacauguucagcaaaaagaaacuuguggaugacaucgccacuguuccccugaacucgguacagcugcacagauugggcccguaaacauuucaucaugggcacaggaggagcccaugaggcucuaccccucccuaagggacaaggggcaguuaaagauugcugguggaaggggugucacuuucuuuggugggaaagccacuguugaguugcucuaguaaauagucucccauccauguucacacaagaaacuccaacuaaacucagcggcucauacauaugaagaaggcaugagugcagugggggaguuuugggggaagaagaugauggggguguaaacaacuaaaauucauuauauauguaagcaaaauguuuaauaaaaagaggaaaggaaauaagauggagagugauugaccaagacaccugguaaccucuggggcucacaugcacacaccaacacguucacacacaaacacauacacacagauaagagggaggcucaagucauguuacacuaacaccaaauauaggagaaggaagguccagaaguuuacccaaugcaguaaauaucaggaggauuuggaucacagucgagccaagguucuaagcugcugucuggagacuggccguucacauuccaaguuccaacaaaaaaccuaauaacguuacagcaaaaaaauaauuuaaaaacaaagaucaaggauaaacaaacacaauacugcuuuuaucacuccuaugaacggguauuuugauuaacauaaaucuucaaaguguuuugcuagacaccuaagaaaagaauucuugggagccaggacuccagauacauauguagcagaggaugggcugaucugacaucaaugggaggagaggcccuugguucuguagagguuugaugucccaguguaggggggaugguagagcggugaggugggaguggguugguaggugaaggagcacccucauagaggcagggggaggggggaaugggaaggggggcauuggcggagggguaacugggaagggggauaucauuugaaacguaaaugaauaaaaugauuaauaaaaaagaacucuugcauguauaacauaaaggcauggguuuauuuucucuucauuuacaucaacggaucaacaaaaggaccuaggucuauauuuuaaacaaacacaacuguuuuggccaaauuuucuuucaauuacauuccauccaaauucauuaagggagagcuuuagguuaggaugggaaagagcuagcuuggugcuagacacagcccaauauggauaacucuucuguaaggaacuacagcuaaacuaaaacaaaaaaaauacaaacaaaaacaaaagcaaaagcccucacuucucgaggaucacgaggacaacucugggaaauauugaagaggcagauaauauaugaagcgggaaagcagaagggaugacauauauaugaggaagugcagacguguuugaacauggggaaaugaugcauggugggauaccauacggguaucuuggauuagaugggauauucuguucaugaauaacacacuggggauaugugccacaccucaucaucuccccuuucuaccagauauaucaggguccagaaaaggggauauaauaaugagcaaaggugacgugaaaacuaaaaggaaagaauugaggacagacugcccagaggacugggugaaauuuuaguugauuuaucaaagcaguaaauuuauaugugguaguaaugguagacuuuaauuuuucaauacuggcuggaccaagguucagcuggcccaaugagacacauacuuauuuacugauggcauuacaggccaauuuucuauucuaugugaguuugaucuauccucuaagcauggauagaaauauuaguagacaugguaucaugagcaguuagaaaacugaagggaagcuauagcguaugcaugauuuaugauauauauguuuuuaagcaagcauagugcccgagucagauaaucuucccuuauacugugcuuccauucuuaaugaagcuaacauuuuuacaaggcaagauuguugugccuaaaugcuuagacucggugaguagaaaacagacacaccugaaagacuggauguugacauauucuuucucucgcuuugugaggauauguuuaaugagacccucucgcugcccgguuuggguguucgggacaaauagcuuccgcaugguauuggucacuuugggcuguucuuuguuugaagcuuccuuuucacgcgaaagccuagaaaaucaaccauggauuccaaaggaaaacuggcuaaaaugugagcugcuuagagcgggcagugcgcugcaacagagcacuuacauucuagucgaugaagaagguggagggggugguucccgaugacucccugaucggggauuuuguguauucauuuucuuaucuaaauccagagaugaaaaauuauccucaaauccaagcagcccugaaggauacaagauccaaagacaaaguggagauaaagagaccuuccaacauaggugaggcuuuuauuuacuuacgacuggaucuagguaccacagguagaguaaucauuuacauuaggguaagacucacauucauuccagaagcacugacacacugacugugaugacagacaguuauaccagucuggaaccugaauaauacaagccaacauuuauagaggggauuauauaucauuugccuuccucacauuucaauaacuuucauaagguagguaccauuaacauauuuuucuacauuguauugaaggaaacagaagcucagagauaagucacucaaacaagaugacaucauuaguaaguuucagacuugccauucacaccuauguugucuggaugugaagucuacacguaacuucuuuuuccaaguaggcucggaaagagcuacccuaccacagagcgaaucaggagugaaguccagggccacagagucaaugguuacaccacccaaccaauucaucugaacuaauacuaucuaucuaccggcucgaaaaccuucauagcagccagagaugaaagagucuuuccaauaccugaauaagcagguuuauccauagugucuaauuucugguaccagcuagaugagucuuuuuguucuggaacaagaagcugugacugagcuggaaagacaagacuugggucagaaacugggaagaccaucauuaaauuacaagccaaagcuauucauuucuucagaguccuugaaugcacagucagcagaauucccaaaaggacuagaagagacuaaguaaggaaauaccaacagcucugagucauucuggggcagaaggaggggacugcaggcugcaguaaacuauaugccaugccacugacucucuuuuuaaagcuggauagacuuguuccuuaaucuacccccagguucuuuccugaagggaaaaauaaagagcuaucugagcucaaggggcagggguguggggguggagcuucgcuaacagugaccugccucugaaucagcauaucagcauuuuacucccauugaaagugucgaaaggaaauuguugaguuuugaguuuaccuuccugagcuucgaggaccucugagaggaacuucaaacagcguucuucaucaggaauuucaaaguggcgcucucugguccagucucccuguacccgaauuuugcagccaccuuuaaaaagaaugaaauccacagagcccuagcuaugggauacaacacuuuaucaauaccuuauugggauaauagucucaaacuuucuggucagagggagguccagauuacacauaguccauacccuuaagaaggagaacauguagaagaacaagggcuccgguauuguagugguggaggggaugaagcagagaagaaacccgacaguagaguacucagugcugaugaacugugucagcgggcagacuagcaauaggcacacugaaucauagcuagcugccuaugucccuaucucucagcugucaauguagggauuucuaaguucuagcaaaagauaaauucacaagucacccuccuucuauccccacacuggaaauuccuaccauuuaaguucagauugcauaauacuuuaagguaugaagguaacauaggaagucacuuggucagguucagaguaaauuaaauuuacaagugaacuuuaaaaauguggggacuggcuucauguguucugagaagacauaccuauuccucauugacacaagugaaaaauaccacagguaucuugaauaaucuugcaaaucuauccuagaguugggugguuuaaaaacagucaauugagaaagaauagaauuagaagcaaauguacuggggcugguuacugaggcuggagagauggcucagcaguugagggcacuugaugcagaugacugaaaugugauucccaacacccacauguuaaaccacaaccuucuguaacuccacuucuagggcauccaaugcccacuucuagccucuguaggcacuaaggguguacauggugccuauacauaaugcaugcaaacaccuauauacauuuaaacauagaaaugccuuuuuaaaaagcaaacuuaccaaggguuuagcucucauuaauuauuaaaauagcauuuuuauuuuauauguauagguguuuuugccugcauguacgucugugcaccacauguaccgucggaggacagaagaggcauugggucccucuagaacuggagcuacuuugaggggucuaggaauugaaaaauacauagggucuuucauugaccugggacuuguaggguaguauaggguagcugacuagugagccccagggaucuaguugcuucuggcaccaccccuuuuuuggucuuucaaauacggguucuggggaucaaaucuguccucaugcuuggacaaaaaagcaguuuaccaacugagcuaucuccccagcccuagaggugcuuuuuagggcauacuaauaugugugccccaccucacgacaauaaaaagacuaucuggagaggaagcccagaaaugucucacuauguagcccaggcucauuucaaaccuuuguuccugccucaggcuccuaaaggauagaauuauaggcagcugccacuacaccugacuucacugguaauuuaagaaaaauacuuguuagggauucuaacauaacuacauuauaaaucagaggcaaaugcaaacugacuaguuuccaagcagguuacuucuuccgcagacuggauuuuaauuccuggucucaagugaucccccugccucaguuucucaaguauuugagacuauagacaaguacuaucaugcuuggcuuaaauaugaugcaguucaauaccuccuauagaguacucccucuccaucucugucaggaaacugcuuucuucugaggcucauucacugggcuauaccaucuucucuuucuuccucuacaggaccaucacucucuacaaaccucagaguucagaauccaaugccuacuacauaagacucuacuuccacucaaaugccugccauuagucauucucgcuuaaaaauuggcacagagaauccaguuaccaccuucaccuucuucacccaguggccuucccacuccacuucagccuccauugccucacccucugcagugacuccuucaagaauauccuagauuuuuccaucacagaaguaccauccccuaacaugcaacauaaaucaaacauuucacugugacuaguaguccucccaauauacuugcuccuuaucuuuucuguaauuguuuuugacuuugaggaaccuuggccccauuaaucccuucuuuugccaucccuggaacccuucuugcuuucacuucccccuuucucaaacagaugucaucauuauugucugcugccuuaccucugggcucccacagcaccgauuuggcuaaauuccaacccacaauaguccaacuaauugcccucuccgugcuuccaccagagcaaccagaggaaaucagcacaaaguacaacauacacauugcgcugguuuuaugguaugagauguuaacuugacaaaaaacuauaguaaucugagaagaggaaaccucaauugagacaaugcuuccaaaaggucaggcugcagacaaaccuguagagcauuuucuuaacuagugauuaauguaggagggcucagcccacuguaggaggugccacuugggcugcugguccuggguucuauaaccagacugagcaagccauggggagcgauccaguaagcaguaccccuccauggccucuguaucagcuccugccuccagguuccugcucuguuggaguuccuguccugacuuccugcuggacugcgauauggaaguguaagcccaauaaacccuuuccuccccgagucauuuuuuugguuauuguguuucacuguggcaauaguaacccuaacuaaggcaaguugguaucaggguaguaggguauugcugugacagaccuguccauguuugggggaggauuuugaaaggauuuuggaacuuugagcuaggaaagccauugaguguugagagccaagagagcagaagauggaggccuggcuuaucaaguuucagagggcaacuuaaaaacucuagaggccauuuguuauuuugaauuacauuucugugguucugauuagcugaggcugaagaguucggcuaugauuagaaagauaaccaaaacuacaaaacugagaccuuuacuuugcugagauauucaaugcuggucagcaggagcugggaaaucagcagugauuaagacaagcauuacugagguucaaucucuugggaagugccuccugagucaacauacagaagcuguguuccagaggcagccaagguuguaccuugugcuggcagcugaacuuggcaguguaagaguuacccaggaacugguuuugaaggcaugugaagggaucauggaaagcagcugaaggcuuggcacugugagaagccaggcaaugcuauuggugaagguguagccucaguggcaguugaaggaguaagacugaaagagucauccagagaaucugaggcuuggaccaugaagagagccuaggagaggcuauugguugaaaugcagcccagaugcagcagaagacuguagaauuuuggaugugcaaguaccugggaugacuauuaagaaugucagcaguggugggaguggagccuacccuaguugagaagacaagcuguguaugcuacagagggcagagcuggagaaguggcccaagcccuuuggaguaguccagaagaggguaaguggaucccaaaauuguuuucucauucuauauagaacugucuugaguuuucugugaugcugagccuacucuauaacuguacaaccaguauggaugcaucuagcuagugagcacuugaagugugauuauugaaaugaagccacugaauugugaauuuuacuucuaauucauguaaacagguaugugcauuagacagcacugugugaaacagcggagcucucaacacaaucacaucucucaagguuuggaugucauucacgugcuaguuagguuuggcuucugaguggcagccaaauccacauagaagugucucaaagaaaucucaaacauggccaaaacuguacugguacuggagaaguggcccaagcccuuuggaguagcccagaagauggugaguggaucccagccauuggacauucuguuuuggagaugccaguaccaugggaugaucaccaagaacaguagcagcaauggaguggaccaaccugaguuuagaguacugguacucaaaagcccaggaauaagucuacuauuacucugcuaaauggacacaguagcaaacugcccucagagcucuccgauuuaucuaaaaagucugugaggugaauggugguuaagaaagaaacucacaaguggucaacaaguaaagagagaguaucgguggcaugccuggccacaaaagggccaucuauaucacacuccuuucccaaugcucagggaccuucuaaaagaggggguggaagaacagcaagagaaagaggcuuaggaggacugaaacaaaacugucuccuuggcaugaugggaccacaguguacucaagcucauggcgacuguagcuaugugcucagggccuguaaaaucagccagucaacauuguagccucaaguguacagggcuucaugagccucuauuccuaacugaggagcuacgggcaacugguggcuucaaggggagggagagcuuucccuaaggguggagcuccugauaggucaaccuuucugcacuggaugacuccauacucaggagcaaguaaaaugauaaaaauguacucacagccgggcgugguggcacacgccuuuagucccagcacucgggaggcagaggcaggcggauuucugaguucaaggccagccuggucuacagagugaguuccaggacagccagggcuacacagagaaacccugucucgaaaaaaccaaaaaaaaauuuuuuuuuugcucaaaaaaauaaaaaguauuuuaaaaaugacaucuugaugguccccucaaaagaaaaaaaaucauuccauccucaaaauuuuuaugcaaaugggcaacauccucuaaguuccuguuggaaaccuuguauucacccuugacacuucucuuccucccaucccucacacccaagccgauucuucuugaccuuaccuccaaauucaucuaucaaaucugcccccuuuucuccauuucucucuuucucuuucucucucucucucucucucucucucucucucucucucucucucuuucuuucuuuuuugagacaggguuucucuguauagcccuggcuguccuggaacucacucuguagaccaggcuggccucgaacucagaaauccaccugcuucugucucugccuccugagugcugggauuaaaggcgugcaccaccacgcccggcuuuuuucuccauuucuaucacaaccauacucucuagcauauacaaccaaagcagccuaguaacuggucuuucugcuuccaggcaaaugaugcuauaucagcauaaaaauccuuaacuucucauuuuuaagucuaaaacugcagauucaacacuguggcuuacaagacuucauagucgcucuugucuuggugugcaagcccuauuucaggcacccuugcauuuuauuucccagaaacugucaggguacuucuaaguuuggagucucacaacccccuuuaucuggaaaauucuuuuuuuuucuccaguuguugccugucucucaggcccucuguucccaauauaaaugucucuucuuuguaaaugccuugccugaguacacugccuaauuuagugaucccucuuguaaacuccuggcacuuuuucuuauuaguauuuauuaaauccacauucauguaagcauccaguccugcuaaagucacuuuuguacguuaaaacacaugaaccaccaagaguguguugcuuucucgugcguuuuagagcuuagcacagugcauaguggccagaauguauucagauguuuagggacuacauuuaugaauuagaggcaucucuguggcucuagcaacaaaaagcacagaaggaaaaaggaaagcggaagaaggacucuuaucucugcugugcucugaugauuugguacgauuugccaccaggucugacaaacagaaggcacucaacaaauauuuguagaauaauaaauaaacuagguaggguacuguuuaaaaauuagcauaacagaguucaucuaaaagucauaaagagauaaaggaaagaaaaagggaaaauaaauucaucuccaugaaaaacagggagaacauuuaauaaaauucaguacauaugcacaauuuuaaggaacggcaaaaucuuaguuuauguuguugguuuuguucuuuuucugugugacacagucuugcuauguggcucagacuggucuugaacuugcuauauagcccuggccuugaauucacaaucaucuugcuuagauauucagacuaauacuggcacaugccaugucugguuuaaauauaauuuauuauuuuuuuuaagaaacagaaaaucaucagggaaaagucuuuaacugggaaaugccaguugaagcauccccacugaaacucagagcuacagaagaguuaacaccaucauuuaaaauugguccucaaauucucauugguacagugagacaugagacaaagucaauggcuguagcuaugagaaauaaggcagaauuugaagauaauuaaaacuaucaaucugccaaaauggaaaaaauagcaaaaauauuaaaaauaaauuaagugaaguaacuggacaaaauauccaagacucacuaauuguuuuauaugauaauaguaagcaauccaucagcaaaucaaauccacuaugaaauucucacccuaaaauuuucauguauaaaaagaaacuacaaaguuuuacugagaacuguaaaauaggacccaaauaaagaguuauguuccuucaagaugacuuaauuuuagaaagaaacuagcuaaauaacagucugacaaaaugucuauggugaaauacugguuaucaaaaauaauguuuaaacaaccauguaugguggaacaaaacauucaucccagcacuagggagguauagagaggaucaagauuucaaugucauguuuggcuacauagagaguuugaagcuagccuaugauagagagaacccugccucaaacaacaacaacaaaauuauguuuaaaaugauuuuaaaugacauaggggaaaugucaugguaaagugcuaagugaaaauccaugauaaaaacuauaaauaaaguaguagggauauagcccagcuguagaacauauguuugacaggcacuaggccucuggguucaauucucagccuuacaacccucccacaaaaaguauguagaaggauuccaauuauauggacuagaaacuauaggaaauacacagaaauguuggcuacaguauaaccucaagauuauauguuaacuuucaaagccuuuguguguuugcucaugcaugugcaugcaugaacaggcaugcaaaagagugcagguguuugcagaguccagaagaggguauuggauccccuggagcuggaguuacaggcaguugugaggcacccgaaaugggugcugggaacugaacuuggcuccucugccagugcaauacuugcucuuaauugcugagcuaucucucccauucuacauaauaauuuuaauuugauacuucaaaacuuuuugauugucacaauuuuacauaauuaagaugcaugaacuuuagaacuaggaaaaugacuuucaagauguuuacugcuaggaucuagacaauauauauuuauaucaaaaucagucuugcacaguaauaaagaguacuguuuucuaggaggugaacucagauuguugucaaucuugugcaacaaguacuuuuacucacugagauuucucccugaccccgccguguuccuuaaaacaaaaacaugauuuggagacauggagcacaggcuagcuuagaacuauguaacugaaggauagaccugaauuccugaucguccugccugcacugcgcugaggucacagaggugugcugccacacccuguuuauggaguacaagggauggaaccagggcuuuuugcacgcuaggcauauaacuacucuaucaaccgaaccauaucuccagccugcugcuguguuucuucuuuugucuaaguacaaaacaacacagauucuaaguuauuuucucucuuagauaccuguaacagaaguuagcagcuagguuuauauaacaguuuaggaauagccauuaagacuaugauuaaagaaaggaauaauaaacccaaacuggaaaacuauuuaauacacauuaagagugccaagggcagagaccuucuccaaacaaaauuaugugcaaccuguagccccaagcuaaauggcaaguucugcucauccguggacucaaacaagagauaagguaaaccauuugauuuagauuuguauggucagauacacuuuccauagcaaccacacaguagcugcaguagcaaucaagugcccauuuucuccucuccagagcacaguacaauuagaugauaaacaaagaacaucucacacagaaagucagugauuugcauuaaacugauuuaaaaaaaccugaaaggacagaaacagcgaaaagaagaccauguucccucugaugaauggaggccuugagggaacagggcuuaaguagggcacaaauuauuucaaaaaaaaaaaagaaagaaaaaaagaauaagccauuuaauggacucugugccuuucaaaauaauguaaagaauagaugaaaacauugugaauucacacaaaaacauaaaaacaaggugggaguaggcucuagaauauaauagucaaaagauaacauuuauucagccacauugauaaacagaaucgugacauuuccgaggaaaugggcguaccaauguaacugucacacuguuaguaaaguaucucagcuacagaaaggcaaaugcugcauguuuucuucucauaugcagagccuacauuuuaauguguauacgagugcaugugugugcaugugugugcaugugugugauguguguguagggguacaggucaugagaguggaaaagggaccacgagagacgaaaagauggcuuaagggaaaacuggggagagggaaaacagguaaaagaacugugugccaugcaggcagaaggcggagcagugagaagaagggggcaggucagaaggaaggaaguaggcuugugugggaccagauucaauaaaaaaauaugcuugaaaaggccaugaugaaaccuauuacuuuguaugcuaacgacaacaacaacaacaacaacaacaacaacaacaacaacaacaacaacagaauagacaacuagugacaacuugagagacggagaaucugccucuggggggaaugaaccucuaauacauuauccaauagaaaguggucagcucugaaaccagauacacacgaagugaaacauucaguagacugucucuacauauuuaugcauccauguaugcacacuaauauauaacaauaauaaugaaaaacaggcuaucaauuugagagugggggacauggaggaagcugggaaggagggaccuuuagaggggcugagguggcaggauaggaaggaggaaaagaauguaauuauaucuuaauuuuaaauauauauccauauacauuaugcauacaauuuuaaaaaaaccuaauauggguggguagauaguuuagucaguaaagcacuuggcauuugaguuugaucuucagaacuuauguaaaaaaaucggaaacgacgcacacuuguaaucugagcugaggaagcagaaaaaggcagauagaguccugguguuuccuggcgagccaguguagccaaguuggugagguucaagcuggugaaucgcugucucaaagcaaaagugcacuacacauaaaaauauuaccuauugcaguacacacauguacauguaugcaugaacacacaaacuaauaaagaaaaaaaugacccauaaaccucaagcacuuucagcauuuccaaagcucuuccuauuaauaaucaguuccacagcaaugaaacgauugcuauagacaaugucugcagcuucaaguagcuuauagcuccacagcagcaaagcuuguaucacacuucagguuugggggaagagucuuagcagccaccuauguuuuucuuaggcucagcuggaauaguuuugagagaugaggauaauuuuuagggcugcguuaagaaaauggugacuucgggaugagaagacaaaacacaagauguacccccgaaaguuucuuaaauguaaaguauuaaagucaauauuuguaagaaugaaaaccaauuccauuccgaaagauacucacuguuugaagcaauaucaaucaaaagaguuucuucugcuucugaaaggaggaaaaacacucauuaccaccagagcaguauuucagaccuaaauaccagcaguacucaguucccccgugucuuagaacacauuaaagaauccuuugauuguuuuuguuuggcacaccuuuguuguuguuguuuuuuguuuguuugguuuugguuuuucgagacaggguuucucuguguagcccuggcuguccuggaacucacuuuguagaccuggcuagccuggaacucagaaauccgccugccucugucucccgaguguugggauuaaaggcaugcgccaccacgccuggcuuggcacaccuuuuuaaaaagggauuuuaauagccucagguuaaaaagaguaugugcaacucaacuuaaaaaaaaaaaaaaacaaaccaaaaccaaaccaaaccaaaccaaaaaaccaggaagagaaagaaacugaucaaggauccaacuggagcuccucaaagcaaagcaagggacaguggccuuagaguagggaccauaacaacgugcucaugcaagugaaggaaagcuuagcucugugugcuuuagaucuuagagaaagccagggaaggcacugacagacuccaaaccgacuuauucucaccgaauuaucuuucaauuuagauauaagcucugagaggcuaucagugaccucaggaucugcacuuuugcccaaaggcaaaaagugcuuugcucuucggcuucagugaaugcccaacaagaaguuuuggccacuugcuguaccaccuuaauugauucaugagagucaucaacugaaguuaugacagauagaugaauaaagaagauagagaauagaauacacaguggaguacuauuuaaggacaaggagaauggaauccuguccugcuggccauaugcauggaacuggaggacauuaugcuaagugaaauaaaaaucagucauggagggacaaauauugcauguucucacuuaaugugcggaaggugagaaaaaacaugaucccagagaaguauuguguagaaacaaguaccagagacuaggagaaaguauuagguaaagggauugaaagagagagaaagagagacgggggagauggagagggagagggagagggagagggagagggagagggagagggagagggagagggagagggagagggagagggagagggagagggagagggagagggagagggcaagagagggaggaacggaaaguuaaguacaguuagcuaggaggacuauguucuaguguuuuccagcauagcaggguaacuaagguauaucacacauuuacagaucuuaacuagaugaguuugaugguacccaauauaaagaaauauuagcaucucaaauggaucaucacauguuucaaauugguacacuguacuuuuuuuuacacuguacuucuuaauaaguacaaauguuaugcaucaaugggaaaaauagaagacagcacaaagcaguuugcaaguuuagaguucucgcucucuuuuuccacauuggucuuccuggacuuccuuuuuuccccccugaguaucugaacucaaccuaucuuuuccucucugacuucccuagauuuggaugauucugagcuggaaucaaccaggaucucuguugcucaaaugggaagucgcgcacuugucuugcucucucagcacacaagauucuacugcagguucuaugcgacagaugcaaaagaagcaagaaguaaggcacucuguugucuacuagcagagaguaagguacuacguugucuacuagcagaauggagucucacuacuaucugcugcagggugaaguaaguaggcuaugaauauacagucuauacucaccacuguuccguaguacccuuuaguuccacaaaacucugagugauuaguguuccaaauagaugacgcaagucgggaaauggaaaggaagugaaaacucaagggcauaacauuucaauuugucauggggaaacgauggcauauguguuuuccacugcagucuagcaaccgaccaucuccugauuaaaaacaauagaagcgagaucccagagguaguaggaaaggggaaauacaugcuagaacaccaaagccuuuggcucuucugcauaaggcugccacuugcaaaguaggugagugcaguaaccgacuguggcaccugugcccuguucacucucucucucacacagggcagacucaauagcugacuugcguuccgacugccuguagauacuauuccucauaggcauuucaaugugccccuccucuuucuccuccuucccccuuucuucuccucuucuuguuccuucugcuuuuguuguuggaggcagggucucacuacacaacuaaaucuagccuggaacucaugcuuggcccagacucugcaauccugcuucagcuuccgucugggauaagaggugugagucacuacggccagcgcagucauuuuaguucuuaaugcauacugugcuuucuuuucagcacgcugccuuaaaacucauacacacugacucuauucacucacagggcuauagcuugagcaaauaacagauaugugggaagguuuauguacagagaugcucaucccauuacuauuuauaccagugaacagcaccccaaaugucaaccagagggaauaauuagauuaugagccauucauaaaauggaacagcguaaagccacuggcagcacagaaaacacacauaacacgguagcaagugggcgggagagaaauguuauauaggaugaguccugcuucaacgagguagcuugugcacagagaagaaaauagauggugggugccucuuaagcaugagaauguaggugacuuguuuucucugugcacugcugcucuuuccaacccuuuuacagcauguauguuacuguugugaaaaaauaaaguucaaaguagaaagcacuugugccaguugggccucuaguucccaauguucuccacuggcugaggaaggcuucugacugcuagaagcacuagaucuuugggagacauaacacauuucuuucuaguaauuggcuuccuuuuuaggaaaaagggagguugcagaggcaaugccucccaccuagcucucccagcguuugaauuccaguguagcaaaugaaacaagauugcucuauguuguguaaggacagaaagccaaguguuucuuucccagagcucugauucacaaaugucaaggcuuaugacccaacagagcugacucugagccauugcaaucugauacuucaugcugccaagguaucuuaaguccaguacuuuggaaaaaaaggugccaaauguguauaaauccuucauaacagacauaauguugguuaagcccaagacaguacuuuaaauccacauauaugucaaaucagcauagaagauuacuuacacaaaucuccagcucuacucagggaaacaggugauauauacaucuguauuuuaaaauauaauucuucggcacuuuuaaacacaacacuuuucaauggcagguuagaaguguuaacuuuucugugaagaguaauauauuucacuuuacaugcagugacaaaugugaguaugugugacauuauacacugcauuaacggcuaaggagaagccuuauaaaacuagcuaagucauuaaagcaaguaccuugaacacaucugaaguggcuauuuauaggaaugauaucuugaacauguuguuccuuuccaugcaacuggauuauuaaccuagaacacagaagaauguaucaacgaacagcuaccaaaaugccuaaucucuagcaacaaaacauugcugucuugcuacacaaauauaaucuguguuuaucagacuugcugcaucgaguccacccgaucuuagcaucaugauugcuagauguugcucaagggcugaaaggugaucaguaccugaacacccaaacugccucacacacguaaagaauguacaauagucuauauccuaaacacaguuuuaagagcauguacugcaaguuacauaccuucccuguaugaacaccagacugaagaacuuacagccgaagggaacuuguuguuggcugggacuguggcuaucuuucuguuacaguauuucuagugcuuaguguagagcuuggcauaucucagacauuccugugcauugaaucaaugaaucagacaacucauucauuagcuuuucauguacaguuucaugucuuugaccaaagaagggugcugcuacuuucacacauacauguaaguuacuaaaugaguaaaaagacucauuccugggccagccaaaagaauacuagcagcugaagagauagcacaauuccugcauggguucccuugauacccuuugugugcauguccucugcuuucucauuuuagacugguauuuuuaugcagacacgaaugaauuuggcucccaaguaugaaaugcaagacucuaaaauucccuucuauucauuccuuaaacauuaauguuugagauaggcuuucaguauugcagaucaggcuggcuuauaacucacuauauaguuuacgcugaucuuaaauacaucaucuuccugcccagacuccaaauugcacagauuacagaugcacacuaccaugcugagcuuaauuuuuuuuuuuuuuuuuuacuuccuaguggggaagaaucaagguauuuccuaauugguaaacagacauucuaaacaccaacuggcuucuccacauuggguacucgucaggugucuuuauuuccuuuuguuuuuuauuuuuuuauuuuuuuauuuuuuaacaagaauacaucuuuucuucccgagacccaguucaaauaccaccuccucuguaaagccuucuccacauauucccaagaagaccaguagucuuauccccuuagacuggcccuccaauagaacacuuaaagagcaguuauauuuauuauaugggagccccgugagagcaaagacccucuucaguuuugucuacaguuuaacagauacucaaugguuacuaguugaauaagugaacaacuuucauuacacuauaaacagagguggauuuugaaaugaaaguccuuggagaaauaaugaaguucuuuuaaggauuugauuguuuccaaaaacaacccccccacccccuuuucauuuuggucuuucaagcaaaagcugcucuauauucagaagcacagagccaaacacggugauggcuucaaguucuaaugacaaaaaggccaaauguaaaaaguuuuggggaucuaggucagagaugaaaaaaaucuuuagggcuuauaagugguacuauauauuagguguuuucaguucaaaagaauguucucuacugggcaugcuagugcacaccuuuaaucccagugcucuggaggcagaggcagacagaugucugacuuugaggccagccugguuacaaugucaguuccuggacagcuauggcuaccuccaaaaaaauacacugucucaaaagcaaaaaguagaaauuuucgcuguggaauucuuaacuaugccucauggauuuggaucucagcuaugcagcuuuguaacucugaguaagccacuucacaucuaugucuguaccuguaaaggagcaugauaagugcuuaacagucuucaagccaucucguuaauugugggcuauccuuuuauuaguuauauggacucaaaacacagggauuuaauuucucuguggggaacuagaaaagagcccuccccuugccaaguuuaaaaguucuaguucaagaacuuagacagaacgaguuacuuuucauaaccggcugcuggcucucuuaguagaguucuaaacccacugacccaggggacaaauaucuguguugugguuauuccaacaguguagcugucccagucaauucuuaaaacuuuggguuuuauagaagaggaaaccaagauacacagaaucuaccuguuugugcagguuacacuucuacacaccauuucuaccuuucccacguggaauugcaccuuuuaauucacuauucuauugaauguacucuuacuaaacuagucuuccuggauuuuaucaagucuacggaaaauaacaugaauuucuuacaucaacaggaccaaccaagcaggaucuagggacgagcuacuucauggaccuagaugauaaucaguuauaauagcacccauagcugcagcuacguucaggccaggcuagugggacuuuccuucuuugugaauuagacagccugggaccaaggauuuaaaaguagaguccaagacacuuuuucaugcagaauccaguguuaagagaugguaggaacuaagugaucaauaccuguuaaacuggggggaaaaaucuauucccagaaaccagugaaccaagggaaguagcuugcacauauacagcgauagggcacugugauaugaaacggucaccguggaaacuuuaaagaugaaguauuaguggcaagggggcaagguuagcagcuguggugacugcuuaugaaaauaaucaucugcucaaucagucaucuguauuuacugagcugccaucaucccaggaagaguuggaggugacaugcacugagaaaaaugucaaaugccauucuguuucuacacauuucauuaacuuugcuuuccaaauaguccgguccagugcgacaguggcugcccugcgccaacacauuagugaauuaaugcauuugccuucaagcaaacggaaaaaaaaaagaggaucuggggacaggaagaaccaguugaaugggaaaaaagacaugucuguaacauuagcaacauagcauuuccauugcacuuuuacuuguaagccacuuuugccuggguggucccccaguuuuaucuccaauagccauaagacaguuuaugguuuuauucaacucaagaggaaaccaaggcucagaaagcuugauuaacuuggguuacacaacgcaugucaguuacagacagggugaaggaacuaagaacccaggcuuccugcuuuccuguccauugaguccauccacugagccacagggcccaggaguuaucuaguagcuuagaaguugggggugggaggcccuggcucaggcagcucacucuacacaccuagcugugaaccuguugcccucuuggccaagguggguggcucccugcgguuucaggcucaaggagguuuauagaagaaggcgcucuccucggugggagucagauuacuuacucauacugcccauuccuccgggcuagggucaggacgcaggguucccggaggggacccuucaucuccaaacccgccaccauaugcaggcacuggucaaggaucucuaauuuuucuuuuucuuucuuuucuuuucuuuuucuuuuuuuuuuuuuuuuuuuuuuuuuuuugcaaacgcagccaaauuggggugacgcggggccagacucauaucgucagcucuccucagcuaucccagcguccacuccugagcagguccccuuucccuacucugcucgcccuaggacaugcugcaccccaacccgcaccccacgcccuuacggccucccuuccccuuccccccuucucucagacggauacugccaggggcugagcuccaaucgggagccgcggcuccaucagggcggccuccaggcucugcggggcugcggacugccagcggauuccacgacaccaccuccugcggccugccgccggccugccucgccuaggcggagaggaagggcuccagcgcugggagccuggaagcccgggagcccgggaacccgggagcccgggagccagccggggagcuuuagagccgggaggagagagacugaccagagagagagagcg

SEQ ID NO: 9471 - RNA, 1137 nt, Mus musculus
agagucugagcggagcgagcaaguugagcgguugucuggucgcaucucagaaacccauaacccuugcagcauggcugaccaacugacugaagagcagauugcagaguucaaagacgcuuucucacuauuugacaaggacggggaugggaaaauaacaacaaaggagcuggggacagugaugaggucccuggggcagaaccccacagaagcagagcugcaggacaugaucaaugaaguagaugcagcuaguaauggcacaauugauuucccugaauuuaugacaaugauggcaagaacaaugaaagacagacagugaagaagaaauuagagaagcauuccguguguuugauaaggaugaaaauggcuauauuagugcagcagagcuucgccaugugaugacaaaccuuggagagaaguuaacagaugaagaggucgaugagaugaucagggaagcagacauugauggggauggucagguaaacuacgaagaguuuguacaaaugaugacaguaaagugaagacaguguacagaauguguuaaauuucuuguacaaaauuguuuauuugucuuuucuuuguuuguaacuuaucuguaaaagccacccccccccgucaaaagauaugcauguauaguaauuaggacuucauuccuccauguuuucuucccuuauuuuacugucauuguccuuaaaccuuauuuuagaaaauugaucaaguaacauguugcauguggcuuacucugccuauaucuaagcccgucugcacaucuaaacuuagauggaguugguccaaugagggaacaucuggguuaugccuuuuuuaaaguagcuuuuaggaacugucagcaugcuguuguugaaguguggagcuguaacucugcgagggcuguggacagucaacaacauguacuuaaaaguugcacuauugcaaaacggguguuuuauccagguacucggacacuauuuuucuguacugcugguauuguaccaggaacauuuucuuuuauuguuacuugcuuuuuaaacuuuguuuagccacuuaaagaaaaccugcucauggcacaacuugccucagauccauuccaaguuguauauuuguuuuccaauaaaaaauuacaauuaaaaaaaaagauucuca

SEQ ID NO: 9472 - RNA, 1137 nt, Mus musculus
ugagaaucuuuuuuuuuaauuguaauuuuuuauuggaaaacaaauauacaacuuggaauggaucugaggcaaguugugccaugagcagguuuucuuuaaguggcuaaacaaaguuuaaaaagcaaguaacaauaaaagaaaauguuccugguacaauaccagcaguacagaaaaauaguguccgaguaccuggauaaaacacccguuuugcaauagugcaacuuuuaaguacauguuguugacuguccacagcccucgcagaguuacagcuccacacuucaacaacagcaugcugacaguuccuaaaagcuacuuuaaaaaaggcauaacccagauguucccucauuggaccaacuccaucuaaguuuagaugugcagacgggcuuagauauaggcagaguaagccacaugcaacauguuacuugaucaauuuucuaaaauaagguuuaaggacaaugacaguaaaauaagggaagaaaacauggaggaaugaaguccuaauuacuauacaugcauaucuuuugacggggggggguggcuuuuacagauaaguuacaaacaaagaaaagacaaauaaacaauuuuguacaagaaauuuaacacauucuguacacugucuucacuuuacugucaucauuuguacaaacucuucguaguuuaccugaccauccccaucaaugucugcuucccugaucaucucaucgaccucuucaucuguuaacuucucuccaagguuugucaucacauggcgaagcucugcugcacuaauauagccauuuucauccuuaucaaacacacggaaugcuucucuaauuucuucuucacugucugucuuucauuguucuugccaucauugucauaaauucagggaaaucaauugugccauuacuagcugcaucuacuucauugaucauguccugcagcucugcuucugugggguucugccccagggaccucaucacuguccccagcuccuuuguuguuauuuucccauccccguccuugucaaauagugagaaagcgucuuugaacucugcaaucugcucuucagucaguuggucagccaugcugcaaggguuauggguuucugagaugcgaccagacaaccgcucaacuugcucgcuccgcucagacucu

SEQ ID NO: 9473 - RNA, 9711 nt, Mus musculus
gggaagcauucucucuaacagccuggaccaacggguaguugggagucgcgggcagagcagcgucagccacuuagagaguuuuugccgccgacccgaagccaccaaggccagcuucgcggcgcugccccgcggcggcagagaaggcugcaccaagagcagaggcagcgagcaggaguggggcaggcagccagcggugcggcuggggcgcucacccucccgcgguccgggagccacgcgagcuccgugcccgcacgcgccagccccggcucgcgccuuucuuugcguccgggugcccugccucuccgcccacucgccggcuccucugggcugccgcggaccgaguugcagcaugaaucugaggcucugcgugcaggcgcugcugcugcucuggcucuccuugacugcaguuuguggaggugagugcgugcccuccugcucgcuuggggcucucccgaggugcagccugcgcgguccucucuuuccgccccacgcgcgcucuucccgccuccagggaaacauggugcgagccuugcaggagcagccacgcgccagccacaccgggaggccuauugacagggcaucuggggccacggggcgacaugccauguaggcuuugcuuccuaggacagcgcgcgcgggagggggggguguuucaugauuaccuugcauaucaccacuuagcccccagccccaugccccucguaguuuaaaguacuuaggaccacaaacuuacaccuuauguccugcacccugcaccccaaguggggguggggggagaggauggcgguauguccagcucaccucgugaaucaguggagguggcugaccugagcugaguggggucaggacuccauguugaaggucucugggucuuagaguuuaggggccgcuggccaguccaggggcucaagcuacuggagaugaugugccaacauguagacgugacacuuguugcauagucaggagcacgcugcgggagcgggggcgggggcgaccgcaguggcuaguggaucccagcuguugcuccuuuagccuauguguaagcagaggcagcguccuuaaggcagaucuggacuggacagagccaggcuuaucuucuguacuccaagguccuggaugauuuuguucucugcuccauugugggacaccuggccccacagcguucaucucuccggagacuugcuucuucuuuauucuggcuuccccuuccacucuugucucagguauaacuucgguccccagucucccgguaccaaaacccaggaaacacaggaacuugaucugauaaccucggugcagcucugggaaacggaaucccuucaccucuaccuguauuaacccccuaccuggaaauucuccacaccaauagauaaucccuugucuacuucaguccccggguccucagugucccaacagccccugcccggucugccuguccucugugggucagagccuccuggggcugccagcucccaccuucagcugccccaguccugugaucuggcugucacaguagccugccuggcacagcagaaagggaaggccaagaccagguggacaguuacuagugccagggcuggagucacagggaggugagaguggagagagggagugaacaggacagcgaguuuccuagaggaagggcccaggaacuuucuuaguuugaacacccccucuccccaacccaagaacaggaggauggcacacugcccagaagccucugggguucuggccaacucugccugccucuguguagccaccuccuuucugcucuuuuguucuuuggcauugccccgaacucagaacacugucgggcuucucaggaaaguacauuggccugguugaugccuccugccuccaggugauuuccugcaagacccuagcaccgaggcaagacagucuccuuuugaggaagagcgguaaagacuuucuccucagaaauuccugccagccaggcaauggccggaagggagcaaaaacuaugaauaaagcuaccacagcagccugccccuccaugggagaaccuacacagccagugugguuggcaagacaagacaucuucaucauuuaauuucaggccaauagcccaagguggugccuuuaaagaagaaaaugguuggauacagaaaggguaccccagaggaggcuggaccaccugaagcugcauauuuccccagaggguauaagggagacuuugacuagaagauacucugugaacccuuuggggugcagcuguugggguguuacuacuaaauucaugagaugauuucaaggaaguuaaaccggcugccagaauacacuggguuucuggucuagacccugaaacuucuuguccugucuucuccuuuuacauuaauuuuuuuuugcauacucuaaccauguaggcauaaguaucacacuuacauuuuauuaaagacuagcguuggcugcuuccaaagcuccuacuauuuuuccaccuccugaucacuccugaaaccaagaacgacccuuccuuggaguuggccaccagccagagguucagauacacacacgcgcuacuccuguauccuugucuaguaaaaggagcccuagaaucacuugccuugucccucgaacagacuugcaugaacucuccauugccagaguucccaaaguuccagguucuaaaauggugcugcuuccuccccucccgcucucuguucugacuuggaauguucacccuaccuccuucuuugccccuccuccaaccacaaagacuccucacugccuccugaccugggagacacuuugcucugcagagacugagaguuucuggggccucgccaagugucccuuggucucugagcaccacuuucucuccuucuacucccucuugccagcgucugcuccaguaugcaguguaaggacagcuuacuguaccccucccacuguggaggacaucacucuguccccaguuuuaaacucuaggcacccuuggaaccugagccaggccugucgacaggaaaggcuagacaagcggaggucaggcuuuccagagccugauccagagaagcaaagcuggcaguagaagacagcacagugucuuagagaaggucaauguggaggcaaccaagagugcuucauaucccagagucacaugcauuaguacagaguaguagauggaguagcgucaucacaagugggaccucugucagagcuguggguagacuuuuaaagcaaucacuauacaggcuagaaccuaaacaagaagacaagugcaccauuccugcugagguuggcauguuccugaaaaguugcacagacuuucuucuucuuucuucuuucuucuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuccuccuccuccuccuccuccuccuccuccuccuccuccuccuccuccuccuuuuuuuuuccgucucagcaggguuagaguucagguugcaugaaaaucaaaucugcuucuuccccuggcugcaguucucagcuugaaaaugcuauugucuuacucucguggacaagggcuccaaaccucuuggcuugagauucucugggaaacagcucuugcuuccuuuuaagcagaaaaugagcuggaauggcauauugaaguguacugggggguauucccccauuucuaaaggggaaagccuuuuguacagccaggaccucaacagugaugagaaucaauggccucuaauuuguucuuucagacuggacaaagccaggguuucagguaucagcuuaucuaacuagacucagcaguaaaaguaggaaacaagggggugaugggaucagagugcaggaggagcgcacagacuuccugugauggggaagacaaugagcuccagcccgaugggauggcagaggccauacggcuucugggguggcugcuuucccaggccuggcagagccucagacagcucaggguagaucuucucuguaggucuagagucuagacauuuuccuggccugagucugagccacugguagcaugcugcucauccuggcucuugaccucccuuccucuagugcccuucccucaaggccucccugacucccauagacacugacagucucagaccaugaggacauggaguggggugauacuuaaucccuccuggcaccauccauucauacuuucuguaccucuaggauacaauggccuggaccauuguuccaaauccaguaguugaaggcaggggcaugagaaccaaagucucacuguuuuaaaaggcccauaggguccuucucuuaugcauggccacaugcuggacacagugcuuaccaccucauaccugaaaugugucucugcuucugacuuagcaucagcaucacucagagcaacccucaaggcucaggguaaguguugaugagaucuuaaaacugaggacagacaucagcaagaucaacugguaggaaaguauaauggugcucccccagccccuucacagacgguagcaggagagcagcucuaggucagacagaagcagucccuaacccuuaauucuuauggguuauagguuuagagguucaguugacgcacuaacauaacacacuuuaaccaugagugcggaaguguggcaagucaacccuuauaaaccccuggguuuuccuuggacaagaauggaaggguguuguauggauacagaguaugugcauggagacguacagagggcaguauguguaguguacuugucuggcccuaaagucugugcaaagauggcuccaaggacagaccgugcccaauuuucauccaagaggaugcuaagugccuagaaauugugugcaagcugaagaaggucaaggaccaaggggucaaggaaugagcuagaguauggggguguuggaagcagggaggauugggggaaggaggaguaaucgacuggaugcuauaugaacugugaaccagugaugggaauuccuucauggauaccaaugagauuugaggaacauggauccagcugaaggcaaaucagauagugucuagggaacagaggcugguauucauuaucacugagaagaacaggcacuucuguguuucugaaggccacucucauacucaggcauugcauaagcauccuacuccucugccucuuccccagaaccguuuagucucugcacacugucugcuucuuguguccaagagugucucuggguacuagcucagcuuuccuggcugcacugcuggcucuaugagaguuggcaaauguaccuucucccucaucuuucccaagaacauucugcacaacuuggauuccauuguuagggcucaguggcaucaugacuucugcacuaagccagauguaggcagauggagacaggagccugggcgagcauauuagaagccagguggccuuagaauggaaagaguguauaucaaauuuuggauaggaggugugauccagaaugguaaccccaacaacccagcccucucuugguguagcacagugccacgggucacaguucccccacuccuguauuucuuagcuucuaaauuuggucccaggcugaguagaacccagaacaaagcagaaggaguuuguuaagucccagccacacucucaaggaagccuugggaacaaggaaaagccucaaagauaccuaccugcugguaaggugcucaagauggggcagaggaggucucuagcacacagaagugggucagcuaucaaaagauguaagcauggcgugacaugcauuuguuauuugcuuuaaaauauugcagccaagaaaagauagauagauagauagauagauagauagauagauagauagauagauagauagauaaagugaaacauacaggauucuauucaauaacugugaugucuggguguagguccauaaagggacaucagugugagguuguacaucuaaaaugguugaaguacccuaacuauaaaugugucacaaggaauugucccugcacccuaaucgaguauaggcuugauguugcagggugcacccccaaucaugacauuuccaaaggaaaagcuuguuugugcuuggugauacaugauacaacugucugaacauuguaaaguccucaaugguaaagugaguggucgacuugucccagaacaguguuugaaugggacaucuauucaucagggcagaaaagaaaauuaugagggacgccaccuuguggagaaguacugucccuuggacuguggccuccccuacggucucucucaauccaucuuccuggcuaacagacuuuucuugucucugcagugccacugauguugccuccagauggaacaggacuagaagaaggaagcaugcgcuaccuggugaagcccagaacuucgaggacuggaccaggagccuggcagggaggcaggaggaaauuucgcagacagcgcccccggcucucccauaagggccccaugccuuucuaaagcagguauuagagccccuugucaguugguagcucuaaaggggaugggcagcccacuaucaacagcuagacaaaccagggucuuagggcuucuugagagcuaguaaaaguacucaucccauuauagaagagguuacuguggcccagagaaaggcuuaguguugggaccagucuccugacucccucccaggagcuaagugggauuggacaagcuguugucauuggaguguucuggaaguucuagcaggcuggagaggugugccgagggagggugcuacagauagccagugugcacucuuacggggaaaaugggagggcagcagagagccuugggacaguuggguagggagcaggagagcuugaaugguagguguccagagcugugacaagcagagaagaccaaaagguugaugcagagagcagggucuaugcuugccucugaggccuuaccugcuuccaaaaaggggggaucaacuuggugccuugggauuauggguggagugggaaugccuucugucuccucguuuccuaagggauuccuuugaccuaggauauugucuuugauuucucucugguuguuuugucccuuuaggauugaagggcucgccaagugcccucccggugccggucucucuacuccacagaugaauucucuucucuggaacccucacaucuauuuggcuuucaucuugcaccuguucuagcugcugauggucccggcucuucucacccaccaaguuccucuaauggcguggucucgccccucacuuggaugauuucauuccucucacaaggaucccuuuggcccauccuccuggccacucuuuggacugcccuuggagacccagcuucuccuugaccuguuccaugcgguagucccuaucuuucagccguagccuucucuuggcucuucccucuuuucauuugccuugggcacuggacaagaacacucccuucuccaguggauuccagcacauccaugcuuucuuaucaauuggaccucuugccuggaagggagcgccgagaugugcaaugagacuucgguugagagggguuggguguugggguccagauaaggugcacuggggaaacugaauggugggcgugaggaagggguguggcgaaauagcugccacagccucuuccuuagcucucucuggcccuguuaaaggaagacgcaaaggaaaggagcccaugaaguucuaugucaccgugccuucuaaugucuucgcucucucuguucuauugcagcuuguucaguccccaggucagaaggggagaguguggauccugacaugguucuauacucuucuggggguaauuuugccaaaaaaauaaucccaaccaaucaaccaaccaaccaaauaacccacagaaagucagagcccaaaggacccuugaagaucacuuagcucccuuaugcaaaagcuugcacaaauaggcccuggagagggaaguaaccugcuuagagccacugcagagccccacagggcaccagggcccucaacucccacuuuaugaugcccuuuuuccucuugaugauguccuuucaaagcaaaugaagugccuuuugcuggguuuagugaagcggguggcuaggaaggaagagcagggagagacaagccagcugugaacugcuuugugugagaauggagcaucucccucccaacguggcccggaauagucccuaaguggugaaauguaccccacacaggccuauucccaggcucaugccauuuuaauugggguucucaggcacugaaacuaccauuuagccccugacacugguugucaugaaccccuguguugacugcgcccuugaucuuggggcuuuugggggauggagaaaggcaaagaaaggaaggagagguggaagaaggaaggagagaugggaggauguguaggugggaucuaucacuccaccaagggggucucaucucucaccaggagccuuuuguagcccuucccugaagggagacccucaucuucucugccugagcacauguucuucucagaggccucucaggagggagaaaagagaagacagaagcucgauauucacuuauauauguguaggguagggggagucaggacccccaagccccauaauaaccugauugccuauucauccuuucccaaagccuuccuaucugcugcugcuaaugcugcugcugcugccucugcugccguuucaaggcccacccuggggagcagggccaggcauagcguccucaccucuugggcuagaagugggagcuggcuggcgccucuucuacugcugguaccccuaccagggaccgggccuucuccgucuuugucguuucugcaccuccugccuuaucagccugccauggccagccccacagggaaagggaggggggaauauuggcugagaaagaggagagauagaagcacaagaggggaguaaacgggcccagugggcugucuuauuuaaagugguuauguguauuucuuauacuaauuuauauagagauauuaaggcccuuugaguuagagaaacuguccccuucccauaaguguguucgcuauguuuguaaaaauuguuccauguaaauaugucuuuauaauaaagaguuaaaaguugacaguuugcccuuacucuuugaggucauauucaggagggcauucuuuuucuccuagggccaaucuugucccugugcccacagauugcacguguagggaggugagugcuuguaucccaaauugguucuaggucaacuggccucaaacugauuugccacaagcucacaaaaagacucgcuaugcuuaagggccaguucacauaaauuugagccccuuuuaaguccuuuggcaucuguucgaauguccucauuuuucuggcagugucacuuaaaggauuuuuuuuccagaagcaauucauuuaaggacacgcugaucaaaggugggauuuguacuaaacgcuguuuuguagcccuggugggugccuucuguuuuaucugcuuuugaauacuuucgggacuuuuuagccaguuugccuuucuugacaaauguuguccucagccauaaauacauuugguaaugacuuuguauguaucguuuuauuguuucacaaaguggaguugcuugaugaaugagauaaccuggaaaauaaacuucgaggaguucgauaggauu

SEQ ID NO: 9474 - RNA, 1675 nt, Mus musculus
ggguaggaggguugcuuguuacuucccauacuuccauuuuccaggguacccuuggguucaagagauucauaccucucaaauucaaccucuccaaugaucuauuuaaaucugggcagaaauuuaucuuauucuagacuaugaacacaggacuuccaagcaauauacagugugaagaagacugggagaguagaggguuuccaacuacuuaggagaccauguucuucauuguuuuaaguagauggacaguguuaucugcuagugggucuuggcuuucaaagcaggcuccccagggccuccccuuggaaauauuucauuagugaucuuuaacaagugauagcaugcauuucuuuucaaauggucuauccucaagacuccugguucacucugguuacuuguaauuagugaaauuuggcugcucccagguuucucugugucuuuuuguuuuggguuauugcagaauuugcauugaauauucccggggggugaggagagucauugggagagagauugauucagauucgcuccuuucugcugcuucucucucucucucucucucucucucucuuucucucucucucucucaguuugguucuuacaguucaauuucaguuaguucaaaauuagggcaaucauagagaguguggaaguuacucguguguguguguguguguguguguguguguguguguuugcuuuuuuccaaucaaccuguuccccauggggcucccuuucuagucaguacucagcccaucuccacuugugggccaggauggauugcuuuccuuccucgacuuaccucagcuacucuucuguugccccuuagguuggccagaagagcuuucucuuucuggugggaaggaucaaaauggaaaucuuuuaucucuagugcaaaagguuuuugguuuucuguuguuuuguuuuuuaaaucuucucucucucucucucucucucucucucuucuuuuuuuuuuuuaaauaaaccuucuguauuuaagaccuuggccucaagaucugucccauucauaccauauaccagcugggacugucccuuaaucugaguucugaucggaggagagauugaagaauugaucuuucucuggggaaagaggccuuauauuguuugauguuuucaauggcugacacucucuccaacucuccccuuccucuccguuccucacacuuccuaugcacccaccccacuuccccaggccaggaugguuggcaaugauccaaacccucagagggaaggggaaaugcuugcccuuuuggcucuggggcccuccuggcccuagcugagaucauuauugcaucuucugugcccccccccaggagugggguuggauuagagguggauucuaauucuauagaagcucaauuccauucuucucauccugaccauccugcccuuaccccuaaggccccccccccuuuccuacugaccaaaucucuuuaccuuguuugggagaaaaguauuuuguuuuuaaaucuauuuucuaacuuaaaagcaauuuaauauguaaaucucugcacuuuugugugagccuacaaauguguauguguugggguuuuucacucucugguauuucuuaauaaagaaaucuuucuuuuggggggaagccaauuaaugaaggagacuugaaugguuuuagaaauacagggccgucuguuucuuugug

SEQ ID NO: 9475 - RNA, 36914 nt, Mus musculus
uggugcucagaccccagagagaagcuggcuggagcuuggcaggugggcuuguagcaaggagauggguggggggagugggcggagggauucuggagugacguucgaaguagccaaugguaguacgcguugggggcgggauggagacauugugaucguuuagccaauggaggacgagcaacuacuggagcgaccuggugacgugaggagcguuccauuccgccagcggugggcgguugccacagcugguuuagggccccgacuauuggggccccuugucaggaggaggcacccucccugucagggagaagucgcuaccaccucuggcugcugacgagaucccccgggacagugugcacuuucugcccccaguugccggccgaguucagugucccuuguucagguaacaaggggugggggugggggucuccggggcucggcucucuggagggcugcaucccccuucagcuccgccgggacccagggacguuggcaccgcccugcucagcucgccagccacggagccccuggccgggggugacuacacguggcggggcgugugugaguguguacgagcguguggacgcgugugcguguggauguggcgcgcgucccagccagccuggggcgguggucggcugcguggcggaggcagggcgggccuccugaggacgagcccgcugcacagcccuggcuucuggcgcuaagcugcugaaccaggucgcugcuuucugacggauuuuaauuuuccuucucccagguugggucccccuuccuagucuguguucuucugcugggucaguuuauggaggcggggggaggggggagauuguuuuccagguuaguuuuacacaaaggaagugaucuuugcaccucuggggcccccuccccuuucccaagccuuacaccuuuccaucuuguugcuaggcucuuaguccccuuuuggaccuuugcccucucuagcucgggaaugcucucuggcugguuguuucuugcucaucgggcugcaggcuuccgccucauucuugccagcauggggcauguggugccaguaaguagaggacacagcccagcaccugagagaagaggaggaugacaguggcugggaaaggcgaggcccggaaauccaggaugcugaauggagcuaugauacuggugaaauguccuagaaagcccccaagggacuuuucuuagcugcugccaccgcccucagccacccccaaccccagcaucaguugccaaccaucccaggaucucuccuguuuaaggaagccuuuuuaucuacaauaugaugugggcucacaaauguuaaacuagaccagccagaagauuucauuucggacuccagaaguuacagaagguuugauuaggggaaaucuguuuuguggaaauacaauguguguaugcuuccagaaugcccugaacagcuuaccccagccagaggguuacuuguuccuuccugugaguaauauuugaauauugaagaaagaaggagagguagaggagguaugggaagggcuacuuagggacaaaggacaacaacaacaacaacaaacauuauuuuuauagauaucuuucuuuaggugacuaaagaacauggugguacaguagaaaguacaaaggguggcuacuuccagaauuccuacuuauuuccaagacucauaucaucauagcucaucaaaaucaccagcauggguuuagaaacaggauugauuaagaaauaucaguccccucccccucuggagaacugguuuguuuguuuguuuguuuguuuuccuccuuagagaccaaacagagaucagaaauaaaauuuucaaacuuuccugcucuuucaagcagugcucaucuuucugucuuugggaaaugaggguucaguuguauuuugucacucuugucucaacaccuuaccccuuucuuuuucuuagggcucuugauaauguuugacccaguggcaacacuaguagacgaccugauuuuaaagcugaccucagccucugcaucuucucucgaguagucccaaagcccaucuuggaccaggaacuguaaucaugucugugauggugguaagaaagaaggugacacggaaaugggagaaacucccaggcaggaacaccuucugcugugauggccgcgucaugauggcccggcaaaagggcaucuucuaccugacccucuuccucauccuggggacauguacacucuucuuugccuucgagugaguuuucauugaacacaauugucuccuuaugguuaauuuggguccaaggaaugacaguaccuccugggcauuuguggugguucuugcaugauuuuacucuucuguugaacgauaucuauagguuguguuuaauugaauucacuacuuugugguuauaguagaauaugcacuuccuaaaaaggccaagaauuuuaauaucaauuucauaguccugauguggggauauuccugacaaaguuugucauaaaaauucacguccuuucacugacaguaacuuaaugauaaaugacuucuuuucaacccuucccaacucugggaguaacccuuguuguuauaacaccccucaccaauauccacuucaucugcuauucaggguaccauuucuguaagcccuaguucuuaccuagcuguucauuugaaaaccaaacugaguugagaaccugaagauuggucccagcaucagcuguaccacaagggagcugugggaacgccauauaggugcuuuugaaauguggguuguucuuucuuuccaaaaucacucagcaucccaaggcuacauagagaaacucugucucaaaaaaaaaaaaacaaaacaaaacaaaaaaccacugaguauaaaaaaaauuauaaauguucuguguaagccugaugcuagcuuugggguuacuuuuuuaugcaauguuguaccuaguacuagagauacuguuugaagccuguguaggucacugcuccagggagguggccaguuggagucuaguguacuguguacuguggcaugauuacugcauacgcagagaaugauuccaggcuccagggaugggagcagugcuaauuguuuugggauuacuguauuaaggaggaccuugaggaaacaagagguguaugugugucuacugaggccacaccugaugugagccugccaugggugaccuggaaacagauuucucauccuggggugugguuggcagaugccagggggugcuccucaaccaaauggagcugcagcccccugggacucacuuuugccuuucucuaagggcuccaggcuuucgcugugcaucucagugugauuuggaggcuacuuugccagccuuucuaugguugcggcuggcuugaggaacagcagugggaacaguguuauaaugcucuauaacagcgcugguaaaauaagaucaaaugaacucuuagcuaaagguccuuuuguuguuauugccucugacuuuguggacguuuucugugaaguuaggcagguugcugaaggcuucuuaccucuuuucauucugaguuuuauagcucagugugugugugugugugugugugugugugcaugcaccaugugcuuccgugugguacaagugagcaugugcagccagccaggcaggguuaugcauaacacaaaacaguuugcuuuccuucagcucccacuuuccauguuucuccugcuucguuucugcuuuucuucuugaugagagcacacauugaauucugaugucaguuucugucuuuuuuguuccuuugguuccaucuaucucugccauuagaugcuuaugauuggaauuucucaugacagagaugagacuuguuuccaggcuauggcugaguugguaguucuggguccagaaaaucucugcuuuggucagagaaacaugggguauagagcuguggcuuuuuuggccuuuuuuuuuuuuuccuguaccuggaaggcuuaaagagacugugacuuggaucuguuccacuuaggccccugaaggccucugaagaaaacugcccaugggaugaagcgucuaauuagcuaaauuacuguucaacaggggcgugauaaguuuucuucugagaugauucccguuucgaaauuacuccuuggguuguuguugguuuuuguuuuggguuuuuuuuuuuuuuugccaugaagagugaaguuguuuguaaaacugccccgaguuccagcugucugucugaaagaguaaauauuucaaaaguaaaggcugggggaagggagggaagaaggaaguaaauguguuagcuuaggaguggaauggggaaguguaaaucugaccaaagaggagaggacucuagcaaugaaugcuuucaugugaugaaugcuuuuaauaaguaaggcggagucugguguguguguguguguauacguguauaccuggucuaucuguaucacauaugcaggcaaauagauaaucaaaguggugguugccuugugccuauccaaugguaggcuguacaaggcacagcaacauaacugugaagaauagaguuuuuuuuuucuuguugacuagucaauaauuuauucugagucaaauagcagaggguaggauuuggaggacacaguuaagacucuaauguuaguauuaagaugcaaugagaccuaaggaaaccagaucaaugauuuagucccuauuuucaggcaagugaugauaguagcauuugacacuacacuugaucuuagccaaaugaccaagaagcccuagugagcauauuuggauacacagauugcugucuguuuucauucucaaauuaucgguaagccuagguuccauaucaucuggcugacauuuuugccucccaggaagauaguucaaaucucgcuacacaucuggaugugcuuuuuaucaacccgguccuguuggcagcaggugcuuaggaaaaaaauugcgagcagauuuagggcuguguuuggcauaaccacgggucagccagauggcuugagcagccuggucaguccugugggugcccccuucaugaaaauugugcaagugcaagugccagccuugcguuuugagauuuuugccuuuccaaaucucgagucuucaaagugaucugcaauuuucaguggacagguuggaugcuggauccauaaaaugaccuaaaagaccuuuugcuugggagcaguuagcaccaaaucguuagaaguuaggugguugucccucaagauugcugucgcagaguggacagucugugcgaaguuguuaauccucugguagcucugucugagauucuaccuaacugucugucugaaagggcccugaaggcaccaaaggggagugcagauuaccaauaggugcuugucuuuguaguaaaucuauauaaaguuaaaaguggagugaaaauugcgaaacacuuaaaggcaaaguauuuucugauuaauucuggggcugggguaauuagaaagugugugugugugggugccaguuucagcuuucaacccaacgaaugagauauaugccuuucugcucgaauccuuauguuggaacauuauagcacaauaacugugacaaucugugaacuguccagcuacucaaaagcuuuugugauauuugguuuaacucagugucccgaggaaguguagacuuuaggaaaggaccaaacacauugucuucuggagugaacuuguuaggguucucuuuuaacucugcgaccagauuucuaguggaucaaaguccccaaacauuuuauguggcaagcagggcuguaugacccuugaccccuccacagaagugugugcugcuaugcuugguguuugugcucucugcgugcuguauauggaggaaauuguaucaaggcgcugucagaccaauuuuugucagauugguccccaugggugcucuuugaugugcauauuagaagagaagucacugaauugaauaaacuauaaaaaggauuuauaauauugcauaguaauuaucuuaguucuagcgcacccaauauuuccuccuuuuucaaauuccuuuaacuguaucucuucucauuguaccuaauaaucacgugacaugccuuacacuucugaauucuuauuuugauuuuuuuuuuuuuugagcuagggucucacguagcucgggguggcuuugacuuuucuguguagcuaaggauaaccuggagcuccuguuccuugcuuccuuccgccccacugaggauuggcaacccugaucuguguuaccacacccaguuuggguguucucugcuucuacuggguuuacacuccucuuuuguuccauagagcuucaagcacuuucaggcucagguguuaucuccugugucuguagcccccuguggugauccgcacuggaguagguagucaauaaauguugccaggaugcauuuaaaauuccagucucugacucacagaauccuagcccgguagcgcgcuauaaagggcucuggaagaucuguugaaugcucaucucuuagcuauggaauuaggaagacauucaaaugauuauauucaggcuguguguaauggcaagcucaugcuauuaguaggaaaccaaagaugauuuuguggagaacugacagcauucuggugugguauucuugcaggagcaccgugccuucucucucucugagugaagauuucaaauguaagaugcuucaaauguaagaguucuugaagcaucauugccucuguugccacuccuaugccuggaacccaggaugagaagugcugagagaacgauugagcaagaucugcuccuucccuagacacucggggugcucaugacucaguggaaagccgaucugacaacaguuaaacagguuuaaggaaauacagaacugcagagacgaaagccacacuuugacuuuaugugggcgagaacuguuguguauguggccauccaaauggcuguuuuagaauacuaccagggccuuuugauuaucagucggcuacaguucuucuugagacuaggucucauguagccuuggcuagccucagauguaccauguagccgacaaugacuuggaacucuugauccucuuuucucucucucuucagugcugagauugcaggcgugugucaccaugucugcuuuuauguagugccgagguuggaaccucaggcauccugcaugcuagacaaguacaauaguaaccgagccacaucccuaagcugucaacuuuauucuugauaaaguauguucuuugaagacguggcucccaaacacuuuuauuuccuuuaauaauuuucuaugguucauucggaguuccucucuguguuuuuuuuaucuugcucucaguuuuuauagugauggcuuacuuacugucacucugcauuuaaaauguucguuaaaguuucaucuagaugaauacuguccuuucucuccaacccaaagccucacaaguguccuuccuauugagcugcaccccccuacacacacacacacacacacacacacacacacacacacacacagggcuacauucuuucuuuucuugagauggggauuucuuuauguuguucaagugccuuugaacccacgugguccuucuacuucagcuucacaauuauaugggacuguaggcaagaaggagagugagucaguugucuguaccauuugguugcuuuagaaaggguccacuuaggcaagccuggccugcaacuuucuaaguaacucacacgggccuuuaaucugccaucuuucuuauccccgucucccgagugcuacgauuauaggcaugcgccuccaugccaguugagaauggaauuuaauaaguauucagcucucuguuuuggaaaaggugagcgcagaggacaaagcugacauucguugagaagcuuacugagggagagaagagacuucagaagucuuccuccucagagaggccagagcuaguauuguuuaagagugaacaaaggacgcaccuugugucucuugccaaaucaggaagcuagguaauuuaguguaauuagugggaugucucugaauuggagcaaugagaagagaggagccuucuggugaugauuagauaaggcuaguuaauggaagaccuuggcauacuggucuguggacuuuggagccaugcacgcacacacacacacacacacacacacacacacacacacacacacaucguuggcagcagggaauuguuccaaguucuuuguuuuguuuuuguuuuuguuuuuuuguuuuuuguuuuuuguuuguuuuuugagacaggguuucucuguauagcccuggcuguccuggaacucacuuuguagaccaggcuggccucgaacucagaaauccaccugccucugccucccaagugcugggaucaaaggcgugcgccaccacgcccggcugaauuguuccaaguucuuaagcaaggguauacuaugauugaaguuuaaaaauugucauuacagcuaacauuuggcaauuacugaggagauaugccuggguacauacuauguaucuucucuggaaaaaagaauuuuuaccaccacagaauagaaaaugcuuguuugguucacuuuucuccauuucuauugaagcacaaagguuguguauuuuacuuugaccauuauguagcagaaugucugggaggauaauuuucaguuaaguuuuuaguguuaaaggagacuuccucccuuucagcagacucugaguguagcuauaauaaccuugaaacuguguucuggguggugguucuacaugauuauuuuggucuagagauaaagcccuguuagucugcuuggcuugucaucacagacuacuauagacucuacuuucucaacagaauuuuauguuuuccaauucuagaggccagagagccuuacgucaaaguacuggcaaagucagggucugguaaggaccuauaucauggcuuagagguagcugucuucuugcaaccuucucauaccauagaaaggcaaggagacucuuguucguaugaaucauuaaucuuauucaugaagauggagacuuggcuugacauaaucauuucucgagggcuucuucggaacugcagauacuauugaauugggguugggauugcagagugaauuugguggaaacagaggcauucaaugcaugccugggaacuagugaauaagaagacaacuccccacccauaucugggagggauggaaaugaaguguuauuuccaucguguuaggucaaaggguaucauuagucugggauccuuaggcccgucucgcuguuaaaagcacaguucuuccuuaaagccacccuuaacagcugcuauuggaaccguuucaucagccaccagcuccccaagagaguuccuuccugaccacuuacagaccagagucagagucaccauucuaacacuugauuauggcucucaucuucugcuuuugcuguuucauaugguagcuauguuuucccccagaaaauuagcuccuauuuuucuuguucuucaguuguuaggccaauaaauacuuguuggccuauugauugugcugauaaaagaacaaacaaaacauuaaaaauguaggaagaaagcuauuagggacuuagagacagaguguuauguagaacaacccaggcuugcaggcugcgaggcagagcccuaacauggaaucuggucucuuaccagcuucacucaugaaucuauuuugagaauuuuuuuuucaagugaauugaagucugugccauuacuaucauuccuccaacaaacuagcaugcuggggguggggcaugggacaugacgcauuacccuagccuggcacugcuggauacugcuagucaguaccaguguguggcucaugggaacauaugggaauccaguauucuagcccagcuauggaagucugagggucagucaaggagucaggaaaggauauuuuaaaaugauaaugcuccuucagguaucagaaaugaaugcuuagugggcaucugguuuauuuauaaagcaagaauggggacaucuaagcccuagaaggaggaaagccuccuggcacuuggaagacaaaggagacuucuguuuccaugagcauaugaaaucaggauucuaagaaaugauauagcuggaaaguagaagggaguuuaaaaaauauuuagcuucugcuuguagcugaaagaucaagucuuccuggaagacaaaguggugaaguuugggguuaccuugacauuagguaauuucuacuaaauuuucaaggagcuuauuccuaucaaagauagacuuccagcuuucugcaguuaugaaacuauaaaaaaagguuaaaauguuugaaaaguggcaaauacaaacuauauuuauaauggauaacauauuuugaugcaugcauauuuuguagaaugguuaaaauguagcuuuuuaacauaugaaacaagcauuucauauacuuacuuuuuucuggagagaacauuuaaaaucuauuuugaaucauuuucauuuuggcuaugaacuacagucacuauuauuggugguagaucucucgaaucuacucucccuuuuugaaguuauguguucuuugaccaauugucuccccaaccuccccacauugaggaagaccuuuuauugacacguguuucuccguuuugcuuaggauggucuugaacucaugaacacaaauaguccucuugacucaggcucuugaguagcugggacuauagacauacacccccauuccuugguuacgaggcuguuuuuauuuaaauguguuuauuuagaagagagagaccaucauaggcuguaguucacaguagucuuaguugcuagcuccaauguuuccucuuauuuggaguagaaaggccuguuggucccccaucugccuuucuaaccacgcccacacacuacggacaacuggcugccuguagccucucucuggaggagaguaacacaaugagccuguugugugcuuguugacauacagaguggauuguuuuagcaggugcaggagauagucuguauggagauuacagagaccuuuauccuugauggcggagaauaauucaaauggaaguugucuuuugucuagucuacagcagguguugggaugggauuuagucaaguuuugguucuucuuugcagggaccagcagugcuuugaaguucuccuuuggugaugguuuuguuagccccuuaaauaaaaagaaaugggguugccuggugauuaaaagcucuuacuacugcucuugaggaggaucugggcuugguucccagcacccauaugguggcucacaaccagcucuaacuccaguccuaggagauccaacacucucugcugaccuccgggggugccaaucaugcgcaagguccacauaccuacauguauacaagucauucauacaaauaaaacaaaagaaaaaucucaaaagagcaacaaccucccuuccguggauaagcagauagcucugcuguuuuaaagcagacaagacauucauacaaauaaaacaaagagaaauaaucucaaaagagcaacgcccucccuuccguggauaaucagauagcucgcuguuuuaaugccuugaaaaauauaauuacaugauuuuccccuucccuuuccuccuaccaaucccucccacgaaccucccacucccuguagaaauauggccccuuuuucuuuaguuuuuauuguuagaaacauacccacacaccuuguucaguccuuuuaguguuaagauaaccaauuagagggcucuuccuugggcaauuagaggacucuucccuggggccaggacgauuucuccugcucuuagcauuccuuaguugccugcaguucuuuguuuauggguggggccccaugagauuucccucuuuccuguggauuggagacuauucaaggcaguuaguccuggagacauugcuucuuuguuuugaagauugaucuuauagaugaucaaugacuagggagauagccauuuucucuuacuguaguaauuacacuugacuugcucaugaagcaugacuuuauaauucuccuguguccuuuggcucucuggcaagugguggugacuuuuguuucugaauuuacuuuuugauuauguguuccugugacgggaggaauggaaaggagucuacaaacuaguaauaugcaugacccuuaguuacccggaccccacuugccagauccuuuuguucugacacgcucccuccauguccuuuugacuuuuagaagaaaacacguuguuaaaaaagaaaacuuaagaccacgaauuauauuuuaaaacgaauaggccauugaaagcauuuuugcaggguucaauacauaugcucccuuucauuguaaauacugauuagccuaauauaacagugaguucccaacccccucccugugcaguuauguuguggaagggaggcaggggaguaucuccuggggcuuguucuacaacuggagcaaacaugcagccugggguuaaccauuugcccugaauagacugcagcucacucauuugcugugcugaugaaguaagcuuuuucccuagcuuccuuucuuugcucucccuccacuccuugcucauccacuuauagucugcguccagugaugaucucuguuuucaaggagaaaugugccucgggaggagauagauaaaaauaggucagugauacuguucaacacguacucucauucauuccguuugauaguccggaucaacaaguauuuauugauagcuucuuuguucccuuacuugaauggagagcuagcagaucuaaaaucagaugcuaaugguaauaaaggacauuuacuuaguguguauuaugauguaucaaguauccuuuuaaguacuuuuuauacuggugcaucugguccacacaaugaccucauggacuacuauuauuauccccauuuuacaggucagcugucacccaacugggaguugguagaaccagaauuugaaccuaagguuccaggagaccaguuucuuguucuuaugaagucaaguugagggcgguaaacucaacguacugauagagagcugggaaaugcugcagggccuucauagugaagcuacagacgggcaagaggacagggagaauggaaugccacuucucauaggccuuuuguaggagacaagacuucuuuaagucccaaauucuucaucuaucaauaaauauaagagguccuaccuuguagcuuuggugugagucuuggaugaaauaagguguuuaaaguaguuaacauggugccugguagaugguaacuuguaguugccacaaugacagugauguuucuaggaccugaaagauaaguccauuugggauauggagaggaaaagaugcaucaugaggaaagacagaaauagacaugguguugggaaguggugcuaaggagguuucuuaucccaucguugauggucauucaucacccacuagcugagcuauuugaggagaccgaaugaauggauauuacagacucaaucagcagccuggaagcuuuccgcugcucuuaaagcgugcugauauccccucugugugccacugugagccuguuuccugauugucccuauuuuuuucuccucgucaucaagcucagcccuaaugccagaugaguggaugaacagcucugcguggucucagagcaaaaguucccuauagugcuuacaaguccaggcucugguacuucucuguccccagccagugugaaccuuucccgaggcagacacacuguuccuaggggccugauaagaggcaugaguuauaugagguaugaguuagcuuacguguaagggaguucccuagagauuguuuuuguaugccauaggugaccucaaucaaugaaguguguacugaaaauacaauguguucagaaucacauuuuuauuaacauuuucuucauugauuuauuuuuucccuuuuuuuccuuuuuauuagauauuuucuuuauuuacauuucaaauguuauccccuuuccuaguuuccccucagaaaauccccuauccccuccuaccucccccugcuccccaacccacccacuuccacuaccuggcccaggcauuccccuauacuggggcauaaaaccuucacaagaccaagggccucuccucccauugaugaccuacuaucagaaucacauuuuaaguguuuggaauauuuagggggaaguaaauaauguaguauuugcccuggagaucuucuguucuuguuguagagaccagaucgauacaguugcaguagcuggacacacacacacacacacacacacacacacacacacacacacacgcacaaacuugacaaaauguugacuugcuuccuuucuucaggugucgcuaccuggcuguucagcugucuccugccauuccuguguuugccgcuaugcucuuucuuuucuccauggccacgcuguugaggacaaguuucagugacccuggagugauuccucgagcacuaccagaugaagcagcuuucauagaaauggaaauaggugagucugggaggcuguuggcaagcuguaacauagaggguggccacguuggcuaggggguaaugauagcaguuguggauucagucugcuauuccaguuguuuucucugagauccugugacuaccugugacuucagaaagacggguaccacacgccugugaagccacaugugcuuucuugucccaugugcuggaguuuguuacugagguauggcuggauuguugccaagacaaugucuuuuccauuuuugaggaggccaucacacaucaguuugcugagggaagcuguaaaccaucucccccuaaaaaggcucuuuuuuuuuuuuugcauauaccuacaacuuuggauauaguuucagaauuucauagaucuucugaagugcauucaugggucccugaccaagaauuccugcuuugggggugggggcggguugcacaaagugagagagugccaucauggcaccaggaagcacucagaggaguaaagggacagauuucaggcucagaacuauacaguccgcagcucugagauuggcauguagcaccaccaggagccauaugggcuucacgaauuuaaacagaacauccaagguuggaaaggagauauccugggaguucccacugcgaagaagucauugaugcgagcacuagaggcaagcgggggaggggagcuacuagcucagcagcaguggcuacauuguuaauuaaguguuucacaauuuuguuuugacaguagcuugaguccauauccaaacaagauaagaguagaaaaaagugacccaggacuuggucugucacuucuuuguccccugguacuggggauugagcccagccccccaccccacccccgggcaugcuaagcacgugcucuacuacugagcuguaugacaagcucugugacccagaacuugucaugcuaagcauccaugcuaguagagugccagucugugacuggcugcuaguucuuugauguugcccuggaggcugcuacuccuuuguguuuguuucuuugaacuguuuccccuccaucucacgcuuauauuucuuuguggaaaaacucaguuuuaguugagccaagaagaaaucgguuugcacauacaugucuuggcuccaacugcauggggugaggucaguguaacgauagugaguauaauguagaggcgaggcuuggugucauaagaugaacccauacacggaugagaaaguagucuaugaaacaguaauacagcuagagaaaaaagaaaacagaacaaaagaacaauucccccucuaucuugcucuuaaguacuccuuguucuacucccaggucuccccugguuucugccgugaacccuguguuccgugcaugcuccuguacagcacacauaaggaaauauuaaaguggcaugucaacacuuacaucaucuaugaacagcuagccuggucuucucaggccuuguugcacacugucacuguuucuucucacaacaccuaccccacucugcacgaaaaggaaaaauguuccauauggcagaugguuuuaaaaucaaaaccaaugcuuuucgaaugauacuuuguggcaaaggugcagggagcccccgcaccucucauaugcuguggauggagagucaugccaauccauacagucugccugggaagcaguuuggcaauaagcaaaauggcauuaaggguuuguacccuuuguccgacuaauuaaggacuccuuaagagugaagucaagggaauuaucagauauuuaaaauaaccuaccauagaaauguuuuagugugguuuucuuuuaugucuuuaauacaaauacagccauuuugauacaaacaaguuacccccuuuaaaaaggaauuuaucauaaaauaauucuuauucaguguauggaugugugcaugcauuuguuuugcagugguaauugccgguaccacuguguguaugugugucugugugggucagaagacaucauucaggagucgguccuuccauccaguagggaccaaacaggucauuagacuuggcagcaaaugccuuacucagccugcugagcugucuucgcuagccuuuccuccuuguugguuuggaaacauuuuuuuuagagaugcaguucuuuuuuauucucuguguauggguguucugccugcauguauguaagugcaccauguaaauggaguacccacggaggcagcagaggacauuggaucccuagaacuggaguuucagacaguugugaacugcccucugcaagggaaacaauuguucuuaacugaggagccgucuguccaggcccuugaaauauucauuuaauuggcauauauugauuguauauggcacuaggcuucacaggaacacuuuccuauuaguauauaauguacuuugagcguguuccuucccucucgacuuguuuguuugaggcagaguuucauguagccaaggcuggucucuaauguguauuguaccugagucuuuccucaaaauccuaauccuacugcuuauagcucccaggagcucugaucgcacacgugcgcugcuauuaagaaggacacuuuuaauuguacuucucuuugacuuuugcuaguagaauuacuaggcuauagagcauauacauuuaaaguuauuguacuugcuaaugcguuguucacugguaagauaaauuugaccuugcuggguacaauguauuaaucuucuuuuugauauuuguuaauuauaguagguagaaauagugauuguguguguguguguguguguguguguguguauuugagauggggucuuacuauguagcccuugcuggccuggaacuuguuuuauagacuggguuggucugggacucacagagaucuacuugcuucugccuccugagugcugggauuaaaggcauaugaccaacaugucaaacuauguuuuaauuuuauuaaugugauuauuagucaaauagacacuucgauuucacauucuugccauuuuucuuuuuaaaauuuucaaaccaacacccuugaagacacauguacaucacagaguuguauagcauucaguagauguguggcagauaccggguguggugugauguugaaauccuagucuagaaguguuugccuggaaaagaagagcccuuaccucucauggccugcauguuuggagacuuuggacucaaacaaagaauagcagugaauuaaagcuguuuuacugauuacagaagccaccaauggugccgugccacagggccagcgaccaccuccucguauuaagaauuuccagauaaacaaccagauugugaaacugaaauacuguuauacaugcaagaucuuccggccucccagggccucccauuguagcaucugugacaacugugugggugaguaaaaccaaggggacauugccugugggauaggcucagcugaacaaagggucucacaguggacauuggcucuugggaaaauucagugggaaugagaagggagauucagauaggaaacaagguauauuuagauaggaaggaaucuccuacgcagcagcagaucagcuauacucauggagauauggucucaaccaaaaagucuuugauaaauggagaacaauaccuguuugggaaaucucaguuuuccuguacuggauccaaguuggguguggcccacuuuacaaaggaggagaacggcaucauccacuggaaggcacuucugagcaaugccuauggcagaaguggcccucuuuguguucccacuauguacuaggcauugugcugaguacuuuuccuuucucucauucaaggcucauagcaacccccagaaaucaguaucacccccauuuuacagaugaugucacugaagugccuuuguguaaguuuguguaauuggcauaagaugauacuugauucggucugaugcccaagccuuuauuuauuuuuuuaaugucuuugcucuugcuacauguguguaggugugcaugcagaauacaaggucugugcuuccaucugcacauaugggcuuaguuauacauacuuccuacuuugugcugaacuccggagaagaucauacacacauaauaaagcugcucauugauagguauauauauaugugacacugcuguuaucacugauguaauucuaacauuuuauaugcuguauaucaugucugagagagccuugcuuucuuccaacuagccaauucuucaggcaguaguugggggagauguauauuucuuuaugugguccgaauugauacguggauuggauuuuaugaaucacaacuaauuuuaaauggacuaggaaaugcuauuuaaauaagaucugaugugaagguuucaugaagaauccccucuccuuauuaauauucuuaaauaggaagaacucacacaagagauagcucagugguuaguaauccugguugcucuauccagaggacccgaguuugauucccagcacccacaugauagcaucuguaacuuuaguuucaggguaucugacacccuuuuccagccucuguggguacuaggcaugcaucggugcagacauggaugcagccaaacccauacacauaagaaaaauaauaaaauaauuauacaaguugauuuuuuuugugacaggaucucucuauguaucucuaggugcccugaaacuuucuguguagaccaggcugcccuagaacucacaaagaucugcaugugucugccucccaggugcugggauuaaaggcauaugccaccauacccaacuuauaaauugacuuucuaaaaagcacagaugcucuaugaaaaacacaggcagugcauaaaacaggaaauuuacuuaccaaaugacauggaaauauguccacaccuacaaauaaucagagaaauacauauuaaaacuggauguuuuuucaaaacauauuuaauuuuuuccugacaauucccaugauauauacaauaugucuugguccuauccaccuucaauacccccccauucccuagaaccuccaacacaugccuuucccaccuucauggccucuucuuuugauucuuuauaacacaaagguccaguuaaugcugucugugugugcaugggugggugggggucacuuauuaucuggcagccgcacuccuaacgaaaaauauagcuccccacccuccagcagccagugauugccaggagcgcccccacuacagauagagggagcaccauuggucccuucuccauccaugcuggaagaauuguuguuguuguuguuguugguggugguggugguaguuguugguggugguaguaguacuacuaguaguuguugauguuguuuuugagacaggguuucucuguguagccauggcuguccuagaacucacucuguacaucaggcuggccuugaacucagagaacugccugccucugccuuugccuucugcgugcugggauuaaaaggugugcaucaccacugcccagccauucuggauuuauuaaaugacuugauauuguacagauaaccauagaagcugggaguuccugaguauaaugguccuguuaugcucagaaagcagccuucaaauccucuggcucuuacgcccuuccuuuucccucugccaugaggcucucugagccuuaguggggucauaucuauggcccacuuaggccugagcacccagcagucaccuggucucagcacuuuggccaguuauagggaaaaaaccucuaacaaaguugagaacaggacuaaaaauaugguaagaacauggauauguauaaauuuacauuugucccaauguuuuuauaugacaaguuugcuuaaaaugaggcuauuauccauaauucugaauuuaggcaugaugcuaaccacuugagcacuugacacacacacacacacacacacacacacacacacacacacacacacacauauguauauauaucaugcagccuuuuuuuuuuuuuuuuugguuuuuugagacaggguuucucuguauaacccuggcuauccuggaauucacucuguagaccaggcuggugucgaacucagaaauccaccugccucugccucccaagugcugggauuaaaggcgugugcuaccacgcccgguucaugcagccuuuuguccaggagauauaccacucuuuuuguccccaacauacuauuucucuuaauuauuugggaauuuuauagagugcccccugaucaugcucccacccuugcacaccccuccaaacaaaacaaaacaaaaaccacgaguccaauuuuuaugaccuauauccucauuagugaccaguuccuuaacgaaaauggaaucuccuccccccugcacccccccccccccagaagccaucaacugugaagagcuacacuucagugucuuuauucuuaaaguuuugguuuugauuaauauacagcucacuguuguucaaaaaguacccccuacuuuuggagguguuuguguguauauucauguguauaugguugcacauucauguauggaagccagaggauaacugaagucuuugacuuaccaaauuaggcuaucuauccuggcuggccagugagccccagggauacccuugucucucuaccuuucuacugcuggcauuauaaacauaugccaccaugccuuauauuuuuuauaucagccugguguguguguguguguucgcacgugcaugcguguguccuuaugcuggcacagcaaacacuuuaaugagugagcuaucccuccagccccuuuuaauuuauuuuuauuuuaucuugcuuguauggguguucugccuguauguauuucugugcaucucaugugugcccggugcucagaggcuagaagagggugcuggagccccuagaacuggaguuccagaucguugugagcugcuguggaggugcugggaauggaagucagguucuuuggaaagagcggcagguacucuuaaccaccgagucaucucuccaacccucaaccccuacuuuuuaaaaagccaauuaaaauaauaaaugcuuaugcuagaauauaugggugguauaaaaauguaaauuaaacccacuuuguuuauaaaaagggagauuacauaaucuaagagauuuuuaauuucugaauuaaguuuugaugggggugaugggggugggguugagccaagucugcacacauaucaggcaagcacuccacacagguuccaucuccugccuuuaaucuuuuuuuuaguuacaguacaaaauacuagguuccaucacgacuuucucacucauaugucucacuccacucugcucagauuugccccacaagugcuggccaucuccuuuauuucuccaucagucccauuugcuuuuaugucucucuccaacacacacacacaugaaucuugcauuuaccugagucugacuuauuugauuuagcauaaucaucucgaguucuauccauuuuccugaaaaugauggaaugguauucuccuucacagccgagaacaauucgauuguuauauguauagcauauugacucaucuguugauggccuucuagacugguuccauuaucuuggcuaucaugaguacuccagcaguaaaaacucaugugcaaauauaucuauggaggauauauuccauuccuuuggguaauauacccagugguauagcugaauauugcaguaguuuuauuuuuaguuuucugaggaaucucuacacugauuucuggcuguuacauauagaagaggcuuauuuaauuuuuugaguguguauguguguagauguguguguguaucugugugugugugugauauguguagugugcuuauguuccacagacuguacaugcaaucagagaacaguuuacauaugugauuuuucuccuucaaccuauaagucuguuucauggauucagcucuggucaccugguuuguacaguaaaugcuuuuauccucugaaccgucuugguuuuuuguuuuuguuuguuuguuuguuuuucgagacaggguuucucuguguaguccuggcuguccuggaacucacucuguagacuaggcuggccccgaacucagaaauccgccugccucugccucccaagugcugggauuaaaggcgugcaccaccacccuggcccucugaaccgucuuaaugaucccuccccacauuauuauuuuuuuugagacagggucucucauuaaacuuggaccucguagauucugcaagacucacuuuccaagaauucucccaucucugcuucuaggauugcaagcaugugcccccaugccuaaugauuuguuuuugagauuuguuuauuguauuuuacauguaugagguuuuuccugaagguaugugcaucauaugcaugguuggugcucacagaagucagaagaaggcauuggguccacuuagaacuggaguuaaaggugguugugcgccaccauauggauaauaggaacugaaccagguccucuguaagaacaaaugcuauuaaucacagagccuucucuccagccugugucuagugugucacgucagugccagagauccaagacuagguucccaugcuugcauggcaagcacuuuacagacuaagucacccucccgggcugauaagagguuuucuuuuuuaagauuuuauuuuauuuuauuguguauuugccuacaugcaugugugcaugcuuguauaugcagcaugagcaugccuugugcuugcaaaguugagaucuccuagaacugaugguuaugagccaccgugugggugcuaaacauugaaccccgguccucuguaagagcaagugcucuuagucacugaccuaccaaacuguagcuccugcuuagaauuuaucuuauuuugucuguuuuuguuaguuagaucugguuuugucuugacagucucgcuguauagcucugucuggccuggacuucacuguguagaccaggcuguccuaaacucacagagauucacaugucugggaugaaaggugacgaugcccugcuuugcuuuugcuucuuaaaauuauaucccgagcucuuauucuacaucucugugauuacuuuaacagcuauuaucuauuauaaagcuauauucuaguuuauuuagucagucuccugucauuagaugcuauucucuauuauuauaauacugaaauaaaaaugauugagcuccgucaggugugguuuuauauauacuuguaauacuagcccuugggagguuaaaguaggaaagguguguguccagggccacaacagaggauacauauuccacaguucuggagacuggaaaauccaagaucuaggugacaacaggguuucugggaaggcuucuuucuguggcuugcagauggcuucuuccuugcugggcucucgguguuugggguuucguuuuugugugcucacauauuuuuaaugucucacccucuucuuaaauccuagugaauuaaggccccacccuaugacuaauuacugagacagucuaaaaaaaaaaaaaaggaaaggaaaggaaaacuuccuuaauaaauuucugguagccuuugguaccuuucuugaggaaguaucuuuuuuauugauuuagaaagauuugucauaaaaucaggcauauauguguauacauaugguuguuuuuuuucucuuuaauuguuuucuuuuaucguguagagagugagagagagaaugcguuguuuguguguuuguuugauguggguggggcuugugugcuaagccuuguguguagaggucaaaggacaacuuuguggauugauucauuccugccuugaugugagcuuuggggagcuaacucagguugugugccuugcaaaaucagugccuuuggccacugagccaucgcacuggcucucuagaauuuuuaauggauaaaaagucauuuuguuuguuugucuguuuuaugagacaggguuucucuauuuaguccugccuguccuagacuuugcuauguagaccagacuggccuuaaacuugcagaacugcuccugccucugccucgugaguaaaaccuggcuuucuccguccgguuucaucgcauuacuauaucuguucuuugucauuauugggagauugaaauuuguuuuuauguacaacaauuaauucaucuggaauuuauuuuggcaaauaguaugaagggaaaaauguaaccuuauuuucuaccaauuagccuauuguugcauaauuacucaugaaaucauacuucuguuuuauaauaguguuuauuagauggcaaauucuuguauauucuagagauuguuucuguguucuuucuguuucacugagcuaugccaugcagcuuuaagaauaguguauuguagauuuauguauuuaauaaauacaggucaaacaacucacaguacugacuuuucacauuuauuuucugaauuuaguagguccaucuacuaagguuuuuuuguuuguguguguguguguguguguguguuuuuaaagcugggaaaagcaaugccccugcccuuaacugacagacuaacccagaucacuggauucuuuaaagucuuugucucuugaucagucaagugagaggauauuuuuuuaacuggcauucaguauaguuaugaagaucuguuuagucaggacuaaaugacauagaugauagaauagcuauauauguguauccauauuggaauggcuuacauggcugucuccugaugaaaaggccaagaacccagugaauagcagcucagucccugagacuggaugugccagcugucucgguuuggugcuagaauccugcaggguuccuagagaaccucugcucuucagucuaccuacuuaguuuaugcuucccuguccuuuuauguggacagccaucagaagaugugacccagauuuagggugagucuuccuggcucaaauaaucugauuaagaaaauccccauggccuugaguuuucuugauucccgagauuaucaaauugauaugauuagccaucccaagauugaaggaguuaguggugagaacauuuuaauaaagaaugucaucucucagccgggcgugguggcgcacgccuuugaucccagcacucgggaggcagaggcaggcggauuucugaguucgaggccagccuggucuacaaagugaguuccaggacagccagggcuacacagagaaacccugucucaaaaaacaacaacaacaacaacaacaacaacaaaagaaugucaacuguacuuuguuccucucuuucucucucccucccacccucccucucucccucccucccauccucucucucuccuuuccucccaccuucccuuucuuccuuccuuucuuucagauaagucucaauaugaaguucuggcuggccccgaacacacuauauagaccaggcuggccucaaccucagagaucugccugccucuaucucccaggugcuaggauuaaaggugugcccagcuccuugaguuuuuuggguuaguugcugugcguacuguagguaggcuugcuccuguuccaggggguuuagcauugagcucucuuucucucacagagcgcuucgaccaucacugccccugggugggaaacuguguuggaaagaggaacuaccgcuacuucuaccucuucauccucucucucucccuccucacaauuuaugucuucgccuuuaacaucgucuauguggcccucagugaguauacacagcagagacugugcugacaaugggugggaguugggggaggguggguagagcagcuuaagggagguuggauuuaugguggugcaguugcucaaguacuauugucugcucuugagcuaaacuacaagucucagcucacauugguagauauuuacugauuauuaugaccccucuggccaucugcugcuaaaaaugggcccauaauuucugagccacauccaggguaccuggugguucagaagugcucaaaaagguugggcauguauuugucucuauacacccucucauucugucuuguaagauauaccuuuguguuggauaguagaagggccucuaccugcgaguggauugugguauagucaagagauggaacacccccccccccaacaugcuugcaugugcacacacaaagcagcuaaggacagguagaguguggagcuaagcaaguggucucgaaaaggggggagcucgaagcuggauaucacacaagggaggggcauagaugagaaggucuuucuagacuacuucugauuucuuucaucuguuacugucccaccuacaugucuauauuuggggacugggaagaggaaaggguaccuagugcuugguuucucccagcucugguccaguuccuaagcaugggaauaugaacucagucaccagcuugcaggucaaggggaaacaauuuacccuugccccagugggaccuucucucuugccaggguauauagcacaggacagggagaugaagaaguggggaguugauagggauaaauauauauauauauauauauauauauauauauauauauauauuacuaaagucacuaauuuuucuuucugcuucucuucccaauuucacagaauccuugaaaauuggcuuccuggagacacugaaagaaacgccuggaacauauccuccccuggcaguucguccgugugaagccgucugaaauugcuugccagcauguuuucucccugcaguucucccacuaucuaguuuuccagacgucagugaaugccaaagccuaaaauuaccaaguguaguccuagcguuagcaacuagaauggaaacuugucaggacucuaagggaggcuuaccccucaccucucucuuggccccuccuguccuugaaggguccuuccaggcucagccuugacuucucuagauggcugcccucucugccaacgcacacuugugcuaugugcuggaaguccugcccuccuguuucagugaaggcuuauuuugugcaguggcuacguuucugaagaggggauuuagaagggauuuggauaaaccacaucuuguuuccaucccacugauguuuuucauuuauaauguuuauucuuggugggauuuccauuaacagugguggguaacauuguuuggcuuuggcaucuuccgaaauguccucuuaaagagccaaugacaaacaggcaaaugauacacacuacagaugcuagagauuuauucauagugaauaaacagaaaugcauuaucuuucaugagggaucuaucucaugaaguuuagaauucauguauaguuauaugcacauaauuuggcuuucugugguauguguugcgagagauaaagaggguaugacugcucucacaagccccugccuagcccaaggucuccgacauuccuuaaccuaacucacuguucuggaaguacucauuugcuucuucacucucuggucuguuguggggcugacuggauuucacacauuccuuguggcucucaaucagaccaccaaugaagacgugagucaaccuuaucucccugcucuguguccuccucuccacacccauucccuuguuaccugcuaggaaagcaaaugugccuccagggccuggagggaugagacaaauggggaaaaaaaaccugcauugggacauuguuuuauuuauuuuauuuauuuuuuaauuagguauuuuccucauuuacauuucccaaugcuaucccaaaagucccccauacccuccccccuacuccucuaccuacccacucccccuuuuuggcccuggcguuccccuguacuggggcauauaaaguuugcaaguccaaagggccucucuuuccagugauggccgacuaggccaucuuuugauacauaugcagcuagagacaagagcuccgggguacugguuaguucauaauguugauccaccuauaggguugcaguucccuuuagcuccuugguuacuuucucuagcuccuccauugggggcccugugauccauccaauagcugacugugauccuccacuucugugauugcuaggccccggcauagucucacaagagacagcuacaucucgguccuuucagcaaaaucuugcuaguguaugcaauggugucagcguuuggaggcugauuaugggauggaucccuggauauggcagucucuagaugguccauccuuuugucucagcuccagacuuugucuguguaacuccuuccauggguguuuuguucccaauucuaagaaggggcaaaguguccacacuuuggucuucguucuucuugagggacauuguuaacuaaaaggcagacagcuuuguucggagcucuagaacauuaggaagaggucgaaaaguuggcuagacacgucuuuuaacuaguuauggguacuuaaagacuagucaaagucccagugugagggaacacuccuauaaucgcagugcuugcuagaaagacugagacgggaagaugucaaguggaaggcuauucggggcugcauagugacaaagaagcuagcuugagugacauagcuaaaccuugucuuaaaacaggcaaacaacgaaaaggcuaguugguucuucuaaguuuggaauggagaaggauaguuucaccaaaugaauauuuacuuuuaaggaauuaucaacucauauucauuauggauaaugagaaaauauagugaagaaauaaauaaaucccuguaacuuuaccuucuaccuaucacuuuuuuuuuguuuuuguuuuuuugggcuuuuuguuuuuuuguuuguuuguuuguuuuuuguuuuucgagacagaguuucucuguguagcccuggcuguccuggaacucacuuuguagaccaggcuggccuugaacucagaaaucugccugccucugccucccaagugcugggauuaaaggugugcgccaccacugcccggcaaccuaucacuuuuguuaauggcaggauuuauagucuucuauacuugaguagauuugaucuuauguauguacauauacacuauaguuuaaauuuaaguuuuuaaagauuuauuuauuuauucauacauacauacacuguagcugucuucagacacaccagaagcucuccagaccuaaauuuaauguuuauuuaacuuuuuuuguacaguauauuuuggucauauuuuucuccuuucucaacucaucccagaucuuucccaccuccauacccacuugacuucauguucuuuuucucuuaaaagaaagaaagaaagaaacaacaaaauucuagacaaacuaaaagagagagagaacuccaauaugacaaaaacaaaacaaaucaaagucaaacaaaacaaaaguacaccccuguacccugcaagacaaaacauagagucuguuuguguaguccaacucggccugcaugggugggaccugcccuggaguguggugguuauauccagugacacuccccagcagguauccauggcaaauagcuucuugguuagugcuagaauugaguucuaccccuucucugugcugggauucugugcagguuguguguaugcucucacagucucugugaguucauauguacacuguauuuuaaaauauaaauagacuauguacauuugucuauuuuaaaaacucuuauaaauguuuuucauggucaacuauuucuuuccuuugcaaacuaaauguauucauuugugcaccugugcaugcacaggugcacuguggacagcagaguacagauugauucucuuccuucuaccaugugggucuugaugacucggcccgucaggcuugguggcaagaguguuucuuuauccacugaauucucucccuggucccuauuuuuuuucauuaauuuuguuaaaaaauauacaucauaaggcauccauaccaucuuagccauuuacaauuuuuuaaaaauuuauuuuugugggauuuugagacuacucuauggacuagguuggccuagcacccagaaucccuuccuuggucucccaaguucuaggcuuccagggugugugaccucuuuaacuguuuuaaaggaacaggucagugacagguagugcauucaguuuauuguguaauuguugccucucgcccuucuucauuagcccacacugccuguauuucuucgacguauuucuuuuucaguguaagcccuggcuuuuaucuugcagaucaaaggaucauggacagggaagaaucgugugcagaauccguacagccacggcaacauugugaagaacugcugugaagugcuuuguggccccuugccccccagguacucaagcaacaaaaccacccuggacucuuaagcugcacuauucaaaccucuccccaugccugcccugcugcauucuucugcauggaacuuucugauaucaaauaggucuuccugggaguugucacagggcaccacaucuccaugagccugagccguaaaaccaugggcuggcuguuucguuuguucccugguuaaugugacauccuccaguguguggaagaguaaauggaagacagaugugugcuggggucaggacagauugcugaaggcauguuggugcuuucugauguacagaccaagguuuaguggggacugagcugauagaagagugacugucaaguccuugauucauucuucuguuucuuucaguguccuggaucgaagggguauuuugccacuggaggaaaguggaagucgaccuccaaguacucaagagaccagcaguagccuguugccacagagcccaguaagugucacggauuuaugcuguguaggugauagggaccguauaggcucacucgacagcuuccaaauauaacugugaucucuccagcuuccccgucucugauugugccuugaugcugccuucagaucaguguauucuugacacagauuaagauuuacgcauuucuuagauacauauugaucaguuauuuggugccaacuccuuucauaggugcuagggauccaucagugagcaaguggaaugauguccugcccggagagcauugccugucugcugaagaugagggauaauaaugcagagcauugcugugugccuggacaguagcuugauuacagaaacagaaaaugguauagaggccaaacuacggacagagagaggaacguguuagaucuaggucgugauuugcuuacguugguagacuauacacguguuguaagcauccucccaggcaccuuggucaacauauauuucauaaaauauguuccuaaaauaugcuccuucuaagaucuuuauugagauacaaugaacauaccauacgaugucuauuuaaaauauacaauuccuuauuauaugcuuguaugaucaauauuaaauaaaaaauuccucugcauuaagaaaccuucucuaucccuccaagaaaccauauauauccuuagcaguauggucuggggaugaaacccagggccucacacauaccaaugagcuucccaggccuaggcguaauacuuuuaaugccaaucuguguuauauguggcaguacuucacuccuuuauauggcacacucauauccuaucacagggauacacauauuguaucuguccacucacuguugccacauuuuguguuuuuauuucuaaaauuuuauuugucauuacuaagguguguguuuaugugguaugugugugagcauagcacauguguggagguccggugacaacuuuuaaagggucaguucucuugucucgaggugaguuacagagaucaaaccuaaguuaucauguuugcuucgccagugacuuucccacguuuuuggauauuauaaguaaugcuacugugagcaucucugugcaaguuuuuuuugcauggacauaggcuuucauuuuucuuggcuguauuccaaagagugaaagugcugagagaguugguaacuauuauagaaauuaaacauuaacaucuuuugggaugcugcugagaugcuuucuaaaguuguuggaccauuuuucauucccacuagcagucucugaaagauuaucagaccauuucuauuuuagcuucuguagaugugaaguguuaucucauugcggcuuugauuugcauuucccugaugacuaaugaugcauauaucuuuccauaugaauauuagucauuuguauaucuucacaagggaaauauuuauucaaaucuuuuguucucucucucucugaaugugugugugugugguagguaggugggggggucagagaauaacuuuuaguguuccuuaagugccuuccagcuuccuuguuuuguuaguuugucuguuuguuuggcuugugugcuuguuuguuuguuuguuuguuuguuuagcgauccucucugacuggucuggagcucaccaaauagaguaugcuggcuguguaucaaaccccagugauccugccuugucagccuccccagugcugggguuagagaagcaugccaccacucuuggcucgccccaacccuggguucuaagaauuaaacucagguccucauauuuaacccagcaagcacuuuacccacggagucaucucuguagcccauaugugcggucuuaauguauaucaauugcucuuuuauugcuucuguuuuggugccgugucuaagaaacuguuaccuaauccaagguugugaaaauguauuccucuguuucuucuaagaguuugguaauuucagcuuuuacauuuauauuuuugaucuguuuuggguugauucuaucuaugcaugcuaagaaguaaagaacaugcauuuauuuaguuauuuuugucuguggauaucugcuuauuuuucuaucauuuauugaaaaaucugugcuauuaucuugacauucuuguugaaaaucaauuaacuuaaauguauguuuauuucuggacuuucaguuacaguauguugauuuauaugucuguucuuaugccuguaguacacugugucuguugcuuuagcacggaacaaguuugaaaacaggaaguacuauuucuucagcuuuacucuucguuuucauguuuguuuuuggcuauucuugguuccuugaaauucuaaauggacgucaggauuaucguaaagcuuuguaguuucugugaagcagccaacuggaauuuugacagagauuacacugacuauagaugaauuugaggacuguuguugccaccgcaugcuuucugagccauuaacauggcaaucuuuugcuaaagguggagcucagugcuaugguacuugcaacacauccacaugcucaugcacaccuacacacccacaugcacaccuacacacccacaugcacaccuacacacccacaugcacacccacacacccacguguacaccuacacacccacaugcacaccuacacacccacguguacaccuacacacccacauguacaccuacacacccacauguacaccuacacacccacacacccacaugcacaccuacagacccacaugcacaccuacacacccacauguacaccuacacacccacaugcacacccacacacccacaugcacaccuacacacccacguguacaccuacacacccacauguacaccuacacacccacgugcacaccuacacacccacauguacaccuauacacccaugugcacgccuacacacccacauguacaccuacacacccacgugcacaccuacacacccacaugcacaccuacacacccacaugcacacccacacacccacaugcacacccacacacccacaugcacacccacacacccacauguacaccuacacacccaugugcacgccuacacacccacauguacaccuacacacccacaugcacacccacacacccacauguacaccuacacacccaugugcacgccuacacacccacauguacaccuacacacccaugugcacaccuacacacccacaugcacaccuacacucacaggagggagacagacagauggggggugugguggggagaaagaacauaucuguucccccgacuguccuuccugcuucugugucaugauauaaugggacacuugcucucugccagguaggaagggaacccuuaccaaaaagcuugggcugccuuuguuuguuuguuuguuuuuaucuuugcuuucuuugaugcuguagcuuuaaauguaucuucuguugcguaacuauuuuguucuuucugacauuuauguaaaugaaguugauuuccuaauuucauuauuuuuugcaucacucauuagggcguagagaaacauaauuaaucuuuguaaagcagucauauucugaaaccuagccagacauguuuucauucuaauagauuguuaaauuuggacuuuauuucaaaauagaaucuuauuuuaugugcauaauuuuuguaagguuauuguccucuuucccccuaaguguucucuuugcuuuugaagggacagcaaguguguuuauguguuauuguugucaucuucaguaucauuuuucugaugagacuggucccaaauaagaacaguauagguuagugcuucucgguugcauaucggagaagauguauuuuagaauuacuuagcaggggccuggagagaugacucagugguuaaggacacuggcuacucuuccagagggccuggguucaauucccaccacauacauacaugauaggucacaagugucuguaacuccaguuccaggggaaucagucuaacaccuucacacagacauacauacuggcagaauaccaaugcaauaaaaugaaaauaaacauugaaaaaaucacuuaggagacauuuuaaaccauaugcaucauuugguuuggacuaaucaauucucuguuaggacagaaacaggauugaaaaccauugggucagaccuuguuaaguaagcacaguauaaaauucuguuguggugggugugcuugcauauaauuauuuaugguuuauguuauuaucauuauuuauaauaguagaaacaucuguccauaacaguuaagaauaggccucaaauaagcugcaggugcauucugguucagauggugagaaccuggucuagaguccaaguuuggugaccuuggcugaauaucuuuaaugucacugugguugaaaguuuucaaggaagaauucaaugccuuugaauaucugcauuuagacuucaagagagagcucuguguugacucugguaucuuuuacuucucaggccuccacagagcauaugaacucuaaugagauggcagaggacaccagcauuccugaagagaugccaccuccagaacccccagagccaccacaggaggcauccgaagcugagaaguagccucucuauggaagagacuuuuguuuguguuucauuagggcuaugagagauuucaggggagacaaccaccugagacagagaacaaaugagcugucccuuauuacuauuuuucuuuggucuuuagucacccaauuaccggcaucuucuugcugcaaacuuuuuuuuuuuaauguuugaacuuaagacaguggcagaagaugccagucacaucuggcaacuggacaaaugggucucuugggacauggcacugguugguuucccauugucucagccacaagguauccuuggacuccccuccucuucccuccagauccuagcuccccugcugggggucauuggucucuuucuggggcuaaagagucucaagacugacuccaguccuuuccagcugcugcaugucccgaguccagaggcagucacagagaccucuggccagggaauucuaacugggcucuugacuccuucagaacuaaggauuggagagggacgcuggaggauucuccuggcuccaaagugccagcauugccagccaauccuuuuaggaauagggcagguaccuuccacuuguauuuauuucuguagcuucucuuuucuccccccccaucuacucucuaacauccaaaucccacucuuucccccauuagaugcuauacguaaguagucaugguagagauaauacauuucuccuacguucuccagaaacuucaaugccugugcuauucucaauaagcauugaugagaugccaacaacacagccccucacacucucugucucaucuccccucuuugcucaugaguccacuuucauuuucuccuuuugacuccugcuucagccgggagcaggacuagcaguaauaaaagucugcacuuugcugguuucuuuuccucaggggaagccugagugcucacuuaaacacuaccccucagacuucuuguguaaggccuacagaggccgugaaugcacaaauggggaagccaaggcacagagaggcucuccucuccucuccucuccucuccucuccucuccucuccucuccucuccucuccucuccucuccucuccucuccucuccucuccucuccucuccucucuucuccccaccucuccccuccccucccucaucauccccucaaaacaaaagagagagaaaaaaaagacuaaucaguacuuccauuaagccuuggcugagugagggaaagcccagcacugcugccccacccuccggguaucccgcuccaaggccucagcccaccucuggcaacgguaaccacaccaggggcuucaucuaagccccugcucuuccagcacuuccaccggcagagucccagagccacuugauccuggggguggacugcagccccccaggcagcucugcucgggaccugcacuauuucagggaagaagaacuauguauuauauguggcuauauuuccuagagcaccuguguuuuucucuuucuaagccagggucuugucuggaugacuuacggggacagggaggggugcaaaccacgacuuuuaaucuauuugaaggcgauuaaacugugucuaaugcaagau

SEQ ID NO: 9476 - RNA, 8637 nt, Mus musculus
ugaaaaaaauaacuuuauuuaaguaugaagugaggcuagcauaguugcacaagccuuuaaucccagcacuugagaggcaggcaggcagaucucugugagugugaggccagccuggucuacagaaugaguuccaggacagccugggcuguuaaacagacaaauccuaucucagaaaaaguagccucugcccuuuguuuguuuguuuauugagaacuugggguaaucuuuccacguagaguuuacuauacagggaagugaagccccguccuggucauuagcaguaaccugggaaauaggacccuguuuguucguauuagaauguauuucaugguacccagcacucaguaguugcuugacaaauacuuguuaacuaagaaacuuccaaguuucaucucuggcagcuugauucuuuuucuguccccuuccuucagauucuaccagccaggagguauuaucugaauugagggcauuaucuaagaaacucaguaaggaaaaccaucuaucuaagaaacaaaaaaagaguccagcaaaggcuguugaccuggucugggaagaggaaccugccccagaggaagaugagccucucuugcugcagaggccagagagaaugcgaacucuggaggaacuagaagagcuagguaaagaggacagccuuccaaauaaggagcgcccuagaccuucaguagaaggggagcaggugaggaggaacccacagaaucacuccaaggggaagaacaagaaggaacaaaugaucagucuacagaaccuccugacuacaagaacucccucugugacgucacuggcgcuuccgacaacaguagaggaguuggugagcaagagccagaucuuuggcuuguggugggguaguugacaguugaacagaacggguccuucuuacacacagcacagucaguacauguugguuuugcuggaauguuuuucaggaguuaagagguacagaugaccauggcaccaugcugggcccaaguguagauauguggacacagcugagccacacgugcugccuaaauccugagccacuaaaguucuuuggggugacucuaaaccugccuucaaaggagaaggcagucacugaaugcucugguuggauuccaggcacaacaauucaaagaucagugauugaucugccaaagcucccuucacuaaauuccagcacccagugcucagcacuccaccccaacuccaaaucaaguaauuaaaacgaguaccuaggaagacaaggcacccugucugcuuggguauuuaagcugcggcaaguccacauucuggccaggaccuuggaguucuuguuacugacaccggccaucauuucugugacccuaaaacuucuuguugaaaguuucaaauugugucaugaugacgagcugaggauguuuacccuagaaagaaagaaaaggaaauuggaguaugauuggcugauugguuccuauugagaauugaucauccuuuccacacuuaccccuagggggcgcuaagaugucauaacccagguuucugucuugucaugaaguacucuugaagacaaguuaaaguucuugcucucauuucuucccaggaagaugaaggggcaagagaccaaaagcaaaugauaaaggaagcuuuugcuggggaugaugucaucaaagaguuccuaaaagagaagagagaagcuauccaggccaauaagccaaaggcuguggaucugaccuuaccuggcuggggagaguggggcgggaugaaccugaagcccagcgccaggaaaagacgccgguaagagaacaaaaaaaaccugucagaagagcacaguuccccgcucuccccgaaguauauccccuaagcuuuugacuaaaauacucccuuuacuauuugguuuccagguuucuuauuaaagccccugaggggccuccaagaaaagauaagaauuugcccaaugugauuaucagugagaagcgaaacauccaugcggcagcucaccaggugaggguuagagucucuccacugucuaagcuccaccgccagcucuccuugcuugagagaacuauuuuagcaucaguggugagagggaugugugauacuugccuuuuuugguuuguuuacuuuguuuuuuuuuuuuuaauuuuuuuuuucuuuuuucuuuuuuugagacaguguaaccccaggcuggccuuggacuccaaauccucugugcuggcucugacccauacuuccagucccuaauuucagcaccccuuaaaaacuaugugucaccauaccuggccggcaugucugaugaucaccaacagaucaaauuugacuuuuucacugccuggccguuagaagcgaagccaggcaggcugugcuauucuaacuccugaccaggguuagucugaaaggaaaaucuuugcaagcaguaacaaaacccccaagucacaauuucgguugacauccccagauuauugagucuugucaaaguaaaaacucaccauucugcagcaggcuuguauuuguagucaagggaacaagcgauagcaaaccaguguucaaaaaagaaaguauucuaaguggagucacuuguuaauaagcaagggaugagcuuuguguggugacacccaccuuuaaucccaacagagucagguggacuucugaucuacaaagugaguuaguucuaggacagccagagcuacauagugaggcccugucucaaaaaaaguuauacuacuaauaagcaagggauguuugcacuacagccggaaacuagacagugauugugauucccuagauaucacaagcaauauggaacacucuuggguacagucacauaaaguggaaagguuagaaaauaggcagaagauccagagagaaauugggaugcucuaggacugagcaugugacccaaaugacauugaacuccauagccuguguguucccgucaguccuuauuauguuugccccucgugaguacaauauugaaauguauuauacuugcccauguaaaagaggaaugaacuauguaauggguacagagcagagaugagugcauuggcuagaauacuugccuagcaugcacaaggcucugggcucaguuacuagcacuguguaaagcucaacaugaccacaccucagcacucuagagguggaaauaagaagaucagaaguucaagguuggcuacaaagucaguuggaggcuagccugagauacaugagacccucucuccaaaaaauuguaagauaaccauucagucguauuguuugaucuuagcagaaacugucaucacuauaaucccagcugagaauguauaacgagacaacuggguagggaaggaauccccugugaggacugcugcaauggccacgcaggauaguguuauuuuaaucugcaggggcccacauuggaggaggagacugucccaaugggacagcuaaaaggaagaaucaggcauccuuucuagagcucaucccauggucauuuacuguugucacagcaaauugugacuugauuuccaggaaucucuugcuuuugauuuguuuguuguuuguuuuagaggggaaucuugugucuaauguacucaggcuuugaauuuacuauauaccuaaacauggccuugaacaucuguucuuccugacucuuccccaguucuucuuuuuuuuuuaagauuuauucauuguuauaucuaaguacacuguagcugucuucacacacaccagaagaaggcaucagagcuccccacggaugguuaugagucaccaugugguugcugagauuugaacucaggaccuucggaagagcagucagugcucucaaccacugagccaucucuccagccccucuucccaaguucuugaauuaagugauccccaacauccccaacguucuuuuuaauuaauuagcucagcucagcgcuucucagccuuccuaaugcuugugacucuuuaauacaguuccucauguuguggugaccuccagcuauaaaauuauuuucguugcugauucauagcugugauuuugcuaauguuaugaaucauaauguaaagaugcgauaugcaggauaucuguuaugugacccauggcaaaguguucuucaaccccaaccacugaauuaucuagguacuguaggagcaauagaaugaaguauuacgagacaggggaggacuccugaaacugaacuuaucuuucaacccaucaguaacauauacagaaagaacaucggcccaaacaaaagauuuccuuagccuaaagggaaaggaagccuuuuucuuucaguacugggguuggggaagucuuccuagaagguaaguacucugcuggaacggaacucaagacaagggccaggagugcaaggguucuauucucucacacuacucuuacuuuauuuggagaaaucacuuccccuuucuagaugccuguuagugcuaaggggguauuaucugccuggggcaaccagcucugcauccucuaaugccuuaagaggauggagcugagcacaggcaccuggaagcauucaggauucagauuuuguuuguuuguuuguuuuucgagacaggguuucucguguagcccuggcuguccuggaacucacucuguagaccaggcuggccucgaaaucagaaaucggccugccucugccucccaagugcugggauuaaaggugugcauccccaugcccagcaggauucagauuuaaaacaucaaccauaaaaaggaguugagucgagcaugaugguacacgccuuuaaucucagcagucaagaagcaaagguagaggaaaguagaucucuagaguucaggccagccagggcuccauagugacacucugucuccaaaaagaaaaaggaaggaagaaaggagaaaauagauagcauuaagagaaggaucggaauccauaaggaugcacaacuauuccggggcuucuugcagucacaaguguuguauagaagcacccagugguuaacagccuugaaacugguguggccagacagaagugcucuuuuggguuuucagucccaaaaccguuugcuaagcuugagagaauagguaccaaauaacuucgaacaguuuacacuccuaagauuguaugagaacaguuggcuguuuuggacucuuaaaaagcuuaccccucuaugguugucauauaaaacugaacuacuugguacaggcuggccuuaaacuugugauccucaugucucagccaugcaaaugcugagauagcaagcaugagccacugugccuucucuaagcugccuuuagaguauugcacccuaggccuuacacugaaucucuucuuucccugccaggugcggguccuuccauauccguucacccaccaucagcaauuugaaaggaccauccagaauccuauaggauccacauggaacacccagagagcauuccaaaagcugacugcucccaaggucguuaccaagccaggccauauuaucaaacccauaacagcagaggauguggauugccgaucuuccccaaggucugacgugccugucaugcagagcaauccaaaacaacacuccaaacaucaaaaacaacggaagaaaagcucuauagguugaaauaucugaggaguguccucugcauggucuaugcugcaagaugaauuccaaaacugguuuaacacuguguguguaguuaagccauaucugagaaauaaaggcauuuuuuuuuaccuuuauaacucgacuaccuucuguauuaucuauuucccuguugaaucuucaggggaacuuccuuucauuaccaagacuuguuagcuggucaugaaaacuaaggaaauuaucccaagucucuaguuucacauauaucacccaucaaucaugauccagugugaauaccaacuuauaaucagggguugagaaaguacugugugguuuaaccucugaaucuagaagcauggacaaaccacagcuggauccuacccuugauugaucauagaaccaagcugaagggagaucuaaccccgaggaguuguaacuuagcuuuuugcaucugugugcuuuccagcuuguucagguugcuguacacagugucauuuggagauguagcucagaggggaauuugguuuccucugagaaauaaacauucuauccuacaggaaguuccccaaacauuaaggcaacaacacagaaaagcuucaggaacucccuaaaacugauuucagcccuucagcacacccuccccaucccccagccagagcaaaugauaaaagcugagaguccacagauggagagagacaagcugcaaagacuaacuuaagcuagaugaucagcugccuggaagagguuuagacccaccaaggccccuggaagggacucucuccagcauguugagcugcuuucuggcagugcagugugcuccagguccccagcauugugagcugucacccacccgugcuuugguaggcuuugguaauacagcuggguuucagucauuuugcuccuguacacaagcccaauaaaacucauugguucaccaaguugaacuuuggugguaucuguacuugggucucucuugggcuuccugucuggggugagcagacuugugucuccccagaaaggauuuuuucuuacaugacaaguguaccagccuauauaccuacaaggcccagguuugauccccccccccccccagcaaccccuaaaaguagagccauggaggcaugucgacagaaagcugaaagagcaguaucgguuuuuuguaugucuucauaguaacaagacaggcuuuuuccucacuuuacagggacacguaugcaaucucagaaguaaacguguuuccuuucuaacucacccagccaguuccucaccagggauucaagcaggauucagccauauggucauuaacgcggacuuuuguauccauggguggcaggcuggugguguaaugcaguggcagcauuagugcuuagcaugcccaaggcccuaaaccacgcugcaccucguguucucuaggggagacucaccccucagaaccuuaucacaagauccaaacucagaauaugcuggaaggugugaaccccucugagacacacuaugcuacgguugcagcuuuagaccuuuagaucaccgguccuauugcuaccaugguuuugggucuuuacaaccccccacccacccacccauuccaucuggaccucugucaggcaugcuacuacucuccaaaugaauuccaaaaugguuagaccuccagcugccuaccuaccaauaccuugauuuccauacgauaagauuucagagaaugugauaagucccauguuacauggugaaucaggaacuagaaccuuaggcuaacuuggaagucaaaagucauacaauuuuuuuucucccagaauuucugagugguaacugugugugcucuuaccaauaguccucaggaaguaccugggacuggcugucaagggaaauaaauauaaugaguaguguucaaugcccaaaggacauuuuuuaacuuaugcacuggcuugagauuguccauaauccgcuccgcuagcugucacuuaaaucgguagccagugaaggggaaugaggaaccucuaccuccuccugccuccauuuaagauaccucaacauucuuucacucuuaagcacaaagcugccaucucugugcaaaccaguucccaaaucgaagcaccaauaaguggacaauuccgggucuacuuucucgggacccuucugcgcgauguuugcgccauacaacacuaaagugaugcaagccaccccauccuucgaaggcgagggcagacgcuggaacaugacauaaacgacgcccacuccccguuuuccaagcccccaaacggauucaauuguuguuucguggggcucuuuuuuuuuuuuuuuuccuuuucuuccuccgaaccuccgaaguguucuuccuuccuauuggccaaagcugccccuugacgccaccccggcuuugcuuacugauuggucggcucuggaugugcccaagccuuuuucccaggguguggcgccccccucccgcccccaacaggguucugaccccuggcuccucccuucccccaacccccccucccguuccgaaugguaccgcccuggcucggcucccccauggcccggccgcugcccuuagggcccccggacggggcggggcacauuggggacgggcagaaggcggugguggcgccuuccugccgagcccgaagccacccccgccacccuucuacaacccucuuagguuccacuuucccuugagcaguuuucgcccuccuuaguagcccugucccgucuguugcagcccccacuggucuuuuggucaucccaaagggcagcuuucaaucccagcccuccgcgcuugauacacgcccaucagccuccacccuuggguucucgaaaggcuuucuccccgagucuguacacccuuccccuccgggucccucuuucuagcggacuguccauccauccccgggaccucccucccuguguguggccguuccucccagcggccuccacuucacgguguccccuccccuucguggccagcgugguggagcacuccugcccccccccuuucucuguacccccgcgcucucuuaugcugucccuucacgucccacucuaagucccucccacgccauuccccccacacacacacucacacaccccucccugcgagucguccccuggcgccccucc

SEQ ID NO: 9477 - RNA, 66694 nt, Mus musculus
cgggagcccagcggccugaucccagcacccccccucccgccaccucccuccuacucccgcuucgcccgcuucccgggcgguguggagaagagcaaaguugcgacagcagccggggggcucugcccaggugaagggggcgcugugacgggggcgggaacggcguggcccugcggcgggggcggggggggggaggauaaagaaacuugcuuuucgcagcccccacccugcgcggguucggaucuugcgugauccgagcccucguggagacgcugcaccgccgccaggaccgaggccggcaccccgagccggacucagauagggaccgcgcguuccggcgggcugccgagggcaggcaggccggcacccgggcaagggcggggugggugaccgugcaccggaccgaaccgcggacucuggcggcgugggcgcgggacgaaccgggaccgggccgaguuggguggcgaaguaggacguggauucggggggcggggcgcagcgggaggggggagagcaggcccggcccggcuggccugggcguggggguggggggcgaguucggggcacuugcugggcucuggaccgagcgcuagggcggggcggcgcuaggggcugggcccgaccgggaggagagggcgaggggagggagagcaggggguggaguaggggcguggaguugcaagcggggucuggccucggccgggggcgaagguagaucugcggggccgaaagcggagggagggaggcccgaggcagcgcggcggcagcggcggcggcggcggcggcggcggcggcggcgguggcggcgaaggccagcuuccgcggaguuugugcccgggcuucccagcugggcuccggucgccucccgcgcacaaaugggguuaggggacugacugguaagcaacucccgguguuggacgggcuucccaggcgauucccggaaaaccgagggaagacgccgucugcaauaugccgcaccccaccacuccaccucuuagcaucuggauucugcucuucggggucgguggacccuuccccaccacaauccuuccaaucuuccagcaccccuuccgucucccucuuauccuuggccaucuaaaucuccuagugguaugcuuuggagggguggaaggcgucgagggcugcacuuucccucccuugggggcagccuaguuugugucuuauuccugccagguaauguugcuuggcaugguguggaccugggguuuagauaauuuaagccccggauccaagcuuuuuugauggcuuuuaaggaaagggacggaucccuggauuuucaugaccagaaugggguuugaggacuggaguuacucucagcucacuuccaguaccaaccucuuuacuaugaaccauuucugugggggcucgaacguggagggugggauacgggagcauuaaugugcuuugcuucucuguguuuccacagggucagcguggugaaggacagcuagugucagagggaaaguagacacuaguccaacuacggccgcccccacuaauacuucgguaagggggacacgacuaaggggaugcugguggguuggggcccaguauaagaguagagguggguagucgcccccaggacucuuuccuggcggggagagaaaggcgagccccuacuucggggaggguuccggggaaggagauggaggguggcgacuggggggggugcgggaagaauggaagagucacacccugcuugcaaggggagccucccuuaggcuccugggaaaaggggacugaauacgugugcucugugguaccagggcaggggagaucuggggaugguucaaagagugauuugcacacugguucuggcacuaguggccugagaaagucagguuggggcauaagguggagaauguuggaaggaaggcagacaaccaagccucuggccccagugcccagaucauuucccuuccucaaccucccuccuaaggggcaucgggguggggggcguggagcucuuggagccccgcggauugagugccuccgccuuucuugggagucuaucuuuuugcccagcuugcuacagcuaccacugccucucucucuggaaucugcucgguucucucugcgauccccuccuccuccuccuccucuccccuccccucccagugucaccggggcugcuuggcucugcccccuucgccgccgcuugcucccagcuuuagucccuccuucucaugcuugcucccucccuucgccuccuccuccccauccccccccucgccaaggccgcauucugggaguuguagucucuugcagcgcuggcaggcgccgcccgcgaacaaggcuggacucgacuucccgucgagcccugcgaccggcacccacuccaccaggcuucgcucacacacacagacacacacacacacaccgcucucccccucacucuuucgcucgccgcggcgcugccaguguguggcucugucucuccuccgcuuugcugagcccucccuucuuccucucaguuccuagaguccgaccgccgccgccgugagaggagaaggaggucgguagcgauaaggggcggaggggggcaucggaugccggcaguguuaggcggguggugguucaaagagggugagagggagcucggguggcggccugagccucccugcggagccgacccgggaacaggugcgucuuuuuucucucucccccaaccccuccaccccuuuugacucccuggcuuuuucguauucccccacccgcuucuuucuauccuaagccuuuccccaacccuguccguuccucuucccuuagcuucucagcuugccccccgggggcgccguccucuucguguccccggacguagagcucucgggagcucucucuguccucgccccucccuucgggacagcuccccuccacuuccaccuucguaccccaucccugcccugcccuauccccuucucgaccuccuucucuuuuagccaggugagacuuguucaccaggauccaagagagucuuccccucggcugggcgggggucuccauggaaacgggggucuguagauccuggggcgggggggguaaccauaggaauuaccccacugaacagaaaaggagguggaggcuauggucuuggaaguaccuggccccaaacccugauccauccaaggauccgacgauccgaagggaaccuggccaacagggcagggcgaaaaagggcuuguuauuuuuugggggggguggugguguccgugaugaagucuugaagagaccgggagaaaaugcccuccaaccuuagagguggaggugcgacgggagcucucucgggguugcuuucuccucuuuucaggggugcaggaaccguaggguaagggguaccccuagguggcggcggggccuggguucgggagugggagugcugugaugggggcaggggcaauuauccgagucccuggaaaaaaggcgggggaugacuucggagcgcccaagcuccgcugcccucgcucuaggggcgggggcuaccgggccaggcgaggcggggagggugcucaaauugaagaaggaugagaugggggcaauucauacuggccccggcaagccuggugggagacccagcuggcuugcaagcccucaacccgcuucgcgccaggccuggaggcuaggggucugggaggaaagcagagggcuggaaaggagggaggcuccgguuacggggccggauuucgggaucaggggcaauccccuggcccuuggagagggagggagagggauggccgcgaaccccaggguucccccacccugcuucauaaggggcgugaggaauggacagcaggcccagcggagcuggauucaagcggaucguggccagggagugggggggcuuagugguggucuucgggggggaguaguccggcggcggggcgggcgggcggggcguggggcuccggcgggcggcggggcggggcccgggcggcgcugcugccgcugccgccgccgccgccgcuccugcuagggccgccgccgccguugcugccgccgccgccgccgcuucugggcggggaaccgaggccaaagagagucccgugccggggcagagggcgcaggcggcgcgcgguggggaggggggcuuucugcgggcgggggcaggcuggggguggaguccccgacggggggcgguacgagcuaggacgacgacgaagaggagccccgggggcccggugcguggaggacgaggugcugggagaaggaaggggggggggugggucccgcgacgggccucgugggcuuggcucccggagguucggcuucgggacggagccuugugggggcgcccagaagccaggaaagggauagaggggugaacuggacgguggagggggcccuccucgccggggucccguggagaggaaggcugggccagagggacguccgggcaaggcugggaggagccggcggcaccaaggcugggguuuucguguuauggaggugcaggagauuguuguaucgaaagaugugguugaggggaaaggcgggagggaagcacgcugcaaacccaggaggcccaacaccacaggccguugggggugcccuucuguuccgcucaagcuuccccuccucuccccauuagaagcacuguguuuuuguuguauuguuuugaaaauuucaagguugccugaucaaacugucgacguggugauacuuucuuauucuugcugguuucuagaguagacagucaggacaggcuucaguuggcgagcauucuuccagcccagcguuuugggggcucuuugcaugcccgugggaagggggcuugugaagcaaggcacagaugaauacucucaaggcgauuuggaggucguuccuaugacacuggguagagggcagcugcagauagcuuuggucagacuucugggguacacucgaaggcuucaaguguuagucccaugcgucuuucaacuuagaagacuauuucucggaaucacacugcagaaacguuucauggggaaagaaauggggcaugaauuuggaguugggaguugauuaggcucauaauaaaauucaaaggauggcugggaguuaccauuuuaauggucaucuagcgcuguucuguuuagugugucuuguccuugaauguuagcagugaggggccuuucuuauuggggagacugcagguggcauagucaaagcuaaauuugggcagaguuuuaggauacucgaaugugaugucaccuggugguacugaagaugacagucuguaggaaagaaacuuacaagauuccacuggggauuaaagagauaaucccgcaccaagaaucacccagaggcuccaaaaggcaguaaaagguugagaaggaaccuguaaaauuuugacagaaacaaaaguagcaagccaaacagagggagcaacagggacauggugagucaaguuaaaagaauccaaaguuccauuaugcacuugaggcuugccgugggcaucuugaguaguucaugaggaccucgguggcagguaguuuuugcaccugaggagauuauuuugagguggaucugggagaugggagcccccagggcuuggcacaaaagcucgcuaaaauggacuuuguuaauggauuuucauguacacuugagugcaggcauuagugaaaagauagacacucggaaaaaaugaaauuuauucuuguggguaugaacuaaucaagggaaagucacucuuaaacugacuuuugaaagucugacucuuuauaggcacagaccuuuaaucucaguacucagugggcagaggcaggugagucucuggaguuaaaaggccagccuggucuacagaauaaguuccaggauggccagggcuacacagagaaacccugucuagaaaccuucugaaucucuuacuagcuuugcagaaacaguauguagguuccuuuccauucugacccagaggugaagagagcuagauaccuaguugauacaggaaggggaagagaugcagaagucuggcuugaauagacuaguucuguaaaacaguaauaaggaagggacggcuaauuguuggaauagggcaggguaaagcuaagugaguccuagccagcuuugcuguugucaaaguagagggacguuguaugagaaauggggccauaccaaggcacucuucuggaucuagcuuuuuuuuuuuuuuuuuuuuuuuuugauuugccaggacugguagagaagauguguggcauccuggagauugccuuucuuucuuacuggcuuuggggcucuugggaagcagaggagguuucucuggggguguguaucugagccuuauucaugauacaguucccuacccuggcaaggaaaugcuuggugaagguggcagaggaucucaagccuugauuaaucugugcugugagcuuuagggaggagcuuugcugagagaaacagaaucauaggagcaaaagaggcuuaccacuagaaagaaggaaggcaaaagaagucagggagaggggaccauagggcagggaaugggggaaggaagaugaagaugagcaucauuguucccaugucaggucuaacuaagaagaaagcaguaaguugaaaccuccaggguaauguuuuccaaagaaaguucgaagaacccuuagggcucucuacaguuuaguacuagaauugcuaaggcuggaguaagaaagaagaucuuggauaaaaauaggcuaggaagaaacuggcauuuagaaagaaauauaaauauauuuacccauaaagaaggagagguaguauccauauuaagaauuuaaaauguacaaugugggcugggcauguaaaaugcuugccuagaauguaugauggccugaguucaagccuuagcauugaaacggaaaaaaauaaauaaauaaaacaaaacccuacaaugugaaagaaaagcagaucauuaaagagccaaaggagagaggcauucagaugcuguucaaagcugggauugaggaguguaaagauuaauuuuugauagucacuacugugggaggacccaggaaacagaauagcugggauuaagcugaaacauuucuuagcaaauccagaugaaugucaagauucugaaugggaaaggggagucuuggucccaucuugaguggagaauaggagaaagugggacuacaccaguuuuuccagucuguaagcuggaggaauccuagauauaaggagguaagcaauagaaauuccagagcaaaacaaacaggauaaagaacagggaccugagagccuugggccagaauugaacaguagaguuaagggcaccaaaaagagacuuuaaucaggauuugacuggacuauguuuacacugguuugugaauucuagguggagcuaucugggauggauuggguugaauauauagagcuuucccagggucagcuagccucuuaagaagccaugcaagaauucugugcugaguuuggaugggaacaugaacacuagaggggaauggagagacuagagagugaaacuugcuacuaauuggacaggaagggggagaaaacacggaggauggcugugugaaggaagagggggcacuuagaucagugggaguuuuuagaaaggaaauuucuuaauguuagcauuggaagucagucugagucugugucugcucgaaucuuuagugccaggauagcuaaagagggaggaaauaaguaaucucccuuugugucacuaggggauucgagggcaguauuuuauaugaucucuuauaugagccagguauuauucaugccagucuguaaaauguaggaaaucguccucuuucuaaaucauagccuuuccugcuguucauaacuuuaaaauggucuuuuauguugaaaauguucuuuuagcgaacuaaaguuguguucuggucaagagcaaaacguaacucuguuucugucuccaaaauuccaguaagcucuuguaguauuuuuuuuaaagcaguagcaacucuuuccucauaaaacauguaaaaauuuaucauuuuuagcauaguaaguguagauuuguuaaggaacaaugagaaaaacuuuggaguaugugcaugggggugggggggggcaggcagggaacaauacucugauagguugacuauuuuauuuauuuauuuauuuugucuuuuuuuuuuuuuuuuaaugagauauggccuauggagaccagacuggccuugaucucacagagauuugccugcuucugucucagccuuccaagugcuuggauaagagugggugauacuaugcuuaguuuccucccuaccaccccccacucccccccccaccuuuaaagaaaacugcaggucuaguguugaggugguguuuuccucuuuguugguagauaaauugugaugaguuugaagauguggcuuguucuuuguaaaaugcugugauuuuccgauuuccccaguagaguuaaauaaauaaggcaagauguggcuucauuuguauuuaaagauuuuaacuugggcuaaagauuugggaaggccugaauucuauguagcagcaguuuugggguugagacaucguuacuaucugcuaagaaacaaaauuuccuuaccucauuacuaagaucuaucuuaguguugauuccauuuaaagcuacaguagaauuuugccacugcagggcuaugaggacaccaaggaggucuuucuuuuucugaguucugugaaauguauaacacacagauaugaucccagggaggagauccacugaagacuuggaucuaugagaggauugaauauauuuucucaugaagagucuuuacucaguugaacuugggucuucugccuugcccagguggccuugcauccuaauuaaucuccuuuggagacagagcugugucugguccuuguuguucaacuuucuaauaguauggcaggaaacaagucacuaacuuuccugagccucaguguucuuaucuagacaagggagaugauacuaaauaucauaggaugguuagaauucuaucaaauaaaauguauauaggcacugcuaagguacuuaacaaauggaauauauuuuuagaacuaaaauuucuugugucuuaugacguuacuuacuacauacaaggcagaaugaaacuaaaaauucauucugcuauccaccccucauauuagcccuuuguccuuuuucucuguaauucuuuuugauuaguagacauccaggguuuauugcaugguaggaaguaauaccuuaacacauugcugcaucugccucagagguggaggugguaguugcuuuuacgguugugccaugacaacaucuacucuuucuggacaggaacugaagacugaauaucccauugaaacuuuaagggaucuuuugcaccagagcuaucaaauucccugaagcugccugauguaggugcugggaacuuaacuaggguucucugcaagagcaauauauacucuuaaccacugagccaugucuccagcccaaaauacugcuuucaguaaaggacucuuguguuauauuauggcugguuaaguguucuaacuaucucuggaaaugcuccgaaagcugauagaacccggagcugaugugcuucgaugauaaagaugcucaccagugauugaaugggagagaauaauacuggagaaagcucuggguuccccaaaccaaacuuucugggcaaaggaaaaacaguggccuucaaaguagaucuccucucugcagcuggaguggacuuuggugucaacaauugggucucuguuaguuuugccaauacagggagagacugaggacaggccaauugaaaacggcagauuggcugacaaauuaacgguuuuucuguuugacuuagaaaaugcauuguuauuuucuaccuguccucuagcccugagauuuaccuaccuauuuuucuucuguuuaggcaaauauuauggcuguucccugagcacacaucuacugguaguccauaagucuccuggguuuaaaagguagcugugggugcagcacaccaagauaguuggggagucgauuuuauuauuuugcuuggcacaauuuuaguugaguucuguguuucucuuuauuguagaaauaaagcaggaauagaguugaagugagagcaaggcaguaaaagaaagacuugcaugcagugcuguuuuguuuauuugauguguaugcccgcaugugcacaugugaacgaacauguguaugcacgugcaugacagcuugcaggaguuggcucucuccucccaccaugugggucccagggauuaaauucaggucaugaggcuugguggcaagugcaucucacuggccauguuuuguuuugcuuuugagacaaagucucauuguauugcucaggcuagucuugaacuugugcauucaagugaucuuccugucucggucuccugaguagcugggacugcagguauacaacguugugcuuaaauauuucuaccuggguaccuggucucucuaugauauaguaaaagggugguuuucccuaguaguuuauuuuagcaagcuauugagccauauugugugucuuauauuaugcuacacccuguugggagggggcuaguaaaucuauagguggguaggagagugagucauggaguuugcauacuguguaauaagagggauaaaaauaaaauaauagcuucuaaugaauuauauacauaaucuauguagucauagcagagccucaucuucagauaaaagaacagaaaaaguaaccugauaauggugucuccaaauauucauguacauuuauggucuaggagagguuuacagaagcaaaccuuaaaugaggaggaauccccuuuacaugaaaaaguccaugucauaccuacaguacacuaaauguuuucagagacccacugaagaccaagauggaggaaagccaacucuuauuuuuggauuaacagaaauuagaagucucacaaaauguuucuauuuacguagaugucuugcugaaguagcuuugcugauugauuuuauaaugcagacuuaaguuuuguagguaucugugacguguagacguuacacaagaacuuuuaaaggauuuauccucucuguuucucucugucucugucucucucugcaugugucuauaugagugcaaugguguguguguguguguacauguaugcagugccuacagaggacagaaacaucauuggacucccuugagaugcaguucccaggcaguuguaagccacuugacauagguacugagaagcaaacucuaguccucuggaagagcagggagaauucgaaacugcuaagccaucuuuccagccccaucuguauaaagucuuauuagcuggagcuugauuuuaguauaaaguuauuaauacaaugauauguuuuuccuaaauagagcaaauaaguuucuuuuacuacaggaaaagaaaacgaauaguguuugaauaguaagagggaaaaucaaggcagaguguagaugagcuaacgcaaucugauggcaugaaaauggaaguaaaccaugaaaacuucgcuuuugguucacaucauccucaaaauauaccucuggccccugcaagugccucuguguuaugcucaguucuugacuaauaagaugaauauauuaucuggcauagugagauggucuugagguggcugagaaauggagaaggggaguauuuuuuaagguuucuaccauaguuuaggcuauggguccuguaauacaucacuguuccaggugaugggacacuggugcucuaauacuguugcuaucugauuacauucaucuucuuccucuuccuccuccuccuccuccucccuccucuucuuucuucuccucuuuaucuuuuugagacagggucucacuauguguuacaggcugucucugaaccaacugcauagcccaggcuggcauaaaaguaaccucucuaaguucuagguuuauaccuccacacuuaugucaugaauggauuauggcuguuccuaaauaucgagucaucucuaaaagcaugggguuuagcagcuacaguagugaagagaucgaaaggguguauauaauaguuaggauuccauguuagugcucucaggagcucuguggaaaauuguaagccuuggccgucuagucacugaggugacugcccagccucccaagguaacuaaauucaucagaaugaguaagcucucauguguuuaauagauaguuaacuuuccuuuguauccagucucauaaauguuuauaggcacauguuuuaaacauggugguacccaaggagucuaugaaggcauccaggcuagaaucauauacagguaauuucuuaagucuucuuguuaaauacaagaauuguaucuuggaagaaaaugcaauauccccugagucugcucucauaugauagacaccaguggacauauucagaauaaaagaaagaaaaaccaaacuuaagugacccagaaaacguuagaauagauuuaguuagaucaaacggacaguuuuuuuuaauacguuuuauuagguauuuuccucauuuacauuuccaaugcuaucccaaaagucccccauacccuccuccccacuccccuacccacccacucccacuuuuuggcccugguguuccccuguacuggggcauaaaaaguuugcguguccaaugggccucucuuuccagugauacaaacggacaguuuuuuuaaaaagguguuauauucuugaggugauuguuucugguugauccuugugugugugugcuauugcauggggcuagaagggaagcacgggaaagcaguugggacauuucuaugucacucaaguuucagggaugauagcugauuaguagcuagaagagaugagggggauagagguaugagggagggcagguagcagaauagaagaccauuuuuccaugggaaaugacuaaaacagagcacuuucagggggagaaaacauucucauuggguuaaagcuugggguauguaauuaaauggggaagcacaaguguuguuaauauccuguucaauacacacagagggaggcagaacagugcugcugcuuuccccaaagugagcugguaggguaaccuuucuuuugccuuuuuaaaguuuucuucuuauaagaguauugcccaaaguucugcauuucuaucagaacaguaggacccaaaguuaguuuucuuucauuagucaccaccggcccaacccuccuucuuaaacugucuaccggccacagcuauaaucucaaggacagauuuagggccaagcuucaagaugaauauuuucuguuuuuuuuuuuuuuuuaagucauaauugcuuccaggucaaaggucacuaagcagugugggccaaaaggagucugaaagaguacugccagaguuguuuuaccugagacccuguccugauguugagcucagccacaaggaacagacaggugucacacauggguuagagagacugaugugaccuguguaucuacugccaccuuugcucaucacuaauugagucuuugguugcaaagggaggaaugaagauuuugacagauucgagguuauaaacuuuaaaaacaccaucuaugguggauuaugucuguaaccaaagcacauagaaaacuaagaaaugaagauugccucguguuuaagaccagccugggcuacauaguauggguaacaggccaaacuggaauccauaucaaaaugcuguuuccaaaaucaacaagcaagccaggcgaggugacauauaccugcaguccuaacacucaggagacagaagcaggcagaucaguaauucaaggccagagucagcucuauaguaacuuuggggccagucugaguguuguggaaguccaucucaaaacaaaacaaaaaaacuaaucccaagaccccaaguugauaaacaaaaacccauuaucuacuuccauguaaaauauuugucagauucuuucucugauacuuugcucuuuugcuuuuuuguuuguuuuguuuuugaaacaagguuucucuauguagccuugguuguccugggacuuacacuguagaccaggcuggccuugaacuuaaagaucccuaucuaucgguacccuccaaaugcugggauuaaaagugcuggacaccauagcuuagccaugcuuggcuuuuaauugucguggaaucgacuuuugucaucuuccuuucaaaacagauucugcccuuugguaagaucuugguauuuuagggcugcucauuuccuauuugugaugcgccuaacccugacugggggcauaacuuguuauauagaaccucuucuuccuuuuuuugauaacacauucucuuuaagcuuuucuaaaaugcuuccgugcuuccccacaguauuucaguuuggcuugugauggugaaaucuuucagguuccccuauuucauuuuucccguuugguugccguguguguggccucuucuuuccaugcucuagcuucuagcacauugucuuugcuuuugcaguuuuuuuucucucucucucccucccucccucccuccugcucuuuucacccuguuaacauuauugcccucccauuacuccauuccugccuugguguccccuacucuaguauggcuguuauggcagaugguguacuuuauucagccuucuuccuaggcacauuuccuaggaucccagucagucucugcugcuagcuacauaggcauccugaauggcuaaguugucuuuuuucaggcacacuugcugcuuugagcggguggaacuuguguucuucauuguccuuaucaugaguuagauaagacuuuuugagugacuucgaccaaagugaagauaguuuacaguggucccucucagugcuuugcaggcaguggcagcauuugagucuugggucaugcagcuuauuccuaacaaugacauaguugugacaccugggaaaacccuuugagguauuucauaucccugugccugugauuucugggucacuugggauuaccggguuucuucuaaguuccuuuuccgaacuuugccuucacuugugggcaaagaaagagagaaggaggaggaagcgagaaugcgacuaucccuguggguacagugaguggaagcacguggaucaugugcguuuguaagguuuuucuuuuucugcucaccuccacuguguaccuauggugagcuuuauagugagugauugcuaacuugauuagacaggauggaacaaaacgagauccuaggcuuacugaaucagaauguguggagcugagaccuaagauacuauuuggaagcagcuccucagggaccuuggcugguugcauugacuguucuggucccgacuacuccuuugccaguggaagccuguuuccuagugcagcauuugaugcuucuauuggcuuuuucucuugcuacaugaaucuugccuucuuauguaggccacuuaguucaguguccugcuugugugucugcuguuuuccaccccuugagcacaaagacuacuguuaauuagcaacagugaacuucagauggucaggaguacugcucugauaaaaucaggagaaaaguuacaaggccaagauuuaagaagaugcccaauuuucaagauuucaugggggccagagagaagguucaguggucaagaagaauguuacugcucuuacagaagacagaauuugauucccagcacccaaaucagguggccuauagugacuucucuaacuccagcuucagggauucaacgccuucuggugucugcacucauaaguacauacacacacacacacacacacacacacacacacacguuuagaaauagugaaagucaauuuuaaaagagauuuucugaaagcagagguauccagagucaguuuugcucucuagguuguuacacacuacaucaugaacguguuugacuuuagcuuccguuuuguuuguuuugccucuaccuuuccuuucauguuuuguugggccuaaaagcucuuuaucuaggggauguuuggucuauugcuguuuccaaacacugagaaucccccuuugacuucuguccuggaccugcaaacagcuuaucucuucaacacagaacagaaauaauucugagugaaaaaucaugugguuggagccaguggugguggugcacaccuuuaaccccagcacuagggagguagaggcagucggaucucugagaagguuuucuguguagcccuggcuguccuggaacucccuuugcagaccaggcuggccucgaacucagagagauccaccugccucugccuccugagugcugggauuaaagucaucugcugucuccuuaugcagcccagucuggccuugaacucucaguccauuuuggauuacauguaccacuaagccuagggaauagggucuuuguuaaaaacguuucuaaaaucaccccaguguuaguaauguuaaaagguaaucaucaggaaaaagguaaggcauuaugacuccaaauacuggaaagggaacacaugguacgggucugauuuuucuuccuaauuaaugagaaagcuagacauguuauagcuacuguaaagcuagauguguaaagcuagacauguuauagcuacugucaagaaaacgucaagaaucacaaauuuauguggaguaaaggaauuagauguaaauggaggugaaacuggguuuuccacagugaggcagagguuggggcaggagaucaauccgaacuuuauggaaccaugacagaguuuguauauccaucagcuacuuguaauuuacagaggcguaaaguagggcaaaaauggugaacucagacagaauccagcaacugugagcaaagugcacuauauagauaaugcauggauuuuuuuuaauaguaagcaagugugguagacacuuuuucauuuugguucauuuugcuucuagugauuucucagaaucaucaccucaguucucaucuagaauucagccccauauaacauguauuuacugacuccuuacuaugugugaaguauuaagaagagccaaagaccagggggaaaaagaauguuguuccuuaacugcagagcugauccugugcuggagagacacacguuccagguucccagcuaacucacagcagaggagagccagagggaagaaggaagaaaagagaagaaagaggagaaaaaaggaagaggagagccagaaagggagaguuaacgguuccugggcugaggcuaggggagugacacaaugacauuugagcuaggcuuugagggaugguagcuggggaagaagaggcacagggggaggccaucucagagugaagaaauagcagaguccugaaacuaggggggccaggagcuggggugccgaggauggcaggcaaagggccagaugcagcagaagaggagcacgcagagguuugaggcaaggaaggcugucugaagaauucugccuugggugcugccuugauucugauggcuuuugacgagaguagggaggucugaucgaagcagcgauucagaagaugaauugauuguggaaucaagcgaugggaggcuaagagagcaguuaagaggccaguauaauguuccuggggugagaugaugaaggccuguacuagggcaguggcaagagggacagaaagagagaaggaauuggcuuuaucaagacuugacuccugauuugaucagugugauggggagaggaguugaagaaauuucaaccaaggagacagaagugccaguaacagaggaagcaugcuguggcugggcaugguggaugggcugcagaguacauuuauggggacagauaaugaguccacuccgagaucucuuggauuugagagguuugguggacauccaguuaacugcaaguugcuggcaucuggaauucugcucugggccuauggagagaggucgggguuuagagauguccauaugagagugaccaguccaucuaggggugaacugaauuugugaaagcugagagagauagaggguaaggguuguuuacacagcagggggagacacagaaagagacccagaagcaagaagaggagacgggcagaaagaugauggagggagacagaagugagggugggaaagacuggaagggaggcagguaaugagacugagagacuaaagaggagccagggaagugaggaggaggaagagacacaggaaggggaagccugggaagagaggcaggaagggaaauuggaagaggcugugcucagagaguuccuagaaaagggaagggagcacaagccgucucaaagaaagauuagagagagaaugaggagagugaggaagagagcagggagagaucaggagagacgaauaagaaaagacaagacagaggagguaguaagagaaggaagauuaagguaaaggcucauuuucagugaacaccaagguuuuugggguagauaacaggaggagcacauacagagaaaccaggcagcacgaagccaggaaaggcuagcgaagggaaguauaaagaaaagggugagcagcagcugacugacauaugcagggacccacagcuggacauuagacuaagcucuggaagucuugugcaggaguugggggaaggauugugagggugggggugggggaggggaguagggagccccaguucuguugucugccugugaauccuauuucccuaacugggcugcuuugucugacuucagugggagaggaugcaccuaguccuucagugacuugaugugccagggugauaccccaggggaaccucccucuucucagagacaaaggggaggggcaaugugaagggggacugggaggaggggcaugcgcuugggauguaaaguaaauaaauuaauuauuuuaauggaaaaauacaaauaauuuuaauuaaaaaagaaaaacuagaaaaggaggguaaggacaagagagccuguuggcugccacagagaugggguuaggaugcagucaaggaagagaauggguugguccauuucuguugcucuuccuuuaccaccuucccugaauccagcuacgaugaccucuuggcucucccuugaucugagcaagcagccuccuccugcuuugagaacuuuucuuucccuccacacauguagaucacucauuccuucacauccuguagguuguugaaaugauuccaucugagggaggccuauguugauugccugauugugacucauagccccuccacucacucccccgauacuguccccaggcuccuuagugugccuuguauagcuuggaauguacuauaacacggauuacucuaaaugugcuuauuguccuugucacuaccucuagaaugcaagugcugugcagguacacauuuugucagguuuuguuaguucuugaaucccuaggaccuaggacaaauguuuguugagugaguaagugaauuauguugaguaugaacaaucugugaacauugaaaggcuaaauggagcaaaucucugauguaacuguacuuuacuaugacaucuuuggaacacagagaacagcagacaagucuggucacuguaggguucuguucaguugaaauuggcugaauggugauuuuagcuaauagguuaacacaacacuggcucacuggauaaagcuauuuuucuugaucucccuuuuucuaucaaaaaugaaauggcugcgugaugauugucaguagcaagaacuaggcuuuggcucaugaagggguuaguaagccacgguggggauuaauaggaaaggacaaggacagaaaugugugguuccugauggaggcuuguuuuuguucauuugcuuguggccggaguacaaaggguauugcaccuaauuuggcgggagcuuucuacaccuuacauagauguauugggacgaacuuggaagcagagcagagcacuucugaaaggcuuauaaagaaagugugggccuccucuggagagcuuaaauuggccauguaacucagauccuucccuauccgugcauucgcgagcaggagcagaagacgaccccuaguugucucucacuucacuugcugcuuaggucuggacgcagcacucuaacuggaugugcuuaggcuaaauggauguagaaaauacacugucccuuaacuguaugcagcagauucaacuuccucaaacauucaagcauaugugucucugaugauugacaguguccucaucuccauccugaguguggguuccuagaaagcugcugugaaguuggccuuauuuggaccuucauuucccauagcagacuggcuugugagagugaucacuuuagcacuuggaggccaugauugccuucauuaagauguuuccguguaaaagauggcuaaagcagcuauacuuguucucagcuuuaacuuuuugguauucuuuucccccagggggaguggccagagcagauccuaucugguggugaguggcugucaugaucucuacagcaccgcucuacagcggcgugcacaacuggaccaguucugaccggauucgcauguguggcaucaacgaggagagguaagguugcuguaccuagucccagggagggguuggaccuggggacaagauucugguuuguuucugauuuuccuaaaacacaggggucaccugcucuaccacacugucccggauccacugaagaugaagaaacuaucagaugacauuugccaccuaguauuaucugucuagugauaaagaacucuaacauuguggaguaaagaaaagcucggaugccuguaguuucugauucuuaugucaaaguuugguguucagaaguucauguaagauauuuucaguucuuguccagggcuuagaagaaaguuggucucaucauguagcuuuaugguggggagcaggucaucaaaauucugggggccaguacuucuuaccucaagaagcuaccaaaauaugucaggaagaccuuaugacauaucaaaggaagaugagguugcugaccauaacuuuaauguaaaguucaguuagugauaccugucuggucuguguguccauguuucaguuucugauauuugguuguucaagagaggccuuuuuaaaaauuaugcaucauaccaaggcuagccaauugccuuucagaguugauauuucccuuuuauccuccuuggccaaguugcucuguauggugguuaugagguuucuucaaacuucaagagauuguucugucaugccuguugguguuuuaauccauuggcuaucuaaauucaaacaugccagaggauucugauaggauucuccccuccaauuuaagauuggcagucuuuaaaaagaaaaagaaaauagauccugguguagaucuguuaagauaguucacuggguaaaaaugcuugccuccaagccugacaacccgaguuagguccccagaacccacuaaguguaagaggagaaguaagucccacaagcaguccucugauguccacaaucacacaugacugugccaccuuacaccccaaaaaaccagagggaagugaaagaaauagauccagaguuucucaaguaauucuaaaaaguauuuguaugucgggagagguaauggugauaguuuuagagggaaaaagagacuauuuuuguuuuuauauucuauggguguguguguguguguguguguguguguguguguguguguguguguaucuagggaugggauacugggaauccugagugcugaguauguucuauaccucugagcuacaccuucagcuucauguuuuuauagaagucauuuuuuuucuuuuccuaacuagagaaggguauauuugucugagauuaggguuaggagaauagacuucuauuuucuuaauccauucacaccugauagcuuaauggucccuguucugaggaguguguuagagguggacuucaaaaaggaauuuaauuuuagaauacaaaaaucaaaaguaaggagaauaaggcgaaauucuucugagagacaggagaaaagaaguaugucccuuugugugugaggucugcucuuagaauauucaaagagaugcuccuggcaaggcaggcugcugggugcuuugugagcacgcacugacaggcugcauuacagucacaaguaguuggggcugauguagagcuguaugccugagccuucaagaacuuaguacacaagcaaggugugcuuacucgcaucuauaaucccaggacucgggagguaacggcaggaggaccugggguuugucaauagcccgggcugccuauuaacuuuuaggcuagccuugucuaccaaagugagacccugucucuguaaaacaaggcuaaccugagaaauuaaaaagcacuggacaaauuaccuuguucccucccugucugugcuguauuccuugcaagaagggagucagagguagaugugaaaucugauuuucucuuuuuacagaccuuucuugggaugcuaaauuacccaauaugcccagugguuaagaugauuuuuuuuaaagcauugucauuucugaucccaucuacccuuugucaccuucuuaccacugucuaggcuguguuacagcugauuuccaaauguaaucucauccuauaugcuuuuaguucuucuuuugagacagggucucuuucuguguguugccugggcuggccuggagcuuacuguuauagcuuagggagacgucagacuuguagcggcccuccugcuucagacugcgugcuagaugucaugugugagcuaccgugcauaucauaacauauauaauacacaucucacacacacacaagaucuauuucugugugugcauguuucaccuccaugcaugucucuacaccaugugcaugccuugggcucauagagaucaaaaagagggcaucagaucccccagaacuggacuugcaggugguugugaggaucuggguggguguugggaauuaagcccagguccuuuugaagaguaggaagugcucauaaaugcugaagcaucucuccaucccccagcgccacccccauuuuaaagacaaggccuugcuauguagcacagaaagaaaaucuuccugccuuagccucccaaguacuaugauuacaagcauauaccaccaagcccagcuuuauccuauguaaaaaccaucuuccuccauccuuuccaacuuguagaccuuacaaauuugagguauaaagcuguuuuuagggauaaacuuaaaauuacauuguaggagucugccagguuuaucaaauaugguuggggcauauagaacagaaggcauaaaucagccuuuuugacugcucuagguggucugucagcuuuagucaaaccuucggcuaaauagucuugcuugccuuuagcauuaauucauuccuucauucaauaagcauguauucaauacaagagcaaacugguaguucgucuucauacauugcuguugaauguguggacuggugugaacagguccuauggagucuagcuggaagaaugauguauuucuuugggaauaucagaggacagugucaccugagcccaggcuagacaugugauuaggaguuugaggugagggccgauauccaugcauccuugauuauuaggggaaggccuuggcuggagugaagggggguucuggugaaaagucucagggguugguagguagguaaggugccucaugcauucuggguuggauauuucucuuagauauuguuccaggcccaacaggaacugaaaaccguccaguguggcagguccugccguuaaucuuuaauaauuaggaaaauggcccugagagaugguggcugguuuugguuaaguucaacaaagccuugagcacaccagcugucuucuagugagaagaaacaguggaacugauuucuaauccugcuuggagccucuuuuggccuauguuuccccccucaccuguauccccauaaccuugcucaguugacccagcucccuccccugccuuucugaucccaggcuccucucucaguggaacauuuuuuuuuuuuuuuaauauuugcuuagcuuugcauccccuucagaggauuugaaacaccaucgcacacauuuuccucccugagcuuggggggcuggugcugcagcuuaggcauggcuggaguagccagaagugcugccuuugcugccaccaccagccucucugccuggcucuaggcuucacugcuaaccucuggcuugugagaauauagcuucugcuuucuucuucugggcagaauuucugcccaaggaggagcccaccaagcaggagggagcguggucaggaggagaaagaauguaaacaaauagggccuucccauguggaguuguggaggggagaggugcgcccucccccuaaaccaucccuggagagucuaguuggaacaugcuucuccagcccaaggcuggcuccauauagguccugcuuuucugcucucucaggaguugaugugaaaaguguguuuucccuucucuguagcccuccaucucuccucuuccucaagaccccuaacugcgguccaaagcccuugccucacaguccuguguuaccagcagucauuuccagugguggaacugucccacuucugccacccuagcuguuuguuaaaggggacaagccuuucccccuugauuagccccuucuggagccggcuccgauccucauugccauucuugcuucucuugccccagguacaguuagaaagucuguguuucagucggagggagggaguuauuugcaggggugcuccuccuugcuggaguugacugcaggcacccccaaauacccuuuagacuagaguguggucgcuaaggcagacgcugcugacuuuucuucacgggcuguauuggaucucuggcagggcuccaaagauggcaggcaaacccaaacaaagagcaggcagagcagcccugugcuuugcccacccagaaaacuugcugcagcuuuguucuuugacccccuaccuccucugcagccacucccacccaggcggcugcccuauugauauggcuccugagcacaggggccggguuccugcugcacuuaaagcggccagcggccgguauggagccaccacuuguccuucgacuuuacuuuagcgugugauccuuuuauuuguucguuuugucaaauggcacauguuuuaggauucuuaccugaaguuuagagaauucuucuugagcaguuugggggaggggguuacgguugaauuuuucuccuuugagauccagcuuucuggccuuuagacuuucuuuauggcacauaccaauagaaauacagaguucuguggcuuugaggcgcucccuuugggaggagagaggauguggugaugcagagaggcugaaaggaaggugcgcccauguacugugagaagagagcauguuguguggagccagguugacuucuagaaaugcuccuuuggagaaaaaaagaaguguuugcuuuguuuugcugguuuuucaaguaacacacggggucuuacucuuacuguauaggcuugcugagucuaagcuggccuugaccucaaagagauccaccugcuucugccuccugggugccaggauuuaaagacacacaucaccaguccacugcauuuuccuuguuguuugagacaggaucuucuguggcccaaaugacugaauuccuuaccuuccugucucuacuuccuaaguacucacauuacagacaggacacaugcucagcuaaaugucguaguuuuaaagagccucucggugucagugaccagauggccucacaucagugcuguaaaugugagugugguugggcuucaggcccgccuugcccgauagaggagcaaacgcuucagauuuugacuagauuggaaagcacuguggaaguggagauuugcuuacaaagagguuuacccugaauggcacuucccauauagacuugaaacaagauuggauuuaaaauaaaacuaauuuguguacccuugaggauucuggguuacaucucucuccuuuugggcaaugccuuguauauccuggagugaauggucaacuugaugguuaagcuccaggcgaaaggagaaggugcuaaggugggguucaucugcacuuugggugagaacacuagaaagcacaauaaguggcccccaaauucuggucagacaaggcuccuccucuucagcaacuugcaaaguugcguguggcggcuccgcuuugccugguucagcuccuagucuucugccauccccugaggucaccauggaagugagacaggaggguuuggaaagcuaggcaggcaagaccuucuagaagugucagugcucuaaguccgggccuuaucucccuuuucugcugugucuucccugccagaagagcaccucuuucugaugaggaguccacgacagguggcugccagcacuuuggaucucaggaguuuugugucagcagcaguuuuuccaagguaaggagcuaugugcugucacaugcuacccaucaaagggugagcuucuuggaccaugugccuaguuuggccuuccugagacugggagcaagaagacacaaguugcuguaggugagacagaaacggcucugcgcaugcccuguacauugcaguugguugaguugucgagaggaccagcagguacuucccaggggccucaggguaccugcaucaguucccaggacuuugcuaagauggccaugcuauucuuucgucgcagguggagcucacggcaguuggaaguggcagcaaugcccgggggacaaacccagauggcaauaccacagaaaaacuugggcacaggucagaagaucagucugaugacccucagccaaaaauggacuauguugggaauccagcagaggcugagggccuccuggugccacugagcagcccgggagacgggcucaagcugcccacuccugacagcacugaggccagccacagcagagccaacugcuccuggacucccuuaagcacccaaaugagcaaacagguugacugcucgccagccgggguaaaggcuuuggacucucggcacgguguuggggagaagaacacuuucauuuuggcaacucugggaacuggagucccuguggaggguacccugccucuaguuaccacuaacuucagucagcugccggcaccuaucugcccuccugccccuggaucggccucugggacccccucgguucccgauccauuccaaguuccccuuucugucccagcuccagugccccacucaggacuaguuccaguccaaguugccacaucggcuucagcuccuuccccuccccuagccccagcagcgcccucggugccuacucucaucucugauucaaacccucucucugugucagccucugucuuggugccaguaccagugucugcuccccacucggucccugugcccuugucggcuccugcuccgaccccucucacagucucuguguccgcaccucccuuggcucugauccaggcucccgugccucccucggcucccaccuugguccuugcuucugucccaacuccaguucuagcucccaugccagcauccacaccuccagcagcuccugcccccccaucuguaccaaugcccacuccgaccccuuccucuggcccacccucuacccccacccuuauuccugccuuugcuccuacaccggugccugcgcccaccccagccccaaucuuuacuccagcccccacgcccaugccggcugccacaccagcugcuauccccaccucggcgcccauuccagccuccuucaguuugagucgaguguguuuuccugcagcucaggcaccagcuaugcaaaaagucccccugucuuuucaaccagggacagugcugaccccuaaccagccucugguauacaucccaccuccgaguuguggccagccccucaguguggcuacacugccaaccacucugggugugucuuccacacucacacucccgguccugccaucuuaccugcaggacaggugucucccagguguguuggccucuccagaccuccgcucuuauccaugugcauuuucuguggcccgaccuuuggcuucagauucaaaguuggucucuuuagaggugaacaggcucuccuguacuuccccauccagcagcacuaacagccagccugcucccgauggggucccuggaccuuuggcagauaccucccucaccacugcuucugccaaggugcuuccaacuucacagcuuuugcugccagcccccagugggagcucagucccaccacacccuuccaagaugccagguggcaccgaucaacaaacagaagggacuucugucaccuucucuccucucaagucaccuccacagcuggagagagagauggccucuccacccgagugcagugagaugccucuugaccucucugccaaguccaaccgccagaagcuuccauugccgaaccagcguaaaacaccucccaugccuguguugaccccugugcacaccagcagcaaggcccuccuuuccacaguccugucuaggucucaacgcacaacccaggcugccggcagcaacguuacuuccugccuaggcuccaccucuucaccuuuuguuaucuuuccugagauggugaggaauggagacccaagcacuuggguaaaaaacucaacugcucugaucagcaccauuccuggcacauaugugggaguggccaacccagugccugcaucccugcuguugaacaaggacccuaaccugggccuuaaccgagauccucgucaucuccccaagcaggagcccaucuccaucauugaucaaggagagccuaagagcacuagugccacuuguggcaagaaaggcagccaggcgggugcugaaggacagccaagcacagugaaaucccguuauaccccagcccgcauugccccugggcugccagggugccaaaccaaggaacugucuuuauggaagccuacaggccugacaaauauguacccacgguguuccaucaauggaaagcccacuagcacccagguucuaccuguuggcuggucaccauaccaccaagcaucucugcuuucuauuggcauuucuagugccgggcaacuaacccccagucagggggugccuaucaggcccaccagcauuguuucugaguuuucuggugugucaccucuugguuccagugaaacuguucauggacuuccugaggggcagccacggccugggggcccuuuugcuccagagcaggaugcugucacaaagaacaaaaauugccgaauugcagccaagccuuaugaagaacaaguuaauccuguccucuugacucucagcccucagucagggacccuggcacugucuguucagccuagcaguggggacaugggaguaaaucagggauccgaggaaucugagagccaccucugcucugacaguaccccuaagauggaaggcccccaggcagccuguggccugaagcuggcaggagacacaaagccuaaaaaccaagugcuggcuaccuauaugucccacgagcugguccuggccaacccacagaacuugugcaagaugccugagcugccuuugcuaccucaugacagccacucuaaggaacucauuuuagacgugguccccagcagcgagaggggccccagcacagaccuuucucagcuuggaagucagguggaucuggggcgggugaaaauggagaaagccgauggcgauguggucuucaauuuagccaacugcuuccgagcugauggucucccagcaguuccucagagaggccaggcugaagcucgggcuaacgcugggcaagcucgagugaaacgggaaagcauuggggucuuuacuugcaagaacaguuggcagccagacgaggagacagaaucucugccacccaagaaggucaaguguaacaaagaaaaggaaauugaggaagaaccacggcagcagccaccaccacagccacacgauaagcccaugguccggaguuccuugggguccaaggugagugccaguauauggccuagaauuccugauggucagcuucacuuaggggucucugcugcaucccagcccacccccucccuacagugcucuugagcagcucagccgugugaagggagcugaugaacgaacgggaggcuucccccuuuaacuccugcucucucucugugauauucucaccuggaaagggccuagcucauuccauaggauauaggaaaugauuucaucuuuggggcuagagaagccauuguccuagauaaaguuggaaagccugagaagguauuggugaaggaaaucacuucaucacaggcucuuccccaaggaacaauucuuccugguucuuuaaagaugaugaaccacugucuuuggcaguuuggggcccagggaggaaaggaaacguugauagggucauuuuggccccacuucuucauagcucugugacauugauuaauuucucuuacccucaauuccuucaucucugcaaugagacaaauaauacuuauuuagagaauuguuggaaagauuaaaugagcuguugauaugaaauaucuagaacaggcaaauugauaggaauaagaaauagccugauaguugccgagggcuggggagggcuggaggguuuccaugcagggcagugaaaaaguuucuguaccaggcaaauggugauaguuacacaauucuguguuuguacagaaacaauugcauuguacauguacguuagugaauuguuacagcagagcucaguaaagcuauuccaauuaaugagauggcauauaagugcuuaaaauagcacugggcacguaauuaagugcucgguugguauuagcggcugcuuuuguuuuuaguaucacaaacagaauggcccugcccucaugcagcuuaggucuugccguguugacuuaaugacaacugggcauagcccuuccgguaugugauggauaguuuaauaggcugauugaaagauguggggggaccgagaauaaaguuccaggagaaggagaaggcaccagcaucuccagguuuucccuuuggaaaccagacaaucuaaguguuucaucaggucccauuuucuugaggaacaugugaacugauaaccaagcuaagaugaggcguuaauuccaaacagcccauugcuggggauggccaagaggcagaauaagcuccgguugcuugcuugaauuauuuuucuuucaaauauuuuuuaauacguuuguauuucuuuucugugcucauguguaugugugugguacaugcaugaugccacaccugaaugcagauccugggacaguuuucagcugcucucucucuaccucagauugucccauguagcagcaagcaccuuuaccugcuaauccaucuugccugccaaagaaugagguuucauuugaugcugccuguacuguauucuugucccuugaaacauauuucaaacaucucuuaacccaaacacugaucuugcuuucuccauccucccaacuucucaugcaguuggagugugucauaguuuuacuuucauggcugcccuggcaggagauacaaacggaaaucucuucuagauguucuguuuuacuuauuauuuauuucuuuauuuuggucuaccuuaggaaguaaaaguucauggucuauacuugaaagaggcagcuaagaacauauuuagaaauaagucagagauguucaaauugacgcauuuaccuuuauuuccccugccuuaaaauaguuuuucuuuggcuauaccugaaguucagauuuuaaagucaucucugucuuccucuuuucucccuauaguucuuuguuuucuaacaccuugguucauagaaauugccagugacuuacuuuucauugcgcuuaguccucugcugagugagcagagggugggaagcuggugggaaaugggugcucccugugccuagagaacugaggguucuuuccccucaaauaucccaucaguaagauggcugccaaccugcuucacugaaacuagagguugauaacccuacuggaagguuauauggaugugauuauggguaggggggacaugugucagucuuucaucacagugacuuaaguaucugaagaaaaaugagagaggaaagguuuguuuuggcuuauggauucaaagaugucagucccucauagugggaagaguguaguggagcacaacaguagcucauagaaaccaaaaggggaggggggagggagggagggggagagagagagagagaaugagaaugaaugaauaugaaugagugcaugucacaugucugcaguacuggccucuccuuuuucuauuuuguguuugggugugcucaugugcauggguguuuguguauaccgguaccugugcagaccagaggucagucuuggguaugauuccucauuagcuguccacuuuguguugugacacagagucuuucucuggaaccaagagcucauuaguuauacuagagggauccacauagcucugcccccccagugcugcuagcaaaagcaggcaccaccacacuuggcuguuuucuggugaugacucucagaucuucaugucuuguagcaaguauuugaccuacucaacuacccccccccccccaucaauuuucugauuuccaccugggcccucagccuacuguaggauguuccauacauagcuuuagggcaggucuucguucauccuuaguuaauucuuccuagaacacaaaacaaaacacagauauacccagaggcaugcuauauuaauuaggagcuugucaauccagccaaauuaauaaauuaagauaaacuucaaguagguuguuguuguuguuguuguuagacagguuccucuggcuguucuggaacuugcucuguagaccaggcuagccuugaacucacagagaucuuccugccucugcguccgccuccugaguguuaggauuaaaggcaugagccacuaugccuagcugacugcaaauauguuuaacucuuucugucuucuuaaaaccuaacuucacgugccccagaucaacaggacuaggaacaccuaccuuaccauuucuuguuuaguggcauggagaaaccucacagcuugugaaaaucuguggcuuugaggcagaguuccuacaauguguauguaagcugauaauccaguaguagguggggaugggacuggacagaaacagaggacagagacaacaaauagggaaggagaucacugaaagcucaugagaagagauccagagaugggagcaggagcaccagggcuuccuuccagcucuaucuaucuuacugcagauguaagggugaccuggucaacggcaucccuucaguuaguguguaugcuagcuuguguguggcccaggaacagucaguugaccucuucucugagugucugucucuucaucuguucggugaggugguucuuaggacgaagcaaaugauggagaguaaagcauccuuuaaauacacccaacuucgcugugaauggcgucccagagcugccccuguucaccguguuaauagggaggugggaaucguaccuccuacguaaugguuugaguccauuuccugcuauuaacugacacaugagaaaagguuuccuugacuugccuguucucagaauuauuaucaauugauagcaaugccauccacaaggaagauguuugagccauguaguuaccuaacuuacagaaaaggcauuuuuguuuaaugccuauuucuacuuggguuugggugugcagaguauggaucccaagucuggaccuuuuaagaaaaaaccuuuggauguguguugaggggucaugaauacagauucuguagaucucugauacaaaucacugaaggaacuagcaaggacacucgacugaguccaacagaaccuuuauaacccaguguguccugugacauacauacacacucccaguccuaacuccggcauaugacaugauccuuccuaagacuggagaacauuguuaagcagcaaggcugaccucacaccugacuuguccuaccuuaacacagugccggaagcugccuggagacccccaggaacccaccaagaaaagccccagaggggcuuuagauucaggaaaagagcacaauggagucaggggaaagcacaagcaccggaagccaacaaagcccgagucccagccuccaggaaaacgaacagauggucaugaggaagguaggucuccaaggccaugcaugaccuucaagccugaacuccagagggauccaauggaauuuugguggggagagaguugcugagagauugaguggaaaauggauccuucuuugcuguggaauagaaagagaauuggaacucagaaguuaacagcucaggaggauaggucuguucuggucaugaguuugugaguaccccaccuucuacagucuuaacauugaacaaagugauuugcaaauggacacagaacacucaccaaccgguuccaugagguggcaucuaggcucaaagaagaagcagcuguaagaauauuuauucaaaaaccguagaauugggauucauuacccuguuuuuucuaccuuuugguauguuagaaaacucccauucuaagaccugaaacaaauagcuggcugacuagcuagauagauagaaagguuaaacgaugucucaaacuuuuuuuuuuaucagcuaagaauacccagaacguuugauuuagguauaggguauacuugaucuauauacucuacuguagauggccccucagugccuucauuggagauaauccaggcauuccuggccacaguaguccauguucaugaucuugcucauuggacaugacauaccacuucuauuuuacucuuauauaccuguuucuauguguccaccacucccagccuuaccuuguuuuguuuguuuuuuauuuuuuuuguuuuuugauucuuguuuuuuuguuuuuuguuuuuguuuuuuguuuguuuuuuaaagauuuauuuuauuuauuauaugugaguacacuguagcuguuuucggacacaccagagagggcaucggaugucauuacagaugguugugagccaccaugugcugggauuugaacucaggaccucugcaagaccagucagugcucuuagcugcugagccaucucuccagcccuuguuuguguguguguguguuguuguuguuguuguuuguuuuguuuuauuuauuuauuuauuuauuuugguuugguuugguuugguuugguuugguuuuucaagacaggguuucucugugcagccuuggcuguccuggaacucacuuuguagaccagguuggccucgaacucagaaaucugccugccucugcaucccgagugcugggauuaaaggugugcaccaccacugccuggcucagccuuaccuuguuaagguccaucgaggccgugcuucuuugggacagcuacagcucaguuagaacuugaggaacacacaccaaccuuuguguuguguaggcagagauuauacuuuggagcaaucuguuaaauugcuucuguguguugcuuucauuggugucagcaaaaaugacccagccccaguuuugaaaaaucaccauucccagaaagagcuggguagugauagcagcuuaaggagagucaguuguguuaaguuaggguaacugcaggcucaauacaagccuuucgguuuucucauuucagcaucccaugugggcuuucugguuuauagauuucuuuuuuuuuuuuuuuuuuuuuuuuaaaaauguucaacauucuuuuuuuuuuuuuuuuaaagaucuauuuuauuauuaauauauguaaguacacuguagcugucuucagacacuccagaagagggagucagaucuuguugcggaugguugugagccaccaugugguugcugggauuugaacucuggaccuucggaagagcagucgggugcucuuacccacugagccaucucaccagcccgguuuauagauuucuaauugugauauuucugccuucugccccuaaaccacacaucacuccagguuccuuggaaaagaaagcaaagaacaguuuccgugacuucaucccugugguucugagcacucggacacgcagucagucuggugaguaagacuaaggguaccuuugaaaagguagacaugaaguuugaaugguuuuaccauuggcguaaguagacauuuuguuucccugugacaaaaugacaggcauuuugcaggaauaacagaguccuggguugggcagaaggcuugccugaaauuuuagaacaguuugcuuaacaauguuagauuagagauuuaacaucaucuuugguuaagagucagugaugcgaagaagaacggccccugccacucaggaaauuugugcucuaacauuuugcaucucaugaucauugaggcccauuugaaguccucagacuuucaaccuuugggcuuuaaucucgucacccuaugcauaaagcauuaucaaaauuggaagguucauugaauccuaugggcuggcacaauuacuuuugcuccacagaacuuguauugguuucggucuaaagaagauaguuguuuccaguuuguguucuucucugcuggcucucuguugggucacaggacagagaugguugccugcauucacccagauugccgugcaaauuggaaggaauagagacgacuaauccaacgagcugacguccuguuaacuggucccucagcacauggcaagcucuauaguaacuggggcuuagaaugauggccuggcggccucacaaaguccugaaguguccucugaaucaucaaagagugauuacauucuugccagucccauuuuuguguuaaacacauuguacuguauuugauucuuuggaaauuggugauuucugugcgauucuguauuaaccagaauauuagguuaacuagaacacucuguucccugccugguccauauaaugcaaaguuuagugggauaguuguugucuuuaagcacuugagcaacuugaagcuuuggucuagggugggguuuuuguuguuuguuuguuugguuugguuuuuuccccuccaaccaccuuuuucuucugcugaccuuacuaggguguagauacugcugaguuaacagcuaggcuuucgggagaaacauaguacugcuccuucuaaggaaggugugagaucugugguguaaaaccaggccaauuuaggguugugcuuuuacuguuagccaaguuaaggguaaguagggagagagcgaauagccucuuggcaaggugacccaagaggauaggaaagaugcuguuuguccuggggugaucggccuuguacuuguccagcagcaaggaacagcugcaguggaugggcagacagacuagagagaaaaguccauccuugaacuucugcaacuauguaagagguaggauuaguuuaauggaagagggccuacuguacuccacugggacaugccugaaucagauuguggcauaggaaagggacucccugccuuuccucucugucagagacacucuucuuuuaugucaauucugcuuggccaagguagcucucuuggccauauugguggaaccacaagguuauuaggaccuaaguugucaccccagacuuccuuacucauuugcucccauuugccaaccagcagaggacuacagcucucuccugcccuucaugcagugcuuggcuccucaucaucacugagaguuugugagugggauucaaguuaacacugcacuggggaggagugaggaugguuccuaguacuucaugguauuuuggacucuauaaaguacguacuuaagaguggaagacuucacuugagcccccagaacaguccuucgagauaaguguaccccuaauaacugacagagccugaccuugaacucaguucuacaaauuucuacuccagggaagcugugucaauaccauacguaaugccuugaagaaguaccugaaugucuucuguacauaucccauccguagguagcaucuguagcucuuuugcugguauggcagacagugacaugggaagccaggagguuuucccuacagaggaagaggaggaggucgcucccaccccagcaaagaggagaaaagucagaaagacccaaagggauacccaguaccgcagccaucaugcccaggacaaaacccugcugagccaaggccgcaggcaucuguggcgagcccgagagaugcccuggaggacagaggcugcccggcaaaugugggacaccaaugaagaggaggaagaugaugaggaagagggccucgugaagagaaagaaacggagacggcagaagagccgaaaauaccagaccggggaguaccugauugaacaagaagagcagaggcggaaagggagagcagguaaggcuggcucuaggcugcuguuccuguugugacgucagcuggagccuuaggacugacaggaaccugguacuauagucuucacaugugggauacacagauccaucuugaguaugugccuuugaaucuagaaugaaugaacacaaacuagucuacaaacuagccuuuuaaaaauguauaucugaaccugugguccaagccacugugauauuguuggcuugggccacugucuuaucagcgaguuaugauuggcuugacagagucaaguuuuuggagacuauagguucuuuuuuucugugauauucaguuuaaaaguaagacaagccaggugugguauauacgucugccauccaagcagucaggaaguugagguaagaggacagugaguuugaggacagccuggguuacauagugaaacccugucucaaaacaaagagggaggggagggcauuggcugccacaccuggcaugcuucugcucacaaacuaaaaugaaauguaguaauucuaaaggcaauagaaaaccugaaauauguaaaacucucugcuuucucagguaaagccacaagggguuuuuuuagaguuaaaguuuugaggugacauagguggcccugagcugugaaagcaggcaguucaaaaagaaaacuuucuauggccauggcucaugcuuaaauaccaucauggaaggauagacagucauaaaaagcuuguucauaccaggguacuucauuaagugccgcucaggacuguucccauaguggcuuucuaauugagcaaaaaaaaaaaaaaaaaaaaaaaaagcucaucucuggauuccauagcaacacauuugucucuucuuauucucuggccucuucccuugaaauaacaaucgauugucucuuacaguguauucacuuuuagcuggugauaaauauguauaguccccuuauuaucuaaaacaaaccaagcucacauucuguaggccauaguuccugggcaugcuauaaugccgagaaggcuuaaccucguuucugacucuguugaaguggagguguauaugauaccuguccccacgcucaagaguaauugagcucauuuucaucaacugucugaacaaguggggcaauuuugcccuucuuuugccggaacuguaauggauuggucaugaaugaauugucaaaccauuggccucagccgcuuguuaggacgcccagcaguguguguauuacucaguccucucuaaugaaggcugcuugccuagcuugggagccucuccuggagcuaucagcucuuucuuucuucuucuucuucuuuuaaaaucuauuuuccuuuccuuuucuuucuuuccuucuuuccuuucuuucucuuuuucuuuuuaaaauaucuuuuuuaucccuuugagacagggucucuuuacuauaaagcucuggcuguccugaaaauaacucuguagaccaggcuggccucaaacugacagugauccaccugccucugccucucaaguacuaggauuaaaggcacaugauacuagcucuuucagucagaaggaccucuuuggaguugccuggaccuauuugcuagcuaguccauaacacugagauagacguugccacagcaugcaugauaggggcuuagcuagccguugcuagaccaucugcaguaacauacugaauaccagugaucaagguaucuugcuuguuuaagggcagcccaaacuauugagaaguaggucauucucccucucugaguauuuuugggagcuaugcauugaagccacugguguuagcaaaucuuuucaugcagaaauuucuuaaaaaaaaauauauauauauuuaaacaggguuucucuguauagcccuggcuguccuggaacucacuuuguagaccaggcuggccucgaacucagaaaucugccugccucugcuuugccucccaagugcugggauuaaaggcgugcgccaccaucgcccggcuaaaauauauuuuuauugauuuuuuuauguuuaugggugcuuuuccuguauguaugucugugcagcacaugcaggcacuuacugaggaggcuagaauagggcaccagaaccuccagacugcaauacagaucauugugauucugugugagugcugggaaucaaacccguguccucaugaagagcaucuaguguuccuaaccacggaggcaucucucuaaccccgggccggggggugaguuuugacaagcacgccccuccucagaaagcucaagucuccuuaccuacacuauuuggcuuucaggccagggucagagaaguaggaaacggacaagccagguagaucacccuccucucuaacucucauggccucuccuuucaucuugugcuuggcucgcuuccuuuucauucuaugaaagagguagaaacagcucuuuccaugugccuaccuguccccugcacacucugugcuuuuguaggcuagcauaaagcucugguucuucugcaacugaguacacuccagaguuugcccugcccuugguuacauggaguagaugccuguuuauuuccuucuuuauugaacuccgagaugugguuuuccgugcucuccacgguuuucacaaggcacaguucuguuucuuccucuugcuuuaacccucuuguugggucagaagcucuggauuaaggcugaguaugguggguguaugccuuuaauuauagcacucaagaaguagaaguaggcgaaucuuuaugaguucuagacuaaccuggucuacauagugaguuucaggucauccaggaccauauacugagaccaugucuauaaaacaagccaggaggugguggcgcacgccuuuaauccuaggacaugggaggcagaggcaggccgaccucugaguuccaugucagccugcucugcagagugaguuccaagacugacagggcuacacagagaaacccugucucuaaaaauaaaauaaaagaagcagugcagaaucccuagcacucagggugcagaggcaggugcuucuccaggcagccaggguuuuacagagaaacucugucucagaacaaaagggagcagggauaccugcugggcaagugagaauuggguuuguucaaugagugucgcuggguauaucaaccacacacuaguccagguugaaugcacacaguaguuggcuaacacaaaacauacuccauguuuuuuuuuaaugggcuuuuuguuuuguuuucauauuuuuuugccaugcugauucauuuuuguuuuucauguuuguguuuuagguuuuuggagagagggaaaacauuuuaaaaagacuaaaaaugggguaaaaagaccugaguuugaauguucuugcuggaagugucagagaccauguagcacagcauuucuuggccauauugugaggacccacuaauacacuagguggaagaaggauaguaugauagcuagggcuucuuuccuaaauccauaagcuacagccaguugugcaauuuccuuuuauuguuguuauuguuuugagacaaguucugucugcauaguccuugcaguccuggaacccacgacauagaccaggccgucuuccaacucacagagauucaaggcuugcgcuaccucccaccccagccaauucacuggucuugaauagagacuccuacaucugcaucugccuuuggcaguuuuacagaugagaguccauuucaaguuugggguggcagugaguugagaacucugggauuccagucucuucauuucacacaugguagaaacugaaguugcagcuacuucauucauagccuuacugaucuguugugugcuaggcuugguguucagguuugugacggagauaccccuucccccuagagcuugcacugaagucauauaauaaauagugcagcaacaaauaagagagacccucccucaauacaagguggagggaggggccugacaccugauguugaccucuguaacugcucauuacagcaccuacaaauacagacauagccacacacacaagccaugcaucuccauugccaaucgauacaagugaaugguuuaugucaccuacacaagagguuuaaggcagacccuauggggugaggcucuugcuaguggaguuugcaguagaccuuuuugaaauuacaauuuuagacacauguuguugcccugugauaccaauuaccugauuuccaaucagggaaggcaguaucuuucugccauuacacacaaguaggccuauacugcgcuggggagugucuguugcauuuaccuugguaucuucagacaggaacugacaggcaguuagaggugaggagaacugagcucguaaaguuagcccuccacuuuguacuugaaccccacuguacuugauugauacuucagcaaaacugccaaguugcuuuugauuuuggagagggaggggguagagaaaggcugaaaagagauucugguuugcucugagcuauggggagauccuuucaaaaugacccgcauuuugggggccaguuagaugggcugcccccugcuggcaggucugggaagcgccucccacggauagauggggaauuugcaugguaaagcacuaaaggaugguguuccauuucugugacagucguucuuuccuguuucuuguucagauucaaaggcccguaagcagaagacuuccucccaaaguucagagcacugccucaggaacaggaaccuucucuuguccagcaaagcccaggggaucucggacucaccaaacgguuuccuuccagauaaccuggaggagccagccugccuugaaaacccagaaaagccgucaggaaagcgaaagugcaagaccaagcacauggcaaacgccucagaagaggcaaggguauguagccaccaaagggaccaauaugacgaccgugggcuagagaggccgacuuucuagcacgucugucuagcuguaauucucucccagagggcaaaggaaacaaguagaugggggagggggccacugagcuguaugaaaguauucuaaaaguauucuagaaacgcgggacacauucaaacaguggaaacugaaguuauaguuaauuaugggguuugaccccugauuucuuuucccuaacaauccuuguaccucauuuuuaaauauggcaggguauuagccugaacagauuguuaacauccagucaagaagcuccugucugacuuucugagacaacuaagguagaguguaacuuguugaagccaggauuuuguuaccuagaccaagguuuaaggguccagguuagcugcugucuccauccuguccccuguuccuuugccucuggaggaagccuagcagcgaaugaauuggguacuuagcaguuagccaggcaagcauucuuugaacccuuuucaaaauuaccaguucauuugcuucugcgguucauaacacuugcagcgcugucagauucuacaauguaccgcuaaagaagaauggcauaguccuuugaaggaagugaguugcagguccagcguguaccugugauagguaucugccauugacaacagaaaaucaaaugaccacguugggcugguuugguuaguuacagcucuuauucuucugucuggcuuucaaguaggaauucccaaaugauaccagugagggauagaugcuugucuuugcccaccucuuccucccccgugaauccuuguugcagcuuagacaagacacucaagucuauuugcucaucuuuaaauggagcugaugcucccugccccuucugucucacaggaguacuuggggggaacaaaagcaaugucugugacaggcuuugauaacggaaaguguucucugagggucaguaugcauccuugcacuucaggcagagacaggaaugagagaacuagagggaaagccagaccaacugugaucuggcaugccagggaauccauuaucccaaacccauagacuacaggacugauaggagccacugggagaguacagacacgugcuuggcucuggccgccucuuucuucuugucacuuuuuauuuauuuaauguaugugcuuauauuguguguagaggugagaggacaagcucggguguaggucccuuguuugagacagucucucuguuuuucugcugcaugcacuggguaagcaggaauggauuuuuuucugucuccaccucccaucuucccauagaguacuggguuuauaggcacuuguaucacaaguccagcuuuuauauggguucuggggauucgaacucauauccucaugcuuguauggcaaaguugcuuuuacuccagcucuccuguuggugcucuuaauucccaaguacuucuuagagguaggcacuuauauuccagucauuuuacaguaaagacuuaugagaggugacucagugguccuccuugccagaaucaggacaugaaacaaauuugucugccugaggaagaggccuagguugucaaugugucuugcagucucugaguaacugcuuucugcccguuucugggccucccuaggaaguagguuaguaggcagaaaacacuaccaucuuuaaacaguucugagacagguagagguccccggguccugcccuccuucccaucuucccuggccccaucccacacaaagggcucagcagcacacucaugcuucugugugcuugcucuggcuggcaccgggucugcuaaaauguucuccuggagaggguuuugucucucccugcagccucccuucccccuccugccuuucuuucucucccagucaccacaccugcuccaguugcccccauggcacggggcuuuguaguaggaagcaaggcagggggaggaugggggaugcuccugcaacacuaaagcgcagcauuggacaagagccucuucccacaggggcucagagccaggaggaagaggggggagggguccccuuacauggucucaccccucccccucucgggcagccuucuugccugcucuggcagccuggcuuucagaaaggaacuuacuggagcuggcuuagugucacaaaaccugaguccauuuccccaugguuuccaguccugguguuauaguuuccaucuuccuagcaauaaagcaguaucauauaguuaguguuuucuugcuagggauugugccuccaccguucugccauggaaacugaucaagacuuguugaaauuuacccgagggcauagauucccuggcccuguaucauuuaucucuuagugccccuuccuugacuuuauggaacuuucuagguaacuuuuuuugacuccccaggcuuuguacagggauagcuugaaucaaggcaacacauaauuguaaugcgcccagcucugacuucagugccguaagcaacaacugagaaggugacagugggaccggugccccuaaggaacuuaagaacuagcgagagcuacguguagaggguaaagaaggcuuguuugauccuggagcugaaggccagcuuaagcaaaguaguaagacagaauccuaauggaaauuaagaaaaaaaaacuuccuagggguuucaagacucaacuacccauggaaaacagcaagaaaauaagaagugagaugucagaggauaaacucugaguaggcuuuggacuugcaguggggccagagggcagaaaagugcagaggacaggauuggacugagcuucggaugcucgggggggcuuugaguagaugcucguguuuuuagcauaaacagucacucugaaaucuagcggccccgcauaaccagaagcagauagccacguaucaucuuuuaguuucuggagcucaggguuucaggaacagcuuagcugagcccagugugggguuuugugugaggucacaguccagguguuaggcaggacuacaucgguguguuucugguguauguaguuugugcacguagcuggcaaaaugaugcugaccauugggaggaggccucuauucccuuccucguggauccccucaaaggucuuuucucacagaaaauaauuugagagagaaccaaaaaggugccauagugucuuuuggaaccugacuuuggaagugacaccccauucccuuuguagucuuaccuggguaaaccuuaucccagugugggaagggagcuacacagagcuggacccucagggauaggaucgucaggguucauugugguggccaccccguuacucuucuaucugcuuucuaguggauucaagucucucauccaugcagggucuaaaacccugcuaacauccccucaggugaccuucaguucauagcuuugacuuggagccaggugcagcugaggcugcucccaucuuggaauccaguugcuacagcgcaguuauuccucaccuagaaccugaguuugagauauaagugaccugugccccuacagaccagaccaagggaggcacagucgagcaagcacagaaagcuccuauguacguaccuucaacucaaaauggggcagagggaagcaccucuguguggcuucugcagacagaccucucagaacauuuguaguccacagccuuuguaggacuucauuauuucagaagggaaaaaugaaugcuccgaggaguuaggcuuuacuuaagggucuuaaagaauauauuuauucauuuauuuuauauguacaugaguacaccauugcugucuucagacacaccugaaaagggcaucagaucccuuuacagaugguugugauccaccaugugguugcugggaauugaacucaggaccucuggaagggcagucggugaucuuaaccacugagccaucucuccagcccuacuuuagggguuuuaacuaguggguggcagaggcaaacuucaagcccagcccugucugguuccagggccucacaguccacugcccaggaugggccugaauauaaucuuaggccaugguaugaaaaaagcugaugcaagcuuaugagguuggauaugggggcagguuuauagaggagugaagggauugagaauugugccuggucagacugcugccucugugugucucuuuguucucauuaccuauagacacagcuuguccaaaaugucaacaaguggacguuggggccagguagaaaaggcauaccaagugcuugagagaagcugggcugucucgucccaauuuucaauccucccgucuugccaggguuuauggggcugaggaucugauauuucuaacauguugucuucuuagucagggucucuauuccugcacaaacaucaugaccaagaagcagguuggggaggaaaggguuuauucagcuuacacuuccacauugcuguucaucaucaaaggaagucaggacuggaacucgggcaggucaggaagcaggagcugaugcagaggccauggagggauguucuuuacuggcuugcuuccccuggcuugcucagccugcucucuuauagaacccaagacuaccagcccagagauggcaccacccacaaggggccuuucccccuugaucacuaauugagaaaaugccuuacagcuggaucuuguggagucauuuccccaacugaagcuccuuucucugugauaacuccagccugugucaaguugacacaaaacuagccaguacacauguauccacccauggaaaugcaggggcuuuccuuauuuugaaaauaagcucacaugacuagugacuaaccuagccuccaggcucccaagcugacaguagacugggccacuuggcauagugucaauaaaggaaaacaugagugccggauguaacgagguggcuuucgcagccaaauggcauggccaugaugaauuggauauguugccuggccugacccaggacuucauuucuguuuuccagagcaaaggucguuggagccagcagaagacacgaucuucuaaaucucccacuccugugaagcccacagaaccauguacacccucgaaguaccgaagugcuggcccugaagaggccucagagucacccacugcccgacagauucccccagaggcacggagacuuauagugaauaaaaaugccggggagacccugcugcagagagcagcucgccuggguuauaaggugaguaagucucccugaacaggcgaugacaggaugacgacguuggccuggaccuuagggagcagcuauacuguugguuccucugcauccgauggucucccucuacucugcacauggccucugaggaugccccuuaugugcgcuccucuuuaaaaugucaguucaggagaaaugcauuugaaaagguagcacaauaucguccacugcauuccuaggcuaugaaggggauuugaaauuuucacuuugucuuagguuaacaaaggggaaguaauggcuuccccaacgacacguggugaugauuacugguuacacauuaucuaucuccugugguuucuccucauuugggcuuucagguagaaggguuaagagccuguucaauaauccugggcuaacccacccguacuacauacuuucuuaaacaugggaaugagaacaaacaaggcaggcuuccuuccuucuuuccuucuuuccuuuccuucuuuccuuuccuucuuuccuuuccuucuuuccuuccuuccuucucuccuuccuuccuuccuuccuuccuuccuuccuuccuuccuuccuuccuuccuucucuccuuccuucuuuccuucucuccuuccuuccuuccuuccuuccuuccuuccuuccuuccuuccuucucuccuuccuucuuuccuucucuccuuccuuccuuccuuccuuccuuccuuccuuccuuccuuccuuccuuccuuccuuccuucucuccuuucuuccuccucucuguguaauaguccuggcuguccagaagcucacucuguagaccaggcuggccuugaacucagagaucucccccaccucugccuccugggugcuggaauuaaaggugugugccaccaugcccggcaaaaggcagcauuccuugaguacuuauuuuaucauguuaaggccuuugauuauaguaagucuguugagguaggucuuauuccuagaguuagcaguaugaaaugauauggcaagauguaugugguagauuacccaggugauaauccaaagcccugggaaguagagauaggcaagucagcaauugaaggccagccucggcuacauagcgaauucaaagccagccugggcuaccaacaaaagaaaauaaaauguguccaauaucaguuaugacaguacuuuugucugaguucaaacacauccugugccucccaugugagauguaccugaggcuguauguuggugcacguuuuuauccuugucugcucucuguugaaacacauaccuuuggcuauguaucucugccccacugugugaugguuuccuugggauuugcuuguggaugcggacuuauccacauugcagaguuuaccuucucuauuaggcuuucuguaccuguaaggguccacucuggucugugcaacuugcacggugucuccaucaagcugccaauguaccuuucuugaguauuuaguauggaugucugcauggcucucagggagaccucaggauguauugaaauccagucuccgcagaaacagcaaacaggagaaaauuggaguaagacuagaacagagcuggacacccccagcccaggcacagaguagcuaucuccagacauccucucacggugucuccugggcuuccugagagcacugacagcagaacuaguggguaccauguucuagaagcuucacccaauggaacugccaaucuccaucccaguuuauucauagcuuugucccacgguagcaggaaugcuucaagucacuugaguucucccucuugucccaccaucucagcuccaggaagguagcauuacccgaggcugaaugauagaaguacauuguggcuauagaucuaacuccauugcuuugccuagcaggcacagagcccuggucucaauucccaguacuacaucaauuggguagaaugguauacaccuuuaauccgaaagaucugagauucaagaucauucuuggcuauauagggaguauaagagcagccuggcugggcagugguggcgcacgccuuuaaucccagcacuugggaggcagaggcaggcagauuucugaguucgaggccagccuugucuacagagugaguuccaggacagccaggacuacacagagaaacccugucucagggaaaauaaaaagagcagccugggcuacaacaagacccugucucaaagcaaaaaaccaaagugaauuguggaguugugcuugccugggguaacuggaauuuaugagccugucaggagcagaguucccauguauaucuuguaaagcucagaaaggugauugcugggcagcagaggagccucucugaagaccuuacuccaaagaucaccacccagaugagugcccuuggccauaagaaaugucuuccuccugccaagggaccagcucagggcuggggcccagcaauggaggcugagaacuaccuuuguucacaaaagauuuugaauugugucauuuguuuccucguauaaagaacaggcuguaaaacuugucagacacuuguggaguggcaagucuaacagggaggauucaaaaaacuucagacuugucuuugcucacagagcugucucccaucccuacaggacguaguucucuacugccuccaaaagcacagcgaggaugugaaucaccgugacaacgcgggcuacacagccuugcacgaagccuguucccggggcuggacugauauccugaacauccucuugcaacauggggcuaaugugaacugcagcucgcaggauggcacaaggcaagaaggcuguuccucugccaagucucagaccucaguucagucccucgcuucagagcuuuacucagaccuggauauuugcagaauguccagcugcuggugucaaaaaggcuuuaaccaggaagccuuuugaaaggaugucugaagggagccagcuuaggggcaggagcugaugaguuccucaauggccagucuguaugggacuaaggaaaggcugagguuguccaggguucacucugucccaugccaagucaauccacucaacccuccugaauaccaucaucgucgugggccauuuaucucauguggaauugaggccuuagguuccaagcagagcacuaaucuagguuucacauuccagauuggguuuuuguaauuuagucucugugaacauacaaaaaaauuaacuaccugggucugugagauuggcuugauauauguaggcacuugccuucaagccuggcccucuuggcugccacaugauggaagaagagagccgauuccugcaaguugucuccuaacuucugcacacauauucaugcacacacacacacacauaauacagaaauaaguaaaugcacuacaccauauuaaugugcacacauaaacaaacauaaaaccuuuccaugucucagagaagucacacccaucuccucuacuccaggggaaguguauaccaaguagaaggggccagaucaaaguguacaggcucugcuuggcugcuaccugguguggagccucccuaccuauccaacccugcccuugcgcagucaccugggcccuuccucuuccacaaccacccacaccugcuuuaauuuuaacuuccaccagggaccuguucuccacugaacuccuaguagaucgacauugugcucuagauacuguccgaagaugcgggggaacacagaggagagacaaauaugggaaagaaaaagaggugcacagagacaauaugaagcguaggccagagguggcuccccugcucucuuacccauguuacacugggguuaccucgaggucaccauacuaucuuucucacucuucuucccccuaauaucgcauugugaaaguucuccauuaaauccuguagcccugacucuuauuugaccuccacaggccaguucaugaugcuguggucaaugacaaccuagaaaccaucuggcucuugcuauccuacggagcugaucccacacuggcuaccuacucgggucagacagccaugaagcuggccagcagugauaacaugaagcgcuuucucagugguaagcauugaccacaguugcagccagaauccucaggguuuguuggccuuggacuccucaaccgggggaugggggaggucuucagucacucuguccuagacaguucccacaaggauguguucugucuucacguauuccuucagugucuuggcaauuucuagcuacuuuaaaaagucccuugcugugaguguccacaucacuaccucaguaaggcccucaccuccuacagagauucauuucaccacuaggugucuggagcagaccucccaaugggaaacuggcuauacucuuggcuggaagcaggauauguugaccugugcuaugaauggaaugucggugguagagaaugaauaauccccauuuugcuguugcugcagucucuucuugauuguaauuaaagugggaccucugggacccuuccugaugcuugauucuuuguggcucuucucccaugguaacuuugauacuuucuaugcauuccaguauuccccuucucuccauuccugccucuucuccacccucugccuucuagugaagugucauguucagguccacggccagggccacaagucauuucauagauuuuucucucuaguacguagcacugugugucagcagguaggcaggcugaucugaguugggcagcuaggaugggaaugaaagagaagacucuacuuacagcaugcucagugucaguuccuucugccguuaucucaacucuuugugacaucauggcuuaguccuucggauugccugagugauggaugcugcaguugggaguugcagccgugacccucuucauaggcuucaguugugauacaaacaucuauuccccucuuacccaaacuuuggcccauuggucaccaacuacaccugccaaugaugcagcacuggguucccagguuaggcgggagucacgcuugcuuaagagaauuuugcugaguagcuaauaaugucaggaguaagagaaccuauacuaaaaguucccaugggagggaaaagagguggggauauuguagaggcugcagggaggcaaggggaugacagauugccuaggaaggguuugacuugugcccguccacccuccaaacagugcccuuaacuaaccucugaguauaggccucaggcuuuccagccuuccuuauccucgggcuaggggaccgaccggaggcuuccuuuuuuaauuucuuccaugacgcuggguccuugagcaucuggucaucaugagacauagucacuuagggauuucuuuccaucagucacuuaguguaggccaguaaugacugguuauuaauccuuucagcagagccacuccaagggugcaacaucuguagccuccucccacgcguguacaccuauguauauucugucuuagaugucagcauggcucugcaggacaaugaagcuucuuugucuuucguaacuugucugauggggguggggggcugcaaaccagguagcaccucugguuacuuuauugaauauaaguguaaaccuuuccucccugauugaucugucaaacuccaaaagacuuuaaauguugacacuuuguugauuuugagaugggaucucucuguguaguccuggcucuucuggaacuugcuauauagaccagacuagcagagaucugucugccucugccuuguaagugcuaggauuaaaggcaugggccaccauacucugccaauacuauuuuuuaaugccuaaaaaaugagagauaagaacuucuucucuuuuuauuuucuauaaacucaucccaaucuccuagguaauuguuuuaaaaaaaaauaacacuuuuaacgauaaggucucacugugugacucuaaucagaacuuguugcuuauaucaggcaggccucaaacucaagaggucugaaguuuugucuuaaauaacaucugcuugccucuguuuccugaaugcuggaauuacaggugugugcaacuacccccagccaaaaagaauuuuaagacauguauuacauguuuuauguaauucuauuaugauuaauagaauuaauaaauacauuuaucauuauguaaagcuauucuggguuacauagugaguuccagaccagccuguccuccuuaagugaacaaacagcaagacacugcuuaaaaaaaaaaaaaaggaaacgaaauucaucuaauauaacaguuuaacugacuaauucuaugacauuaagugcguucaugauggugauaauaaccaucauugggggcucugaugccucaaaacugagcagcgccucucuuccguuucaucccuggaugcuaccucaccgguuccccaggagccauaaggucgaauguuucugagguaggaagguagggaggugcucuucuuauguuacaccauauauccagcuaccuaugcaugggcggcuuuuguugguguuuuuucagagguggagguuguuucugguauugcuguuguuguuguuguuuuaaauuucaguucaccugucuggcugagacauuuaaaaguaucccauucaucuucaagcacuugcuuagccaggugcugcagacaugcauugucugcguccucccuagcccaagucuuccaguagaaaaugaggcaaacccauguagggugcuaaggacuccauauuuugcaagcaucaggauugggcuucauggcuagcuuuccucauucuguguaaggcuccugcucuggaaugguugccuaggacggaacucuucuaagaaagcuaucuuguuuacauggagcauggagcuguccaaacccccaagagaucuaggaaaggcuucccccaugggccaucuugcuaauuuaccuuugacccuuuggagaaaaaaaaagagcaauauccaauguuacugcgagggaaaauagaccgaguuuugccuccucuguggaagcgcacaggaacugugcaguuagggcucagacauuagacuucuuucccuuucacuggggaaaggguuagccaaugaccagucaaggucacugaagcacacaguuuugguuuuccugcagagacuucuaugauaugaagccauauugaagacagcucauuucuuuuucuccuuucaugucccucagcuggugacuuugguuggguaggguaugcuaggaugcugggaucuagagaaacucuacuagcuccaauuccauacgugggaacaagguuuucucuacuuaagaaugagguacugaaggccgggcagugguggugcacgccuuuaaucccagcacuugggaggcagaggcaggaggauuucugaguucgaggccagccuggucuacagagugaguuccaggacagcuagggauacacagagaacccugucucaaaacaaaacaaacaaacaaacaaaaguacugcugagggggcuuucaauaaaaaaguguaggguaagauugaugagguaaaaugacuaauugaucaaauuacugaucaccacgugaucgucgguucagugcccuuuacuucauuuacaggguuccagccgcugcggucuaguucugaaacauuaucaucguccuugcauacaaccuuguacaaacuguuuauucccgucaccuucuucucagcuccugcaguugccaaucugcacuccugucucuguggcuuugccuauuccagacauuucauauacauggaacccuauaaggcauaaucauguaguauagugguuuuauggcccaucuauaugcuagcauguuucagaacuacacucauuuuaauauucuaucacacucucucccucuccuucucuuccuucacccucugucugucaguuuguaugcgugacaaaugucagaggacaaguugugggaacuuagucugucuuuccaugugggggccugggauugaacuuggaucuucaggcugaugguaggcaccuuuaccuauugagccaucuaucugacccaacauucuuuuaugacugacuaauaguguguccucugugugugugugugugcgcaugugugcgcaugcacacgugcacacacuauuuuuaucuguucauucaugcauagcccuuugcgcuguguccaucuuuuagcuuuuccacggugcagcuuuggucacgugugcuccaauccuuguuuuauugguccuggugcauuuguaugugaacaggaauguuuacgcucacaggaguuucucacacaacggguaaaaucuugcaaguuugcuggggaugaaggcagaauccaagaaaauaaaggccacucauuuugaugguaguccuaucugaggacuauggauuaaugcuauaccaucaggugacuccgcccacguguuugucacgcaugggccuguuccaacuuuagcaucuuugcucaugccagcuaacuuuggcagguucaccuguccacgacaaagcuuugcaggcgguggagagaauuagaggaaugugcugggcucugaaggcgauuccuagugggagccacaggaauguggugaacuugaccugcuccaguggaauccugugugacugcggguagggggacaggggcggcggagugcauauguuuuggcacacugcuuaagcaagcccuuugcugucucacuuuauugugauucucuccuuucuccuuagucauccucuucccuaguauguuucuuaguauguucuucucuuaguauguuuauuaagcucuucuuaggggccagacacuggaguuccggcaaaggagggacaguaguuaacaaaaaguagacccuguuccuuccuuuuacagaaagaagggccuccuuccuuuauuuucuaugauacaaagcauaggacuagacucagaguagacuagacaccugcccaacagaugcuucuggaaggaaguccuugugauuuaggcaguacaguguacugaagauguggaggcugucagcggggccuccauuuuaugugggguguacagagaucuaaccuccacaacguaaggugccucacucugcuguuacuuuaaaagcuauucccuggugccuucccagugggagccugagcucgucaugucuuggaagauggcuaagaagggaguggcuuuggaagguuacauuaacagacaguucuugcugcuggauugguccagaaggggcacuggguggcgaugguaccuucaguggaggaagcaagcugcacuccuuggggggaauaacucccaguggaauucugggacuggcuuugcaggugaccacccucaucuccuuguguucuuuguguucucuucuuuccuguuaccuaggugcuacuugagagcugguggcgaucccccaucgcucagccagccuguuaauuguacaauugggcacacuggcaacuuccuagccuugcacucacaggcuucaucaggaaagccugcuuuguaucuggguggggagaagaggugaaccugucuacugacugaugcuaagaagcagggaggcugagggcgaccugaggccugucuuuagagcuagccaaugaaagguggguuguaaaccccuuucauugugggaguagauacauagaagaaguuagccacuugagacagcugugugauggaguguuguugagucacaguguuguacuacagucaccacuaucugcuuucagaacuuuuuuaucauugcagagggaaaccccagaucuauucuuagucacugcccucccccccacacacacacugccauccaugcuuagucugccuucugucuuauugacuuugccuagucuggagauuucauugagauggauauauauauauauauauauauauauauauauauauauauauauccuuuguaacugauucuuaguagcaucauguauuuccaguaugugacauauuaucacucuuuuuugauuaauuuuuguauucgcuuuacaucacaguaucaccccucccauuaaccccuacucuuuucuuuauauggcacuuugugucuggcuucuuucaccuaccauucauguuguuccuuuuuaugguuuaguaauauucuucuuuguggauauuaccucauucugucuguccauucaucccuugacggacauuugggcuguuucugacuuuugaccauugugaauggagccaugucaguucauguggacagaauuuuguuugaauacuugucuucgguucuuuuuuuaaaaaguaauuuauugugugagugcaugcauguuugugugugccacccuuacaggccacaucaugcagguagcagccacugggcacguuuuggggugguaguccucucagagcaccuuguuuucaagcaggaucuauuuuuggugugaugugcuccagccuaguugagcuuuuaguugacucuccuguuucuccuucaagucuugcugguggaguucugagacuauaaauacuuccuaccauacccagcuuuuuccaugccuccaaggaucaaacuguuaccaggcuugugcagcgggcacuauuaccugcugagccauuuucuagcacugccucuugagcucuuuuggguagaagcaaagggguuucugguuuguuuguuugguuuucuuuuuuuuuuuugguuuuguuuuguugagacaguguuucuucuaguggcccaggcugaccucaaagucaguuuucuucccuuagccuucugagugguagggugugugugugugugugugugugugugugugugugugugugcacgugagugccacccugcuguuauuuauguauuuuuugagcuauaaauaaacuuagauucuugcaugugcuaagcaugcacucuaccacugagcuaccccauagcuacuuaccuuacuuuauagaagcuagaucgugacuggacacacauuccuauugugauaggcgugggauucugcuuguagaggaaugcccugugccuuuugaagcugagguccccaaguaacagccuucaggcugacguguaagcgagaagaggcccaguggggacuggaggcuguacaugugucacaguguccucuggccaacuguugacauagaggaaugcagaggcagugcugccagaucuuagaauuuuuaucuuuuuuauauauaaaauguuggaaaucuauuuuuuuaauuuaaacccccauuuaauaauacuagaggguaauuuuuccuuuuauuaaaaacuaggucauacaucagugaggcuacaugggacuucugcuugcuugcaaucuguugugucucuuuccugucaccccuggccacucuuguagccuugcccacuuccccucccccaaccccauauaagcuaauccucaagagcuccucugugucucacaccuaccucuguucucucaucagaucaccucucggaucuucagggcagggcagagggcgauccccgugcguccugggauuucuacagcaguucuguguuggguaaguucagagugggaagaagcugggagggcuggaugcagcuccguguggcucagagguaggagccccgcuguggaggcagccuuuccucaccugcuaguagcuuuacgggcccuuucagcccucccccucagucucaauaaucaccagucugaagccugagaugccacaaggauuugcacaaugucauccucuccugccuugucccuuuccccacccgggaugcuuuguaauccuagaguuaccucaaauccuaguguuagccccuuacccggcagcuuucauugucccccacucugucccugugacauugcccucauucguuuuuuuuuuuuuuuuaauuuucuucugggaagggugugguggugguuugguuugguuuucuuguuugcugcucuguuuuuuguuuuguuuuguuuuguuuuuuugagacaggguaucaaucuguaacucuggcuggccugaaacucacaaacacccuucugccucugccucccaagaacagggauuaaaggugugggccaacaaggugcugggcuuagcucuuaguuuuugagauugcugcuguccugggcccuuaacccucugucacaagcacugugcagcaggaagcucagcacaccagugucugccaucauccagcguuugucuagugagcugggggccgaggaguaagagcagaaggcugagaugaaauacgucgggccgcacccggacgaucgaucggguggagaagggaaccuucugagucuauggaccuugggaucgggcagugagguggauggaggaaccugcagccagaggacagguggacuagcccguaguagcugcuagugucuuccgucuuuaucugcaacagcugagcuugcaaccuucagggcacuuugcuuuucccaaccagaggguggagaaggauaauggccuucuggccacagcauaguuccuuccaagacuagaacuuuccugugcccucuccagaauucgaguccauagucgauccagccaggggccuguggcccuguauuuauccccuaaguggucccuucauacuccuuuauggagccguuccuuuccuucaguuuugugcuuguagcugaugccccauguucucauccuacagagaaaaaagacggguuugccugugaccuccuccauaauccuccugggagugccgagcaaggagaugauucagaacaggaugacuucauguucgaacucucagacaagccucuccucccuuguuacaaccuccaagugucagugucccguggguaagugucugggaagucuauggagacugugugacaguguccuggcaaccuguggccugcuuagggaaggaggagcucugcagaaggaggcacaggcugucuggggaaugagugcuggagcagaggaaagacacccuguuccuccaguccaaacucaagcuucacagaccuccagagcuacaccucagcuaucaacuugaugcauuuccaggcccccaaaucggaagaauuuugugcacuguuguguguggaggcgauaaucugggaaauaucugggaugaugaacuauuagaaucucuggaacauuuuugugguuucuggggacaguuacacagaauacuugcaauugaaauucuuggaaaagccaagacauaugguggccauagcuuuggauccaccagaauucuuagcaaugcaaagcacagggcuuccacagccuguggucaguaaggugaucaguucuccaggcucagaugacucugagaacaugagaacacccuuuuuuggagacuagaguauaccucacacccgguaguagacugagcccaacugacucuuagcugagggcaguucgucagccuucaagcccauggcuugugauugcuuuuccagugcaucauauggaaguguuaggcagauggauaaaaaugcuacgucagggcgcuggagagauggcucagcgacuuagagcacauggaaagggcccagguuugauucccagcaccuacaugguagcucaggaccauauauaacuccacuuccaagggaucuggugcccucuuuuggucuccacagacacuaaucacaugugugguacauacacaugccugcaggaaaacccucauauaaaaugaauauaucuuuuuuuaaugcaggaucaguuaaacauaauuuuuuuauguaggaucacucaccuuuuuguucuuagucuccuuguucuggacagaagcugaucccagggggugaggcugggccucugggauauaguauugcacaguugauuauuucccccaaaguauucagcaccuccuucucugaaacuggauccugggccacaggcaguaaaagaaccagagucguuuucucuagguacagacagaacaugggcaacccguuaagccaggcgcauggaccucugagccauguaugugccugcugccuacagaggccagaugaggccguuggauuuacuagaacuggagcugcacacagucaugagcugagccacuacauaagugcugggaauugaacucagguccccuggaagagcaagcagugcucuuaaccauggaaccaucucuccagccccuuuauccucguucuuugaaagaguugguccacauauaugguauugauuguuccguucucuuagcugagagcgcuccauucccuaauuuuaugauguggcagacuuugccauggaagaaaugcugaauuuuagggaaaaggacugagucuaaauagaugagaguaucuuguuuuguugauacaggaucuauauguagcccuggcuagccuagaauucacuagguagacaaggcugaccucaacccaccugccucugccuuccaauuucuguaauuaaagacuugagccaccaggcccagguagauaggcguuuuagauaccauauggaaugacugaucccauaaacauguuuuauacccuggauccaaccuugugauccauaguacagauaacucuggccuucaaaacagcccagcugaguguaguacacagggaagugcgcaaugaacuuuaauaagaccaaaugcucuaagcagguuuauuacuauaaaaagaaugucaagugaaaaagaaaaaguucacuucauccugagcucuggugaagaccagagaaagccagaguuuauguugacuuuguagccuuuuggaaaugggcugcgugucaugagagcguagaagauguacugaacacucaauuacuuggggguuuguagguugaaaauggcauccgagcugggcuaaaagaaggagaggcacagggaaggcaugaacaaaggcauuauagcaggcacacucaagucguucagaaagcaagagccagauguuaugacacaugcccagcacuuggagacagaggcagguggaucucugugaguuugaggccagccugcucuacagaaugaaucaccaguuagcuaagguuauauagugagauccucugaaaaagggagggcgagcuggagagauggcucagaaauuaagagcacuggucuccaggaucuguguucaauuucuggcaccuguuaugguugcccauaauugucuguaacaccacuuacaggagauccaacauucaugcaggcaccagguauguacaagaagcauacagacagugguggcgcacgccuuuaaucccagcacucgggaggcagaggcaggcagauuucugaguucgaggccagccuggucuacagagugaguuccaggacacccagggcuauacagagaaacccugucucgaaaaacaaaaaacaaacaaacaaacaaacaaaaaaagcauacagauacauugggcaaaguaucuauacacauaaaauuuguaaaaaaaauaaguguuucugguaggacaggaauacaguaccggugaguagcugugggagcugcagacugaguagaagaaauugaauuggggucaucuuuuggaggucugacuuaauacuacacgaaaaacuugcugugugaccuggaacuuacucugcagaccagccuggacucagauucagagaucugccugccucugcuucccaagggcugggauggaaggcaggugccuccaggccuggcuucuauuuucuuuuuaauuaugcauagaugugugaauuugcauguguguauauagacaugaguguggguacccaaggagaucugcagcuggggucccagcaaugaggcagcugacguggguacugacaauugaaucugagcacuagaagaccaguauaugcuccugguuguugagccccaagucgguaugcuugcuggaacuaagagagagccaucauaagcuauucagugaggggggagacggaggucauauuaccuuuuaagaaaagagggcccgagggccugagaaaccugguaugucucacuuucuguucaguaccuuuagucuuaaaccuauguacuuaagccuauauuaaaauagcuuuauuagguuggucccccauuaagaaaacagagacagagcaaguguaaggcugguguauuguaacccaaacuagaaguggcaaaggcugcagaggagaaguggagugacuaggaggaagaacuauaaaguggggugagcgagugaggggagacugcagcacuuccuccuggguugaguuccugcaagugcuugccugguaagcagaggccucugcagugccccucccagcugucccuaggcugccgcccagucucagaugugcuccacaagggcagacuggcuguaaugugagcccugggccugcagaaacauuggugcugccgcugcuggaggaaaaaaaaguugucuaauacauuccagagccaaagagaaaugccuuuuggauuacccacaguuuaggccuuucuccacagcuccaccuccaccagggaagaucuagaacaagugagcaggagucaggucaggagagggaggccaggcaggguugccuagagugggggucaggaagauguggccccagcagauaguaaaugccaggccaugggguagcaggcuaagccuaguuugccccuggcuugccuucuauggaagagcuagccuguggggugaguacucagugaugcucagcuagaagcuggggcagguauugugcucuaucccagccucaguccagagacucgugguuuccugagaggcagcaguuaagugucaauaggaaguauggcuguggggguggacugugggggucacuuggucucuuggccuucuaugcuuugggggcuccacucccccuccugagccugcuucccuaauucuuucuuugccuuuccagacccugcaacugguuccucuucagcgauguccugaagaggcugaagcucuccucaagaaucuuucaggcccgcuucccacaccuugaaaucaccacccugcccaaggcugaguucuaccggcagguggccuccagucagcugcugagcccugcugagaggccugggagcuuggaggacagaucucccccagggucuucugagacuguggagcuggugcaguaugagccagagcugcugcggcuccuagggucugagguggaauaccagucuuggagcaguugacagaaacagccccucuccccgucuucuuucuccuucgaguucacccuucccccaccgcucaugugucccccaccgagcaccagacugcagaaagaggcaauaauacggaccaacaagaagccgccuuaucaaugccagcauuagugacuggauuccuuucuuuuuugggggggggaggggguuacaguuaguucucaucucccuguuguuguugugguuggugaugggguggaaaguugaacuccacuucugaagacaagaggucuggagauggugggagguggcaccagggucccuuggacuggcuucuacacuucugaccaagaccaaacaugggccuggguggcuguggccuguccuaaggagaagugagaaaaacccaaaucucuugagugcccccuuuugucucccugugcucuucugucuuccauaguauuuauuuuauuaguauuuaauuuguauuguuucauugguuucugauaagucuguaucacugugacgauuugagacaacuuguuguauugagggacuuucuuuaccuccucucccuuuucuuucuacgugagcucuggggaugcucgcucccucccucccucccucccucccucccuccaagaaaaguauucccagcuugucuuucuccauguggggagggagcagggugaggaaggauagggggacaucaucauaugauuaaacaaccuggcugcugcugaccuagagcuggggggcugggggcaaaucccuggccuuuggugcucccccacccccugccaguuuuaccccacccuuuguagcagcucuuccaucuugagauugguguuuacuagggagcaggguuccugagcugcuccgauaaaggcagguugagaugggccugaggcaagggugcuccucacacugaucucucagugcaguuugaacuuguuccagcaucuuuggcccugcaccccuccccuacuugccucaccuuaccuacccugggcuccucaucuggaaauauugagccuuugccuugccaccacucccacagccuuacagcauccucuaccccucucuccuccaccugccccccaacucuccuuuggaaucuguaaagggcccggaacugacuaggcuccacaucaacucggggaaugagugaguggcuccuaggccuuuggaugccugguuagaucugguaccagagggacggaggaggagcuuggguuguuucccuggccccaccccuccauggcauugucuccccccccccuucuuauuuuucuaccgauugcuauuuuuccgaacaauccuuguagagaguauguaccauccaaaggcaggagggccuugcugggguuggcucuggauggagaugguacaguuuuauuguacaggugcuaaacuacaacaaagaagaaaauagaaaaaaaaagacaaaaaaaaggaaaaaaaaagccaguuuggggaugggacaaucuguccucugggggcuccugacccauuuaggagaguucuuucuuuuaacuguguguguguguuuuguucccagaggaauuucugaguccccuucuguaggacagccccaucauccuacccaauugguuuugaacaacuguuuucccuuuuuaacggcaacaaaauuauauauauagauauacauauauauauauauauauauaaaguuggggggguggauuucaauuuuguuuuguuggaaauuaugauacugugugguuuguuuucugguuuuuugguuugcuuuuguuuuguuuuucuuuuuuguuuugcauuucgguguguauucuggcugcccuuuauguuucguuuuaagcaacuggcuguggagucaaaaacacuugcauacug

SEQ ID NO: 9478 - RNA, 714 nt, Mus musculus
uggggggucaacaagaucuugcugauguuucugaacaucucgacacagaucuuccuuccugccuccgcuucccaaguagcagggaccacagguagguaugucacugugccuggcuuuuccaugaauuuaguaguuaauggccuuggcucccauggcuuuccuuuccuuuccuuucucuccaucuaggugaaacauucugaauacuuaacaagcagaauggccaagccccacaaauaauaaaucagaccaggaaauuggaaaauacauuuagagccagguauugugcccaugccugugauccuaauacuggggaagcugaagcaggaggauggauuugaauaugaggccaaccuggacuacacagugauaccucauauccaaaauucaaaugaaagggagaggggaaaagagaaaggcauagcagggagccuuugccuauaguaacucauuuagcccuuggcagcagccccuaggacuggucacauaggcccauuuuguacaggauagugacuugccuaaguuccaaggcagaucuaggucuucuuccugaaagguccacacucggggucugcagggaccucuguuggccauucuaggcuguagggucuguagggaucuccacugcgcaaaccuucgagguugugauagguaacaggaccauguucuggaggucagaaguuaccaggaccuagccuugcucccucccugcgucug

SEQ ID NO: 9479 - RNA, 42509 nt, Mus musculus
uaccaggcugaccuugaacucagagaucugcuugccucugucuccugggauuaaagaugugucuguguauuccagaagaucuuuggauguggucccuugcuagagcagccauguuugggauuaaaauuccucuacaggaaaauaaaacagcccaggaucugagugauguguguguaagcacauuggaaugugagugcucagccaaguucaaguuauuaaaaauacagccuucuacuuaaucuuauucuugaguuggagauauagcuguagcccuuuacuauacgugugggucacccauuucuaaaacccuugauuauacuagacaacauuaaaaccauccagagaagccggguggugguggugucugccuuuaaucccagcacuugggaggcagaggcagacagauuucugaguucgaggucagccuggucuacagagugaguuccaggacagccagggcuauacagaaaagcccuguuuugaaaaaccaaaaaaaaaaggggggggcuggagagauggcucagugguuaagagcaccgacugcucuucugaagguccugaguucaaaucccagcaaccacauuguggcucacaaccagcaaccacaugguggcucacaaccauccaugaugagaucagauguccucuucuggugcaucuaaaaacagcuacaguguacuuaaauauaugaauaaauaaaucuaaaaagagagagagagagagagagagagauuggaucucacugcguuguuccaugcugcuccccaaaacugcugggcucaagggcugucuugccucagaccuucagugaguuucuagaaauaacaaaaagcaauaucuauaaugucauuauaauauaaaauauauuuauuuuauucuggaauugauauuuucaauaauaaucccccaaagcagauuuagaugaaaaauaucauucaaagccaggagguggugacacaggucuucaaucccagcacucaggaggcagaggcagagucaggcagaucucugugaguuugaggcuagccuagucuacagagcaaguuccaggauagccagggcuacauggagagaaacccuuucucaaaaaaaaaaaaauuaaucuugagggcuggaaagauggcucagugguuaagagcacuuguucuugcagaugacuaaguuuacuucuuggcaccuacaacauagccaacuaugccuaauuaauguuaugagggcaccaaccauacaccuaguacacagacauaaaugcaagcaaaacagucauacauauaaaaucaaucuuuaaaauguuacuaacuguguuuugaggcuuuggggguagcugucauuuuuuuuaauuagguauuuuccucauuuacauuuccaaugcuaucccaaaugucccccauacccacccacucccacuccccugcccacccacucccacuuuuuggcccugggguuccccuguacuggggcauauaaaguuugcaaguccaauggccucucuuuccagugauggccgacuaggccaucuuuugauacauaugcagcuagagucaagagcuccgggguacugguuaguucauaauguuguuccaccuauaggguugguagcugucuuuuagcaucuguuucugagacagggucucucuauguaguccuggcuagcuuccaacucacagaaauucuccuggaucugucccccuagugcugugauuaaaggcaugugcuaccacauccagcuuguuuuguuguuagucuuuucuuucuuucuuucuuucuuucuuucuuucuuucuuucuuucucucucuuucuuuuccuuccuuccuuccuuccuuccuuccuuccuuccuuccuuucuuaucgagacaggguguuuuguagucccagcuuuccccuaacucaccaaauagcugaggaugacuggaugaccuugaacuccugauugccuuucucugccucccaagugcggucauuagagguauaugacuccacuccuggcuucaugacuugcgauuuuaaacacugaucuaaucugcugaacagauaaugaaacuuuggguguuuucaugcaaugaauccugcuuccuggguuaaacuuccuaaauuaugcuuuagucauucccuuccaccaagauauauauaaaaaaaaggaauuucaucauuuucaaauucauuugacaguucaaguuuggcugcgaugcaguugcauuccuuaucacuacuuccuaauacagcaagucuucuguuauuguuuccugaaaauagacugaacuuuauuucugauuuuuuuuuaaacuuuggauaggggcugugugcugcuucaaacugaaaagaggaccuuggaauguuuagcaaacaucuugccucugagcuauacucccagccuuucaguguuuugaagcagucuauguugcucagguuggucucuaauuccuaauuuaguuccaugcgcugagaaacuguagguuuucauccuuguuuguuuguuuguuuguuuugguuuguuuuucgagaggguuucucuguguagcccuggcuguccuggaacucacuuuguagacuaggcuggccucgaacucagaauuccaccugccucugccucccgagugcugggacuaaagguauugucaccaugcccggcuuauagcuuuucauccuuaaguccaacugucuccaggucaguugaagccaacugggugacuuguccaaguagcagaggcaggauuaaaccuagguccuuauggaggagaaauauguuuauggaggucaauauguuuaaacccuaaaaauauuacuuuuggccucaaugcauuuacccucugaaauacuauucuuucucuuccacuagugacucugucccaaacuccuuccuugcaguggcucugugauagguaucaucuaaaugacaauagaucccauuacagugaucacuuuccauguuuuuauauccacagaagccucuauauaguacuguuccauaauaagggacagggcaucuucaccaggaagccuuggcaggcuugauaugaacaaggcuggccucaaauuuccuugcuguccgucugucucugucucugccucugugucugggaguucagguguuaggccacuacacacaguuuccauaaauacuuaaucugcaauucaaaacucccacaggagagcaaaauaucuacuuucucucaguucucacucuguaucucccacaacuuucuaaguccugcuuagaauuucuuucacagaaaauuugucaggcacaaacuuuuuugucagcuuucucuucucaagcacgaaagccauaauagcgcgagacuauccacaacacuugauacauaugacagugauaacggagauauaacacgugaaguacacgucccacuccaucccgccucccccccaccuccgaaaaaaaaaaaagaaaccaaaaacaaacaaacgaacaaaccgggcugcucaagaaauggccaguuaguuuuaaaacauggauggaauuuauucaggauucaggaagucggguguaaugacuaagacugggggaaagacuagaauuggaucacagaaagagauucagaaaggcuuaaaugccggcuagcuaguugccuaaaacgcacaaaaaaaaaaaaacaaaaaacaaaaaacaaaccagaaaguaaaguucucaggucaguuuuggugaccguuuugcuagcaguccccauuaccuacacagcggcugccccacccgcugccuccgggcaggagugucccuuguccagguuucuuaagcggcucaaccuacuacagggccgcuaacucugggaaacuugcaaaugcggaggcggggcccggggcuuugcagcgcgcgugccgccggacgcaugcgccgaccuccucgcugugggaccaauugcagugcggugcugagucuuacgccugcgcagugggucuccagccucagugccuuucccccuggcucuagugggccgguuccucuauccaauguccacucggggcugggaggaggagccugcguagugugcgugugacgggagggggagcggacccgagcccgugguauucgacccguucgacggugcguggaaggaaaaggaaggagcgggagcuuccgaggagugaucgccgaaauguuccgguguggaggccuggcgggugcuuucaagcagaaacuggugcccuuggugcggacgguguacguccagaggccgaaacagaggaaccggcuuccaggugacuagcugaccugucccaggcaaccccuuauccuacuucaaaguccaauggccuaggugccaugggcuccccaucccucgcagagcuccccuguccuucaaaaaaaaagaacuuucuuucacagucucaagaaucuccaaauuggcgggauauaaacccaagaguuuccaagcugaggaauaggcauacuuaugccggccugaccuucaagagauuugaaccccagaaaucagcaugaggccuucuucugggaggcuuugcgauuuggggauaacagaacgcuuggcuauaacagaccauauugcccauccucugccaccuugccuuuuuuaaagcauugaggucagauggauguugucauuuagugguugggacacagucacaaguuucuccuggaacucagauuaucugcuuuaccucccaaaacuccacgugagagcuguacauuugauuguccuacgacguggcaaugguguaucaccaguagaaacuguaugucagauaucaagagaauuagcucagauugccuugagauggccagauaguugaauuccugguggugggcuuacacgcuucaaugaacguuuuucgaucccccucuauuuguucucugggaaguugucucaucaaacuuuagagcuggaaggaauuuuguggucaacaccaacccauucauuuuauggauaauaaauugaggaacaaagaggugaaauuacuugcagaaggucacauaauuaguagguagagcuaaagcuacucugcuagucucuaggccccugauccuauugcuacacgccaauccuacuuccuaaaguuugaccugaaacaguuaagaaugaauucgcuucucuuuccacuaauuagcccauugugcuucugauauccauggguuuaucugagcaugguuugagucaucaucuuuucuaccuauacagauuugugggaaugaaugcccccccuccacaaucuccaagguguauuuuuaaaucaacauuuuaaaaaaucaucauccuaguguaauuacauuuauaauaucaaauguuacccuggagucuuuuuugaaguucagaugccuuuucuguaguuuaggaauaagaaguggaaauacuuuuugauuguuaggaccuuugcaaauguguuuggauaguuuguccacuucguacaugucaagaaaaaauucuuaauggguguuaucugcuggguauggugacauaugacuuuaauccuaggacucuggaggcagaggcagcagaucucagagaauucaaggccauccuaguguacauaggaaucucuaagucagucacggcuauauaguugcccaucucaaaaaagucaauguuaucccaguuaccucuuggaacuuaagaauuucuguuuuagaaaaaaagccaccucuaguuuuccuaaaaacccagugaauauaauucuaauuugugugaguucuguacuuggaagcacuggugcucuauguaaauuguggagaaauauuuaaaaauuuagacaacccaaagauacuacccuuucuaauauugugcacuuauuuugcuaaauacauagcuuuuuaccagaauucugguggcuaaccaaauguucucaucaauuaaauauucauuugauuauaacauuagaucuguggaaaaauacaggacugaaaugccuuuuccccacugcauggcugcgguugaaggccucuccuguagaaaauaccaggacuuccugcaauacccauccaucuuuuugcacacacuucuuuguccauguaccagcggaugacaucaccugcuuuaaaaaugagugggggguagggaauacaguuuccaaaagaaaugaugguaaugucauuguaggaaugaauguuuuauggcucauuugccaguugccuuuaaucugauuucaguuucacauaacagcaucugcccuauguuuucacagagguggguaagagacaaggucuauguaccacuuugcccucuuuuauccccucccccaaugcuuugccagguuguuagcagucuuucuucuuugcuuuuauuuuucuuguuuuaguaaaccuugaagccugcauuagaacggcgucaucuacguuucucaccauuguaaagcucauuuccaucacaccuggcuuuuugucuugaaaccucaauaccugcuguucggcuuuauuuggauuuucugccucuuucuagaaaugauuaaggguaacucaaucacaacucugugccugcaucuauuacugggcagcagaagggguugauaauaaauauuuuguguucuauaauauuuuauuuauucaccaaacauuaugcugccuauugugaucaaacugaucacuuaacucccugaccuaagguucaaauacuuacauuuuucuuucuuuggaaucauaguaucuuuuuuuggagacagaaucuauuaugcugcucugauuguccuggaacucacuguauagagcagguuggccucauggaggucugccuggaucugccuucucagugcugggauuaaagguggucaccaauagcuugucuugaaucuuugcaucuuuaaagaagaaacugagcucuugguggccuagaauccuagauuguggguagugccaaauggcacauugauacuuugagacaagaucuugguauguauuccaguuguuacaacucacuguguagcuaaguauaaucuugaucucaugguccuucuucugucuuagccucuagaguucuuuuguuguuguuguuuucuuuguuguuuuuuguuuuuguuuuuugguuguuuuuuugguuuuuuuuuuuuuuuuuugggguuuucgagacagaguuucucuguauagcccuggcuguccuggaacucacucuguaaaccaggcugaccuugaacucagaaauccaccugccucugccucccaagugcugggauuaaaggcgugggccaccaccccagcuuguucucauguccuaagcauucuguacaauuucugacacauacugaguucuugaugaagggcuucuuuucuuuuuuuaaacucuuuuucuuuuuuguuaucuaaagcauuuuuuucuuuuguguuucuuguaagaaugauucauaugguaguauaauuaucauucuuuuuuauuauuagucaaugccaaaguugugguucauaccuauauucccaguaggaggagagaacugccaagauuuugaggcuagccuaugcuacauagugaguuccagcccugcccagucuauaaugugaaaccaugucuccgacaaacaaaacaaauagaaauaaguguccagucaaaguaccggggagccugagguaggggauuaugaguucaaagcaaguggggacuacauagcaaagucucaucucaaaacaaacccacacacaacaaaaguuuggucaauaucaauaaaauuaggaaaaacauuuccauuuuucuuccauuguuuagggccagguggcaguguacaccuuuaaugccagcccucuggauagugagacaaacugauuucuaugaguucagggccagcuugggccagucaggacuacacaaugagaccgucacucuuaaaauauuacuuucuaccguguaucaggaaaguuacagaagcccagcuugaguuacuggaaagugcauucuaccuguaaguacaaaauaauuucuauugcugcagaaaauggaaaacaaguaacugguacaguaaugagaagccaagaguaagcugcccucucagaaggcaaguggagaggcauucaguugugaucacugguucccuugauugccuaaaaauugaaaacuacauggagaagggcauagggauagucucauagauuaaaauggaggacagucccagugguuucacauagugucuacagaauuaccagguuaaugcuagcuaaacuggacaacauagaaagaccgugccucaaaaaaagaaaaaagaaaugagguaaacuuagagauuuuauuuuuuaaaaaauauuuauuuguuuauuuauuuauuauauguaaguacacuguagcuguuuucagaaacuccagaagagggcgucagaucucauuacagaugguugugagccaccaugugguugcugggacuugaccucaggaccuuaggaagagcagucggcgcucuuaaccacugagccaucucaccagcccgagauuuuauuuuuauaauugacuauucuaaaaauuaaaccauuuuauuucaugacaacgaagaguucugaggcagauaagaaacaaggagaguaaagaaaaauauauuuccuuuccuagagaguauagguuuaaagucucuuuuuuauauuucagaaauugaaauaggacugucauguuuguauaacccucuucccaguaugaaauaucugcaugggaaagaggcuacuuagacuauuguuuuagauguauuuccuuucaguuugugaguguuuggccugaauguauaucugugccccacaugcaugcucauugcccaugguggucagaagagaaugucugaacuggaguuagagauguuugggagccacuauguggcacuuggaaacaagagccagguucucugaaagagcaguaagugcuccuaaccacugagccaucgcuucagcuccuaauuacauuuuuuaaguaccacaguguaauaauuccucuuugaaguauuaauggauuugaaucuagauugcugcccuuuccagugccagcuauauguacuauauacuuaaaucuguucugaguucuaaaauacuuaugcucccaagaacuuauaagauucugcagaccuggguuaggcuuguuagcccccuguguccugacacugugaaaggaaagggagagucuuacauuuuccuaucucuguaaguuuauauaggauacuacuaccaaaaccuuuccuuuuuaaauuaaacacuacuagagauuggcccuaggguuuuugcacaugcuagguaaguacccuguuuuggaguugugucccuggccccuuuaaaaacaaaaacagaaggucucacuaaauugacucggcugcauuugaacucacucuguaucccaggaaggucuuggauuuaugaauuuaccucagucucauuaauuaccucuguguaauguggaacucaccuuguagacuagguuagccuugaacucagcaaaguucuccccugccguugccuuucaagagauggaaugaaaggcaugcaccacuauguccagccucuguuugucuuuaaacaacucaucaggcuaagauaggauuccccugagcugcuuagggagacucucucacaaaaugaaaaggggccaguaaauggcauugucagguacgcgcacuuguuggcaagagaaagaccuguauccagugcucacaccccacaauggaaagagauaacucaguccuacaaggugugcucugaaaucuuuguauacuuguacauucucucucucucucucucucucucucucucucuaaucuuuguauaguuguacauauacacacacacacucacucucucuguuucucucacacacacauauauauacacacacacacauacacacacuaaauaugguaauuuaaaaaacaaagcacggggcuggugagauggcucaguggguaagagcacccgacugcucuuccaaagguccagaguucaaaucccagcaaccacaugguggcucauaaccauccguaacaagaucuggcgcccucuucuggagugucugaagacagcuacaguguacuuacauauaauaauaaacaaaucuuuaaaaaaaaauaaaaaaauaaaaaacaaagcacaacauaguauuaacauaaaaugcaaauuaucaggccuuauccagaaguagcaggggucaaaagucuuggggguggggccugaucagucaccaccuaacaaauauaucaaggaguuuugacauauuuugaaguuuuaggaaccacaacuuuguuuuguuuuauuuuuguauagaacagagcuuauuuagaauauggagggcuggagagauggcucaguggguaagagcacccgacugcucuuccgaagguccagaguucaaaucccagcaaccacaugguggcucacaaccauccgaaacgagaucugacacccucuucuggggugucugaagacagcaguaguguacauacauuaaauaaauaaauaaauaaauaaauaaaucuaaaaaaaaagaauauggaaaggggaguugagaagggaguagagacaaaaaggcacagaggggggagggggaagggggugagagaggaagaaggggaugugagacagagggagggagggagagagagagaaaggagagagagagagagagggagggagggagggagggagggagggaggaaggaaggaaggaaggaaggaaggaaggaaggaaggaaagaaggaagggccaaacagccuucuacuacuacuacucagccaaacauggugaacuagcucauagugaaguagaugugacuuuuuguuguugguguauuuucucauuugagacagagucucccucuguagcuugaguacaccuagaaguacucuguagucuucccuguuuuccaauugaggauuauccagccucacccgcucacguccuagaauggaaauuauaggcaugaccucgcccccaauaaauaauaaugcugaggcuuuauuuauucauuuaguuuuauaguuuuuagauauuuugagccauuuucacacuguaaucuaggcuggccucaaaucugcagcaguccuccugccucagccucccuacugcuaagguuauaggugugagcugcuauacacaguguuuauauauuuuaaauggccaagaaacccuuagacaacauuguaauacuuaauaaauauuuaauacuuagauuuuaguggcuauaaguaaaguuuuauuggaacauagaccugcguauuugggggcuacguucauacccagcagaauugauuguuacagagaccggacuguucacaaagcugaaaauaaaaucaccguucuaaauuagugguggacacccauauggaguaaucugagaagauccuaaggacaggccucaucugaaaaugucagcauccacggggaaacaagaaaucgggaaaugcugcacauuuuccuguuccuaguaugucauggcugugugcuuauuacugagcauuaauuacuuguacauaaaaaugacuguguuaucuugaaagagaagugauaagauauuggccaacacuucaauuuugucauucuggcauauauguucaguucuucaguuauuugugagagguuaaguucauuaugaaauuuucauucugacuuccuucugauauuuaauguuucuuucuucuaggacacauuacuuuucacacaagacagaacuguguguuccaggguuguaauuaagcaagguuugagccuuguagauuguuucugaaauggacaucauaaaaucccagcuagccuguggucaauuuuauguauuuuuuugccuucuguaucuguugguucugcauccauggauucagccaaccauuaaucccaucacuugggaggcagaggcaggcuacuuaacaagcuccaggcuagccaggcuauuugugaggcccuguuucaauaaauaaauacauuucuguacugaacauguacaagcuuucuuuauuuuuuuauuuucugguuguuuucacuaagcaauauaguauaacagcuucuugcauuguauuaaugauuauaaauaauucagagaugguuugaaguauaugugacaauaugcauagguuguaugcaaauuccacaccagauucuauaagggacuuaagcauacucgaauuuucguuccuucuggggguuuggacugaaagccccacagacacugagagauggcuguuuacuaaauagguuaucucaguguuuacuuacugcauggaaagauuuauugaacugcucuuuuuuucuuaaccaacuucccgagagcugugaauguccucauugaaugacauugaaauugucuucuugagaacucuaacagcuaagcuggguaugguaguuuaggcuuaguaguuuguuaucagcuugggcuaugaagcacaacccugccucaaaaggucugauagccaaaaguuguacauaaauaucuguuguaucuauguguacagauuugauuauauuuuucuuggucauagaacagugaacaucaugcagcccaagguauaauucucuauuucuauaauacauugauauuuaaucauaaacauguguuaauuauucuauuuguguguguuaacaaauuguguuccuuuaggcaacuuguuccagcaauggcguguuccucuagaacuccagauggcaagacaaauggcuagcucugguucaucagggggcaaaauggauaauucuguguuaguccuuauugugggcuuaucaacaauaggagcuggugcauauguaaguaaaaaagcagcuuauguagaaaagcugccagacagcucccguugaucaacucaguacucugcuuuaaaacuuuugcaacuaauucugcuuucucccguaggaaaaguuccaaaggcccucuuuaaaguguuuaugggagccuggguggggaugacugauauuuacucucauguugacucaucuuugcucuuuuuacuugucuucuucuucuuugcaugaaaacugcuguguugccuuaggcuugauuaacccacaaaauuacacuugucucuugauugugaugaaguagccuguaaacaaagccaaaauucacugcagcuccuaagcacaauauuugauuuuaauuugucaauuuuuaaaagauuuuuuucauaacuugagauugagaguuuaaauaaacagcuuuaaaaaaaaaauacuaagcauuccuaaaaggaaaacuaaaucccuggauccuauauaaaggcuaaauuauagaaaagggccuaguaucuccaguuguagaauggcauuuuggggaguaauugcuucauacuguuagcacaaguacaucuccuuaaaugaccuggucauccuagccggucacagagaauuuauucuguggguguuuuuucuuuuaacuuggcagagugugcugagcgaauuuucuuugaugaugccuacugacauccugaucaaagaaagcuguuugcuuugcacacugagaacaaaagguuggaugccacuauagucuuaggucuuucucugcugauuauaguaaaauuauuuuuguuccucuggcaauagguugggcaugaaaauuauuugaauuacccauauccucauaccuuaaccugacuccaaagugcacaaaaggaguagcuagcuccugccaguuguaaguuagaucagagcaagauauagaaacaauucugcuugauaacacauuuugacaagagaggcacucuccuccaauccuggagcagcuuuuacauuuuuuuuuagcacaguaaccaaacugcuucucugcauuugcauuaaauguucauucauuaauacuuagugcuuucucuauuuuuugucucuuucuuggccauauguuugccuacaguugugcagugucaucuccuaggauccccuucuagaacacuagcgucugcaggugcuucugggaaagauggcagcagccuaguauacuucuuaauuguaggagcaacagugacuggggcaggaauuuauuauguaagaugcuuaugcuaaaauauguuuggggauaggguggguaagaccaugguacuaauaauaacuugguucauagaauauuguaaaauauucacagcaugugcuuucuauagacauuugcuaaagggacauugucagucacuagagaguccucaaauauuuuucagaccauugaaauuauacuagaucaauccaaacccauaaauuuagagccaaauauaucaaccuuuuuugaaacaucugucaaauuugugcuuauuuuuaugcugcugaaguuuauugugcuuuagugcugcaugucuaacaagaaauauugaauaagcaaauaaagggaacuugaguaccaucuacuuugaaucguuuuagcuaaaauguaauuuuucuguuuuguggcaagcaaucaacucggcuuuugcuaugaaaagcauuuuauuaaaugcuucugaggagguccucaaagccauagagguuggaguauuuucucaaaccacccacagucuacuucaaacuaaauccacuuggcagugucccuuuuguuaccucuaauuuggucaaacaaguggcugaagcauucguguggggugaugucuugaauaccacuuacugauucagauucuaccuucugagccuuaauguuuccauuucauguuuuuccuaucucuucuaccccauuuauuuaaaaauaauuuuaaagcguuugcauuagauauguuaauaaugauuugaaucuguuaaagcucugguuuguguugcugaccagaguuagauggccccaacagaguuaaccaugcagauacucuugaugccaaacuauaagaugggccagccacugaugcuuucuccugccuuagaaauauugcaaaacacaauuuucucucaagucauucagugaaaugcuucauugcccucuguguuuauccaaacacugguuguaauaaaccuacuauaauggcuccagguuaaaugauaagcuuuugucuacauuuaucaaacuagucugucuacuuguguuucagguuucaaauaguugaaaaccugcuuucaaggggcuucauuuuuuuucucugaaauucauauuagucauaggagaaacuuaguuuaaaaucagugcccagauuuggugagauuucuauagcggcaaauuccguaagguucagggcugaugagauggucgauggguaaagugccuguggccaugccugaccccugaguuccuaggaugauggagaguaagcaacauagcucuguaaugcuguccucugaccucccgguacagaccggcacucauaugugaguguacacaugcaaacauacaaagaaaugcgauaaaaauuauguagugcuuauguuuguuucucagacucucauagccaaauaccacaaaaugguuuggccuacaggcauuaauuuuuucaguucugaaagcuggaaaaucagacaagguuaaauuucucaugaaggcuuucuucaugguguguauguagccaaccauucacauuacucuguccucacauggggucagaacauguuaaaagugaauuagugcugaugucucuuccucuuuuuguaaaagcucuauccaaccugucaccauuccugucacuggauacugucauuuuggcaguuagggcuuuagcauaugauuugaaucccuuccacaacuuuuuucauuugaagaaauguuuuuaauuugacuauaauuaauccuucaacaauuacuauauuauguguucuuuauccuccuggcccucugucccuuuggcuuugaaaaacacuuucccaggauguguaguaagaaaugcaguuuaggggguuagagagauaggucaccaguuaaggcacugacugcucuuccagaagacccagauucaauucccagcacccacauugcagcucagaauugucugcaacucacacccucauauacacauuggaggcaaaauaccaauacacuugaaauagaaauaaauaaaaaagaauugcaguugaucuugccacccacuuguuuagaaagguugucucuacuaauauuuuacguaaauuuguaguauuucuuagccagcauauauuugccucccuuauuggaaaucuguguaaacuagaaauacagaaacccuuugaggaauagaauuuguuacuuaguguauauguaaacuaauuuugauuuuagauuuauauuuuaguuaauuaauuaguccugcuuggcugugguggcucauggcuuuaaucccagcacuugagaggcagaggcaggagaaucucuuguguucgagggcacccuggucuacagagggagcuccagaacaugcauggcuacacagagaaacccagucucaaaaacuguaguccucauccauuuauagcucuggcuauccuacaauucauagagaccagucuuagcuccuugccaaauguuggaauuaaaggcacggcauagcccgcccucccucucucucucucucucucucucucucucucucucucucucucucucucucuuucuuucuuucuuucuuucuuuaacuuauuuauuggggcaggggaaguguugagucaggaucucuuguauguagcccuggcuuuccugggacucgaucuguagaccaggcuggcuuugagcucagaugucccugccucugcauuccaagugcuaccacuaccagaugccauuauuuuacugaaugaauuagugaaugaaugccuuuacuuuugagauuaagggcucacuguguagucuuacuagcuuagaacuccuguagaccaggcuggccuccaacucacagaaauccauaugccucugccacccaagugcuggaauuaaagauguuauuacuuguuuugaaaauuuuuaauuaggacuagggaauauagcucaguagccugauaugcauaaggccauagguagucuccagcuucuaaauauuuuuaaacuaaguuaaaagucgcuaauaaauccugcuguuacauguuauaaacauaaacaauagaaacuagucauacuaaaauagccuuccucaauuugaaaguauaggugaaagaguaugcuugaaguaauuuagugaagaugguguuuaacccuugauaauucuuaauuuguaguguuucuaagugagauuucuacccccucaguuuaggaaaaguaaaaccuauuacuggaaagaugacuuacauuuuaaagauauaaccacauaucccaaucccuggcaaaaucuucaacaucuaccaugaagauauauuuccugguuucuaccuaugcccauguaggaugauuuuccaacuagcaccccgcauaguccaaaagcccuuucuaugcuuuagccauuucuguacuuacuaacauuacauuuccuuuaguucuacuuuucugaauucaguauccagagaguuucuuacggaaagucucagaaaaccugauguauuuucaucuacuuucaaguacucuuuccuuauguguacaacaaaucauuuuauuucuugacaaagggguuuugggcugggguuuaaguucagugguagaguucuugauuaguaugcaugaagcucaggguuccaucccuagcacugaaaaaguaaacuuggccauagugcuuuuugcauaaaggaaguaccuucaauguagacgaaagcuucucauuuaauugaaaugauauuagcuuaugguaagagcuagguaugucaggaaauaaacuuucucuguguuugggucuacaggccuacaaaacuauaaaagaagaccaaaaaagauacaaugaaagagugaugggauuaggacuguccccagaagagaaacagagaagagccauugccuccgguaaggacuccccugucucuucuguguggguugagaugaaauaagggaaagugauuaaggcugaggugcuaugacuuguuaauaucuuguugacgugagugaagagugugagaguguguuucuagaaacuaugguuuuaccgcacaacagggagcaauuccuaaaguauuugcuuggcauuuuagaccagagaggaaaauuaauuauuguggguaccuguccauuuuuuccauguuggauuucucuuuuuuuaauuguuuuauuuguuuguuuguuuguuuguuuauaaauguuacuuacccaccuucuugguuccccccuccaagaguucuuuaccccauccccucuccccuuugccucugagaggaugcuuuucccccaaccucaccccucacauucuccuucccuggggcaucaucaaucuacaggauuagacacauccucucccacugaggccagacaaggcaguccucugcuacauaugugcuggggucacagaccagccuauguaugccccuugcuuuuuggcuuagucucugggagcucugagggauccagguuagaugacacuguuguucuuccuaugggguugccagcccuuucagcuccuucagaccauccccuaaugcuuccauaggaguccccaaccuccauccaauguuuggcuguggguaucugcaucugucucagucagcuguugguagagccucucagaggccagccaugcuagguuccugucugcaagcacaacauggccucugggguuuugugccugcucaugggauggaucccaaguugggcuggucacuggagggccuuuccuucagucucugcuccauuuuugucucugcauuucuuuuagacaugaacaauucugggucaaaauuuuugaagguaggcugauauaaguuugggggaaaaaacuacuggaaaagauaggaaagccauuuuuccaaugacuaacuuuuucagucacauuaguucccuugagucuggagucuugaguuguuauaaauguguuuuccuguagcacaaagcucuaaccuucuguuugauucacuuggauuuucaaagaggaauauuuuaauccuuuaauuaggccuauaaucuggguaggcgguuuguauugcuuuuuucaauaaugccuccuucuucaugaacauuguauaauaauccccaauugaccuccuagguguuuccccuuuauugguaacaaaaggugcaacugaacuugauauuuucuugguggucaguagaaaaccaauaaggggcuggagagauggcucagcaguuaagagcacugacugcccuuuugaaaguccugaguucaaaucccagcaaccacaugguggcucacuaccauccauaaugagaugcugcccucuucuggggugucugaugacagcuacacuguacuuacauauaauaaaugaaaucuuugggcuggagugagcaggcuagaaggagcagaccggagcgagcugggcuggagcaagaagaaaaagugucuugacaacagcuacagugcacuuacauauaauaaauaaauaaaucuuaaaaaaaaaacaauaagaagggcagaggccuuuuaauauauguuuucuaaaguauuugagaaauaaauagcagguguggugauuuauauuuuuaaucccaccauaugggaagaugaggccagccugggcuacguagugagagccuaucuuaaggguggugauaaggaaaagacuaauauuucagguaggcccuagagccgguauagaccucaugagugaaagacauugcagcucauucauccucuucaaaugguuuugcuacuggugaaaugaaagggacacuugcuuuugcccuccacuguaauguuaugaagauuggggucuuuuuccuugucuucuuuuuuuuucauuucuggcugucaaacccagaaccuuagacaugauaggcaagcuuucuaccauugaguuauaacuuuuuuuaaagauuuauuuauuauaugucaguacacuguagcugucuucagacacaccagaagaaggagucagaucucauuaaggaugguugugagccaccaugugguugcugggauuugaacucaggaccuuugaaagagcagucagugcucuuaaccacugagccaucucuccagcccgcacugaguuauaacuuuaucucgauaaguuuuugauuaguauaggccugcugguuuauuuuauguaaaggacugagaugaaugugggguggcuuuuugaaauagugccgaggagucaucaaagcguuuuagaagacuuacucuguuuguucugucuuuuacagcuacagagggaggcucaguuccucagaucagggcaccaagucacgucccuuuccugcugauugguggagggacugcugcuuuugcagcagccagauccauccgggcucgggauccuggggccaggguaaggugcauguuauuuugcuuggcauggaggggauagugugcaagcacuuagucagugugaguguuuuaacuuuuccucuuaaauuacuuagcucugagaaguaucauuuugugucuacagguccugauuguaucugaagacccugaacugccauacaugcgaccuccucuuucaaaagaauugugguuuucagaugauccaaaugucacaaagacacugcaauucagacaguggaauggaaaagagagaagguacguuuccuuggguaagaugagccugaccaucuucagcugagcauggggagcagguugggauuuugucacugaccauggaugauaaauuggaaggcugugcaugggagucugcuauuaugcaugcuugaucaggcucagaggcaacagaccacaaagaacauucuaaugucuguuccccaaacuaccaacagucaguaguuuaaggcuagacuguuacguauuaggguuccuauuucuaggaccuuuagguuagauuuuuuuuccuguuagagauuaucuuaguugguauugucaguucuuuauaaauaccuaggcaugucauauacaagcaagugaagcuaauuuuuggcacccuuaauauuuugggcauguauauguguagcaggaauggcagggcugccucgauguaaacgcuaggggccgugcagcugcagaagcaucuccugcaggaggaccuaguugaggacugccugagagagcaaggauggcuggugcaaauaaugucagccaaucgggaacugccauuuaaaauaguuccuuucuugggagcaauggggacauggguggagguauuaaaggagcucgcagcagugcucagauguacguguuaauaugcauacaugcauguacauauauguguguguguguguguguguguguguguguguggaagccagagguuaacuuuuggugucauucaucaagugccagcuaccauuuuuuuuuuuuugagacagggucugucacuggucugggacucaacuaaauagguuagacugccuagccaaugagcaccaaggauuuuccuguccuugcuuccacaguguugggcuuagaggugcaugucaccaugcuugcuucuguauguggguucugaggcuaaaacuuagucuuucugccucuccagcaagcacuaacugagcugucucccuaguccauuaauggcacuuuauuugacacucuggccagcauucacaauuguggggguaaagugggaugaccauaaugaagagccucauuaucagaauguaugcagaaacgacacuuggagcuagccggguaugaugguugcaugccugaaaccccagcacugagaggaugaggcaagacuaaccucugaguaccaaggguaacagccucugucucagagacacaaaacaagcgaacaaagccccaagucucggagcuguggauccagaagcuucguucuucuaacugacuccgugggucuccauuccaacacuguucucggacacugcugcuuugcucucugauguagaacuacaguuuuacaagccugugccagagacaugggucagcauuuuagagcacuuuuugcuuuugcagaggaaccauguucgauuucuagcagucacaaggugguuucgcaaccaucuguaacuccaguucuaggggauaggacacccuuuccugacauuagaaacagacaggcaugcagggaaaagcauccacgagcauagauaaaucuaaaaaauuuaaacaccaagauguguuuguuugccucccucaucuuuacuauuauguuccauuuucaagcagaacacagacuuucagcuaauuuauuuuuguuuaauauaucauaauuauuuacuuaguuuuuuaaaauuuguauuuucacuuuguugcccuggcuagccccaaaacuggguucaagcaauauucuugagucuuccugaguagucaagccuagauacaugccaacgcaccaacuuaauuguuucaggcagagucaucuaggagcaagauauugcucugcugaugagcagcaccauccugaaaaauugaugggggucgauacaugaaucccagguucuugacuguccuuguucuuaguuugaaaugguucuauaucuagagcuuaguuucauguuucuguagcauugauugcuauuugaggcaacauaauuuuucuggagguaagggcugcccuguguacacauccuucuuucgagauaccaaguaagaguagcguccccuuuuaaguugcaauccaaaaugucucccgaaauugccaaaugucuuuggggcuaaaguacccaauugagaaccauugaucuauacuucucaguaagccagucacuacggagcucuaguggcuagagacuuacucugaaaaaaugugccugaguggauuuuucuuaauuggcaucauuuuacuaaagcuauagggggaaccuauggcaguugcagaugcuugcuuaucauuuucuccucuuucccauacagcauauauuuccagccaccuucuuucuaugucucugcucaggaccugccuaauauugagaacggugguguggcuguccucacugggaaaaaggugaguucauaggcugcuuucucuuuggggcucaacuuaguuaccaaccagcacguagucugcuuucccauuucaauucauguuuccucucccauguaguucaucaaagaaaagccaaagcauuuuaggauuaagacuguuuagugugucugucuagggaaaacccauacccgagccuagaguuugaaguuaccuaagcuuugccagggaaagucccacugucagauacuaguucuauaagaauugccacuuuuuuggugcuucuacauuuuccuccuuccuauuguuuucuuuaccuuucuccccuauuguuuuguuuuguuuuguuuuuuucgagacaggguuucucuguguagcucuggcuguccuggaacucacucuauagagcagucuggccucgaacucugaaauccgccuuccucugacuuccgagugcugggauuaaaggcgugcgccaccacgcucggcuuucuccccuauuguugaugacaagaguuuaaaccaaauuugcagcauaaugcaacacuucagucaaaacgcagcauggaaacuacuguuagacuuuaccaaggugcuugccuaaguaaggagagcaguuauugaggaugcuuguggggucucaggaaggcuuugucuuguuuguuguguugcccuuuaguuuuguuacugggaaacaguggacuaugguuguaagcuaaugucaguguuucaauggaggggaugguagaaaggggguggaaagcacagaacgaaagauucaccugcaaccacuuccucuauaacagagcugcagaaugugguuaagcugguagugagacgucguguuaaaugucucugcugggaaacacaggagcccggcucccugagggagaccagaaacaagcaggaacacagacagacaaucacaucucagaaaugucuacgcgauguguaugcugggagcgaggaggaggaagagcgugcaguguaguagugcaugcaaggaaagcuuccuggagaaaaaucugauagaccuaaaaucuuacuaaaacaugccuuuuagauugauuuauuuauuuuauuuugugucuaugagugucugccugaauguauguauguauguguguguguaugcauguauguaugugucuggugccugcaaaaguuagaagaggaaucuuggauccccuggagcuagaguuguaaaugguuaugggccaucauguggguucugggaacugaacugagguucucagcaagaacaaaaauugucuguuucuugguguguguauguguggauaugguguguggggguguaaggaggaaggugucacgugucccacucuauuacucugccugauauauuccuuuugaacagggucucuuagugaaccugagacuagguugguggccagcaagcuacaguucuccuccugucucuguuucuucucacugcuggguuuacagauuuauacacugcuaugccuggcuuuucucucucucucucucucucucugucugucugucucucucuccuccauugcuuuuuuucagaacagaaguauuuuuuaauuagguauuuucuucauuuacauuuccaaugcuaucccaaaaguccccuaacaccccccccccgacuccccuacccacccacucccacuucuuggcccuggcguuccccuguacugauaugccuggcuucucucucucucucucucucucucucucucucugucucucucucucucugucucucucuccuccauugcuuuuuuucagaacagaaguauuuuuuaauuagguauuuucuucauuuacauuucaaaugcuaucccaaaaguccccuaacaccccccccccccgacuccccuacccacccacucccacuucuuagcccuggcguuccccuguacugauaugccuggcuuuuuuacauguuucaaggauuguaguucaugcccucauguucauacagcaaguguucuuaccuacugagccaucucccuagcccuagagcagaaaauauuaaagaaugaagaggcguagacuacauaggagcagagaagacucaggagaauagcauuugagggaagaaguagcgucauaagcaagggcccagcaguacagaaaagcacacuuagucaagggaaacaggcaguuggcuucugauaaaguagaaaccuggaugaggggacuggggauauagcuuaggguggaagaguugucuaguguggguaaggugcagguuuggucccuaacuuagcaaaagaaguaauagauuagaaaauaaauagaagaaauguuuucuuuacuuuauuauugucuggguuuuuggaggucugauuugcaacagggucucucuguguagcccuggcuguacuggaaccugcucuguagaccaggcuggccuugaacugacagagaucuaccugccucugccuccuaagguguccauacaagaagaaauuuuaaaaaaaaauauucaaguuaggaaauagcaagaggcaaaacugagaacuuuuacuagggauugguuaagacaaacuuuuugccauguaggagagcuugaacuuuauauacacuggggagcugaugacgcuuggacaaagguauagauacgugaaaugaacuuuagauaauuacuguugacuauggcaugguggauuucaggugaauacaacuagaaguggagggaccagagaaauggcucagcaguuaaaaacacugcugcuuucguaacagaacugaguucaauucaaggcauccacauagcgucucacaacaauccaggcacacauauauggugcacauacauacaugcagacagaacacccauccauauaaaguuaaaaauaguguuuauuuauuguauaugaguacacugucucuaucuucagacacaccagaagagggcauccaaucccauuacagaugguuaugagccaccaugugguugcugggaauugaacucaggaccucuggaaaagcagucagugcucuuacccgcugaguuaucucucuagcccaaaaauaaugguuuuugagacaggguuucucuguguagccuuggcuauacuggaaaucacuuuguagaccgagcuggacuugaacuuagagauccaccugccuuagccuccugacugcuaagauuaaagguaugugcaccauugccuagcuuuaaaguaaauuuuaaaaguagagauagaccauuucaaaaauuauuauaauaauugaggcaaaaaauuaugauaguugacauuaggaugggguggcugugaucaugaagaugaggacuguaaggaauaacacauagugccuacuuucaccuuguuuuuacugauugauuuuauguauaugagcauacugucacugucuucagacacaccagaagagggcguuguaucccauuacagaugcuugugagccaccaugugguuguugggaauugaacucaggaccucuggaagaacaaucagugcucuuaaccgcugaaccaucucuccagccuuacccccuuuuuaagauggguucuuauguagcacagaaugguguugaacucauguagcugagaagacuuugaacucugguccucaugccucuaugucccgagccucaaccuccuagguguggggauuuaugggcauguaccaccacaccugguuuauccaggguuuuaugcauacuaagcaagcacuccaugcacugagcaacauccacagcccagugacucugaacuccuuuuuacacuaguggagauugaaccaagggccuccugcauguuagucagacacucuacuagcugaacuauauucccagccuuccuguuggaaucuuauaagcaaaguuuuuaaaauguuuuauguucauuaucucuuauaguucuuuuguccuuacaguaaucuuacaacauagaaauuccauuucauaaagaacauuuuuaguaaagaaguuucaaguaacuguccugaacaguacaacuaauaaaugagaaacagaauaugaauccaggcuaucuaacuagagagguagaaccaagaaauucuaaucagagcccaagguccuaaucauguauuacuucuuguguaacauuagaugcccagcauggagggaaguacuugaucagaaugugggccaugcuugaggaaugcuuagaaggcaaacaucccuaaggccugaagauggguuaaaagcaggagauggaaagcaaagagacaaaguaucuaauugugugugucagaguagauaauagugccaccacuagcccccagcucagaaagacauuuuaagaggaagaucugguuuaaggggaaagauagggaaaaauaaaaaucuauuuggacaucaggcaugaugauggaugccuuuaauuguagcaccugggaugcagagauagguagaugucugcaaguuugacagcagccaggucuacauaagaguuccaggccaguuaaggccacauaaugagguccuguaucaaacaaugacgaaaauaacuuagagagaaguauagaaaccuaggauaagagccaagguuuuagguacuuggaagaagcagaacaugaccugcaguuuuacuauugccaaagaacuugguaaggaaagaacuauaagguguccccuucugguaguuuagauaacaaugcaaaguuaaacuaccauuuauuuuuuugcauguguauacucauguugacauugugugugcacaugcauguagaggccagaggaaccucucuuuacccuguuuacugcgccagaguuucuugucaaacauagggcuaguucugcuagucugcucgcuggcucacccuggagaucucaucuccacuuugcuagcacugagauuacaaguggguggcuacagcuacaauguuuuuauguggauacuggggguccaaacucuguuccucaugcuugcauagcaagugcuuugcucacugaguuagcuccauagccccuauacuauucuuucaguaaauguaaaugaucuagaaggguaaggugcuggaggaccugaguucaauacccagaacccauguacaacaaauccagaugugguggaacguguguguaauaccagugcuaggaaggcagacagguagaucccuagggcuuuccggccagccaccuuagccuacuuggugaguucuaggccuccaauaugagaccugguuucuaaaaaaagagguggacagggaagggcuugagaaacaauacucaaguuuaucuuuucuccacuacaugaaugaguacaugcacccaugcagacaugaaaacacacacaaguuuaaauaaaauuuggacaugguaggucacgcucuuuacaacauagaaauuccauuucauagagaacauuuuuaauaaagaaauucuaaguaacuguccugaacaguacuuuggaaacugagucgggaagacugcuacaauuuugaggccagucuaggauacaguauaguccauuguagaccuaucugggcaaaagacuguggccccaucucuuaaaaacuuaaugauugccaggugaugguggcgcacgccuuuaaucccagcacucgggaggcagaggcaagcgaaucucugaguucaaggccagccuggucuacagagugaguuccaggacagccagggcuacacagagaaauucugucuccaaaaaaacaaacaaaacaaaaaacuuaaugauuacagguguagcuuagugaugagagagcucacauggcacucacaagggucuggguucaauuucuguacaguaaagguaaguaaauaaaauaaugguuagugugugaguauuucuuuuucguaaauccuaaauuaaaaguuuaaauaaguggagauggcaauuggacaaaaguuugaagaggacauagaaucaaagauugaucuuauuggauauaguaauggacugaaaucuaagaccacaggagaggguagaggaaugaauggaccaggugaagauucugaaagacaauaaaauggugagacacaaaggaauagaaagguccccuuauucaguagcuggaaaaaaaggaaguaaagguauggaucaauuugugugcguaccuaugugugugguguauauauguguaugcacguguauauagagggaccacuguauaugcacguguggagucuagguguugacauugagugucuuagcuauuugucuccacauuauuuuuuugagacagggucucucacugaacccggaggguucucucucacuaauucaguuggauugacuauggaaccucugggguaugccuaucucugucuccccagcccuggguuacagaugcauuaccacugcacucaugcuuguguugcaggcacaucuaacggccuuacuugauuucacaguggauguaaggugguuaucaaggggaaaaaaagaugguugucgaaaagaauagucuagauguugaauugucagguuguauugaagagagagcuuaccaagaacaaagcaaaggaggcuaaaggagcuacuccuucaucuaugcuguugacucuagaaagcuuuacacaacucaaccagacucgaauucccccaccccauguuucuagugccaccugcccugucaaagcuaucagguuugacacuccuuacuauuguugguguuuguuaaauugcugcuuuugucuuaauauacucugaaggcagagaaaauaaugucuuucccaucacuguccccugcacuuagaacugccucuaaagcaccagagauguuuaacagguauuucuugaugggauggucucacacgcuaguaaggaauagagcagaugaugcaaacuaaucucucagacucaagcuguuaacccuagugaagacaaggggauuaagaguauuggcaaaagagccauuugaauggucuaccauugauuggucuaaauuauuuggaauggaacuaccaaccaaauaaucagaaaauuggaagacacugaggcuaggcuucaugguacagugcuugccuaaacauacacaaagccccaggcacauucuccacacugcagcaaacaaagagaacaaaaacugauguaacaaugggaauuaagaaagcauuuggcccacgccuuuaaucccagcacuugggaggcagaggcagguggauuucugaguucgaggccagccuagucuacaaagugaguuccaggacagccaggacuauauagagaaacccugucuggaaaaaaaaaagcaagcaagcauugaagcuaggcuuguguacauguauagugguguaugccuuaaucccagugcucaagaggcagaagcaaguggauuucuguaaguuugagacaaguaugauauacauagcaauuuccaggcuagauaggcuguauaaugagacccuauuucaaacaaacaaagacacacacacacacagacaaccaaccaaccaaugaccuugagagauaauugugguaagauauuugagguagaaauaguacuuuaggagauaacaagaaucuggaauauggcacagaggaaaauagucaaauuccaagguccuuagauauaaggagcaguggcaggaagugauuucccaacagugacuuaaagggguauaaauagauaccagucagaggaggaugaacguacaagacucuagaacaccuuccucuuccuggacuugugauaucuuugaguguaacaucccagagggauagcugagugucagugaaaaguagaaguuggagaaagauucugcagagauguucugaaugugcuagaguuguuagcaaagaaauaaggauucuaauggcaagacagaaaagacuuucuccauuguccauuucaguaaauccgaauggaaguuugggaauccaacugauaguaaucuugauugugugaagaaacugggucccgaaaacuauggucccaauaauuaccuaggcagugcagugguagcacccaccuuuaaucccagcacucaggaggcagaggcagguagauccuugugaguucgaggccagccuggucuacagaguaaguuccaggacagccagggcuguuacgcagagaaacauuaaccauccccaccccaccccaccccccaaaaaaucccaguaauuacuuagaaacaauuucuuuuuuguuguuguugguuuuuugguuuuuuguuuuuuguuuuuuuuuuguuuuuguuuuucgagacaagguuucucuguauagcccuggcuguccuggcacucacuuuguagaccaggcuggccucaaacucagaaaucugccugccucugccucccgagugcugggauuaaaggcaugugccaacacgcccggcuuagaaacaauuucuuaaggauggcuuuggucaaaaacuaauucuucucauugaggugacaacauagguuuggaggcauauuuuuaaaaauuuggugggcaugaaauguucugcaguuagauaguggugaauaggcuaaaaaucaauaaauuguacacuuuuaaauggugaauauuauaucacaguaguuuuucaaaacuuauucauaucuaccucuuguguauauguauucaacuauaccagguaguacaucuggauguaagaggcaacauggugaaacuuaaugauggcucucagauuaccuuugaaaagugcuugauugcaacgggugaguauuucuggagguggcugucuucucuacuaugguagcucacucaagcuuuagagucuaucuuucucuugaaaagaugguacaauuuauuuuucuuaagaaaucugauguccagaaucucuaauguagauaucugguuaauuucagugugugaugucuuauuuauuugcaauuuuuauaagaaagcuuauuaaaagaaguggcuguuaucuuaaugaguuucuggccaaccugaucuacauaguaacagccugucucaaaaaauggacagagagagagacaaacacauauauacacacaccauggaaaaaggaaauaacucucucuggcuuggcuagucguugaggcaagguccccuaagaggagcucggcuuuccuucuuaaaggaaauugguaagaagccugcugugaggcaaacugucuuaucugcuagucacuccaugguaauauuagcagcagcagccacagcaagcacuaccaccaagacuacugcugugacaccaagcauacuuagccacagucacagcagagagcuccuaacuuucgggauuauuugggcuagcucccacuugucaggcuaaaggacuuuucuuuccuauuauuuccaggaggcacuccaagaagucugucugccaucgauagggcuggagcagaggugaagaguagaacaacacuuuucaggaagguaauugcuuuagugggcuucuguguguguucucuugaagagguaacauccuuuugugguccccaaguacucccuccaauugagagccaaguucucuuuauagcucuuccccaaacuugcuaucuggcuuuggagcaagucacuucuccuuguaccucugauacuucacucaaggguucuaugcuucuaggagagaacuacauuugguuuccacugcuugcuauaguucugauugcccuuccacaguuguuuuucucuaguguuugauccaccagaacucuuugugguuucuuggcauuuuucguuacaaguacuuugugaagacuucgguguaaaagauugaguauacaaggacaaaggaaaggagauuguuugcuucuucaccccaugccuugcuggaauuuucuaucuacacuuagggauauuggaugaagucuguauguucuugauuauuaacgcugaauaauuugugugggagaucgccuccuuuugcuuuguagaauguuggcaacaucacuggcuucuccacuagagacuaggagcaucuuguccuggcagccaaaaugugucuggauacugccacauacucaccuuggacuagggagaaaaacugauaucaguugacaaccacuguugcuagaaggaauguuacaaucgagaaagauagucacauuaauaacauagaggguguaauugagccacuuuguacaaaauauuaugugcaaaugucuguugcaguaaauuuagaggaaaauaucuucuuggauuauugucuuaugccccuuugggaaaucaguggacuaaacugguaugauccugcagauuggagauuuuagagccuuggagaagaucucucgggaggucaagucaauuacaguuaucggcgggggcuuccuugggagugagcuggccugugcucuuggcagaaagugugaguauugacaacuguucucagcugucuuucucuagucacauagcacacaucuuggugaacugucacaaaugccagaaauacauuugccagcaguuggacucugaucaguguuuaugaaaugagugcaggcauguuugaacauaaauuccagaaaucaggagauagaaacaggaggauugugaguuagauuuucgacuggcuugcauaaugaguucaaggcuagucugggauuauaaagcaaaccuacucucaccccacuccucccccgaaaaguauuuuauagaauuaaaaagcuaaguacuaagauuaggacaaggguuucuaucuacuuaguuucuauugcugugauagagaucauggcgaaaagcaaguugaggugggaaaaguuuauuuggcuuauguuucuacaucaccguucaucacugagagaagucagacaggagccuggaggcaggagcuuucuuacggaacccaagaccaccuguccgaagaugguacaucccacagugugcugggcccucccacaccaaucauucauggaaaaagguccuacacacuugccuacauaccauuugauggaggcauuuucucaauugagguuccucuucccacauaacuccagcuuuugucaaguugacagaaaacaaaagcaauaagaacagucccucagugaccagaaaacugucaccuaaauaacuugacaguagggccuucuuuccuuuccuguaccuucucugccaagacuuuuuagaaaucaaguauuugaagauguggguuaggaaggugagaagguccaugggaacuaaagaacuguauggaauaugaugguucccagauaaacagcucuauggguucugguuugaaugugucauggccacugucuuucugucuuaaauuauauuucuuuguuucuuugguggggaugggggugggauuaugugaaugcacaugcuaaacucuggauaucuuccuaggcgagugcuuccuauugagagcuugaaaagcccugauguaagccucagguggccacaggaguagauggauauguacuacauucacaguugguaccuuaauccagggacacaagugcugacaccucuguguuugccuuugaagaagcguagccauuaaggcugucuugcccuagugccucacaggcaggagcuguggccucagaauugacuaacuguccuuugccucccuccugucugccugggguuggcuuuucccuucuucucuaacuagcuccccuucuucccagcucaagccucgggcauagaagugauccagcuguucccugagaaaggaaauauggggaagauccuuccucaauaccucagcaacuggaccauggaaaaagucaaacgagguagaaagacucuccauagcugcucuuucuuuugagaguaaacuaaaagcaaaguuagcuuuugugggggaacccccuugacauaauuccugacaccuggcagaggaaauguuucauuguugcucagucagacaaggucacaggcuuucggaaucugaggcaccacauucccagacaugcuaaaaauggaguguguguggagguucuugugguugguuccucaaagcugccugcaucugaggcugacugauuuuuuaccacacaggaggccuccagccagccuccuuacucuucccagagcucccaggccugugaguucaguuugggucucauuucauuuacagagggagugaaagugaugcccaaugcaauuguacaaucaguuggagucagcgguggcagguuacucauuaagcugaaagauggaaggaagguaaggaggaagagagguaagaaggaagagacagaaugccagaaggccuuccaggccauccuuuccguucccuuauugucauuccuuuacuugacaucauugauuuguuuccuuagcagccaccauuaacaucugccaguucucugaguuaaccagcccucugucaaaauagaauaaugagaacuagaguggacacaauguaaacuguucucccuuggccucuucuaaacuguguugucuuuaguccuuccuaggauagcagauuucuguccaggugcuauggaauauuaauggggcuuggggguucuuauaaaaguagagcuuaaagucucuuuacuggaaguaaguuaaccuaugauuauuuuugaaggucuaauacuuuauuuauuuaguuuucuuuauuuuucuuuucucuuuguuuuaaacagcaguuccuugcaugcuacaaaagcauucuaccacugagcugagcuaccccccagacccuugauaggaaaagccuguguuauugggcuccugaggccauuaccuuuuugaaagucugauuuuaaaugcugugauauaauaagguugugaggugaaggagcucaucaaacaaaucccuuuuuccuuucagguagaaacugaccacauagugacagcugugggccuagagcccaauguugaguuggccaagacuggcggacuggaaauagauuccgauuuugguggcuuccggguaaaugcagaacuccaagcacguucuaacaucugggugguaagugugcuauagccuaagccagugugauucauugcuccuagccuggagguaagucuggccaagugcuaaagcucaguaggaaagaagaaaagcaagcaagcaagccaguucagaacagcuuaaccaaauagagucaccguguuugauggccgcagagaaacacuagaaacuugugaagugcuuguauucgaagagcaccuauggccccaucugcaagcuauggcagagugacaagggcaauguggauggcuaugggaacagaacucuuaacaauucuauaguuccaacuuucagacagaccuccuguucccacagcucagcguccagagaauguaguagggugaagcacuuucccaauguguucccuagaaaggaaagccauucuguuuucauuuuccuugaguacuauuugcagcuauuuuuaaaaccuauuaugacaaaaccaagacuuucauauguagaaacugagguaacuucccccuugcuagaacacugcaauguauuguuugguuauggauucuguaacuaaggccauaagugcugagaagggauguuuuccuccucuggugucugggauuuuuuuuuugccuauuguacuauguauucauuguagaaaacgcagacaagaaagagaaagggggucagucaccuguagcaaccagaaauguuguaguuuauuuccuucccuuuguuuucuugagcauaaggguuuuucccccuucauuuuaugugguugaggugaaccuacuauauauaaacauuucuauucuauuuuucauuuaacauuguaaaagcaagcguuuucagacuuguugcucagacucguuaagcaguuuaaugauugcguaauagccuauuaaaugaacucacaguucacuuggcuguugcucacuuacuggauuuuuagguugcuuugggggagucugaauagcucuaaaaaaugaacaagaguuggagagcuccaauaccgcgucgugcaugaagcuggcccuguucaccccuugcugaggguucucugaagcacuuagcuuguugaaucuauaccucuucuagggcacgggacuuguuuacauugccguguccuuaagaucaaggcugugucuuuccugugcgagggucuucacucccugcaggaaaggcucgugccacuuuuaucuccccagcccauguuaagaacgcagcuuuuguaaguaagaaguacuccaugagcacguagugacugacugcugaccagugaaaaacuucucuuaggaaagauuucuagacaccugcuuuccacguagagaaaagaguauuccgggcugaauaugguggugaaggcuuaucccaccgcuagggagacugaaacaggagaaucauuaguuuaaaaccagcuugugcuauauagagacccugucuccaaaauaaugagaagauauucuucaaugcuccauuaguaaguaaccuaugugcuauaacaacaaaauagggagaaauaggcauacaggaaggaaaggagauauaggauaguuuguuuucuuuaaaaaugcaaucucacuuguuuacaaaugagucuagcuuauagauaaaaaauauuaacauugcaagauccuuuggagcccaaaguuuauacucugccuuuaacuuguuuuugguuuuuuguggguuuuuuuguguuuuuguuaauacaugguuuccaucauuuguuuucgaaggcaggggaugcugcaugcuucuaugauauaaaguugggucgaaggcgaguagagcaucaugaucaugcuguugugaguggaagacuggcuggagaaaacaugacuggagccgcuaagccauacuggcaucagucaauguucugguaaaguuuugugccucggggacuuaacugcugagaacucugugucaaugagcucaaaauacagaggguuuuuuaauuugguuugugauuugguuuccuucuagcccacuuaccuuuguacagaagggaaaaagucccacuucauguccacaccuucugucccuaagggguuauugaauaaaaguaccauguuugccaggcguaaaaugaguagaaauugcaccagugcuucuaggaaacuaagacguugaacgguacuaguugauacagaaguauagcuuuaagaauaggcagcaguguauuuuaauuagucuuuaguaguaucccuaauggucccagcauacuugggaaaacacagcccauucauguaagcuuuaagagcagcaauuugccaggaauaaugccaugugccuuuaaucuuagcacuugggaaacagaggcaggcagaguuaguucugugaguucaaggccagccugacuaagcuguuccaggcuagcuaggccuaccugguaagacuauuucaguuuuuuuuuuuaaaucacaugcauaagacuguuguuugaacuuuaaaagguuaagagugggcaauccucccuucuggccuccaugggcgacaggcaugcaugcgauaggcagcauauaggcaaaacaccccaacacauaagaagacaaaagcaaacaaaacaaaaaacccaacacaaacacaaaaaccauccuguaucuaaaaggaaaaauggaaagagugagcaugauuuauuggcuaauugacuaguaguaauuaguacugaagauucuaaauaaaguccucaaggcuaacccuauuuaguacucuuugaucuugauuuuuaauuaaaagauaauguuagccggaacugugccuaacuauacucuuuuuuuuuuuuuuuaaagauuuauuuauuauauguaaguacacuguugcuguuuucagacacaccagaagagggcaccagaucucgugaucucauuucgggugguugugagccaccaugugguugccgggauuugaacucaggaucuucagaagagcagucagugcucuuaaccgccgagccaucucuccggccccuaacuauacucuuaacuauaaguagcgagcugggugagaagaagcucagguuugaggcuagucuggagcagucuaguaggauucugucucauaguaaaggaauggguauauaguguagugguagaacaguggauaggauccuagccuggugucuacuacucuaaaaauauggaaauaugggguacagaaauaaaagccuuaagauuucagaagaccaagugguugauguuggagauauucacagcuaauagaaauacuuuauaggacaagcacacgcaguuuuaugugugagcagccaaaaaguaacagauuucuaggucagugcauacaacacaggaaaacugagucuguaauuauacaguuaucugggcuuacauauagauucuaaggguuuguuguugauucuucucugaugauacuaaauaccuauuguagcaaagaaaauaaaacauguacuagcagaagcaguaucuuugauuauaacccaaaagcuagaccucagauagucuguauauuaaggauguguauuauaaagggagucacagugagaugccaaguaaaaacuuguuuguugccaagcuuguugauucugaucuaauuccuggggucugcaugguaaagagaacccacucccacaaauugucuucugaccucugcauguaccacaccacaugcauauguccaugaauacacacaagaaagaaggaggaaaaagggaagucacuccaugugaagacaaggggggaguaccaauaaguuaauaaaaccauaaucauuagauuccaaauuucaucaaauaggacacauuuuacaacuccaaaaaggcaguauuagugugaguuaaagaaaaucagagaguaucaaaaguagggaaccugggccaagcaguggugguacaugucuauaaucucagcacucuggagacagguaccugugaguucgaggcuagccuggucuacagagcuaguuccaagaauaaaaaagguggggauccauaccacgccauauguauuaugggauaaaaaaaucacaaaauucaggaaguuuaaauuguuauuauauggguaugauguguauagcagcuacuugaggaaaagcacagcugucugagguaauccuucucucaugcauguccucagauguccugguaacaguaaaucuguuugccauuccuuaugguccuuugacaaaauguccucuuuguuuccacaggagugauuuggguccugaugucggcuaugaagcuauuggucugguggauaguaguuugcccacaguugguguuuuugcaaaagcaacugcacaagacaacccaaaaucugccacagagcagucagguaaggaagcccaacuacuucucuaggaagaauggugagaaauaguaggccuggguuuuccuggacgggccagaggaagcugccauucacaagccucuguagugugccuuuuuauaaaaaguaaccaaacccagacuuuccacucuuugcugcucugagaucggucaaagcagagacucauggauaguagguauccuauccauccuaaacaguggcuaacguccugcucagugacucuaguuugucucucggggcugagaaaagccaggcgaugaagcaaaccugauuuuuuguuguuuaaauugccuguuucauaauaaucucaaggaccaggugagagccucagcguagggccugcugccuucccgggauccuggcaaguaaagaauugggcuaaggaauucuuaagcuaacucucacgccagcugucugccguggaugccaggucugccucagacaggaggucccacucucggagugggcguuccuccuacaggugucucuuucacuagcuccuuggccuuauuucacgaccuugguuugaguuauuuaaccagcucuuuuugcuggcuauuuuucauggacacaucacuuuuuaagaaggauauuaucuguaaauucaaggucagaagcugggugugguggcgcacgccuuuauucccagcacuugggaggcagaggcagguggauuucugaguuccaggccagccugaucuacagagugacuuccaggacagccagagcuacacagagaaacccugucuggaaaaacaaacaacaaacaaacaaacaaaaaaguucaaggucagccugaucuacaugagacccugucucagaaaagaagaaaacccugaauucucugguuuuuuugaauuacuaacaauuuacauuauuuaaauagcuguauguggcuaguggcuacuguucugaaucauuguccuaguuugauuucuauuucugugauaagagaccaugccacuuggagggacagguuuauucaguguaaauguccucgucacaauucaucauuuagugaagccaacacaggaacuaaagcagacuccguggaggaaagaugcuuuugggcgugcuccuccaaggcuuaguuagcggaugauacgaggaagaaccaccagccaggagugggacccucaguacuugcuuguggaaauacuuucugguuuggaaagauccagagaccuggaaaugucuguagcauaaaauggaaaugaaguaguaaaguaagaaaguaugaggugggcuggagaaauggcuuagcgguuaagagcacugacugcucuuccgaagguccugaguucaaaucccagcaaccacaugguggcuuacaaccacccguaaugagaccugacgcccucuucuggggugucugaagacagcuacacuguacuuacauauaauaaauaaauaaaucuuuuuaaaaaaaagugaggugagguucagcagugcccaggagauagcaagaaagaacugccuuuggcucuguuaaucaaaaggggcuagaggauacucugaggaauauugaaaagaaaaaaaaaacauaucuagaaguagcuuaaagccaauuucaaaagaaacuuucuaggcuggggaaauaucccaguagagaaaagugcuugcuuugcaaauaggaggagcugaguucagucuccagaaaccauauuugaaaagguaggcagaguggcacaugauuguaauuccagcacugggggcucagaaacagguuuguuggggcuugcuggccagccagucuaacauuuggggaguuccaggccauugaaaaagaccuucucuuaaaaaaaaaauccugaggcgauacauguguguaccuguacacauacauacaaagacacuugccuucuagaauuuuucaaguucagcaugacugaacuuugguuuuguauuugugaaaucggccacaggaacugguauccguucggagagugagacagagucagaagcuucggaaaucacaauuccucccagcgccccugcagucccacaggucccuguugaaggggaggacuacggcaaaggugucaucuucuaccucagggacaaaguugugguggggauugugcuauggaacgucuuuaaccgaaugccaauugcaaggaagguaggugugcuugucgaugcccuuagaggaagaugaaaguggggguugugagcauuccugugaccucacuaggugcccugagaugcauuguccaccaaggucagauuguccuuaggcaaaacaaggucagauuguucuuagucaaaggcauagccuugccucagaaacgcuucuuuuuuuacuugaaacuuggcugggcugccagaggguugucaagcugcucauuugggguuaguagagagcuguucccacaauccccucccaguguauaacuggagacuagcccaguuugugggccaggcagccccauugugugggccaggacagggugcacauggacugaguuaagaaccuauuguuacucuaucucucagaucauuaaggacggugagcaacaugaagaucucaaugaaguagcuaaacucuucaacauucaugaagauugaaucccaaucguggaauacacaagcacuuuuccaucccuggcgggauggguggauagaacauuuuuuuuauucagcauacauuuucuuuauguaggagcaggaaucgaacaagccucugugaauauuuucaucuguauaaaugcacaucacaaauuaaaaucugauucuuuucag

SEQ ID NO: 9480 - RNA, 10984 nt, Mus musculus
cagagcucacacaccggcagaaggagaccucucaaggcuggcccagucuccauuucuucucucucaagcuuuugugucugugccuuugagcugaaaggagggugcacuaggaaaggaggaggggugccuggggugagagcacccucuucacgcgcgcgcgcacacacacguugccggcgcacgcacacacgggcggacacacacuuccagacgcgcgugcgagcacacacacauacacacacacacacgcacaaagcucucucgcuuugagcgcacuaacguggccgcuuucuuuguguggagcccucgagugggguugggacccggguccugucccggggagauggcacagcccauccugggccaugggagccugcagcccgccucagcugcuggcuuggcauccuuggagcucgacucaucgauggaccaguacgugcagauucgcauuuucaaaaucaucgugauuggggauuccaacgugggcaagaccugccugaccuuccgcuucugcggggguacuuucccagacaagacugaggccacuaucgguguggacuucagggagaagaccguggaaaucgagggcgagaagaucaaggugauccugcuggucagguccgggcagggaggaaccugggaggggguuuccgccugagguauauugcuagugauaauaaaugacuagcuuuggcugugucgccaccugccgagcucaagacccugggcacauccacaacccuuuuagcuucuuucaggggcccauccccaccuaacccaaauuuucuggcaagccagggugguugcauucuuacccuuugccccuaccugacagcuuuggccgggaaaagcagguuugaaauuguucucaauccuaaacgggagagacaccccugaacacagaaaggccugagacaucucugguccuaguuuugugggauggaucucaaagcacuuuacacauuuugagguccuuucuaccucuugggugccaauaggcugcaaaaaagaaaaaaaaaagucauccuggcuaagcccugugacauuagagagguugggaauaaauggagcaagaacacggcuuuauuuuagaaugcaguuuauacuugugaguagagcugacuugagauggagguggcauggagcaugguuaugucacaaagcccuuuuaaaggcugagacacagucaccugcuggcucuucauaaucucccaaaacuuguucuuugggggcagucccucccagaugcuugcugcuuuagaucgguuuggaugaagcuggugaaugaagagcccauuacucauucuacuggcauugucuucagaaggcuuguugggaaacacacaacaacuucucugagggucagggggaagugccuugacauaguuuacuaaauaggccaaguacaaauauuuuuguauguucauuuaguguagcgaaaguagaaacucgguaagacaggguaugucaguguguugggaggggguagcaggaagcgggguauggcaaggacagcuuugugugucauagaaagcuuguaagaagacaccgggguuacuaaacaccaaguccucuagacucauagcuggccuuugcuugagcaggacccccggggaagucagagaugaagguaaacuuguuggucaaacagcugaaggagacacaugcccuguccuguguucugagugacacagagugaaggacuggugaacuggagagaaugacaaaacaccccaaauugugcaagauuucuuggugaucaaaaugauugcauuuuaaaaugacuucagcaaacaagccaaagcacugugcuuuaggaagauggguggagagagaaggagagauucugggucugggagauaauagauucuuuugaacuucugaucuauuuuagcucuuuccaaucugaggcgacagggauggccuuuuaaagccaaugcggggaucugucuuuuuucuuuuucaaggacucuucauguugaauguuugcacaggucagggcuucuuccuugacggugccuaguuucuuuaauauauggcuauaagacauuggaaagucuaagacgugauuuuuuuauaaucaaaguagaaauaaaucaauggaugcauuuuaaaacaccuucagaaucauguuuaauguuaucauuuacuuaaaaucagcuauuacagugagcugaaguguuuccugggcuuaaaaguuggagcagcauauuaaaucccucugaaguuugagugguggggaaacagaagugcaugggagucuaggagggaagggagaugaagggggagaaagggaagaggagaaaugagggguaggaggugaacaguggauggaguuaucaaccaauggccuuggggagggcuuuaaaccauuaccccaccccacaccccacacccuacccccggcccuggccacaaccaccaccccuggacuuaaccuaacuaacuggcuuucaagucccugccaaauauccuagacuuuuuuuccccagagggcagagccugugacagugugacucacuggaaacagaucagcacaacaccccgugcagauaagugcuuaauauggguuuugaggggaagaugauauuucuaaaaggacaaagccuuguaacacaguucaaggaggaaccucugaggacaaauugggcaagaaaccucaguggagugugggaccugggacaugcugaccucacuccccuguaagcuguugaaucgcuaaggccaaagcuggcaggugagagaccagagugucuguggcaagauggcagaacauggcagcuggcaagaaaucaagaaggacguagauugugcuucaugcuuuuucugcaagaaaaaaaaguaccaaaacaugguuagggguagggguagggguagggguacgguuagccccauaguucagccagcuauaguaagcuaucagauuauaaguagaagcccuggcaggugagugguagagacuucucauuaucucuucuuaguucuagaguaguguauuaccucuuuuaggcuuucuccuuuguguccuccaaguggcacauaugacaaucucugcugggggauagaugcucgauguugcucuggccuccacaaauacauucacucgugggcacauacuuacacauaauucaaaauaauacaaacaaauagaaacuaaacaaaaaauuccauuuauugacugaacaaagcccaaggugaacauuuugauacaacaacccuaggaauuaagauuuuagaauauuuuuaauuuaaaaaaaucuacagugugugugugugugugggggggaggcauauguguuccacagagcauaguggaguucagaggacaacuugugggucccaaucuuucuuuccacccucugaguuuuacaguucauucgguugggugccaagugcugaaccaucuugccaggguaaaauugggauuuuuauuauucuccuuugacagaucaggaaacugaguuugagacagaugaaauaccuugcccaugggcacagcgaucuuuugucauugcuagcauuucaauugagauccagaguccauguucuauauacugagcucuacuacagaggacaauaucuaguccacuagauugggagugauacacuaccaaguagccagucuuauugugucuaggcugggacucaaggcuaugguccaaggaucaaggcgccuucaacuugucuccuucagguuuggggguaaaguucaguguuagaguguuuguuuagcauaugugaggccuuggguucagggucacuaaauaaguaaaaaagaauuuaaaaagaacucuauuuugccuguacucaggacgcucagcagagcacuccgaguuuacuuuucauaccaugacugucucacuguggucaugagaaugacagggguccagagauagaaacaaccuuaggggcaaauccccccuaauccaaagucauuuuagagauagggaacuggagcucagagaaagaaagugacuucccuaagaucaaucagacagugcaggcuuucuaaucccuuuuccggugcucuuucuggauuucacacugccaggcuuagaagacuacacaagucccaaguucauuuaacccagaagguugucugugcaagcagcauagugggacaccacauaggaaagcuggcagcuuuuccugaucaaucuaggaaagauggagacaucuuccaacucccaaaggaaggguggagcuucucuuaauaaccauuaugcauuauggaugugucaccuacggguuuagcuaagccauauugugucugucucagccuaaaagcauccgaaaccaaugaauaggguggguuggauaggcauuguugaaccauucuugguaaaauuacaagaaaguagcccucugccuaguuuggguacucccacaagccuagcacccccacugugggcuggccgugucuauaggcaggcauggcccagacugcagaguucuuccucucugcugaucacuggggaaaacaccuuccuguuuuauguuacuaagugcaaagaggcugagcucaguguugcuuacaagcugccugcagucagaaugacaccauagcugugggggcuccuaagccucuaucuucugucacccuaaugauuaauuauccgucacuguguguuccuuguuuucuucuccucccuuccucucccucuuccucccacccuuucucuucccccuuucccucccccccugucuaucuuugucucuguccuuuuuauugucaugugugucagguuaguauaccuguguaucuuagauacauaugggacaguccaguuaauugaaaaaaaauuuuuuaaacuuucuccauccaccaaagguuguaaaugcuucucuuuuuuugcacauaugccuucugccauuggcuuccaacaaaaggauacccaugguccauuuauagaaugaugccagcuaugucccuuaaggaaaaaaaauacuuaggucagcuaagagauuguauaggggauggagagcuugcugaagcuuaccaggcggauauaacucucagaaaaugguaaaaaggugcgguuucucuguggcagcucuccacacugugccccccaccccaaaccuuccaucuaucccucauuaaucugggcuuaucccaagccacucaugaaaaguugauacaucuuucucccugucacaccccacugguugcccuugcccuguuucagcuucuagagccaagugugcccgaaugagaaccaguagauccaaggcacaguacuaaaaguugcuguucuuucugacacaaugguagcaacuaauauccauugagcacgucccauuuuacaaacgcuguuucucauauaucaugucauuggauuguccuagcaagcagagaagcucauguucccacuauagagaugaggagagugagguccaacuaagaaaagacuauucauuuaccccucuacuaacuagaagucagaaugcugucuuuccagcugcacucagcugguuguccauguagauucaggguaguguuguguagauucauucagugucaggccugaaaggaagaaagacuguauacaguuggccuucucaucccaacuaacugagaauaaaacauuuagaaauaaaagcagggacugagggucuagcucuguuaggaaagugcuugugccucccaagugcuggucuuaaaggcaugugcuaccacuaccuggcauacagauuuuucuuauuccauaagcaauacguuguaucaaauauuuuaagagauuaugugcugggcagugguggcgcaugccuuuaaucccagcacaugggaggaagaggcagguggauuucugaguucgaggccagccuggucuacaaagugaguucgaggccagccugguguacaaagugaguuccaggacagccagggcuacgcagagaaaccuuguguccgaaaaacugagagagaggggggggaauauguaaacagcacaccauuuuauagaagccuuugagcuuugagcuuccgugauuuagacaucuggggguucugguaucuguccugggcagugucauagugucauacauagccaaggaaugccaccaaagcauaccuacacaauugcucuuacucucuucauuuuccagauggggaugcugaacaaaggacccaccacuagcacgggauuuggacagagauuugcauugcaguugguuugauugcacaguacccuacuggcccucugagaaugaugaggaucugagagugaugagaguagcuaaggggcaggccucugccauguccacugggaaaggaggaaggaggagagggagcaucuacuuucacuuccuagcaaggaugaaaggcaugugaggauguugaggacagggaaaccugcauccccugacacagagagcccauuccaucuguccagugagccugccuaauguauuucccuuucaaaggcacugaagcccuacugccuaguucuguuuucugcuggcuguagccugcuuccaggcuucagucucaucaugacgggggugggggugggucaaaacuuuggaugugguuucuauagaguggggagggagaaguaacuacccccgaauuaccaagccucugcacgaaaacuucaaggcuuucuuuguagcuuuggaaaggcagaggaggucuccagcagaggggcucucccuacaguucuggcaacuugagugguggacacaauuaggacgccaaggaaaagucgaacagccaaccuuacucagcuucaaacaccucgcacauucccacccguguuccugcagguauuuuuagaauccugagcucaugguguuaaagcaucugccacaugccugagggccguuaggaauucagcuucacucagaggcaagagugaagacgacuagagacugggggugggaacuggcgaucaggagccaaguggaaaugguauucuuggacuaggccucuuuucuucucccugaccuccaucccucuccccaucugccucgcuuucuuccuguuccaagcaccagagagauagaaggaauaauauauauauauauuuuuuuucugucucuucuuacagaaacaaauaagucuuugagaauuuuugguuucgcauguaaccaaagucagaugcuuucucugaaauggcucuggcagaucccugagccguccaguugcugggaguucuagugcucaggcuuuugaucaccaccaccucagugauguacaaucuaaggcugaaaaaugcugccaaguuuagucagcaagggaacagcaggacucguggacacagagcacacagauguauucuaaaugguaugauuagacccaaagugcaguuccuaaggaaagagaauugcagaaguuacacaagauuugcgggggggggggggggggggcuggagagaugacucaagagucgagagcucuggcuucucuucaaguggucugggguuucauucccaucacucacaugguggcugauaaccaucuguaacuccacuucagggaaucugccauucuuuuucugaccucugcaggcacugcaaugcaugugguguacacauucauacacauuagauauaaauacaugcaugcauacauaaauacauaaauaaagucuuuaaauauuaaaaaaaauguuugaaccagacaucaugguggcgcaugccuuuaaucccagcacuucggagaaagaggcagguugaucucugaguucaaggccagccucguuuacagagcguguuccaggacagccaaggcuacacagagaaauccugucucaaaaaauguccuuuuccccugccccaccccccaaauugacaaugauaguggaggcacaagcugaaucuucaagaaugaaugagauuggagacauccaaaaaccaaugacuacuagaguucacgaguagggagaugagagccugacccagggugcaugaaaauccaaauggaagcugaagaugguaagaaauugcagcacccuaauacuuagcaggcugagacagaaggacugaggccaagccaggcuauaugugagcuucugucaaagaaaaauucaaauagaagauguaaaaacaaacgcuucacuagaagaucuuggagggugaaagagagccuggacaaugaaaaccgauguccaggaugauggccuuauaagaucuucagucagcaaagagcuucgguuauauuccaaagauuauacucacugacugcuaauuccaaauaaagacuauaugcuucacuugaaaauuacaguagucaaauuaguggccauaaaaagaaagauuuuguuucuuucucuuuuuuuuauuuguuugucugucuguuuguuuuuguuuuuucaagacaggguuucucuguguagcccuggcuguccuggaacucacuuuguagaccaggcuggccucgaacucagaaauccgccugccucugccucccgagugcugggauuaaaggcgugugccaccaugcccggcucaagaauuuuguuucuuaacugagaauuuuauagggucuugagaucaucauuuugagcaugaaugucuguugucccagaccuugcauacauuacagaaaauaaaauuggacuugaauauauguugacucccagagucaucccccugggaauuaugucuguguaugugcugacugauaccagauuuuucucuucauaacuuggccuuuaucccaaaagcuaagaagcagaaaaaaauagaucagauuuaauuaucuuuuacauaacaaagaagugaauuuaaaaauaaauugaaaaacaaguaugguggcucgaacauauaauuccagccccagguuggcugagacaggaagaucaugaauuggaagucagccuagacuacauaaugagauuucauauaaauaaauaaauaaauaaacaaauaaauaaggcucaauggugaggauuuaaacacuaauuuugcuuuucugaugggaggaaaacaggcucucauacagcccaggcuggccuccaacuugcuuuguagcuuaagcuagcuggacucaguguuucuuguaaugcaaaaguuagguaagagguugcaugccuauaauucagaaaggucggguaguaggaucacuaguucgggacuaacuugaacuauauagcaaguuggaagccaguuugaacuauauacacauuaaggcccugucucaaaacaauagcagcaaagaaaacaaauauuuccuguauucgaauagcuauuaccauucugauauauauaauucuagacuuuucuacaaauauauuuauguuauauguuuuugaaaauugagacuaugucauaugaaacagauuugggauugguuaaaauuugaguacaccagcccugaaauguucuuuuaucuguuuucucuuucucacuuugucucucuggucuuuuaagacaggguuuugucauguagcccaggcuggucuugaacucucagcaaucuuuuugccuagcucuuacggauuacaggaauugcuguaguugcaggugugaacuggggcaagcauuccucugugugugugugugugugugugugugugugugugugugugugugcacacacgcccguaugcuauuccucucccagugaacauuguuuccuucaggagcaguaacgccgugaugaagauauuuucacaaaauuugagagcaucuuuucaaugccuuuuguauagauuccugaaagcaggauuauaagucuuaagagucguggacguuuuaaagauuauugauaaaauuaucauauugcccuccaggaaauuugacccacauggguauauuuuuaaaugauuuuuaaaggauuguuuuauguguaugaauguuuugcuugcauauaugugaagugcacuaugugcaugccccgggcuagccaaggucagaagagggcauccaaucccuugggacuguagguacaggcaguuaugaauuaguuaccuuaugggugcugggaaucaaacuugggaaccucuucaacaagugcuauuaacuaccgagucaucucuccagcucuuguguacuauuuuuauacuacaacccuuaaacuuuucacucaguauuuucauccagaaagaaaaaaaaacacuuagcaaacuauaaaacuacacucuggggucuauauugcuaagauaucgagaaguacuugcuauaucaggccuuguaaccaccuuuucuaauguuuuaaagaauaugcauuuguuugaguuuuuuuguuuguuuguuuuugagacaagguuuccucugugugagagcccuggcuguucuggaacucaguagaccaggcuggccuugaacucccagagauucauccaucucugccucuccgcugcuaggaugugccaccacuggccagcuccgacgaugcuuuuucucuuguuuccuuuucugauuuuacauaugggcuuuuguugcagguucaggugugggacacggcaggccaagaacgcuuccguaaaagcaugguugagcauuacuaccgcaacgugcaugccguggucuuugucuaugacgucaccaagaugaccuccuucaccaacuuaaaaauguggauccaggaaugcaacgggcaugcugugcccccacucguccccaaggugcuuguggguaacaagugugacuugagggaacagauccagguacccuccaacuuagcccugaaauuugcugacgcucauaacaugcucuuguuugagacaucagccaaggaccccaaagaaagccagaauguggagucgaucuucaugugccuggcuugccgacuuaaggcccagaaaucccucuuguaccgugaugccgagaggcagcaaggcaaggugcagaaacuggaguucucacaagaggcuaacgguaaagccuccuguccuuguugaagccaaauggugucaauauucgagaauuaccacuggaguuuuuccuuucccuuuuuucugugccugcauaauaccuacaccugcuuguuuccauacaaacuaauaucaaaauaaaauuuguauagauuaucacgugg

SEQ ID NO: 9481 - RNA, 15722 nt, Mus musculus
cgccucgcgggccccgugcuccaaucugagcuggguguucgggucgcgggagcgcuuuggagccucacccggaagcuguugucgucugaagcgagccgcgcgaagaugcgaauaugaaguaaggauucuguuucucugcggauaggggcgggaguguucuccgcggaagggagaguggcuugaggauggccgcccagaaagggcggggaccgguccucgcccuccgggccuccgggcgggagaagcucgguagggagagggcgggcugggaggaaaaguacuuaucgcacuuaccggcuugccugccacccgcgcagcccucugacuaaggugaagcugaucaaugaacugaaugagcgagagguucaacuuggaguggcggaaaaggugucuuggcacucggaauacaagcacagcgccuggaucuuuguuggugagguccccauuuuucuccagcagugccuuucagaguccgccccgucccuuccccuccccuccccaucccucuccaucccucuccccuccccuccccuccucaucccucuccucuccucucuccaccccuuccccucuccucccuaugcccccucccccgguuauuuagugccccuggucaucgcuucugaacaagcucaucaccucacacucuggaagcuccucugcucacagguccacuuuucaguugccuucagcgcuucuuagaauugguauuugccuuucauucuauucaaaaccuugcuacuuggcugcucagagacaguucauuccacagucaaccuaucacgaugucaaagaaacggaggcgcagacagguuacuggacuugcuuaaggucacaugcugcagcacuucaaaacuguggggcuugugcucuucgucacggucacauaccgaucgugugugugucugcccuuccucacaaugauuuuucuccucuccugggcuucugcuccuaguccuuagcuguaccgugauguaccuggucagacauuagcuggauuugaagacauuaaggcuugauucaaaauuagcuuuacuccggcugaacauuugaaaggccaccugaaaaugugacaggaucagggaaagcuacuucugaugaaaagaauagagucuggaguacaccccuggcccuggguagauaccaggacauuuucaggaaaccuacauguuacauacuagugugccccuuccuucagacauaauccaacagagcuuuaagucaucuggccaguagacaccugucaggaaagcucagucaccgccagacacgcuagggacacgggagggaaaugauccccagugcagguggugcugauguccgcccuaagucuaccugcugcucugaggccucgcugagccccaccucucccuuucuuucuguucucugggugcuggcggaaauccugagccugcuugccccuaacacgcugggcuuucucaucucacaucuaaauguuuuccugucccuuugcggcuacugcucuguccccauuuuugugcacuccugcuugcuccaccuccuaauucugaaggcauggcugccaacccuucuguagcucccuccucccuccuccucccgguagcuggcgaaucuuacaccuugccucccuaucagcucucccucaaaugcuaacacaauggaccucaagcuugcccuuuagucuguuuuagaauuauuuuaccaagauuagagacugagagccuuuguaaaaggggaacucuugagucucuggggacaauauuaccuuucguguauucucuuuaugucacaaccaaaaucccgcaguuugccuuuugaagggauuguguuaagcacuuuauaugccucauuuuaguuuauuuccauaauacuccugugaggcaaauauguuaacguccccuuuuugcauaugaaggagaacauugaggaacaugugaaaggcuuccugugaaccgcuuagcacuuuccuugauacauccuaguuugcacguggggggcaguaacaguguauugaagucaguguuuaugaaaucugagucuugugcuggaaaucaugugcuuuauaggacuuuggguaugaagacucaaugauaagauuaauuugguaauuuaugacccuagccuuuccccucagaguuaauuaguuuuuuucuuuuucuuuuuuucuuuuugaggcacaguuucgcucugaaacucacuguguagaccaggcuugccucgaacucaaagggaucugagagcuaaugacuuuucuuccagacaacugucaucguacccacucugucauuguauuaggcugauaauuuccagaucaaggcuuguuuaaucugcaccuccagugucuggccuagugcauagcaugcagugaaugcuugauuaaugcuuguuaaacuggagaauguguguuuucuuccaggagggcuuccuuaugaauugacagaaggcgacaucaucuguguguucucacaguaaguccucuguuaguuccuaucuccuggaugcauggaacaguuugcuuccauaguguauuuuuguaacagcaacaaagcauuucaagcuggguguggaguuguacaccucuaaugccacuagacaagugccugagauaggaggaucacuuggggucugccuaggcuccauaaugcauuccaggucagccugcacaacuaagugagauccugcgucaaaaagccaccaaagcuauuuuaauucuagggaugucuaaugacaucccuccauggggaaggcuagacccuagaucagucccagagaguuaccccaugggagaucccagagcugagaucguuugagagucugucccagggauuuuaguccauuucugucaguuuuacuaagccuuuuucagcgugggcuuucauuggaacagacugggauucucaggaaggugcaguguugcccuuuuucuuuggguucuugaaagcucugggucauccaugaucacagggcucucugagccuuaccuguguggcauugggccaaacagaaguagaccuugccugcuaggcuuugucagcacugcugaguuguucuuugaaauggcuuuacuaauuucuacucuaacuggaaugccuauucacccuuuauuucucuguagaaaaagcuguccuauagcucucuguagaccaggcuguccugcagcucucuguagaccaggcuguccugcagcucucuguagaccaggcuguucugcaguucucuguagaccaggcuggcuuugauucagagaucuguuugccucugccuccugagugccaguauuaaaggcaugugccaccaccacccaguucagaucuugaucaaaguuaccuaacucuaagguaggggauuaaauuugguuuuuauugggauaauauuaacauuuuuuauuaacuuucugggagauucuaacaucuuucugauagugagucauccaaucuaagaaaaauaauguauuuuaaaaaaaugcauguuuaugucuuuuggagauuuaaaagaguucuucauauaggcuauguauagugcuugguuaguagguguacuuguaaguauuuuguccuuuuuuugcugauauuaugaagggaauuucccuucuauuaucucaucugauuauuuuuguauauaaagggugacugacuuuuaacuuuguccuaugauuuuacugacuuguuauacuguuuauuuuugucauugcuuaucauuaaugcuguuuaauuuucucucuauacuauuguauauaaucugcaaacagaaagauacuuuuacuucucuacuucuuuuaucuguuuuaucuaauugcauuggcuauaccucauuauauugucaaauaguucucaaccuuaguugcgaacauucacuauuuuacauacuagauuuuggacugguauguauauauagaaucauguaacuuauacaucaauuccuguuuuuuuuaugacuuaauuuauaaagcuuuauuuggaauugguuuuauaagaaguaggguagacuuucuauuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggauacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcaugguggucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuauuuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugugugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuauauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggucgccuccccagccgggcgggcaccuguccucuggucuggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccagccgggugggcaccuguccucugguccggaagguggccggcuguccccggcccacacagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcucgacuuucuauuuuguauucaauuaauuucugcuuuggucuuuauuaaagccuguuuuaaguuuguuuuauuuuauuuucauucuuuuuaaggaaucaaauucuuuaagguuacaauuuucccuaaguauagcuggcuuagcuacauccuacaaauuuucauguauuuuauucuuuuuuuuuuaauuucuaagugguauaccauagacauuuuaauuuauuuuucauuuuaguucauccaacuauuagcuaagagaauagguuucaaguucuaguuaguagcaaguuuuuuaaaaauuauuuuuuaaaaaaauuauggauguuuugcuuacauguaugucugcaccaugugagagauagaagagggcacuggauuccuuggaacuggaguuacugauggcugugagccucuaagugugcgcuuggaauugaaccuggguccucuggaagaguaaccagugaucuucacuauugagucaucucucuaguuccaguagcaggauuuuguuuaaacuauuauuucuaguuuuaucacacugauuuuugaguauauguuguagguauuagaauuuauuuuuaacaacuuuaacucuuuacuuucaaccuacugugucauuuacaguauucuuauuaugugaauuuuaaaugaauaaaacuuuuuauaaaauagauauggggagauugucaacauuaaucuugugagagacaagaagacugggaaauccaaaggauucuguuuccugugcuaugaagaccagaggagcacaguucuggcuguugacaauuucaauggaauuaagguaaaugugcuuacugugugcucuuuggcugaccuuuuccuguggaugggugaggcuucgcuuuuuuugccucuguuuacagcugcacgaauaguacuggucaucuggguguaccguggggguuguggaagugaguagacacacuuggauagggaaggauuccaggaaaccauuuucuggcucaugcaccuuccaggaauuguaacuuuccccuguuuguuagcaaacuuguucuagaaacgugggucugcgcccccuuaucuggcagauguuuuuaugcacauuuuccaucuguucuaguacauuagagaaugaagagccuagggacacugcucuuggauauugugcugugucagggaacugggagcuucaucauggcuugaugagcuacgagccauguguaucuagucaaugacuuuugugacuuaacauauuggcuccuggaaauucucuaguuaaaaucugaugaccaagucuauaaaaguaagccauucugaaauuuuaagggaguggcauucacaagaaaucaccaucagaggaaaauugcuuuuucaaaaaguguaucaaaaugagaaauagaauggaugacagaagcuuuugaggcuuuuaaguaaaagccucaaaguagaaguaaaaauguacccuuguaguggaacagugaaauuaaucuuuaggucuuagaugauguugcccacauaguaaguguaugugcuugaaaacagacuauauacaggguaaaggauucauuuuauucuuguucucuuggaaaccucuagcuuauagcccaguaauccuugggaacuagaaguuccuauaugguaggaguagggcuagggauggagcucagagacgagagugccucucugucauagucaaccaguaccccagagcuguggcucuagcugcauauguagcagaggauggccuagucggccaucaaugggaggagaggcccuugguccugggaagguucuaugucccaguacaggggaaugccagggccaggaagcuggagaggguagguaggggagcagggcaggggaguguauaggggacuuuugggauagcauuugaaauguaaaugaagaaaauaucuaauaaaaauagaaaaaaaagaccguaaguucaauaccaccgccaccucuacugccacugccaucacaaucaaaggcaacaacaaaagaaguuuguucccuuggucucauuuugccuccugauuacuuuguugaaaaagcagccauagcacuaaauuucauguuucuaguccucauguuuuccuagggcaugcuguuuucuuguuaaauguauauaacuuuguauauaugaacacacauucaugagugugaugccuuaggucaggcgucauuccuuagaaucugucuaccuucuaccucccccccccaaacuuuauauuuuuuguuuuugcaagacaggguuucucuguguggcccuugcuguucuggaacuagcucuguagaccaagcuggccucaaacucaaggaaauuuaccugucucugggauuaaccaccacugccagguucuuccucuucuucuuccucuucuuucuuucuuucuuucuuucuuucuuucuuucuuucuuucuuucuuucuuucuuucuuccuuccuuccuuccuuccuuccuuccuuccucucucucucucucucucucucucucucucucucucucucuuucuuucuuucuuucuuuugacaagaucucuuauuucucuggaacuuaucaaguaggguaggucugucugucuucucucucucucucucuccuucucuccuccccuccucccucucccucccucucccucuuucuuucuuucuuucuuucuuucuuucuuucuuucuuucuuucuuucuuucuuucuuucuuccuuccuuccuuccuuccuuccuuccuuccuuucuuccuuucuuccuuuaucucccacucucuggaaauuaucaaguaggcuaguauucuuaucuagccucacaaugcuagaauuacaaguguaugccaucacacuaauauuauguggguucuucguauuaaccucagguucuuauucuuauaaggcaaguuuuaccaacugaacacaguuccuuauagacaaucaguugugcuuuaaauuguaaauucucacaguuuuucaugaugcugugcuuuagggcaauacuucugaguguuuuuuuuaaacuucgugauacacacagaauaugaagagauuugcaugacaccuguaguauaucaagggaggagggugggcucugugcauaauuggucuagagggcucacuugcccccaggccccauuuagcugcccagagugcugugcauuaauguaugccuucuuuaaucauuucuuuauacaaggcaaugggugugccucaaaccuugcuuccuuaguuguuuaaauagucugaugcgggagcucuuugcugaaacauuuccccuuugcuuagauuaaaggaagaacuauccguguggaccaugugucaaacuaccgggcuccucaggaaucagaagauguggaugaugugacuagagagcuccaagagaagggcugugggguuaaaacacccccaucaaguccuccugaagucucugaagaugaagaugccaagcucacaaaaaagcacaaaaaagguagcauauuaaaacucaggagaagaguggguagccuuagugucuuugccaagcaugcacagauagucaacaauccacuccucauugcaaaaggggaaggugugagaaugcuuacuguggucacgaaagcagagguaucuaagggaggaaggcuagucgugcgggcagaauuaaugugcucugaaacccuugcggaucucaaagugauauuguuuuuggagacagcccuucugugugggguuguuuuguacaacuugacccaucaggaguaacagguguccuauuugauucuuagagacauuugucaggaggcauaaccugugacugcuuccugcugcugccugggauguguauaguacaugugcauucuccaucugcuagcuagcauggggacguuuuggaaugucucaguuuuacaugaucuacagagauaagaaaggcacauuuuaaagagauuuuuuuuguguguguuuucuuuuucuucuugauugcccccuuccagacaaaaaagagaaaaagaaaaggaagaaagagaagacggaagggcaggcccaggcagagcagccguccugcuccagaagcgcgacagugaaggagaagaaggaugagcgcgcuuccaggaagcacaguagcaagacuuccgagagagcacagaagucagaacacagagagagcaagaagagucacucgggcuccccugauggcaggaguuccuaccaugcuagggcagaggacccugagugcaaggcaaggaaagagaaacccaagcaugagcacaaguccgccagcaggagggaggccgaggagaagagcagagagagggagagagggaggagcucggggacucauuccggcaggcacagggggcauucugaugggcggagccauagaaguagaaguaggaguaggaguccagauaagucccauaggcacaaaaaguacaggcacucucgggagcgggacuccuaccauggcagugaccggagacaucacugaagccugauucagcugauuuugguugcauaaugucaguuucucuugguugcuguuauuucuguauauaaagauucaagauugaauucuuucaaucccuuaccugacagaguuggugaaaagaucaauagcuagauaucuacauuaaaaacaaacaaacaugauccguuguaucugggaaaauauuuaguauugaccagaguaugugccuaaaauuuggcuuguaaauuugacccuuaaacccacaaaccucugauuuaagaugagauugccagggaagucaaaacacaaggcagugcuggagugcuagucuccacguuagcuauuuagagcccagcacuguagggccuaccagacggcagguacaccugugaagaguugcagcucaugagauuugaugagcuuaauaaggaugugauaggauuccugaggccagccaguuccuuccccuuugcauuuccucuugccaugcuagggauggaacccaggucuuugcacaugccaagugcucugcuacucagcuagagcccaguucccuuuauuugguuuuuaguuuuugauaugguuacagacaugucuguguauuuuuucuuuguaacuuauuuauuuguauugagaugaaauucauauaaaauaaaguuaaccauuuaaacaguuc

SEQ ID NO: 9482 - RNA, 6896 nt, Mus musculus
uuuaggugaucucaauuuuguuggcaacauccagagcaccauaaugaggaaccagucuaacauacaccuucuucucucugucaggccacagcaggguauugacuuuggccacaucaaugucauagaguuucuucacagccuguuugaucuggugcuuguuagccuugacauccacaaugaacacaaacguguuguugucuucuguccucuucauggcugacucaaggauaaaggggaauuugaugauagcacaguucuugagcuuguuucuccuuagugcacucuuucgaggguauuugggcugcugccuuuaaucccaggaggcugaggcaaguggaucuaugugaguuugagaccagccugguuuacauagugaguuucagggcagcuacugcaauguaaagagacgcugucacaaaaacccaacagaaacaucacuuucaauaguguaugcaucccauuaauggaaaggacuuauauaguuuuuacuuaauuuuuauagaaugccaaguacucauguuauaaagcgauaagaaaggcuuucaaaaugaguaggaguuuggaagcaagccaaaaccuuaauuaggagaaguugucggugucgcuuguuuauuuaacaggucacaauuuuuuaaaacuauauuuagccgguaguccauuagaaugaguugcaugaugacuauguaauucagcggcagugcucggaauagagguaauucuaacaacguuucccuagaucuacauuucuuagcccuacuucugcuugugcgaguagcuggcuguguagcaagugaaggcuucacccaaugggaaaacauaggaacuuagcguuuuuauaaaaucuaaucacgaguguuaaaugcgucaguuaguaaaaggauaaagcaaaauccuuuuaaaauccaguuuucuuuaaaaaaaaauaaaaaaacacauuacuaagagcaggaacagauccauuuuuuuuuuuuuuuuuuuaggaaaacauuauugucaacagaaaaccuggcauugcuuuuaucucagcuuauugaauuuugacuugaaaaaaguucaauaacuuuugauuauaacuaacucaguuauaccuguguuacuuuccuuuuuugguucuuuaagaaaccaggaagaaaaccuauaucugaaauacaaaguguaaccugagcaucaauagaaccaaaaucaaaaugcgaagcugcucucacagauuucauagcccuucucauuccagggcuaaagaacaggagcaagagacucccuacagauggaaucuccuuugcaacaccacuuugggcuaacacuuuuuacucuuuaauuuauagugaggucaaacugcauuuuccaugcuuguuuuuuguaucugaaggaaaaaaaaugacaagaaguucauacaagaaauacugauuccugggucaucuaucuuacccagugccaaucuggaauauaguuuccuuccugaguugggcaauguagcccaucucauaucagccacugucuuauguuuggccaccacuuaaaagcucagguggcugguuucuuucugaggaucccuggaggucuuuggcucagaagcaaugaaaaguugucuaucgcagaaucugcuccccaguggaaacacuucuguccccagaaaaaguuuuauuuuaaagacuuauuuauuuauuuauuuauuuauuuuauguauacgaguacacagucacugucuucagacacaucagaagagggcaucagaucccauuacagaugguugugagccaucaugugguugcugggaauugaacucaggaccgcuggaagagcaaucagugcucuuaaccucugagccaucucuccggcccccagagaaaguuuaaaggcauagcuauacacauagcagcuggaauuuugaacugucuaugaaguuaaguuauggaaagucuuuccucaaaacauugucuauugaagauguagacuuacaagaacgagcuugaggcaaggaugcaguuugguagaacugccacaguggaauaauucccaugaccuaaaacaaucagcuucaugugucuugagcauauggaguguuuuuuaagauuuuuagguugaaaaaauguauagaaauuugagugaccauuuugaauguguuuuggauccaaaauaugcuacuuugggaguuugugugugugugugugaaagagagagagagagagauagggguaguucugccacugugucucagaauacucucucagaggaaaaagaauggauuaggauauuggaaggaccagaaaagccauuuauuguucccugugacccaggaaugggguauggguaggauagaggauuucuacacuuaauaaaucccaguauggucagagucaagaucccuaaagaacugaaggaccuccucaugcuacugagggugacaguauaugucugugucucuguuccccacaggugacauuuucuggaggcugauuccaggaugcauuuuugaaacccgguuggcaaguuucccugacuauggcuuuggcugauccuccccuacaagcauagcuugauguuacugcacgcuacuuuggucucugcugguuuguuuuuuuuuuucuuuuuuuuucuggucaggaacccauuuacucuuuugagaauuguuauuggauucaaagauagaauucccuuaaacuaggacuagagaaguggguuagcuauuaggggcacuuucugcucuugccacucccugugagcuaaugggggggggcauuuucauucauacuacuacaaugugucucaucugaauucauuugaugaagaacacagggacuaagguccgaguggggaccaaggcuggaaugagauguugggaacaucagcaugagcaguggucuugauucuuugaaaguagaaagacaaauuuguuuugggagucugacccuuguaaccuagaauacauuuuguuacaucagucuugggugguaauccucccuuuguccugucuacagacuuucagcaauagauaaggcuuuauugccuucuacaauuggggcaaagugucaugguucaacucugaaauaucuaccacagacugauguuuuguauguccauuucauagcuagugaugcuauuucgggggccuguuggaccuuuagaaggugggaucuagcuagcuaaguaacuuaggaaaggccuuugaagcuauggcucagucucuaauucuggccuugcucucugcuaccuggacugugaugguauauacacagcuuucucagggagagaauuaagaagcuguuugugcugcagccuaacagaaguccuugauucaugaugcuaaccuuuacguggcuccccgugcucuuugucuuguauugugugcugguauguaaacuucuaaugucucuaaaagaugauaaaaauucacaucuuuuccuugcucuggggguuuaguuuugagagauuccucaggaagaauugcugggagaagugcucugaaaagucuucuugauucccccacuguguucucucucucucucucugucucugucucugucucucucucucucucucugugucucucucuucucucauacuuagugaagguccuuucuaggcuuuaaaggaaauccccauuucccuuuaagacaucauuauguuugaauaaccacauauucuagguaauguuuuucccucccacuuugacccucaguuaugacccuuucauucuuauaaaugucauaccugaaggaaaguaugaauugugugucagcuuuauuuuuagauuuucuguugcuguuaacuucuuuuuuauauuuaacagaaagcacuucaggaauuagggggaccuacacuugucacagguggcaggguaggaaauauaaauuaauuugaaagauuuuuuuagacauauucuauuuuauguguaugaauagcuugccugaauguauguauguccaucaugugagugcccgaugcucauggagaugagaagagggcauuggauauccuagaacuggaguuauggaugguugugagccacugugugggugcuuggagccaaacccagguccuguacaagaauaagugcucuuaauuuguucuucaguccccucauuugaaggacauuuuagaaagugccccuggggucuccuacucucacagagaauucuauggaaguguuuuuccaggaugauacacuaggauggucagagacuguugaggguugacauugugcacuguguauucagaugcugauuucugugcgcagacauuuguauauagucuagacaauggcgugguggucaagcaucuuggcuucaauguuauguaaaaauuguuuucuauuaucucugguuggucaauaaagaguugauucagccugugacugguuagaggugauaggaaggcuggauguccggucccagccagaggucccagggggagagagagaagaggagaggaagaaccacaagacaaggaagauuggagaaaccacauggagagaacaaggaguuuucuaugaggucgugaugagaggagagcagcuaugaggacauacauagagcaagccaaggaaagaucagauggcaaguaacagggcauuuaucugguuauuaacaucauagucagguuagaauaauuuagaagccacccacuuuaggcuugcagcuuguuaauaaaaauaccaggucucugugcccauuuuucaggacuacaaugggccagagcagguacagaaauaucuugcauuuauucagguucaaaaggugcagaggaaaaaaaaaacccaaaggauuauagucuacaagagacuacuagagcugugguccaagaggguacaacuaauacuugagcuugugguagaacuuggcaucaucuacaugauucugguuuuccagacaugcagaauacacgauuuacagacucuuggagucuugccucaagauauuuaaggaugucuaugaggcaagcaauuuguugcuaaaucagauucucugcaaggagcaccugggaggcagaggccuggagucaagagugaagccugcauuguaauggauguaggcuuagcaugaccucaggaugguggcaagaaaaugaaauaucugcagaagaaaucugcauacguuacuauagcuugccaagagagaagcuguguguacuacaaaucguaagaacaaagaggucaaucuauucaagcuucuacuuaggaaguuucaggccagccagaacugcauaguaagauauuguccccaaaacaaacaaaugaaaaagaaaaagaaaaagaaaaaaaaaaaacaaccaacaaccauaaaacguaaccaccacaguauuguaacuaucaugacuuuagggaaugacauaagccuuuggggaacaggaguagauuguuaggcuuugaaucugaaauguucaccuuaggcaaauguaguaaagacuuguucccuugugggaaauugugggacuuuuaacaggaggggccuugcagguggagauaggucauaauggaauggcccuucugguuccaguaucagaagggccuuuguuuccuggucugccacagcaggaauagccuaagccacauguuccugccaucauggauggacucauggcucuaacuugccuucccaaccaggacggacagaaauccuccgaaacugggaagcaaaacaaagcuuuccucucuuaagcuguuucucugaguacuuugaauagagugauauuaaagcaacuaauguagacaguaugguccuuuggccucccucuuuauuggacacuacuacuuagccccaagaaguccccacacacugucuucccugggcaguggaaacuuucucucaaauucugguauuguucugucuccuucagccuugagcaguagacaaucccucuguaauucagacaguggucucucccuccccggcccccucaacccugggaaguggaauauuccuuuggaacuguggucaauggacuccuauccccucagcauggaccuucccuuuggaacucugacaguuguuuuaccucccccccccaugucugggcaguggaugcuuccucugaaaugcugauaauuacuuccccccaucagcccuagacaguggacccuuccuuuggugccccuggcaacagucuaccccuucaguccuggacaguggacccucccuuuggaacucugguaguuguuuuaccccccuccaucucugagcaguggaugcuuccucuggaauccuuauaguuacuuccccccaucagccuuaggcaguggacccuuccucugguacuccugguaagucucaccccuucaguccuggacaguggacccuccuuuuggaacucugguaguggucuuauccacucaguccuggacagugguuccuccccccuggaacuguaaugguggucuccccccccccagcccugggaaguggacccucccucugcagcucugggaguggguccauaaccucaaccuugaguaauuuccccagaacucucaaacauuguucuuggcugcaucucucugucuugaacaaugcuuccuucuuuggaacuuggacauuggucccauucuuucauccuuauucgguuaguuuaacucuggaucugacuuuaagcaguggcuucacccuuugaaacccuggaagugguaacccuccuagucuuucccucuaaccacugcaacuuaggcacuagccccaucccucuuacuccugugacuuggcccuggcuuuugacccucagccaguaucccuacacuccuaaaccuuggggugacacuuuacucuaaauccgggaaguauucugacacccuugaagcacuagcacugaucgagucuucuuacuggacucagaaagugaggcaucuaguccauccugggugaccgacccuucuccggaaccuaagaaguagucucagccuguucauc

SEQ ID NO: 9483 - RNA, 1304 nt, Mus musculus
ccagcuucuuggccugugaaauuuucugauugaaauaacucaaauguuccuacaguacuaaucauauccacccaugcuguucugaccgcuguagccggccccguaacagccacucacugacuggcucuccaggccacuguaaguugccugggcagcugacacacccaugcccugcaucaccuggcugcuauaagccccauugcuagccccuguuguugaauucaggaagaguucuauguaucugugcugcauguuggccuuguccuuggacauagcugccacugcuucuucaugaguagcaaacucaacaucagcuucucccgucacucuuccaucaggaccaaucucaauaugaacucucacaggguugaguggagagaagaaguuguaaaugucguucuccguugcuuuguagggcagcccucucauguggacgcaguggccgguggugcucugcacugugaacucgcugucuccauaucuguggucauacauuccugagagacaauagcugagcucucucccaaacaggucaguggugaagccauagccaucacugaggccacuguauucuucauagcccccauagccugcacuauaggcaccagaccucauccuauccagaccugccuguuucacaaugccaauguaccuccgggcugugccaggccugucauaaggcccaggccuuugcacagacauaaacuucagagguggaucugaguaugaucuaacuucuuccugacugcucuuaaacacuucaauauaccugugcccuauucucuccuugugcuucccuaaagcuuucucagcuaacucuugugaggcaaacugaacgaaggccuccccuguaaucuugccuuccagguccacagguagugugaucccguuuggcauaauuucccacccugagaagaagugaacgauuucuuccuuugugcauccaaaugggagucccggaagccucacaaagccaccauuggcacugugggcgcuguuggaccacugugcuucaacacccaauccaucucuguucugugugacuugaacaccucaauauacuggugucccaugcuuucccugucuuuuuucagagccaauuuuacaucaucuucugacucaaguucaaaaaagccucaccacucugccugccuucucuaguuuaaaugaaaugaacaccugcgaccccaucaugaauucugcaguuggagaggaaguuuuguacguccucaauugagcaggaccaggguaggccacgaaguuugaccacauagccuucaacucccucaggggccagcaucaug

SEQ ID NO: 9484 - RNA, 25242 nt, Mus musculus
ugggauauuuucacaugcccgaagccgauucucggacucgacaguuugcugccauggccuuccuagcuuugaggagucuguauguccuuuauggucauucucacaucugaaugcccucuagcuugcuuuuaaauuuucauuuagccaccuuuugguucuaaacuauugauuuucugcaucugucucgauccggugcuggcagagccucucagaagauagccauacuagguuccuguccugcacauguuggacucaggaauaaugucgggguuuggugucugccuaugggauggguuccaaaguggggcagugccagggacagcccaggcaugggaucuuucuuguugguucuucuuuaggcagcggagggggaagagcauccgugggggauaagacuuugucuuaugagauaugggguaagaaguuuuuaugagauauuuaggauuucugaauaaugauaauaauaagguuacuuguguaaguaaaguaauaugcuacuauagcugaccugccuucugugauccugaggcaagaaacugcaguuucuggcacuuagcaccucuuccucaauugagcagcaauaaguagucuuuguacuaucucagcaggaacugcacugcucuuucagcccacuaguuggaagucucaggaaaaaagagcggacacauagaaaagugauuauuccguuuucauuuuucuacauacagacagccaguuagaccagcaccacuuauugaagaugcuuuccuuuuucaaauggauauuuuuggcggcuuugucaaagaucagguguccgcaagugugugguuuuauuucugggucuucaacucuauuccccugaucaacaugucugucucucuauaauaccacacauuuuuugucacuauuuuugcuugaggucugggauggugauuuccccagauguucuuuuauuguugagaauguuuuugcuauccuggguuuuuuguuguuccagaugaguuuacaaauuguucuuucuaacucuauuuagaauugauuuggaauuuuuuguuuuauauguuuauuuauuuugauuucuuuucuuuuaauuuuuauuauauauuuucuuuauuuuuuaugauuguaaugauaugacuuuauuuuacaauaguuagggggcacaaaacaauccacuuuaauaaaguugagaauuaacuucacuuaggacauuuuaauaauguacauuuuuuaaaguguuggucuuuuuuucuccuuuuuuauuuauauucuauuagauauuuucuuuauuuacauuucaaguauuacucccuuuuccuaguuuccccuuugacaauccccuacaacucaccccugcccauccucaacaacccacccacucccucuacuggcccuggcauuccccuauauuggggcauagguccuucacaggaccaagggccucuccucucauuaaugaucaacuaggccgugcucugcuacguaugcaacuagagccaugagucccaccauguguuuucuuuggugguuuagucccagggagcuuggguguacugauuaguucauauuguuguuccuccuauggggcugcaaaucccuucagcuccuuggguacuuuaucuuuuucguuggggacccugugcuccauccaaugggugacugugagcaugcacuucucuauuugucaggcacuagcaaagcuucucaggagacagcuauaucaggcuccugucagcaagcucuuguuggcaacugcaauagugucuggguucgguuguucuuuaugggauguaucuccagguggggcagucucuggauggucauucuuucagucucugcucugaaauucgucucuguaucuacuuccauggguauuuuguucccccuuuuaagaacgauagcaguauccacaauuuggucuuccuucuucaguuucauguguuuugcaaauuguaucauggguaguuuaaguuucugggcuacuaaccccuuaucagugagugcauaucauguguaugcuuuugugauuguguuaccucacucaggaugauauccuccagaugcauccauuugccuaagacuuucaugaauucauuguuuuuaauagcugaguaguacugcauuguguaaauguacaauauuuucuguauaaauuucucuguugagggaccucuggaccuucuuucaggcuccugucuauuauaaauaaggcugcuauaaacauaguggagcauguguccuuauuaaaaguuagagcaucuucuggauauaugcccaggagagguauugcuggauccuccgguaguacuauguccaauuuucugaggaaccgccagacugauuuccagagugguuguaccagcuugcaaucccaccaacaauggaggaguguuccucuuucuccacauccucaccagcaucugcugucaccugaauuuuugaucuuagccauucugacuggugugagauggaaucucaggauuguuuugauuuucauuucccuguugucuaaggacauugagcuuuuuuuuuuuuuccuaggugcuuuacagccauucgguauuccucaguuagagaauuuucuguuuaccucuguacuccauuuuuuaauaggauuaauuguuuuucuggaguccaacuucuugauuucuuuacauauauuggauauuagccccauuuuggguuuaggauuggucaagaucuuuucccaaucaguugguggccuuuuugccuuauucacaguguccuuugccuuacagaaucuuugcaauuuuaugagguuccauuugucuauucuugaucuuacaucauaagccauuugguguucuuuuuaggaauuuuuccccagugcccauaucuuugaggcucuuucacuaucuccucgauaagauucgugucucugguuuuauauggaguuucuugauccacauagacuugagcuuuguauaaggagaucagaauagaucaauuugcauucuucuccaugcuagcugccaguugugccagcaccauuuguugaaaaugcugucuuuuuuccacuggaugguuuuagcucccuugucaaagaucagugaccauagguguguggguucauuucugggucuucaauucuauuccacuggucuaccugucugucgcuguaccaguaccaugcaguuuuuaucacaauugcuuuguaauacagcuucaggucaggcauggugauuccaccagaguuucuuuuauuguugagaaaaguuuugguauccuagguacuuuauuauuccagaugaauuugcaaauuacccuuucuaacucagugauuaauugaguuggaauuuugauggggauugcauugaaucuguagauugcuuucagcaggauagccauuuugacuauauuaauccugccaauccaugagcaugggagaucuuuccaucuucucagaucuucuucaauuucuuucuucagagacuugaaguucuuauuauacagaucuuucucuuccuuagugagaaucacaccaagguauuuuauauuauuugugucuauuuugaaggguguuguuucccuaauuucuuucucauccuguuuauccuuuguguagagaaagaccacugauuuguuugaguuaauuuuauaucgagcuacuucacugaagcuguuucucagguuuaguucucuggugaaauuuuuagggucacuuauauauaccaucauaucaucugaaaauagugauauuuugacuucuuccuuuccaauuuguaucccuuugaucuccuuuuguugucaaauugcacuggcuaggacuuaaaguacuauauugaauagguagagagaaaaugggcagccuugucuaguccuugauuuuagugggauugcuucaaguuugucuccauuuagcuuaauguuggcuacucauuuucugucuauuguuauuauuauguuuaggcaugggccuugaauuccuaaucuuuccaagucuuuuaucaugaauggguguugaauuuuuucaaaugcuuucucagaaucuaaugagaugaucauauggcuuuugucuuugauuuguuuauauaguggauuuugcuuugauggauuuccauauauugaaacaugccugcauccguggaaugaagccuacuugaucaugaugaaugauuguuuugauguguucuuggauuugauuugcgcgaauuuuguugaguauuuuugcaucaauauucauaagggaaaguugucugaaguucucuuucuuuguugggucuucaugugguuuagguaucaaaguaauuguggcuucauagaauaaauuggguagaguaccuucuguuucuaauuugugaaaucguucaaggaguauuggaguuaaguccucuuugaaagucuuauagaacacugcacuaaauacaccuggcccugggcuuuuuuuaguugggagacuauuaaugacugcuucuauuucuuuagaggauaugagacuguuuagaucauuaaucuuauccugauguaacugcuaucugucuagaaaauuguccauaucauccagguuuucuaguuuuguagaguauagccuuuuguagaaggaucugaugauuuuuuggauuuccucagguucuguuguuauaucucccuuuucauuucugguuuuguuaauuaggaugcugucccugugcccucuaguuagucuggcuaaugguuuaucuaucugguuuuguugauuuuuauuucuuccuugaccaaguugucauugaguagaguguuguuauugaaaauuagccugaguuggugcugaucugauagggugcauaggauuauuuaaauaauuuuguauuggucgaagccuguuuugugaccaauuauauggucaguuuuggggaagguaccaugaggugcugagaagaagguauaaaauguucuauagauaacuguuaaauccauuuguuucauaacuucuguuaguuuaguauuugucuuaaaaauuguucugcaguccaaauauauaaaggcuuggaaaacaacauuuagaagacaaaagccgauguaaaaagacagcuacaaugguacagguuugauauggcucagauuuuacaguuuucuuacugcaucaucuacgucagagaucugguccuucagcugacuccauuguuccauauuuaaagaaauaccuuuucucccugguuucauuucaucuucugaguccauccaauacucucuaauaucaauuugaauuuuuccucuaaaguccugaacacuuccauaucucauccuuccaaucuggagcaugcuaucaucucagcugcugcugcucagccuggagaaugcuggagcucuagaaggcucaucaggcuuuugcuucuucacagguuucucuggaaccacuugcuuuuuccucuuuaacuuuuuuuucaccuucgcugucagaaucacugccugaggagcuugaagaaacaaguuccuuugauuuaggcauugcucuccuccagcugacuaacaguuucuagcuuccucacuugcuccugacuguguuuucuuuguuuacauuucaaauauaauccccuuuccuaguuuccccuccgaaaaccccuuaucccaucuccccuccuccugcucaccaacccacccacuccuccuuccuuguccugacauuccccuacacugggauaucuaucaagccuuaguaggaccaagggccucuccuucuauugauguccagcaaggccauucugugcuacauaugcugcuggagccuugauugacaccauguauacucuuugguuggugauuuagucccugggagcucuggggauccugguugguucauauuguuguuccuccuauggagcugcaaacuccuucaguuucuuggguccuuucuaaaucucguccauuggggaccccgugcucaguccaaugguuggcugagagcaaccaccucuauauuuaucaggcacuggcaaagccucucaggaaacaacuauaucaggcuccugucagcaagcacuuguuggcauccacaauagugucuggguuuggugacuguauaugggauggauccccagguggggcagucucuggauagccuuuccuucagucucugauccacaguuugucucuauaucuccucccauggguauucuguucccccuuguaagaaggacuggaccaucaacacucuggucuuccuucuucuugagcuuuauguguucugugaauuguaucuuguguauucugagauuuaggccuaauauccacuuaucagugauugcauaccauguguguucuuucgugacuggguuaccucacccaggaugauauccucgacauccauccauuugcuaagaauuucaugaagucauuguuuuuaauagcugaguaguacuccauuguguaaauguaccacauuuucuguauccauucuucuguugaaggacaucuggguucuuuccagcuucuggcuauuauaaauaaggcugcuguaaacauaguggagcauguguccuuauuacaugcuggagcaucuuuugaguauauucccaggagugguagagcuggguccucggguaguacuaugucuaauuuucuaucuuuuuuuccaguggaugauuuuagcuccuuugucaaagaucaaguguguggguucauuucugggucuucaguucuauuccauugauccacaugucugucucuguuucaauaucauguaguuuuuuuuuuuuuugguucuuuuuuuuuuuuuuuaucacuauugcucuguaguagagcuucaggucagggguggugauucccucagccauucuuuuauuguugagaauuauuuugacuauucuggguuuuucaccuuugcuauaaauuugagaauugcucuguccacgucuuugaagaauugucuugggauuuugauggguauugcauugaaucuguagguagccuuugguaggauggccauuuuuacugcauuacuucugccaauccaugagcaugggagaucucuccauuuucugagagcuuccucgauuucuuucuugggagacuuuaaguugucauacaagucuuucacuuguuugguuagaguuaccucaagauauuuuauauuauuuguggcuauugugaagggaguuguuucccuaauuucuuucucagccuauuuuucauuuguauaaagagaagcuacugauuuauuugaguuaauuuuauauccggucacuuugcugaaguuguuuaccaucuggagaaguucucugguagaguuuuggggucgauuauuuauguauaucauaucauaucauaucauauaucauaucaucuacaaguagugauaccuuuaucucuucuuugccaauuuggauccccuugaucucuuuuuguugucuuauuguucuagcuagcacuuugaauacuauauugaauagauauugggagaguggacauccuugucuuauacccgauuuuagugggauugcuucaaguaucucucaauuuaauuuaauauuggcuguugauuuccuguauauugcuuuuauuuauuuauuuauuuauuuauuuuuagguaugggccuugaauuccugaucuuuccaaaacuuuuuuguuguugaugaucuuuguagaacaugauuuuaauauuucagcuguugauauccaacaaacagaauaaguauuuuaagauauauuuugcuguuauggcucauuuuucauuucugauuuuauuaauuuugauacugucccugugcccucugguuacucugacuaaggguuuaucuaucuuguugauuuucucaaagaaccagcuccuggauuugguaauacuuuguauauaguuacuuuuguuucuauuugguuugauucuuuccugcagucuacaccucuuagguguauuugcuucuuucagguguauuuguagagcuuucaggugugcugccaagcuguuagcguaagcucucuucaguuucuuuuuggaggcacuuagagcuaugaguuuuccucuuaggacugcuuucauugugucccauuaguuuugguaugauuugucuucauuuucauuaaauucuaaagagccuuuaauucuguucuuuauuucuuccuugcccaaguuaucauugaguagaguauuguucaccuuccauguguauguguguuuuccuuguuuuuuguugguauuuaagaccagccuuaggccaugcugaucugauagugugcaugcgauuauuucaaucuucuugcaucuguugaggccuguuugugacccauuauauggucaauuuuggagaagguaccaugggguacugagaagaagguauauucuuuugcuucaggaugaaauguuauauagauaucuguuaaauccauuugguccauaacuucuguuaauuucacugugucuguuuaguuucuguuuccaggaucuguccauugcaaagaguuggguguugaaaucucccacuauuauugugugggguaugaugugugcuuugagcuuaagaaaaauuucuuuuuuaaaugugggugcucuugaauuuggggcauagauguucagaauugagaauuucucuugauggauuuuucccuugaucaguaugaacuguccuuccucaucaugcuugauaacuuuauguagaaagucuauuuuauuggauauuaggauggcaacuccagcuuguuuacugagaccauuuguuuggaagaccuuuuuccauccuuuuacucugagauugugucugucuuugcuauugaauuguguuuccuguaggcagcauaaugcuggauuuuguuugcauauccagucuguuaccuuaugucuuuuuauaggugaguugagucuauuaauauugagagauauuaaagacagaugacuguugguuccugauaugcucauuuuuguacauggcuuuauguguuuguggcucucugcuuuuaacuuuguugugagaugcuuaauaucuuguccuuucuuuggugcagguaucuuccuuguguuggacuuuuccuuccaggaucuucuauagggcuggauugguagauagauacuguuugaacuuggauuuagucuggaauauuuugguuucuccaucuauguugauugagaguuuugcuggguauaguagccugggcuagcauuuguguucucguacuaucugcaugaccuaugaccaggcucuucuggcuuucauagucucuguugaggagucugguguaauucugauaggucuaccuuuguauguuauuugguccuuuuuccuugcagcuuuuaauauucuuucuuugcucuguguguuuaguguuuugauaauuaugugaggagaacauuuuuucuggucccauuuauuugguguucuauaggcuucuuguaccuuuauggccaugucuuucuuuggguuaaggaaguuuucuucuaugauuuuguuaaaacauuuucagguccuuugaacugggaaucuuucuucucuauucugaguauucuuagauuuggucuuuucuuuguguccugauuuuccuggaugcuuuggguuaggaguuuuuagaauuuuucuuugacauuugugucaaucucuucuacaguaucuucuauaaccaagauucucucuucugccuuuuauauuuuuuuggugaugauuaaaucuguauuuccugacuucuuuccuagauuuucaauuuacagguuugccuccauuuguguuuucuuuauuguuacuacuuccacuuuuaagucuuggauugcuuuauucaauuccuucaccuguuuaccuguguuuuccuguauuucuuucagugaguuauuaauauccuccuuaaaggacuuuuuucuucaugagauaggauuuaggucaguuuccugauuuucagguguauuuguguauucagggcuuguuguggugggagaacaggguucugaugaugcccauguauguugguuucugcugcuuauggucuugugcuuaaacucucgccaucugguugucccugguguuuauuuaucugggugacucuguuuggagucugucucuuuugucccaggguugcuucaggucuccugguaggccugcauaccuggcuguagcagaccaccugugggaccuuccaacugggggaucuucacaggggcagagaaggugcugaucuguugcccuggcugcaguagaucuugugggaggccuucaauguguugcaucuucacuggagcagucaagcuguuguccugugugaagauguucuccagggggacuuaccgacugugguuucuguuucccuguguacagcagaacuuuagggaggcuuucaguguguuuggucaguugcccucugugcuuuuaagcuguggugucuauugcucugaguauaggauaugcucagcugcucugagugcagcagauccucuaggaugggucaggauauggugucuucaugggagcagaccaccuagaagucuccucagcagaaaggaugggguggaaugcuaggaaaagcauauuaauagcagaaaucuuuccuaauaugaauucccuuacagccuuguuuaagaagggugacccuguugcagucuauauauaauaaucugaagugggccaucucaggaagaucaccugcuaguuauuagcuugucccauuguggcucccaacagggcagucucuggauggccuuuccuucauucucugcuccauuuuucaucccugcauuuccuuuagacaugaagaauucuggguuaaaauguuugagaugggucggugaccccccccccccccaucccucaacuagggaccgugucuaucuacugaaguuggucucuucagguucugucuucuccacuguugaacauuucagauaaugucauccacauuggauucugggauccucccacaucccugguaucugggacuuucuaguuguucugccuauucccccccaccccacacugcugcauauuucuauucauucuccuggcccucuggguuucucuucugucucccuccauaucugaugcuguccuccuuuuccccuccccucucccacccgggucucugccuuccaugauuauauuguuccccuucuaaguggaauugaagcauccacacuugggccuuccuucuuguuacgcuucacaugguuugugaguuguaucauggguauucugaacuuuuugguuaacacuaccuuauuaguacacaucacauguguauuucucuugagucuguguuaucgcacucagaaugauauauucuaguuccauccacuggaauuguuaggaaaggacugaaggagcugaaagggauggcaaccccauaggaaggacagcaauagcaacuaauccggaucccucagagcucuccaggacuaaaguaccaacuaaagaggauaugugggcugggcccuggcgcaccccaccccaccccacucuaccccugcuaccuauguagcagagaacugacuugucuggccucagugggagaauaugcucuugguccuguggaggcuugauuccccagaaaagggggaugcuagaaaggugaagugggagugggugggugagcacccucuuagaggcgaaggggaaggaggauggggggcucauagaagggguaccaagaaggaggacauuugaaauguaaguaaauaaaauaauuaauaaaaaacauguuuuucuuagaaagaaggacugaacccuaauugaaaguccaggcaauuugaguaugaucugaagccuuagaaaagugcagggugauaaauauaacucuguuugcauucuucuacaugcagacauccaguuagaccagcaccauuuguugaagacacuuucuuuuuuccauuguaugguuuuggcuucuuaaucacaaaucaaguauccauaugagauauagguuuauuucuuaaguaccaaaaagaaacaaaugauagucauaaacaaaagccauaggaaacauuauugaauaauggaagaaaauacuuuugcuccaauguugucauaaaagcguaaguuaauaucaugugauuucccccaauacauaugccacucauguuaaggcuuuguguagcguucaacauucagcacuaccuugaaagucaaccucccaccuaguggaaaagaacuucaaaacuaggcccugccuagugggaaggucagauauagaauaugaugcccagggaacuugcaaagugaaucuggaugugaaucaagucccugguaugauucacuguucuccaggcucugagaugucacuauucuuuucuaggccuacauucagaagacaaugcgacauccugaggaagccuuggagagagauugcugcuagcugaaggaggcaaauggaagcccuggccauaaggcuguuauugcgggcuuuaaaagagaaggcaccugauggaggugagugccuuagagcccacuugcuugugcuuuucuuuuucuuuuucuuuucuaugguaccagaauuccaugcugacucuuuuccaagacauuugcuauuaacaccaaauagaaaccaaaagcuaaacuuuuuuuuuuuuuuaaagagagguauuugcuuccucauauuaagcaaaaagacccuagagucuggguagcuauugauggcuuuuuuuuuuuuccaguuggaagggcagggccacaaagcauggcuacagaacgccuuggcuuuucuaaggcaacacugccaucaugcggagauaguuucauaaauuccuugugccuaguuugugucuuguucugccauguuugguugauaguccuaggaggucugcucuuuucugaagggaaacagagaaguggaucuucgggguaggagcugaggagcauccucuaugucuucucuucuuggggcuguuugcucuggaucuauguuacuaaaaaacggcuuccuccgaggguugcuacuuucaauucucgcaaacguacuaaauuucguuugcagcagcccagugaauuggacacagaagacaugagcagaccaaagugcuuaacauggugguaaucaauccaaagcccucucuaauucuuguuccaugagacuggaacggggaaccagagccccagagcguccgugcuaguguuuaauuggauucuucgagacuuguucacaguaggaaguccggaggucccacuacauaacuuccugagccacucugucccggcaagggccuguccacucuggggaccucacuuucuaggucuaaaacgagaaagcacaccagaacaugucucuccuuggacuuuaagagaagccacgaaagcccuaauaagcucagguacuucuugcuaggaaucaugggaaagaagcuuaccgaugccaguuuugaaguucuuuccacaggauggcaguaguguuccagaaacaugagcaucgcaaacacuugucuccagccuuucauaucuggacaaccaacaaaaacacaugcccuaaagaaaaggguaccaggaaguauggcuguugugacuuuaguccaguaacuacgaguucaacaguaguuuacuuuuuuuuauuauuauuacguauuuuccucaaugacauuuccaaugcuaucccaaaagucccccauacccuccccccccccacuucccuacccacccauucucauuuuuuuggcccuggcguuccccuguacuggggcauauaaaguuuguguguccgaugggccucucuuuccagugauggccgaguaggccaucuuuugauacauaugcagcuagagacaagagcuccaggguacugguuaguucauaauguuguuccaccgauaggguugcagaucucuuuagcuccuuggggacuuucucgagcuccuccauugggggcccugugauccauccaauagcugacugugagcauccacuuauguguuugcuaggccccugccuagucucacaagagacagcuauauuuacuuugaauugccacaccuggagagaagugaagccuaaagccagcauuaagucacuucucuucuuuccagaagcgaaugaauuuauagggacuuugcauucaaguaggaucuuucacccguagccuguccauuuauuuucuguaguauucaauuuuguuuaucugaaacguaaauacaggaguacaaagcaauugcuugaagccuggaggguaggauguaauccaaacgucccucccucuuuuuaauucacauuuuaugcuugaaauucuaaaguauacuuauuaggguugucugaggaugcuguaagguguguuugugcacauagcauggcauuuguggcgaggucagaggaaacguuucaggacuuaauucucuuaugcuuguguggguuuagggcucaggcuugcauggucagugcuugaagugcaaugccaucuucccugguccacuguaaaguuuaaccauuacuauccacuauuaggauucgcuauggaauuuucuaauaaaaucugugguuuucaguaccccggagcucuugacucuagcugcauauguaucaaaagauggccuagucagccaucacuggaaagagaggcccauuggacacgcaaacuuuauaugccccaguacaggggaacgccagggccaaaaagggagagugggugguuaggggaauggggguggguggguaugggggacuuuugguauagcauuggaaauguaaaugagcuaaauaccuaauaaaaaaugggaaaaaaaaucugugguuuuuguguugguuugguuuuuucgucauauauauuaaguuuauuuagcuaagucuauuucaggauucugcauuuuguuuauugauacaugcuuuauuuuuuaauuagauauuuucuuuauuuauauuucaaaugcuaucccgaaaguucccuauacccucccucugcccugcucccuuaccuaaccacuccuacaucuuggcccuggcauuccccuguacugaggcauauaaaguuugcaagaccgagggagcucucuuuccaaugguggccaaguaggccaucuucugcuacauaugcagcuagggacacgagcucuggggguacugguuaguucauauugcuguucuaccuuuaggguugcagaccccuuuagcucauugggugcuuucucuagcuccuccauugggggcccuguguuccauccuauagaugacuaugagcauccacuuguguauuugcuaggcacuggcauagccucacacaagacagcuauaucaguguccuuucagcaaaaucuuucuggcauaugcaauagugucugggauugguggcugauuaugggauggaucccugggugggguagucucuggaugguccauccuuucgucucagcuccaaacuuuuucucuguaacuccuuccaugggaauuuuguucccaauucuaaggaggaaugaaguauccacacuuuggucuuccuucuugauuuccuuguguuuuguaaauugaaucuuggguauucuaaguuucagggcuaguauccacuuaucagugagugcauaucaagugacuuguuuugugauuggguuaccucacuaaagaugauauccucgagauacauccauuggccaagaauuucauaaauucauuguuuuuaauagcugaguaguacucgcuguacaaguaccauguaguuuuuaucacaauugcucuguaguacaucuugaggucagggauggugauuccaacagagguucuuuuauuguugagaauaguuuuugcuauccuagguacuuuauuauuccagaugaauuugcaaauuacccuuucuaacucagugaauaauugaguuggaauuuugauggggauugcauugaaucuguagauugcuuucagcaggauagccauuuugacuauauuaauccugccaauccaugagcaugggagaucuuuccaucuucucagaucuucuucaauuucuuucuucagagacuugaaguucuuaucauacagaucuuucacuuccuuaguuagagucacaccaagguauuuuauauuauuugugacuauugagaaggguguuguuucccuaauuucuuucucagccucuuuauccuuugugggucacuuauauauacuaucauaccaucuacaaauagugauauuuugacuucuuccuuuccaauuuguauccccuugauuucuuuuugucguggaauugcuuuggcuaggauuucaaguacuauauugaauaggaagggagaaagugggcagccuuuucuagucccugauuuuagugggauugcuucgaguuucucuccauuuaguuugcuguuggcuacugguuugcuguauauugcuauuauuaugcuuagguaugggccuugaauuccugaucuuuccaagacuuuuaucaugaauggguguugaauuuugucaaaugcuuucucagcaucuaacaagaugaucauguguuuuuuugucuuugaguuuguuuauauacuggauuacaauaauggauuucuguauauuaaaccaucccugcgaugaagccuauuuggucaugauggaugaucguuuugauguguuuuuggauuccauuugcaaggauuuuauugaguauuuuugcaucgauauucauaaaggaaauuugucugauguucucuuucuuuguuggaucuuuguaugguucagauagcagaguaguuguggcuucauagaaugaguuggguagaguaccuucugguucuauuuuguggaauaguuugugaagaacuggaauuggaucuucuuugaaggacugauagaacucugcacuaaacccaucugguccugggcuuuuuuugguugggagacuauuaaugacugcuucuauuucuuuaggggaaaugggacuauuuagauggauaaucugauccugauuuaacuuugguaccugguaucugucuaggaaguugucuauuucauccagguuuuccagcuuguugaguuauagccuuuuguaguacuaucugaugauguuuuggauuuccucagguucuguuguuaugucuccuuuuuuauuucugauuuuguuaauuagauuacugucccugugcccucuaguuagucuggcuaaggguuuaucuaucuuguugauuuucucaaagaaccauguuugguugauucuuugaauaguucuuuuuguuuccacuugguugauuucagcccuacguuuuauuauuuccugacgucuacuccucuugggugaauuugcuuccuuuaguucuagagcuucuaggugugcugucaggcugcuaguguaugcucucucuaguuucuuuuuggaggcacucagagcuauaaguuuugcucuuaggacugccuucauugugucccauaaguuuggguauguuguggcuucauuuucauuaaacucuaaaaagucuuugauuucauucuauauuucucccuucagcaagguaucauugaguagaguuuuguucaguuucuacgugaauguuggcuuucuauuguuuaugcuguuauugaagaucaaccuuauuccguggugaucuuauaggaugcaugggauaauuucacuauuuucguaucuguugaggccuguucuuugaccgauuauauggucaguuuuagaggagguaccauguggugcugagaagaagauauauccuuuuguuuuaggauaaaauguucaguagauaucuauuaaauccauuuguuucauaacuucuguuaguguccaugugucucuguuuaguuucuguuuccaggaucuguccauuggugaaagugggguguugaagucucccacuauuauugugugagguacaaugugugcuucuauugcugugauaaaacaccaugaccaaaaccaaauuggggaggagagguuuuauuuaugcuuccauauuacuguucauacuugaaggaauuccagacaggaacucaaacagggcagaaagcaggagcccaugcauagggcaggaggagugcugcuuacuggacuuucuuacacaacccaggaccaccagccuagggauggccacaccucacaaugggcuggguauucucccaaucaaucacuaaggaaauuuuccucaggcuugccuaccacuggaucuuaaagagacauuuucuucauugaggcuucuuccucucagaugacuccagcuuaugccaaguugacagaaaacuacccaggaccaccccgugcgcuaaucacgaagaaaagcagcaccaaaaccacuuauaacacaacuaauaauggggacuugauauagcucaguagccauuucagguggcucacagagcccaguuaacuccagcucaagggaagccaauaaaguuuucuucugucugcuguggacacauacacacacauaaaugcacacacauaaacugaaaugucuaaaaaagaagaaacugcucacuuuuuggacuguucuuguacaugucuuucucuucugagaaauuuggggagcccaucuugaacaucacaugcugccagggaaacugggagcccuucuaaagguucuuagucucauuaauacaauaauuuacgaaaugacucagaaggaaacucaagaacaauuuuauuaguuuagaaagacauucccaggauagccaagguauaaaucucucaguuacccagagagggugagggaacaaaaaggguugagucaagcagguaggcccuggcagagcugcacggcauggguguggggccaaagucucuaacaccacggacgggcuuucuaggaaggaaaagcacacuaucucaguaaaggguacuuugagagauguuggaggggcucaaauacuaaugugaggccccccucagggggugucuacaggaagagaagauaauuaacuagcacgugguuuuuauguuagaagagugggacugugucuguagguucccaugcaagugcugaagucuugaaugaacuaagguuuggaacacuguaucuacccagcauucuccuuaucaauaauaauaauaagaagaagaagaauggcuuuuuaaaacacaucucacauagacuuaagccuaaugucuggcaaguaagauauauauauauauauauauauauauauauauauauauauauauauauauacacacauauauguauauacauacacaauuuauguuuauagaaucaaagguaaaaauuuauauauuuacaauaguuaaguuacaucuauuuuaaccuuugaguauacuuuuugcuggcuuaaguacaugcagcuggccaaaauuucuuuuuuuucuuucuuuuuuuaaaauuuuucuuuuacugucaaggccaguugaguuuuuguccucaggagccguuggggcuuggaagcacccuuugacucuuuucucuuuaguaucuuuucucccauuuuugaaacauccaaugaucuuaacauaggaugguuucuauauccuuuuaauauuuaugaguucccucuacuuauaaguuccuuuauuuccugccuuacuaucauaguaacuaacaucuuauuaaauaguugaaucugagcuauaugaauagcauaauauaauaaauuaagauuacuguauguauauugcuaacaaugaggccuuguaaacucccaggcaaaucucauaggaaacacaaaggauuuuuuuauauauauuccauaugguccagagaaugauguaacauaccuaugccuuugguuuuguaugaguauagguaccauauagagaaagguaacagacagcaaaacaccaaaaaauauuuagguuaugauuuauaauagcaaaauugcccuuaugaaggagcaaggaaaagaauuuaaugguuggggcuuaccacaugaugaacugaauuaaaggguuacaagagcuuaaaagguuuagaaccuucuagacccugaagaaguagccuaaauuagccucugucaaagauaauacuacuuaggaccacaaccugaaauccucaaguaugaaaaggccacagagcuccuccuggagauaaauucgugcucuuggggagccuuugucuacuacuuaguccccuggaagacauuuguaagcuuuccgauggaauuacuaugcuuugggaguuuggaguuccucauagcuucuucagucauaguaaaucagucauuuccaauggaaauucaguggucauggaugagcuugcuaagagacuacagagggaauaauuguuaugagaccgugcuugggguuggaggaaugaguaagcuuuaugcacugcucuugaggccagagaugguuccuaucauccaagagggguugguagguacuuaagcuugcacagauauauacauaugauuagaaaaugauaaaaacaauaacaaguacaaaauaaguaacuguuuuuuuaaaaaaagauucauuuuauguauaugaguauacuguagcugucuucaggcacacuagaucccauuacagaugguuguaagccaccaugugguugcugggaacugaacucaggaccucuggaagagcagucagugcucuuaacgaaaagccauuucuccaaccccaauaaguaauuuuuaaaaaucuuuuaaaaagcaaacugugaaguucugccccuccacuuauucuucauguaccucaggacaacuauacacuugguucggguccuguuuacuagguuauguaucaagacuauacuaaugaauggcugcaggguacccacagaaauaauguaauguuuagcagagucugcaaccacuugagcacccauagacucaguuuuaggggcuucuagggccuuguguggcagaaauuaucuauauacuggaacuugugccauaagagaacaguauuggcccaucaucaaggaucuugcucugcuccuaccauuccaaccugaggaaacaacaaaacaucugcaauagacccaggcuucagcuuuuuguuauuccgucuuaagagugagcagauacaagaacuaaauuuucgguuucccuuugcuuucaauaguauuuauauuaggaauggcuagaaucucaucccagcaacaaaaauauguuaaagaaaaggaagugagaucuaaggcacccacucucaucuaucaucucaucuuuuugaagaagucagaauccagauagccaaggccucugauuucuguccauccuuauccaggugccuucuaucaagugcuucucuauuuaacaaacuuucuggugauccugguggcaacccuaggggauccagaccuaggaaagaaaaggaaaugcagaaacaucaagauuugagaagcgccaauagugguucucauucacacugacuucuaacauucuccacauucugaccuaggccuuuugugccuagggaucaagcugacuuaacuuuuuaaauaaacuuaauuacauuguauuuuacuucuaacaagcccuacuuucuggacauuucuugacacuuuuaaaaacuagcaaggucuagaauguagaaaauaaaacauucauauguugauauaacgaccacaguucucaacuuaaaggcaauaaggauuguuuauucuggauccauuuugagucaccauguccugggaacacagguuuagauuaccccaaauuccauguuccaacgugcaagcaguuucacaggauuuuuauacuuuuauacaucaaacaaaaucauaaaucagggcaauuuuaaaagacauugguggacacaugggagaggugggugcaacuugauggggaaagcuacucuauucuguagcuccaagaugcuaccuggugacauucuuagcucuugaguagguggaagcuaguggucugcuaaguuaauagcuuuuaaggggauuuuauguauuaucaugaggcauuaguucacauacagagugagugggacaaagaaugaauggcuguccuaaaacuagcccaagauacaggaauuuucuucugaauccacaaaaucccaaucucuccacaggacuaugauuucaucagccucugaagacagagaauccuuccaggauuccuucuuucaucuuccuuuuguucauugccuuuguuuuguuuuucgaaagagaguuucucuguguagcuagcccuggcuauccuggaacucacucuggagauuaggccggcccugaacucagaaauccuccugccucugccucccaagcacugggauuaaaggcaugcgccaccacuuccagguuuuuacucacagucacauacagcugcuucuuaggaauuuuuuuuuguucauacacagaagucucuuuuuauuagauuuauucauuuuuaccuuuguauuuucccuguauguauguauguauguauguauguauguauguauagcacucccaugcuuggugcuuacaaugguuagaagagggcccuggauccuuggaaacuggcaugauagaugguggucaaucaccauaugggcacuggaaauugaacgaggguucucugugagagcagccagugcucuuaacuccuauaucucuucaggacccaauaaaagucgucuuguaguuuauuuauggcaaauuauuaagguuuuuauuuauauuuauucaucuauagauaaaaguacuugaauguauuuuguguauaauacauauaaaauuaauaugaggaaucacauauaaaaauguauagggaggaaucucaaaaucauaacuacucagaaguuaugauuuucuuaguguuuuugagagaagaucucuacauaauuuuuguuguuuaaugcuuaacuuugcauaucuauaauaccagacugagagagaauugccaguuauaggccagccuagguggacuuuauaaguaugacuauucuaaauagaaaaagcaaaccacaucuucaaaauccauuaggaaaaagaaaaccucaacaaaagauguuuaaaccuggcuucucaaauauagucucacccagcagugcucacugagagcuuucgguacauagcuacagcauucucauacacucaagauuuucaugaacaccccuuuaguuauuaaauuauaaaauagauaugcauguugcccauaaaaaacauucuaacagucgucaacauuaacagacauagcuuuacacaaagucuuugucaucaccuuaaacuguggcauauauucauauuaguauauauuuugaauuuauggacuucuguauuuuacuugagaagacauuaagauacgauaaaguaaacuguauggagcuugcuacuaugucuuauaugaaauucaauuuuguuccaauuacacaucuucaaaauguucauauggaaucuaucccccccagcccccccccccacaccuuugcucucguggauggaagcauaauucuuugcccuguguuuugggucccccauuccuucacacaguuggguacacgucaggccuuuuccaaacaccugugccaccuggcacuggcuuguccuggcuggucuuacccugccgcaguucuggauccagcagguauaguacugugggagcagugacgguacaaugaaguucugcuucuagcauggacaagagcaagaaacacacagaaacacgcacacgugcuucguauacugccaugccucuaccccacaagacugcccuuuauaaaacuucguucuuugacacaaagucuucucucuaguccaggcugaccuggugcucacaguaguccuuuccuaccuucugaacacugagauuacaagcaggagccaucuugacugcagagaguuugcaauugucuuuugaguuauuucccauuuuuaaaugcaagcugggaacagcaguuugagaaucccugaucacuugugacccacuucaggccacucgcccuucaagucccaugaggauuuauaccagcuuccugacaucuccuggugccugggaagacaaugagcuucaggucaaaguccagcccuccuccuagcaagggccuaugggaaagaaacugcugguguccuguggaaacuaauuccucuugggggcaguagagcucuagacaagcucuacacugccuucuuacaaccuauuccccugcccauuuggucuggaaaaaaaaaaaaaaagacaagaaaaaugccugccuucucuccucugcagacucaggcaauuaguuuuacuaggaggccauuuuacuuuuauauucgcaauucaaagcaaagaccucaaaccacuauccuucaccaucaggaugccucucuuuugucuagauaaauucccucugaagccugugugcucaggcuugauguucucagugauauuugcccaguaggugaagagaaaaguagaaagcaagcccgugaaucacaaauccaagugcuuuuuacucauuucuuuacguaugaauuuaugcaguguccucugguugacaaccacccuuugugguacugggauuacauguacgccuggguaccucugcuccaucuccagcacccucuuugaaggacauaaacaccaccucuagauuguccuuggaccuuggcaggcacacugccgggauacacaagcaccuacagguauucaauagccuaugguauucaauagccucauugcugcugguccaugucacccucuaguucugcaccgauguccagguaggguucaguucucuccucagguuguagaacaaaaguaaugcccaauccuuuuccagaagccuaauggccagggcccugaugggaaggaaacuggagguaccaagucuguugaaacuauguccucauggggacagcagugcaguagaggagccauuguguaccccuccucucccacccaccucaucugaaagaaaucauuuuccaugacuaaaaaugccagcaacuaagagccauuuaaacucagagccagcuuguaaggcagccauuuuguuucuguauuaccaucucaagacucacuguucacacaaaacuacaaccccugccuccaaagggauuagagauacugaagccaaacaugagugacauucacuuaggacuguauaucuacguuaccccaacuuauaugcuccaagaaggugguaauguaaugaaguguuuaugguaacagagguaaaaaagucacaauccaggccaaaggucuguacuguaaagccgagucuggaggaacaggacaucuuaucuaagcucuucugagacugaccugggcuucaccucaaauucaacacugccugggcaccaaaaagacuaucuggugaaaaaaagaaaggaaggaaaaaucuggacuaaaauaucauuaacaugagucuaaucuuaacaaauucuuauaacuucuucaguguuuuuuaucaucuaggccaaacguggcaucucacugcuacuccuuugaucaagaggcaaaaauaaggggcacaggauagccaagaguucaagccuggaauauuacauugggaccuguuggccaaagaaaaggaagcagcuguauuacagacaaaauguagacuguauauucugauacuauuaaaguggaaaauugggu

SEQ ID NO: 9485 - RNA, 79582 nt, Mus musculus
cgggacagugggcgggacuaagggggccaccugcagacacacccuggcuucgggaccgucuuccuucucuucccccucggggccuagaggaggccacgcgcggggucuccgagcucuaggguccggagcucuaggguccuuuuauguagcaaagucaggccugggaacagaacuucaugugcuuguaaaaagucucaggugcguccucguuguuuuagagacuuggagaggaaugggggcggggggaacaaaauccgaggacagucgagccaagaaaagucggggcuucuaggaugccaaccacgccaaacagaucaaaaccaggacuggaggacugaagaugaagccggcaaaaagucaccagccacggcucuuguaagguaggugguaaaccggagaagacaugguuguuucuagaagauuggaaaacgagcagaauuuuuaaagcaguauucuaaacauuuacuauauuuuaaaaguguuaaagcuacauaugaggaaaacuaaugauuucaugcccaaaguacaagggaauuugccccuuaaaauaaaaaccuauauauuacacaugcaaagugaaguuacgagaauguguggcaagggcgguuuugguuugguuugucuugcuucucagauuaguuuguuuuuacuuuguaauuucucaaaauuggaauacuuugccagaagugggaaaacuuugacaauuucuugggauagaaagggcuucuggaugcagacauaauaaugaugccaagcacuuagaaaucugcagugauugccaggggagcaaauggucugugccgagcacuuucugcgcugccguacccugcgugcaucggguuauauuucagaagacgcaagcuugagugcgugcuuauacgauccuuuccuuguagacauugcuaaagguuuagacuuugaauccuggucaguguuaaagccggcuugacuguacuauucaacgugaacaucucagccaaggcuguguauucauagcuauguuguauuuauauuuuuauacaaccaucacugcaguacaaagggugugacugcaccugcuggccccuuuucuuugaauauccaucugugugacugaauuuuggaaauaucuauuccuuuuuuaaaaacugccuuagagaucaaaacuugagcaaguacagcgacuacuuauagcuuuuuuuucuuccuuuauugaaauaugcuuaaaaaagaaauaugcuuaacacaugaaaaaucggguguauuuggugcauacaacacauuuauuuuuccucaaacgauaagcacaaucaaguaucacaaguuacauguuugaaauuuacugugcugacaauauucaagagaaaugcuaauggcaaacuucauuaaauucuguauguuguacagguuauuuuuuaaagauuuauuugcuuguuuuacguaaguauacuguggcugucuucagacacaccagaagagggcccggauuccauuacagaugguugugagucaccaugugguuguugggaauugaacucgggaccucuggaagagcaguccaugcucuuaaccacugagccaucucucucucuccugcccgucuuacaguuuuuaaagacauuuuucgagauggaaauuuguagcaaauucugcaaaguguacagcuagaauuccuaaggccacacacaccccuuaagacaggguuucucuguguaucccucuagcuguccuggaacuagcucuguagaucaggcuggccucaagcucagagauucccuugccucuaggaucaaaggcgugcacccccaccaccuggcugaguuccuaaguuucuuaagcuuuauuguguggaccuguuucguuauuauguggcaauuuagguaaggaaggacuugauaauaaauuccuuaaaugauaauauuauagauacuuuauauugcuguauagaguuuuaaauauuaagggagaagcuaguguucuuuaaugaacagggucaauauagaaacucuuuggaaauuucuuauuuaucuaaaauccaguccuuugaaauauuucaggauauuuuaaucuacccagaaaucagaaguacagguuuggaauuuaaaaugguguguguguguguguguguaaaucugacuuuauuauugauuuguugcaauuuacuggccauaaguacgaaacuauauguguguacucaaaagaaaauuggaauaaauuugcaaagaauuaucagugcuugauccaagacuuuaugacauugcuuuuguuucugaucaagauagggcggcuuucuaaauccuuugcaagcacuguauuuuagggaagaacacuguaagacuuacuauaauaaaaacauaggaagcacucguuaaugauucaugugugaagaaaaugugguugugcucugucaaaugaaccuaugagacauauucaagucccauuugacuggaauuuuuagucacuccaggagagacuuaauaauacggaguugggauguggccuuuccuggguccuccauuuagagucccagccacguugccuccuacugaacacagaaggccaaauaccucggugagaaaauggaggauucccuaggaaucugauccugagaccuaagucaccugauaaggagccuaaauuugcauuucccugggagcuaaauuccagagucuuuguuuucuucagagggacugcucuccgaagcacacgauuaggguaagaguagggaaaucuuggcugaaugaagggcagguuuguugcgccuugcuagaguacagauggaauucuugaagaccauucauagcuaaauaaacugggugcuacaugccuguaugaugucccccaccagaacaaacgggguggcaccuuucuuucugcaaucucuucucacaaguuuuuuuuuuucuuucaaccaaagaguaggaaguagaaggggcugauuaaucacguuucccagaauaauacuaucacccagagggagguguuuuccaguacccuguggugagagugugucuaacaguuaagaaagguuggcucuuugguuaagugggucuaggcccugaaacagaccaccuucaacuucaaagaaggagcuugagacaaagaugggauccaagggaagaaacuaaagaggaauugacagggugguuuugugacugaggacagcugccugauaggccaguuauugcagguccuguagcucagagucagugaaaucaggcaaaaaccaaagcacucgaggagcuuuguggggaggugcugggcauuuguuuucuggcucugcuucuugaccaaggugcaggagcugaacaaaccugcccuucauucagccaagagucccuacucuuacccuagucauuugcuucugugagccaucuccgccuaagaaaacaaagaggacucuggaauuuagcuccggggaaaugccaauuuaggcaccauaucaggugacuuaggucucaggaucagauucccagggaauccuccauuuucucaccaggguauuuggagucucaaaagacacucagaauugaugcuccauugccaagauggaggagagccuaaagagaagagguaaccuuuuccaggccuaagagauaacagcuacaguggcagugaagguuuuccccacggucuaguggaaggccugcucuagacuaguguagcucucaaccuuccuaaugcugugacccuuuaauauaguucucaugcugugcuggcccccaacauaguaacaucuucauugcuacuucauaacuguaauccuacuacuguuaugagcuguaauguaacuaucugcuuucugguggucuuaggugaccccugugaaaggauuauuugaccccccucccccaaggggucacgacauacuggcugagaaccacugcucuagaaggacaugcucuuaccucaguuuucaugaggugagacuuugccuauuaaaacuggaagucagucuaguaauaaaagugaaacuuaugcuacuugagaccuaacccuugauucauguuaguuagcagguguuauucaacugccugcuucuuagcagcuuucaaauggagauucccuauaggccuucuaggauauccucuuaagagaguuuuaagcacaccaggaacccuaggacucuuggugucagcauaguaagaaauauugauuauuucauagucacuguacaugaacauuucccccuuguaauggugguguugguagcugagcacucacaagagaggaaggaacgcuagucugcuguacugccguaaggaacgcuagucugcuguauuguuguaaggaacgcuagucugcuguauugucguaaugcuugcucacuacuugaacuccuuuacccagguaugcuucaccucuccugcuaagucuucaucccugucuaugaggacaaagaaguuacggguuaaauuggcgaugggccaggcgcuccuugaggaugcucuaaagguaagccauggaaugaauggagacauuugaaacagcuuguuuccaaggucuugaguaguaugugacaguaacccaugccuucuucggcugacuguagguaagcagguggugagaaaugcuacacgagcuagguuaagcugugcacacugaaggcauaguuuccccuugugcuagacuaaggggguuacaugugugaagauagugcauuguucuucaaguuagaauugugggccacagauaagguagcacaaugcccuaaacaucuuaagguacaagaauuuuguagucacauacauuaagagauuacaucuagccagaaggugaguggaaaccuaaagcaguaguaccuuccugggucccaggaauucaaaaaugacagauugcagcuacggcuaacagauagucuucaaacuauuugugucaguucaaaugguaucucagaaugaaagggucagaggaacgaaacaauucagugaaggcauaauggaccccugacuuuuccugugcugaaguuaagcuacagcccccuaaguacugccauaaugcccccaugcuuuaagugagcaagaacaugaaagcaaagucauugcuacaacucaguuugugugcagauuuacagaacuguacaaacucuagccagaaaagcaaugcuguucauugauucgccgcuuccaaugucaaugguuacgacaguuaaccuuucucauagacaucucuuuguccaaagacugccucgugaaauuggucacacagucacgcucuacaggaaagguaggcacaaagaggaagggugaauuccuuuuguaagaguaccagugggguagggaaaggggggcauuuccucuaugcaaaauagucgucuucaacuuuuagaacauugaaagccauuuccaaguccucuuuaggggagagauagcugccuuuguuuuaggaaugaaaaaacagauuuuuguuucuuucagaugaagcuauuuugguuagagaauaggucaggagccaucuaggacagguuagaagguggccuuccuggaggugacccacaguuuugcauggacgaagaugagugagcucuaugaggcaaggucccaaagagacuucaucucaggacugcuucuugcagcugauaugccuuuccuaucauuauuaauauuauauaauacuuggacauuagcuuauccuauugcagauuucuugcagaucaacauaaagaugaacuuucaugaauucaugcuauuuagaugaauuaguaauuuuauagaguaccuaauuugauucaaauaaucuuaggaagaaaguuuuaagagacaguucuaguuguuugcuaggaagauguaauaaaguuaaaaucaagaauagaaugugccuaaucuucagaauaguaaguaaaaguuacauaauaagaaauacagugagcuuucaugauuacuccaaaaagagauacaggcuugacaaguuuguguucaagguaaaacauucaggucccaggaugaagccacagguguguacuaugauaaaacaaggccaugagaaacuugcuuuggacuuacaaugaguauagagaauggaacacugcuuugaacuuaauaucaacagccuuuuguaacuuccauuuguggagucuuuuaccuaugagguaauuuuccaagaacuuuugucuauuaaaaggccagagaaaagaaauaaaggugguguggugugcugugcugugcugugcugugcugugcugugcugugcugugguaugguggcuuggggagcucugccucauccaugcauccauccaugcauccauccaaaaguguaugucuguuuguuuauauguauguauguagguauaugugaguguauguaagcaugcacaaauuccuguggaguuaauugagagaggugcucaggccugaccagaguguggguguauggaugaaaaugugucggugcgacguuuccuguguaaaggauucuuaauucucuuccuuuccguccucucugguucgcaaaaacuuaacuagccaagcuagugaaggacuucugcgugccaggccagaaaaaaagaguauuagcauuaauccuuuagcuaaccuccccuaccccuagguguuaagcaaaaggugauuaaauucaccugaagccauuggcuucuggcccuaguauaacuaagaaucaaagagagugaauauuauuaacacuaagcaaccuuuacagucgugaaaccacauuuuguccccugcugacuuacugcccaaucagccgcagaggacacaagcugggaaagcuccuggcaggaauauaagacuuucucuacuuauuuauuauacacauguuuaaauauguucuucacagaaacauggugagcaaaauagugacuagguccaaaggacuaauugugcaacugccaguuguuuauugccuucaaguuguuaaaaaucuguuauuagcauuauuauucucacuaauuuucuguguaugggcauuuggucggcauacgugucugugugccccacacaugaauggugcccacagaggccagaggagggcaucggauccucuggaacuggaggcaagaguuguugccagccaccgugaggguguuuguugguaaaagaauucaggucuccuggaaggacaagugcucuuaaccacugagcucucuacucagccucagccuugaagcuuugauuuauucuuauguuuagaauuaaaauguugaaaauagaaaacacauauuugaauuuuuuuaaaaaagaaaaaaaaacaagaaaaaacccgguaccauuuaaaaacauaacugaaaaauagccacgucuuuuucucuaaaaaaaaaaaaaucauauuucuaugcaaaauuuaaagaucacuuuuuauuggcauguauuaacugcaaaaaggcaaguuucacaauuguauuucuuuucuuuuguggggaggggaccagcguuugagacucaugguguagcccauauuguccucaagcugauggccauccuuuugucagcacgcaugagccgucacaccugcuaguuagggcauuuucauauagcuguuuaugauauuuugauaacaaacaucuuuucuguuaccuuguaccuucuuacauacugucuuucccucuuccauauccccauauucccaguagcccccaaaagccucccucuuaaaagaccucacucuuaauuuuuaugcacguggaaugcuaucauuaauuucuacguguaauaacaaggguuaugauaugaggccugagaauacaggugauagaaguaacugaagaggcaaggauauauuccuuauauauuauacaagucagagucaauaccaacaaauuccaucagccuguauauaaacaugugcuauauguugucaauguaaaacagcagaaugcaauugaucacagauaagcuagcuauacagcaucuaagaguauuuguuucaguugcuguuuuuguuuguuugcuugcaugcuuguuuguuguuugccaauaugcuugcuagucuuuguauuuguucagcuacaagguaauacuaggagggggcuggagagaugauggcucagcaguuaauaguacuuacuggcuguucuugcagaggaccuggguucgauuccuagcacugacauugugacucacagccuccuguaauuucaguuccagggaaucugaugccuucuucuaaccaucacgaagacaagguacacauguggggaacaugcaagcaaaacauauuauaauuaaaguaaauaaaaauguuuuuaaaagaaaaugcuauguuauuuacaccccuccauacacacacauaccaaaaagucauguuuccugugaauaguuuauuccuguuuguugagugauggacuaauggcaucaaaccauguauaguguaauaagaaaagaaaaaaaugaaaauguaugguauauauuuuuuuuaggauuaugcaagcauaccacaauuucagcauaucaggaguucagggccagcauuaagcuacauagcagguuugaagacagucuaggcugagacccuuucucucacacaaaagaaugcagguuguuuaauaaugagacuaaaucgauuuaauuaaguaacaccaguccuuuuaaagaguuguccaucgcuuuuacaauaugccggagcuagggguacaucucagugguagacgccuuacauauauguacaggagccugugaugaaccuaaacaugcagaccucuuaguagucuuucagggaaauugaguuuggagugaauugaguccacuuguauuagagaaguuguauagucuagagauucucuaagaauugagaauaaacucagaauaaauaugugucgaaaaaaaucacucaagaaaugugaucuguugaccacuugugauuuaauauauuuguuuuuccaguuggugauagaaaaugggagaacugaagacaaccacuuuauaaaacccuugccugcuugaauuuguggugaugguaaguucuguauuuuuugucccugacuagucugcaauuuuaagaaauguuacuuccaaaaccacagaaguuaaagaggaaacauuaaaacuauuacauauucuagggcuaggugugguugcuuugaauuuaauuccagcucucaggagucagaggcagguagauggaucucugaguucaaggcaacccugggcuacauagugagaccuugucuaaagggggaaaaguacauauuccaaagaauaggaccucaugcuuguaggaccucagacuauacuaagaaaauggggaaaaugagagaauguaucaugaccuucuaauuuugauuaaagugccuaccauuuuuuuggcuuuauagaucucaaaaugcaaacaaauugccagcaaccaugcacaugcauacacacacacacacauacacacacacacaugcauguauaaguaagcuagaagaggaucuacuuuuaagaauaaauauaaaauguuuuccauuuagggaaaauaaauuaauauguaaguauucugaguguacaguugguacagaaggcuauagagaaagcuguacucaguaugaaucaaaucaccauuaagguggcaggacuaugugcuuauagacauauguccauaacauguagcaguauacguaaguauaucaaacaaaauaagcaucauuuauagugauucacuuacuaaaaaugagaacuugaaaaaugaauauguaauuuugucagacugcucgggaaugaggagugaaaucuaucuguuguuugguuucuuuauuuuuccuccuuuuuaaggucacaaauuagcuuagcuuugccugguaacacuuguggccuuggcuggccucaagcuugugcuauucgucuugcuucagccucccgagcaguaggaugaccaagcugacucaccacaccuggcucaaagccuggacauuucugugcgaaccauaauguaaaaacaugucauuuuaauacaaauuucucguuauauaugaaaguagacuuuacuguugaaagggccuaaaggaaauacucugaaaguuuaucagugaucugaaagacugugggagaaguuggucuacugcaugguugcuuucggaaucuuugacuuguacugugugguagagccuaguaagaaaauaguuuuuauacuuuucucuacaauacagaagauugccccaaaauacugaacgaugucagauuauagaaagcaguugaaggcuauuuaaugacauggcaaaguguccaugcagaaacacaggucucacuucaaagaagauaagagaugauggucauuucugaccaugacccaggaacacaaauacucuuauguuccauaguugaaguacuuaccugauauuuuauuauuaaacaaagucauaaaucaaaauauuucccaaauguauugggagaggucacagguaugugaguuauaaccaagggaagaauucugauguagguuucaaaauagauauccuuuagauuggugaaagcuaguggucugcuaagaauauauuuuaagguguugauagucacaaagaugucacagacaccagauggcaguggauggcuuugagagggauugaaaauagcacaagguaguucagccuugguuuacaauaccuguauaaccuuaaaguucagucuagugagccuaaaguugacucugugagcgugguggcucaugcauuuaaucccaucacuugggagacagaaacagaaagauuucugugaguuaaaggccagccuggucuacaaauugaguccaggacagccagggcugguuacagugagaaaccuugucucaagaaaacaaaaauaauagccgggcaugguggcgcacgccuuugcuuuuaaucccagcacuugggaggcagaggcagguggauuucugaguucgaggccagccuggucuacaaagugaguuccaggauagccagagcuauacagagaaacccugucucgaaaaaccaaaaaaaaaaaaaaaaaaaaaaaaaagagagaaagaaaaaagaaaaaagaaaaaaaaaagaaaagaaaaagaaaacaaaaauaaauaaaacaaaguucagucucuuggauuuagcacagggucagcuucuguucuuccuucugguagcuuuauuuguucauaaaagccuaagaaaacacuugaguaaucugacuggcauauaacacacacacacauauaggaauccuaccauguauugccuaaaaugaugagagcucuuuuggcaucuuaaggucuuggccaaauggcugccaacaauucagccuauaaagucuuuuucagaauauggugaguuacuugggugaugagaagaugaaccaaaaaaggacuuuaccuagagagguauuccugagcucaaguuaccauaucuucccuuccuccccuccccucuccucccuuccucucccccuccuuccugucccuuuucuuuccuuuccucuucuguuuucuuuucuucccuuuuccucccucccucccucccucccucccucccucccuuuccuccuccuuuuucaguuuuaauuuuucuuaggcuuagauccuuuauuugucuuggagcuaacaacuugaugacuugggagccuacgagggguguguggagcucagugaacgagagagcagagcucggagggcaagggccuuuguuguauuguuuugcuuguuucuuccauagaaaaucuuagguuaaggcuggucuccugcaucagcugagacuguuagggacucucaacagagcucugccuggacugggacucacucuguagaccaggcuggccuggaacucacaaagaccugccuuccucugccuccugcgaucaaaggaguacccaaucuaaaauuuagaauauuuuaauauuuuuuuaaaaaucuuuucaaaucuuuuuuuuuuuuuuuuuuuuuuuuucuuaaugcuugaugggcacaaugauuuucugccucugguuuuagguuuagaaaaacagacaagaaguuuuguuuuuuaaaugauccuguuaguugugcuugcugguaccuuuuucuuucuuuuuugcgagugcgaugggcgggagaagaaaggcgcgcagccugaacugucugucuagauggagcacuacugccaucgugaggauguaaguucaaaucccagcgcgcaguuauuagcgaauucucgagagcacuucugguuuuuccaacuccauuccguaaagaagacuacccggcccuaacaucaaaauggcccaccguuucccuucuaaguuagucuaggcguucugagcugaaguuugaugcugacaggaaaacauuucauccaguguugaaggcaggagcugcccgccacuuuccggaagcugggaggcgggacuuuggcugcggaagccuugagccuagagucagcuagcugccuaucacccgcugacugguucaccuuuuacugaagcaacauuacagcuuaagaaacuaacugaagggcuggugagauggcucaguggguaagagcacccgacugcucuuccgaagguccagaguucaaaucccagcaaccacaugguggcucacaaccaucuguaacaagaucugacgcccucuucuggagugucugaagacagcuauaguguacuuacauauaauaaauaaaaauaaaucuuuaaaaaaaaaaaaaagaaacuaacugaaagucuuacccgccaccaccaacucccuguugaauuaauuguuuugagacaguccuucaccgagucaaggcuuccaaggaaacuauuagguaucuucuuuauauaaugaaugcaaaagaaugcaaaucccuauaagaaaaaaaaaaaucuccggucacacuaaaguacaagagaaaaaaaaaacuuaaauuuuuuuccaaauuaacuucagugaaggaacauuccuuuucuguaguaaacccccaucuaccuuuguagcuccuuguauccccuuuagauuacguaugagagagaauaagcgauacuuuucucucucaauauuauaucuuguuuucaguaguggcagauggagacuaaguuuuagagccaaccagaaacaccaccaaaaaucugaaauagaucuugauuuuuuuccuaaugcagauaugacgagccaguuaaagaccguuuuucacuucaguauguaugacuuguguuaagagaugagucaaugacacaaagucugagcagcugcuguuugugauguauguauguuugagaaauuuacugcucaaaaugagauacugacauggcuccaaagaaagauagcugagcacgucuucuaggaauccaaagcaaauagguaccuuccauuucauuuacucuagcccaguaaauagagaaggacuaucuauagccuccaaugguagcagucuccuuggcuagacuuuaucuuaaaagaaauaagcuuuuguggguuucuccuucucuccccaccccccaguuuauucauuuauucaaucauguauaccccagugcgucugaaccauuaauuaguaauuaauuaauuuaaauaauugagacucaucuuuggacaguagagcuagucagguggcuauaagaagccuguugauacugccccauugggaagacauuucccauacacucauuuuccccacuucuuaacuccuuggcuguaagucccuguuagccuuugcugucuucaggacugagccugccuuauuucucccuuguugagagauuuauuuauuuauuuauuuauuuauuuuugagacaggguuucucuguauagcccuggcuguccuggaacucgcuuuguagaccaggcugggcucgaacucagaaauccuucugccucugccuccugagugcuggaauuaaaggcgugugccaccacacccugcccgaguuuuuuauuucgagucuuccuuguuuuaacaauaucuaauuuuaucaacaauaguaauaagucaagugagguugcuuagaaaugccuaccucugucauugauuuuucugaauuucuuuauuucccuuaggccaggcuucugaagauuugcuuacaaagcagcaaacaauaauuuggguugccaaagauaugaaacaaagagcaguaguauaguacuaagaaaucaagggucgugcugagaaugguggugauuaccauaguccccaguuuggcuucagacagaaauaacaaguuuacuguguggcuuguccaagcagggcaaauauaaagcagcugccauguuuccugaugcucuugcuuuugguuagcauuuucguuuucguuuucguuuuuuuuuuuuuuuuuuauagcuuggaaaggcggggaaggaguagggcauuuguaugcauaccuggaacguuacugccaucuugcggaaguagcuucauuuugaaaaagacaaggcgauuguuucaguggugcuaauagcuguaguaaucuaggcccuugagaagcugaagcuggcauauuuuggugaguucuagacuggucaggucugcauagugagucuucaucugaagaaagaagaauagggucaugaagacgucauucccauguucuagcagcuaauccugcuucuggggagaucucagaggcuugcacucagacuuggcuugcuuuuuuuuuuuuaugcaaauggcucuggacccugauguauucuauucucucuguggaccaagagcugucagaagacaccggcacaggaagugaaggggcaggaucgccacuccucccaguuugcucugaacugugagccccacugaaagggucagcuuucuuuggugcucuggcucagacagcacugucacggugagcacucccuccaccuuuggcuggcuggccaagacauucauucacagaucaaauacauaacucaugcuuguaagcugcccuuuacuguccuguccaccauacucugaaagaaacuaagagaacuccaaagccuaguauuacugcaggaaagcuaauucuugguccacaggacgagacucagaggaaaauaucccacaaaaaccuggauuuaucuccaaaguccugcaagucuuagaagagagguauuacuucaucacuuccugagucugugugcccuggaagcugcaggucccuguccacaaggccucuccagcuccaggaucugcacaacggaaguuuuaggcuucagaucauaacccgggcccuaguaauaaugcuuaugccuaaggaagucuagcuaagagcagaggccagggcuuuccaaccccucgggccucaucuuugcaugcugcuaagaaucaugggaaggaagcugcuaggacguguguugcuuucuucaaaacucuggccgcgugguggcaguagggcuccagauaccacaggccgccaucuuugcauccucuacucccgcccuucuguguuugaaaaaaaaccaaacuguucucugacaggaaaaagugcugaggaagacugcccuccguuuugugaaaaucaguggagcuaguuaacagcagccauuuugcuuuuguuuucuuuugcaaagcagcuuaagggcuaaaaccaccugcuccguucagacuuuugugguuucccuagguaaauugucacuggauuuuuguucacuaaagugugauuucuuucccagagugguucauguccaauacauuagccguugccuuuuuaaugcuguaaaugauguggacaaaggcagaaaagggaagacauuucguaagucagugcacaaguuaaguuccccuuuaguucuuuguguugaacccagauccaugaguauauuaggcaggcucauuugcuauaacuuuagaucauguguguauaugugcauauauguauauauuacguauauauuuguaguuauauaauuuuauguagauaauauauaacacacacuauauauacauauacaacuauaugauuauauaauuacugcauuuauauaaccauaugauuuuacauacauauuugaacugcagauugaacuuggggccucaggccuuggggccuucccugagguggggaagugaguccucuaccacagagccauacaugaagggcauuuuccuuuugaagcaaggccucccaguguugcuucgcuugcccaggaauuuacucuguugauccggcugcucugaaaaguaagauccagagccucuggaguaaguggaauuacaaaucuuucccuuguuggacacccugcuuuccuuuuuucccccucaggcaaggucuuacuuugugagaccaacucccaagucucccgcuccuggccuaucuaggcucugucugagauuagaaguuuguucuaucaugccucgcccaaauagccuaugcacugcuuacucuccuaggcaggaggaagugcuuugugguuucgcauuggccugaggcaucagagaaggaggauugcagcaggcauucccacaccucagucacuuauacugcucuacugagcacuuaacagugucuauccgaagucacucuggguucugucauuuucucccaugagaauucaguacauuccaaugucaugaguuauguuccaucacuuacugugauguuuauugggggaauggugcauaggagacauuguuuccuaaucuuugguagauagaguaccuuguuguugagaaggaguuucucuguggagcccuggcuguccuagaacucacucuguagaccaggcuggucucgaauucagaaauccuccugccucugccucccaagugcugggauuaaaggugugcaaaaccaguaccuggcuggugcuguaucuuguaugaugucucauuacuaaguuaagaaugacacuuucacagcacuccgaaagacagcaugcuggcuguaaaguagugccaacauuuguuucaaagcaagugauaaucuuguugaguauguaugugcacaucauuucacauauacaugcaugcauauauauuuuauacuaaaauuggaugggauagguacauuauaguuuggaucagaucaguuuauauuucacaaagacuugaggaaaaugagauuacaggaauguugucaauuuugcuuaucaccaugauguuauaaaagcaauguuuuaaaaacgcucuaaaauuacuuuagaacuauagaucgagugaggugcuuuugucugagcuaggaucucuaguacuagcuggccugggaauuugcagugaucuuccuucuugggauaauuaucgaugugggcaaccagagcaggccugugagauauuuuguuuauuuaaccaaccuguggcuuaauugcugguauugcauaauuccuuuguaggaaagacugacacaaaguacgcguuaauacugaugugagaacagguguucagauccaguggacucugacuacaugaacggguuaaucacuguuggaacuauauacgauguugagagaauugaaguugacagugagguuuuguguguguguguguguguguguguguguguguguuugugugugugugugaaaggcuaucuaugaagcccuaguugcauugaacuacaugaaccaggcugcucaggacccgaguucaaucagacaucaggagaaagcacuggaggcugggugcugcuggauccagaugggagcagguccagccuccuuugauaugucauugauaaaaaauucaaaauggaagguaaauucuaggaguacagcauugcaagcuucugacacagacaagggaggcuagaacugcacaguuaguggauacugccucaguuugacauuuuuuuucagucugugaaggcggggacagagagcugcagucaagacaccuucccugcucuggggcaacacugccaucaugggaaaauguuuccuguagacuagcacaggcacacaccuccuccuccauccugcuucuccucagccauuuugaagcagggaggaugagggggauucaugaauggcgaagcuugcccguuuuacuauauuucucuccuguaggcagacugucaucacaggacccuucagaguauuaaugcagacccuggugacagagguccaguaccaagugcucagcugugcugaggugcagggacaggaagcagaugggcgguuuccagcccgcucagcuggccaugguaaucuacuagcugguguccuagggcagcaaggcgccuuccucuccagguucugaagagaaagcacugcagucccaguuucuguuggggucugaggagaaggcaaggcagcccagcuaggcacccacagcugcuccugcugucuguaaucggccgccaucuucugccauugcuaggaaucaugggaaaaaggagaguggcucugugaguuuugaaaccguguccucaugguggcaguagagcuccacacaagagcuugugagugccucucccccgcccuuccugucugaaaaaacgccaaggaugcauguccaaacuuuuacccaacuuugaguaauuuaaaaguuauuuuauuuuuuuggucauguguuccaugugaagccaaucugagacguacuuauacccuaggcggugggacuuuuccuucaguuauguaggguuuuucccuuuucucgcucuauagcuauggauuuuuacccuaauccgauauuuaaugguguuaaaauuuugucugauuaacuuuuguaaguuuuaaaugauaaagauaugaugggagauuuagaagcaaaggacuaugcugagccgugguccuagugaacuacaagaggcaggcuggccugggccuuuccaggaggcuucugguccauguuaccaugcucagcggacacgaguagguuuaaccuugucuuaaguaacaucagcaaacaaacacugggcaguugauaauuauaucccagcggcgauguccaugcugcccaguuuucuccucugucugccuucauccaccaugucuacccuuugaggacaagucacucgaagggaaguauaacaggucugaauggagaggggacaguggagaauuacuggugaaaaacaguaacaaaguccuagacauccucgauccugggccuuugucucuagauauugguuaugguauuuauuuuuuuaagauugagggugggagagagguaguccaggauggccuuugugaccauaugugguguccuucugccauccugcaggcagagcuacagugcugagccauuaaaaucucauucccaugaguccuagcaguggggaaacaaugccagguuagauaguuuggguuccacacugggacccggugccuuuccucuagagcagaagugugggcaccaguaauggcuucgagcugaaaagaaagacaaaggcgaacagcagagcuguagggacaagcugacacaggaaguuguuggccaggccuuugguucuuccuaucuggggcaugacaagaagacaccacagggaaaaaaugcaggcucuuuguggagaauucggucuccugcuccuuguagcauguguaggcaggauuuuaagccaugccuucuuucuaagacacagagacucccuaauuaguccacgcuguucaagcacacauuauguagcucaggcuccucucagagguguaugucuuaguggccaagggaaaguagaagacugaaaguauaaagaaaagaacguguauauaguuaagccaugggaaacuguaauuggccuauaauguaggaauuucuuaugucgugcuccagugugaacuauugaaaaccccauugaaaaucagugacagaucuuuuggaaaucagucauuggagagaccuauguuucuucaaguaggcauguucauagcauucaguguugacagguaucagcauccucuuuacagagccacuaagugagccugccacaggacacacaaggccuuuugucuggggcucuuguguggaucucacacagagcaugauacccagggaaguguaagugugaucuggguaacaaggacaugaccugacgccuagguuugcuucuguugaugcacugaggugacaguguguucuuuuucucccuagaaccggccccugggauuugcugcucagaaccugaguucacugagacaucaggagcaagcacuggaggccgggugcugcuggauccugaugggagccaugcaggacuugaccauggccugcacacacuucuucccaggagaaggggaaugaggaaggugggggccucaaggcuuucuuuccaucuauuuguguugcuauguucuuauauuccuuuuuuucuguuuaauuauuuauuuaguacaaaaucagguccagccuccuuagguauggcauugauauaaaauguaaaauggaagcuaaauucuaggaguacagcacugcaugcuucugacacagacaagggaggcuagagcagcacaguuagaggacacugccucuguauugacauuuuuuucagucagugaaggcggggacagagggcugcagucaggacaucuucucugcugugggacaauacugccaccaugcgggaaauguuucuuguagaccagcgcaggaacacauaccuccuccauccuaguucuccucagccauuuugaagcagggaaggucagggggauucauaaauggugaaauuuguccuucuuacuguauuucacuccuucuguaggcagacuagaaucacagaaccuuucagaguauuaacgcagaccgcagugacuaagguccauuaucaagugcgcagcugugcuucgguacagggacaggaggcagaagggcagguuucaccauugcucagcuggccaugguaaucuacuagcugguguccuagggcagcaaggcgccucccucuccaggaucugaagagaaagcccugcagucccaguuucuguuggggucugaggagaaggcaaggaagcccagcuaggcacccacagcugcuccugcugucuguaaucggccgccaucuucugccauugcuaggaaucaugggaaggaggagaauggcacugagaguuuugaaaccguguccucaugguggcaguagagcucuacacaagagcuugugagugccucucccccgcccuuucuuucugaaaaaacgccaaagaugguuguccaaacuuuuacccaacuuugaguacuuuaaaaguuguuuuauuuuuuuggucauguguuccaugugaagccaaucugacacauacuucuacccgagguggugggacucuuuuccuuuaguuaugaagguuacuuccuuuuucugguuuuauaagugaauuuuuacccuuuccagaucguaaauggucuucaaguuugguaugauuaauuuuguguagguuuuacaagauaauuuuaugcuaggagauucagaagcaaaggacaaugcugagcccuggcucuaguuaaguacaugaggcaggcuggccugggccuuuccaggaggcuucugguccauguuaucaugcccagcugacaugaguagguuuaaccuugucuuaaguaacaucagcaaacaaacaccuggcauauauuaucaaauuauaucccaaaggcgauguccaugcuucccaguugucuccucuaucugccuacauccaccauguuuacccuuugaaggacaagucacucaaaagaaaguauacaaggucugcauggaaagguugcaguagagaauuacuccugaaaaacaguaacaaacuccuagacauccuccauccugggccuuucucucuagauauugguuaugauaauuuuuuuuuaggcucgagggugagagaggaguauccaggauggccuuuguggacacaugugguguccuucugccauucuucaggcaaagcuacagugcagagccauuacagcuucauucccaugaauccuagcaguggggaaacaaugccagguaggauacuuuggguuccacauuuggacccagugccuuuccucuagagcaggaggagugugggcaccaguaauaucuuggagcugaaaaggaaagauaagggccaacagcagagcuguagggacaagcugacacaggaaguugugggccaggccuuugggucuuccuaucuggggcaugacaagaagaaaccccagggaagaaaauguaggcuguugcuggagacuucugucuuuuccucguuguuccauguuacacaugcuacacauuuuaagcuaugucuucuugcuaagaccagagacucccaauuuacucccaaguugcccuggcauacauuaugcaguccaagcuccucucugagaugcauaccuuaguugcuaagggaaaguacaagacugaaaguauaauaaaguauaaagacaauaacaggugcauguagugaagccacgggaaccggaaaucaggcuguaauguaggaaaucauugugucccugcuccugugugaacuaaugaaaaucccauugagcaucaguggcagauccauuuggaaaucauagccauuggagagaccuguguuucuccaaguaggcauguucauagcauucaguguugacagcuaucugcaugcucuuuacagagccacuaaagugagccuucuagaggccacacaagaccuuuggucuggggcucuuguguggaucucacacagagcaugauacccagggaaguguaagugugaucuggguaacaaggacaugaccugacuccuagguuuguuucuguugaggcacugaggugacaguguguucuuuuucucccuaggacuggccccugggauuugcugcucaguucacugagacaucaggagcaagcacuggaggccggugcugcuggacccagaugggagccaugcaggacuugaccauggccugcauacacuucuucccaggagaaggggaaugaggaaggugggggccucaaagccuccuuuccuuucuguuuggcuuccuaugucuuuauucuauuuuuuguaucuguuuaauuauuuacuuaguacaaaauucagguccagccuccuuagguuuggcauugauaaaaaaugcaaaauggaagguaaauucuaggaguacagcauugcaagcuucugacacagacaaggaaggcuagaacugcacaguuagaggacacugccucuguauugacauuuuuuucagucagugaaggcggggguagagagcugcagucaggacaucuucucugcucugggacaauacugccaucaugcggaaaauguuuccuguagaccaacacaggcacacacaccuccuccuccauccuguuucuccucagccauuuugaagcagggaggaucaggaggauucaaggauggggaagcuuuccuguucuacuauauauuuucuccuucuguaggcagacuggcaucacaggacauuuuagagcauuacuguacacccuggugacugagguccauuaucaagugugcagcggugcugagguccagggacaggaagcagaagggcggguuccagcccgcucagcuggccaugguaagauacuagcugguguccuagggcagcaaggcgccucccuccccagguucugaugagaaagcacuacaguccuaguuucucuugggccugagaauucaaggcagcccaacuagggacccacagcugcuccugcuggcuguaaucagccgccaucuucuuccauuguuagcaaucaugggaaggaggacaguggaguugugaguuuugaaaccgcauccucauggaggcaguagagcuccauacaagacuuugugagugcuuuucccccccgcccuuugugucugaaaaaaagucuaagauggcuguccuaccuuuuaugcagcuuugaguggcuuuaagaguauuuuaauuuuuugucuucuguuccacaugaggccaaucucaggccuaauucuucccuaggucauuguacuccaugccuucuguuaugcaggauauuuccuauuucuuacuuuauaaccauuuauuuuuccacgguauaucaaaguuugauauacuuauuuuuuguagguuuuacgcaaccuuaguggaaggucuccagugugaaauacuagccaggucuuucgguugucaucuuauggucucucaggucacacaaaaucagauauugguugguuacucucacaagcuuugugccacugguguuucugcagauuguaagguuugcuucuuucuccuuccaugaguccuaguccuuauagaguaggugcuaguaaccuucucugugcuccaugcgucuucagcaguuuggccuugcugucaguuuaugaagggccacaaauagccuucauaauagccuggauuggcccaaucuccauuugaaguaauucacccccaguacugaaggcuucauuuagugacaagaggagucuaguuggagauguuucuacccuuuugauuccuccccauauuaccucccuccugucccuuuccccucccucuccuuacuugauccuccauuccauucccccacucuguguuccauaacuaucaguucuuauguuccccuuggaaggauuaucaaaccgucccccauagguccuuuauacauaaccucuuguuauaugaacuguacuuugcuucucugugauuuaaccgcuaacauucacaugugagugagcacauaaaauguuucccuuuugaccgggcagugguggcacaugcacucaggagacagaggcaggcggauuucugaguucgaggccagccuggucuacagagugaguuccaggacagccagggcuacgcagaaacccuguguagcaaaacuaaaaaaaaaaaaauucccacuuuuggggucugaguuaccucaggaugauuuuguuucucuuucuacccuuuuacucaugaauuucaugauuuuuacuuugcaaagugguugacuaauauuccauuguguaaauguaccacauuuucuucauucauucaugugcagacaucaagauuuccaguuucuggcuguuccaaauagagcagcaaugaacaugguugaguaucuuuguaguaggaugaaacagucuuuaguauauauccaagacuggcuaggugaaucuugagguauugccaucuuucugaggagccaucacacugguuugaauaguggcuguaaagcuugcacgcccagcaauggaggaguguccccuuaccaugcauccuaccaccaugagcuauccuuuguuuuguugaucucagccuuccugauugguguaaaaugaaaucucaaaguaguuuugauuugcauuucccugaaagcuaaggauguugaacauuuuaaaguauuucuucaccaucugagauucuucuuuugagaauucuccaucuaaaauuguagcccguuuuuaauuggauuauuaauguuuuuuuuuuuuagaaaacuuuuauucuucuuuaauguauuacuucuguaccauuuucaaccuccugucacuuaaaccguauccccauguccugucucugccagaucaacuacugcucuauacccgucaaaauaagagaaggacaaaaaggaggagaaaagaaaagggaagagggagggagggagggaaagagggagagagagugcaagagagagagagagcagcagcaaggacuccucccacaggguaugaaaaggguuccaagcacagggaaagauucagagacacaugaccucccguucccacaauuaggagucccauaagaacacccagcugcacaaccacaagguaccuagcucagacccauacaggguccauguuuguuguuucagucucugugaggccugaugagcccuauuuaguagauuuuguacccuguguuuucaagguucccaaacaaucugacuccuacaauccucccuuuaauggguuuccuggcucuacuuaguuuuuggcugugggucucugcaucugcucacaucaguugcuggauaacaccacucugaugacucuuggguggcguggaucugugaguauagcagaauaucauuaggaaucacuuccuugacuuuuuuggauacuuuuugccaaucaugauugguucuauccugggucucaggcuguccuuccucugauccuggccauccaggcagugucagccaugggaccccucuccuggcagugugggccaaaaguuagaccagucauggguuggcuacuuuuacaaguucuuggccaccauuguucuagcaagucuugcagauaggacaugauaagucaaauguuuuguggcuggguaggugucccaguccaaaggcuaggaggcuugccugguuauaaaugaugguugguuuaggcucuguauccuccauuaccaggagauuuuacuaggguuacucucauagauuccaaggaguuuguaauguauuagauuucuacaaguaucacccccaaaaggacccccaauuccaguugucucucuuaccccccccacauucuaguuccuucaaaauaaagguaugagaaauuauacaugauagauuauaauauaaacacaaauuuagugaauguucacuuucguuuacaggucaaacauacuccaugaucuaugugauuaggaguuauagugauuuccauagcuuugucaccccaaaugcuauggagcauuaaauuuugagaccuaccuagaucaucauuacaggcagguagucagauuggcuggacgcccacccaaggccaguuguguaagaaaggaugggguauggugaccagggaaucugugaagggaaucaggcagagacccagguuuccugguuccuagguuugaucuucuccagacccugacuuggcaacauuuucuuuccuaccuagaacuggacgaugaauuuuaaccuccacaccacaagcacugggguagaagacugcugcugggugaagaagagacuagacuugaucauugagcagccacucacugauaucuucagugcugcaugaggaaggugggugccucaaagcuccuccauccuucucuuuccuuccugcuuagaucauaaauuccaggcaauuuccuucuuacagcagaguuuauucuucuggauuuggugguggauucuggugaagauacagauggaugcucuggcugagucgcuaccuugaaaugaaaaugggagguaaacucucccauagaugaaucuuccucauuuugaagguaaaggguaaggaaagcugccauaguuguuggacucuguccauuauuggaguuuuuuucagacugugaaggcggggacagagagcugcacucgggacaccuucccugcucuggggcaacacugucaucaugcggaaaauguuuccuguagagcagagcaggcacacacaccuccgccauccugcuucuccucagccauuuugaagcagggaggaucaggaggauucauggauggugaaaugugcccguuuuacugucuauuuucuccuuaaguacccagacuagaaucaccugacccuucagaguauuaacucagacccuggugacugagguccaguaccaaguacacagcugugcugagguccagggacaggaagcagaugggcggguuccaacccgcucagcuggcaaugauaaucuaguagcuggugucuuagagcaacaaggugccuccaucuccagguucugaagagaaaacacugcagucccaguuuauguuggggccguagaagaagucaaggaagcccaacuaggcacccacagcugcuucugcugucuguaaucggucgccaucuucugccauuacuaggaaucaugggaaggaggacaguggcacugugaguuuugaaaccacguccucguggugguaguagagcgccacacaagagcuugugagugccucucccccgcccuuccugucugaaaaaacacaaaagauggauguccuaagguuuacccagcuuugaguaguuuaaaagguauuuuuuucuuccauguguucccugugaaggcaaucuuaggcccuagguggugggacuuuuuuccuucuguuuuguagguuauuuccuuuuucugucuuuagaacuguagauuuuuacccuuugcagauauuuaguauuuuuaaauauuggcaugauuagguuuuuguagguuuuacaugaugaagauagucuaggagauuuagaagcaaagaacuaagcugagcuaugaaguacaugagacaggcuggucugggccucuccaggaggcuucugucuuuugcucugggaguuccaaaaauaucucagaccaugcuaccaugcccagcugaaggcaguagguuuaaccuugucuuaaauaucaucagcaaacaaacacuuggcaguugauaauuauaucccaaagaugauguccaugcuucccaguuuucuccucuguuagacuucauccaccauguuuacccuuugaaggacaagucacucgaagggaaguauaacaggccugaauggagaggggacaguggagaauuacuucugaaaaacaguaacauaggccuagacauccaggauccugggccuuugucucuagauauugguuaugguauuuauuuucaggcuugaaggugagagaaggguaaucaaggauggccuuuguggccauaugugguguccuucugccaucauguaugcagagcuacagugcagagccauuacagcuucauucccaugaauccuaguaguggggacacaaugccagguaggauacuuuggguuccacacugggacccagugccuuuccucuagagcaggagaagugugggccccaguaaugucuugcagcugaaaaggaagacuaaaguccaacagcagagcuguagggacaagcugacacaggaaguugugggccaggccuuugguucuuccuaucugggguaugauaagacgacaccacagggaaaaaaaugcaggcucuuuguagagaauucggucuccugcuccuuguagcauguguaggcaggauuuuaagccaugccuucuuucuaagacacagagacucccuaauuaguccaagcuguucaagcacacauaauguagcccaggcuccucucagagguguaugucuuaguggccaagggaaaguagaagacugaaaguauaaagaaaagaacguguauauaguuaagccaugggaaacuguaauuggccuauaauguaggaauuucuuaugucgugcuccagugugaacuauugaaaaccccauugagaaucagugacagaucuuuuggaaaucagucauuggagagaccuauguuucuucaaguaggcauguucauagcauucaguguugacagguaucagcaugcucuuuacagagccacuaagugagccugccacaggacacacagugucuuaugucuggggcucuuguguggaucucacacagagcaugauacccagggaaguguaagugugaucugaguaacaaguacaugaccugaagccuagguuugcuucucuugauacacugaggugacaguguguucuuuaucucccuagaaccggccccugagauuugcugcucagaaccugaguucacugagacauagggagcaagcacuggagauccggugcugcuggacccaggugggcgccaugcaggacuugaccauggccugcacacacuucuucccaggagaaggggagugaggaaggugggggccucaaggcuuucuuuccaucuauuuguguugcuauguucuuauauuccauuuuuucuguuuaauuauuuauuuaguauaaaaucagguccagccuccuuagguauagcacugauauaaaguauaaaauggaagcuaaauucuaggaguacagcacugcaugcuucugacacagacaaggaaggcuagagcagcacaguuagaggacacugccuccguauugacauuuuuuucagucagugaaggcagggaaagagagcugcagucaggucaucuucucugcugugggacaauacugccaccaugcgggaaauguuucuuguagaccagugcaggcacacauaccuccuccauccuacugcuccucagccauuuugaagcagggaaggucagggggauucauaaauggugaaauuuauccuucuuacuauauuucacuccuucuguaggcagacuacaaucacagaaccuuucagaguauuaacacagaccgcggugacugaggucaauuaucaagugcacagcugugcuucgguacagggacaggaggcagaagggcagguuucaccauugcucagcuggccaugguaaucuacuagcugguguccuagggcagcaaggcgccucccucuccagguucugaagagaaagcacugcagucccaguguuuguuggggucugaggagaaggcaaggcagcccagcuaggcacccacagcugcuccugcugucuguaaucugccaccaucuucugccauugcuaggaaucaugggaaggaggagaauggcacugugaguuuugaaaccguguccucaugguggcaguagagcuccacacaagagcuugugagugccucucccccgcccuuccugucugaaaaaacgccaaagaugguuguccaaacuuuuacccaacuuugaguacuuuaaaaguuguuuuauuuuuuuggucauguguuccaugugaagccaaucugagacauacuuauacccuagguggugggacucuuuuccuuuaguuauguaggguuugucccuuuucucacuuuauagcuauggauuuuuacccuaauccgauauuuaaugguguuaaaauuuugucugauugacuuuuuguaaguuuuaaaugaugaagauaugaugggagauuuagaagcaaaggacuaugcugagccgugguccuagugaacuacaugaggcaggcuggccuggcccuuuccaggaggcuucugguccauguuaccaugcucagcggacacgaguagguuuaaccuugucuuaaguaacaucagcaaacaaacacuggacaguugauaauuauaucccaacggcgauguccaugcugcccaguuuucuccucugucugccuucauccaccaugucuacccuuugaggacaagucacuccaagggaaguauaccaggucugaauggagaggggacaguguagaauuacugcugaaaaacaguaacaaaguccuagacaucuucgauccugggccuuugucucuagauauugguuaugguauuuauuuuuuuaagauugagggugggagagggguagugcaggauggccuuugugaccauaugugguguccuucugccauccugcaggcagagcuacagugcugagccauuaaaaucucauucccaugaguccuagcaguggggaaacaaugccagguuagauaguuuggguuccauacugggacccggugccuuuccucuagagcagaagugugggcaccaguaauggcuucgagcugaaaagaaagacaaaggcaaacagcagagcuguagggacaagcugacacaggaaguuguuggccaggccuuugguucuuccuaucuggggcaugacaagaagacaccacagggaaaaaaugcaggcucuuugaggagaauucggucuccugcuccuuguagcauguguaggcaggauuuuaagccaugccuucuuucuaagacacagagacucccuaauuaguccaagcuguucaagcacacauuauguagcccaggcuccucucagagguguaugucuuaguggccaagggaaaguagaagacugaaaguauaaagaaaagaacguguauauaguuaagccaugggaaacuguaauuggccuauaauguaggaauaucuuaugucgugcuccagugugaacuauugaaaaccccauugagaaucaguaacagaucuuuuggaaaucagucauuggagagaccuauguuucuucaaguaggcauguucauagcauucaguguugacagguaucagcaugcucuuuacagagcaacuaagugagccugccacaggacacacagugucuuaugucuggggcucuuguguggaucucacacagagcaugauacccagggaaguauaagugugaucuggguaacaagggcaugaccugacaccuagguuugcuucuguugaggcacugagguggcaguguguucuuuaucucccuagaaccggccccugggauuugcugcucagaaccugaguucacugagacaucaggagcaagcacuggaggucgggugcugcuggacccaggugggcgccaugcaggacuugaccauggccugcacacacuucuucccaggagaaugggagugaggaaggugggggccucaaggcuuccuuuccaucuauuuguguugcuauguucuuauauuccuuuuuuucuguuuaaaaaauuuaguacaaaaucagguccagccuucuuagguuuggcauugauauaaaaugcaaaacagaagcuaaauucuaggaguacagcacugcaugcuucugacacagacaaggaaggcuagaacugcacaguuagaggacacugccucuguauugacauuuuuuuuagucagugaaggcggggaaagagagcugcagucaggacaucuucucugcugugggacaauacugccaccaugcgggaaaugguucuuguagaccagugcaggcacacauaccuccuccauccuacugcuccucagccauuuugaagcagggaagaucagggggauucaucaauggugaaauuuguccuucuuacuguauuucacuccuucuguaggcagacuagcaucacagaaccuuucagaguauuaacgcugaccauggugacugagguccauuaucaagugcgcagcugugcugagguacagggacaggaggcagaagggcggguuucaccauugcucagcuggccaugguaaucuacuagcugguguccuagggcagcgaggcgccucucucuccaggaucugaagagaaagcacugcagucccaguuucuguuggggucugaggagaaggcaaggcagcccagcuagguacccacagcugcucuugcugucuguaaucggccgccaucuucugccauugcuaggaaucaugggaaggaggagaauggcacugugaguuuugaaaccguguccucaugguggcaguagagcuccacacaagagcuugugaguuccucuuccccgcccuuucuuucugaaaaaacgccaaagaugguuguccaaacuuuuacccaacuuugaguacuuuaaaaguuguuuuauuuuuuuggucauguguuccaugugaagccaaucugacacauacuucuacccgagguggugggacucuuuuccuuuaguuauguaggguuuuucccuuuucucgcucuauagcuauggauauuuacccuaauccgauauuuaaugguguuaaaauuuugucugauuaacuuuuguaaguuuuaaaugauaaagauaugaugggagauuuagaagcaaaggacuaugcugagccgugguccuagugaacuacaagaggcaggcuggccuggcccuuuccaggaggcuucugguccauguuaccaugcucagcggacacgaguagguuuaaccuugucuuaaguaacaucagcaaacaaacacugggcaguugauaauuauaucccaacggcgauguccaugcugcccaguuuucuccucugucugccuucauccaccaugucuacccuuugaggacaagucaguccaagggaaguauaacaggccugaaugaagaggggacaguggagaauuacuucugaaaaacaguaacaaaguccuagacauccaggauccugggccuuugucucuggauauugguuaugguauuuauuuuuuaagauugagggugggagagggguaguccaggauguccuuugugaccauaugugguguccuucugccauccugcaggcagaccuacaaugcugagccauuaaaaucucauucccaugaguccuagcaguggggaaacaaugccagguuagauacuuuggguuucauacugggacccagugccuuuucucuagagcagaagugugggcaccaguaauggcuucgagcugaaaaggaagaguaaagggcaaacaguagagcuuccugauacaggaaguugugggccaggucuuugggucuuccuaucuggggcaugacaagaagacaccacagggaaaaaaaugcaggcucuuuguggagaauucggucuccugcuccuuguagcauguguaggcaggauuuuaagccaugccuucuuucuaagacacagagacucccuaauuaguccacgcuguucaagcacacauuauguagcccaggcuccucucagagguguaugucuuaguggccaagggaaaguagaagacugaaaguauaaagaaaagaacguguauauaguuaagccaugggaaacuguaauuggccuauaauguaggaauuucuuaugucgugcuccagugugaacuauugaaaaccccauugagaaucagugacagaucuuuuggaaaucagucauuggagagaccuauguuucuacaaguuggcauguucauagcauuuaguacugacaggugucugcaugcucuuuacagagccacuaaagugagccugccacaggacacacaaggccuuuuguauggggcucuuguguggaucucacacagagcaugauacccagggaagucuaggugugauguggguaacaagggcaugaccugaccccuugguuaguuuauguugaugcacugaggugacaguguguucuuuuucucccuagaaccggccccugggauuugcugcucagaaccugaguucacugagacaucaggagcaagcacuggaggccaggugcugcuggacccagaugggagccaugcaggacuugaccauggccugcacacacuucuucccaggagaaggggaaugaggaaggugggggucucaaggcuuccuuuccaucaguguguugcuauguucuuauauuccuuuuuuucuguuuaauuauuuauuuaguacaaaaucagguccagccuccuuagguauggcacugauauaaaguauaaaauggaagcuaaauucuaggaguacagcacugcaugcuucugacacagacaaggaaggcuagaacugcacaguuagaggacacugcuucuguauugacauuuuuuucagucagugaaggcggggaaagagaccugcagccaggacaucuucucugcugugggacaauacugccaucaugcggcaaauguuucuuuuagaucagcgcaggcacacauaccuccuccauccuacugcuccucagccauuuugaagcaaggaagaucagggggauucaucaauggugaaauuuguccuucuuacuguauuucacuccuucuguaggcagacuaguaucacaggaccuuucagaguauuaacgcagacugcggugauugaggucuaguaccaagugcacagcggugcugaggugcagggacaggaagcagaagggcagguuccagcccgcucagcuggccaugguaaucuacuagcuaguguccuagggcagcaaggugucucucucuugguuuugaagagaaagaacuacagucccaguuucuguuggggcuugaaaagucaaggaagcccugcugggcacccacagcugcuccugcugucuguaauuggucgccaucuucugucauugcuaggaaucaugggaaagaggacaguguugcugugaguuuugaaaccgcguccuaaugguggcaguagagcucuacacaagagcuuaugagugcuucuacccugcccuucaugucuaaaaaaaaaacugcuaaagauggcuauccuaacuuuaacccaacuuugaguaguuuaaaagguauuuuaauuuuaugucauccauuccuuguuaggccaaucugaggcccuagguggugggacucuuuuccuucaguuaugaagguuauuuccuuuuucugucuuuauaaguggauuuuuacccuuuccagauaguuaauggucuucaaguuugguaugauuaauuuuguguagguuuuacaagauaauuuuaugcuaggagauucagaagcaaaggacaaugcugagcccuggcucuaguuaaguacaugaggcaggcuggccugggccuuuccaggaggcuucugguccauguuaucaugcccagcugacaugaguagguuuaaccuugucuuaaguaacaucagcaaacaaacaccuggcauauauuaucaaauuauaucccaaaggcgaugucuaugcuucccaguugucuccucuaucugccuacauccaccauguuuacccuuugaaggacaagucacucaaaggaaaguauacaaggucugcauggagagguugcaguagagaauuacuccugaaaaacaguaacaaacuccuagacauccuccauccugggccuuucucucuagauauugguuaugauaauuuuuuuuuuaggcucgagggugagagaggaguauccaggauggccuuuguggacacaugugguguccuucugcuauucugcaggcaaagcuacaguacugagccauuacacuuaauucccaugaguccuagcaguggggaaacaaugccaggcaggauacuuuggguuccacauuuggacccagugccuuuccucuagagcaggaggagugugggccccaguaaugucuuacagcugaaaaggaaaaauaagggacaacagcagaaccuuagggacaagcugacacaggaaguugugggccaggccuuugguucuuccuaucugggacaugacaagaagaaaccccagggaagaaaauguaggcuguugcuggagacuucugucuuuuccucuuuguagcauguuacacaugcuacacauuucaagcuuugucuucuugcuaagaccagagacucccaauuuacucccaaguugcccugguacacauuaaguagucaaagcuccucuccuagaugcauaccuuaguugccaagggaaaguacaagacugaaaguauaauaaaguauaaagacaauaacacgugcauguagugaagccacgggaaccggaaaucagacuguaauguaggaaauucuuguguccuugcuccuggguaaacuaaugaaagccccauuggagagaccuguguuucuccaaguaggcacguauuuagcauucaguguugacagguaucugcauccucuuuacagagcaacuaagugagccugccacaggacacacagugucuuaugucuggggcucuuguguggaucucacacagagcaugauacccagggaagucuaggugugauguggguaacaaggacaugaccugacgccuagguuugcuucuguugaggcacugagauggcaguguguucuuuuucucccuaggacuggccccugggauuugcugcucaggaccugaguucacugagacaucaggagcaagcacuggaggcugggugcugcuggacccagaugggagccaugcaggacuugaccauggccugcacacacuucuucccaggagaaggggaaugaggaaggugggggccuccaagcuuccuuuccuuucuguuugacuuccuaugucuuuauauuucuuuuuuucugaucaguuauuuauuuaguacaaaaucagguccagccuucuuagguauggcauugauauaaaaugcaaaauagaagcuaaauucuaggaguacagcauugcaugcuucugacagagacaaggacggcuagaacugcacaguuagaggacacugccucuguauugacauuuuuuucagacugugaaggcgggcacagagagcugcacucaggacaccuucccugcucuggggcaacacugccauuauguggaaaauguuuccuguagagcagagcaggcacacagaccucuuccuccauccugcuucuccucagccauuuugaagcagggaggaucaggaggauucaugaauggcgaaaugugccuguuuuaaugucuauuuucuccuuaaguacccagacuagaaucaccugacccuucagaguauuaacucagacccuggugacuugagguccuguaccaagugcacagcugugcugagguccagggacaggaagcagaugggcggguuccugcccgcucaacuggccacuauaaucuauuagcuggugucuugaauaggaaggcaccucacucuccagguucugaggagaaaacacugcagucccaguuucuguuggggucugagaagucaagacagcccaacuaggcacccacagcugcuccugcugucuguaaucggucgccaucuuccgccauugcuaggaauuaugggaaggaggagaguggcgcugugaguuuugaaaccguggccugaggguggcaguagagcuccacacaagugcuccugagugccucucccccgcccuuccugucugaaaaaucacaaaaaauggcuguccuaacauuuacccagcuuugaguuguuuaaaggguguuguuuuuuuuucauguguucccuuugaagccaaucugacuucauagguagugggacauuuuuucuucuguuauuuagguuauuuccuuuuucugucuuuauaacuguugauauuuacccuguacagauauuuaauguuccuaaaauuugguaugauuccuuuguguagguucuacaugaugacaauaugcuaggagauuuagaaguaaagaacuaagcuuagcaaugauucuuguuaaguacaggagacaggcuggucugggccucuccaggaggcuucugucuuuugcucugggaguuccaaaauaucucagaccaugcuaccaugcccaucugaaggcaguagguuuaaccuugucuuaaauaucaucagcaaacaaacacuuggcaguugauaauuauaucccaaagaugauguccaugcuucccaguuuucuccucuguuagacuucauccaccauguuuacccuuugaaggacaagucacucgaagggaaguauaacaggccugaauggagaggggacaguggagaauuacuucugaaaaacaguaacauaggccuagacauccaggauccugggccuuugucucuagauauugguuaugguauuuauuuucaggcuugaaggugagagaaggguaaucaaggauggccuuuguggccauaugugguguccuucugccaucauguaugcagagcuacagugcagagccauuacagcuucauucccaugaauccuaguaguggggacacaaugccagguaggauacuuuggguuccacacugggacccagugccuuuccucuagagcaggagaagugugggccccaguaaugucuugcagcugaaaaggaagacuaaaguccaacagcagagcuguagggacaagcugacacaggaaguugugggccaggccuuugggucuuccuaucuggggcaugacaagaagaaaccccagacaagaaaaugcaggcccuugcuauagacuucugucuccaccuuuuuguagcauguuacacaugguacacauuucaagcuaugucuuuuugcuaagaccagagacuccuaauuuacucccaaguugcccuggcauacauuaugcaguccaagcuccucucugagagaugcaugucuuaguugccaagggaaaguauaagacuguaaguaaaguauaaagacaacguguauguagugaagccacgggaacuggaaaucagacuguaauguagcaaauucuugugucccugcuccugugugaacuaaugaaagccccauugagcaucaguggcagauccauuuggaaaucacagucauuggaaagaacuguguuucuccaaguaggcauguauauagcauucaguguugacugcuaucugcaugcuuuuuacagagccacuaaagugagccugccacaggacacacaaggccuuuuguccuggccucuuguguggaucucacacagagcaugauacccagggaaguguaagugugaucugaguaaccagggcaugaccugaggccuagguuugcuucuguugaggcacugagauggcaguguguucuuuuucucccuagaacuggccccugggauuugcugcucagaaccugaguucacugagacaucaggagcaagcacuggaggccgggugcugcuggacccagaugggagccaugcaggacuugaccauggccugcacacacuucuucccaggagaaggggaaugaggaaggugggggccucaaagcuuccuuuccuuucuguuuggcuuccuaugguuuuauauuuuuuuaucucuuuauuuauuuaguacaaauucauguccagccuccuuagaaauggcauugauauaaaguguaaaauggaagcuaaauucuaggaguacagcacugcaugcuucugacacagacaaggaaggcuagaacugcacaguuagaggacacugccucuguaucgacauuuuuuucagaccaugaaggaggggacagagagcugcagucagggcaccuucccugcucuggggcagcacugccaucaugcggaaaauguuuccuguagaccagcacaggcacacaccccuccuuuauccugcuuuuucucagccauuuugaagcagggaggaugagggggauucaugaauggcgaagcuugcucguuuuacuguauuucucuccuguaggcagacugucaucacaggacccuucagaguauuaacucagacccuggugacagaggucuaguaccaagugcacagcggugcugaggugcugggacaggaagcagaagggcagguuccagcccgaucagcuggccaugguaaucuacuagcugguguccuagggcaggcaaggcgccucccucuccagguucugaagagaauguacugcagucccaguuucuguuggggccugaggagaagucaaggcaacccaacuaggcacccacagcugcuccugcugucgguaauuggcagccaucuucugccauugcuaagaaucaugggaaggaagcucaguugagugucuuuuuauaaaacacaacagugguuuguaacugcauccccaugacaguauuagagcuccaggaaagaagcguuaagaacuuuucauuucuugugcccuccuucuccaaaaccaaaaauaaaacaccauucaaguauaaauguuaccauggaauaugauuaucuugauuuucccugacuuugaauaguuucuuuaguauuuuaauuuuugucucuccugucugaaaauuugccuacugaaagucaaagcagauaugaggauguuuggcugaguacuuugaaagguguuuuuuuuugcgugugggaaucuacuuuuccauauccauuuaucaguugugucaggggcacacacaugcagucgcacaaacauagcauucaaagaaguugaaaugcuccaggaccuuccucuucucuagaugggacguaacacagugacccaaaacuggacaaugugucaggagugaggagagacuuuggaacacuuggguccucaugagaucucuucacuaugucccuccccucuguauccagggagcugugcagaagaggaaacaguaagauuggaagcccagagggaaugcuugagaccauaaaagcaguaucuuccagacacaacaagacugauacauuauaacccacugagaccgggcaccaacaugcuuagggccuauauaggcgguagcuagaugucacugugauauugacagugcaaaguggacacaaauccaccccuaaccaagaugcuugcuucaguugacacccacuggcaagggaagcuuuuguuuucuucaguuguuugucgucauguaaacacacuuaaggauaggccucauaccuuucagguaaugcccaucucaaagcaaacgcagugcuuauauuuuguugauuuuuuuuuuuuuuuuggucucauauuguuugcucugggcauauucuuaaacugucagcuguuuugcuaguaucuuacacuuuaugaguuugucuuguuaggaccucucucucucuuucucucucucucucucugugugucuuauauauuuuugcuucugguuuguuuguccuuaggauccaugaggaaauaacuaggaaagcaagaacacauuauaguguaugaaaaauuguuuucaauuagaaaagaaaaaauacuucauacaaagauauguguuuucuuccgauuuuuaacugagaccugaagaauagaaaugugccuuaguggaaacucauaccaucugcggggagcacagguuauaguggugaccaaugcaagcugucccugcuuuuucuuagguguguaggcaaaggccugucaacaauucaacagagaguaggaucuaugcaggugagcuacaggguagcauguggggacuucggguuuguaguuaguggguaccuccaucuguuuccuuauggcccaaacuucacucuucauucacacaggggucaccuaagcaguuagggcagauaauuugaugagaugugaaauccuuggugauagauaggaaacacacccacuuacuauaugcagggaacaguuugaccuaugccaaaaaguuuccagauuuugguuucacagggaacaaacaccugaccaagagcacagcaguguaagcuuguccucucagacugggccaaguacaaggcugccauuuuucuugcaggugguguguuuuuuuguuuuguuuuguuucguuuuuguuuuaaaaaaacaagaggggagggagaaaaaggauaaaaaaauggcgcuuuuaaaaguauguagaaccauacugucccccaugaggaauuagcuucgauguagacagcaccauugcagcuuccugcauucuucuuagaguggggguuggucuguagaggccuggagaagcgggccugccuugacuuucaauauggcccuaggagaacucuugguguuauaaugaacggaaugguuauguuuacuguuggaauauuuuuaugcuguuuucaauaagaagguucuaauuguuccugagugcaucaaaauaaauaguaguagaugcuuugagauugcucauuuaaugaucccuuaauuuauguauuuucucuuuaaaaaauaacuuccuuaucuuuugaauccaugcagaaaaauauuuaaaaugaugagcucaacaguuaauggagacauaaucuugaaaucaugcagcaaauaugauugcuagggcacgugcucucagcuacugcuccagcagcgugccugccugcuucugugcuccugccacgcuggacacugauuuccuacuggaaacuguuaagcggccuccaguuagaugcuuccuaguggcucuucacaggaauagaagaguaauaagauauuguuaccuauccaauuggaauuuauaggcagugcaaucuauuugucccccuuggauuaugagcauucagaauuaguacuuaucuucuccuuauaugaugguagucaaccgcccacugcacacacaaagccuguuauugucugucaggauauggugcauggugcccaaggaauguggcugagaaccaggguucuggugccuagauuugcucuaaugcagacacugagguuccauauagcauuuuccuucuucuuucuagaacuagauccuaagagcagaagacaaucauauguccugagaacccauuggagguugaacagcgcuggguggauggagaaaggcagaaaugcagaauuucgucauugccuggaugcugacuuuauccaaagagaagaugcaugaggaguguacaugccucaggucucacuuggcuuucucuuuccuucuugcuuuguucugguuuuggucuuuuguccuuuggaguuccaagucaggaggaguuguaguuggucuggcauacauguaaaaugaaagcagaagggggccugcaggaaaggcuuccucaacucacuuggaaggaggaaggcaaggcugccaccaccauuacuggacuccaauuguaguugcuuuuuuuuuuuuaaucggaaaggcgggagcaggcugcugugagcugguuuuuguuucuucuguagagcaacacugccaucgugcggaacauauugcauacauaccugaaugcaggucucuuucucuaugguggacuaacaaauaggaaggaaggcuauggucugagagguauuagauuuacucauuuauuuuauguaugucaucacacuguagcugucuucagacacaaucagaacacacccgauccccauuacagaugguugugagccaccauggaauugaauucaggaccuggaagaacagucaagugcucuuagccacugaaccacugagcuuggucugagagguauuaguuauccauguuuggacucuuuccccuucuucuuuucccuggugcacagagcacuaucuuaaugcuucuagacauuaugaagaagguggaguguccagaggauuccuaaaugaccaagcucguccuaucccaaccccucuuuuuauaggcaguuuggagguaugggcuauugcagagucuaaguguuaguccuauugacugagagacaagugcccauuagguguccugugguccaggaacaggaagcaggggggcgggauuucaugcugcucaguuugcaguauuaaucuauuagccgcuguccuauggcaguaaggcacuuucuagguuccgaugagaaagaaguacaguuucuguuggggucugaggaaaagucaaggaaacccaacuaggcacucacagcugcuccugcugucuguaaucggcugccaucuuccgccauugcuaggaaucaugggaaggaggacuguggcgcugugaauuuugaaaccgcauccucaugguggcaguagagcuccacaaaagagcuuaugcacaguugccuccugcccuuccugccugcaaaaaaaugccauugagacagaaaguuaccaaggaagaggagugugaugaguuuugcucaguucuggguacuuugaaaaguuuuuuauuugugucuuguuuuucaggugaagcccaacuaaagcccaaauuuagaaggggucauaggaugcuuuuccuucuguuauguaggguguuucccuuuuccuuuguuucuacuuuguccaggugccuaguuuuauuuaaaaauuugguacccuucuuucuuuuaauguuuaugcaauaaagaugcacuaugagauuuagaggugaacacauguaauacaugaggggaacaauuuuuggguuauggguccuagcuccuaguuuugauccucacuacuagaggugaggaacuaauucauuuccaaauugugugccuuggaauuucucacuuccuaguagugugagaacuaucuguggcauuaaaucugauuuauaauaugacugggauggaaaugaagaaaauaauugaauuuaauaauaagaacccauuauucugaugaaaccacuuuauuaguauauuuuguuuuauuuucuuuguuucuuuuucuuuuuccuuucuuuucuuuuuuuuuuuuuuuuuuuuaaacaaaacaggguuuuucuguagccuugacuguucuugaacucacuuuagaucaggccggucugaaacuaacagagauccaccugcauuuuucucuguuuccagagugcugggauucaaggcaugagccacccacuacggccugucuuauaagucauuuuuacagacuacuuuuuccaugucugucucuagucuguaagcugggaaaauucauccaauuauaaauauuuucaguaaugucuaaggggaaaaauuggccagccugaagcccacauuuauuaauuucuauuaguaacuccauauugcauucaaguauucccuuacugacuguauauauuucuauauguccaguuagugcacacagacacagaaacacacacaaaaacauauguaccauaagaaaggcaaaggguuugaaaaguguuuugucagcuuugucuugcaguaguugggaaguaacacagagacccacaacugcacaguguggagagagugagagucuuguggaacacuugcugaggaauggcccucuccucagggcccagggagcgaaagcagaugaguagcccuuaagauugugagagccagagggcacggguaaccccaaggcagcugucuucuagacacaacaggacugacacacaucggagcucucaggcuccuuccuagcauuugcugggccugccuacacagcuuaaagcuagauaggaccccagcccugauaguggcaaauggacacagacucccacuucuaacugagaugaucuuuaauugacacccacuugcaaaggaaauucuuucucuaauggaguuucauuagguauuaaaccacacuuauggguaaaccuuucuuucggguauuuuuauuuuauaggucuuuuguauguuuauguuauaguuucugguuuuauaguucuauggauuuuguguuuggacgugaaucuguguguaauacuugugcuucaugaaagguaacuuuuauucacgugauauaauuguagucucagagccuucagucugcaaaccuaggccuaguccuggaagcuuuaggccucucuauagucuuaucuaggucuagaguguuuccugccucugcgacuugcugcugacuaagcucacccuucccuaucucuuucugagcucugacugguugcuuaacccugcuuuucuggcccacacuccucucccagcugacugauucaauccggcuuuucucuagguuucugacugaguuucugugcuugccucguacuaacacugaugaucuguucgaaucccugggcuccuucugucuucaucucugucuaguuuguucucacucuguaagcugugugcuagggcugaguccuaccacgacaggguuuugccaggucacagucuugggguucacaaugcgauuaaguauccugcaacagugcuuuugcuucuuuuaaaaaaauuucugcccgggcagugguggcgcacacauuuaaucccagcacuugggagguagaggcaggcggaucucugaguuccaggccagccuggucuacagagugaguuccaggacagccagggcuauacagagaaacccugucucgaaagacugaaaagaaaaaaauaaauucugcuuuguuuguauuuuacaccaccacccccauuuaaaaauaaauaaauaaauaaauaagaugggaucucuguaguccuggcugaccuagaacucaaaggucugccuucucuaucuccuaaauauuaggauuaaaugagugggccaccauauaugcuccuguuuguuuuuuauguuuuuugguuuuuguuuuuuguuuuuucuagcccuggcuguccuggaacucacucuguagaccaggcuggccucaaacucagaaaucugccugccucugccucccaagugcugggauuaaaggcgugugccaccacuugccaggcuucuuguuuguuuuuuaaagggaaguaagaaaggaaaccuugaguuggggggcagggugcagggugguuuagaggacaugaguggggaaggggaaaccaugaucagaacauacugugugaaaaguuauuucaauuagaaagaaaggaaaaauacuucauagcaaaggaaugaauuuucauuccacuuuaagcagagaacugaaggaucagcaaggugucuauguccaaguggcaauucaugcugcaugcagggaacacaguuuagaaaguggagucugcugugaacugucucugccucuuaggucuuuaagcaaagagcugccaacuguucaccagaguaugaaaaauggaggugaacuauagugucggaucugaguacaacauuucagacaagaucugccagaagaauagaucagagaauuuaaugugaaggugauuuaacucaugagaaaauaugaacaauguggugguuggugagacuaaaguuugguuuuauggagaacacuagacaaagagcacgauaguuugaucuucucccuuccaauuggacaauggacaaggcagccauauuucuuguggguguuuuuuguuauauuuuuuuuuccaacaagaagggugggagaggacauuacaaaguggugcuuguauaaguguguaauccaauccugccaccaugagggaacaguuucaaaacagcgccacuccagcuuccuggccucuccuuagagcagugauucucaaccugugguuugcagaccagauguccugcauaucaaauauuuauuuuuauuuauuuuuauuuuuugguuuuccgagacaggguuucucuguauagcccuggcuuuccuggaacucacuuugcagaccaggcuggccuugaacucagaaauccgccugcuucugccucccaagugcugggauuaaaggcgugcaccaccacagcccagcaucagauauuuuuauuaugauucauaacaauaucaaaauuacaguuaugauguugcaaugacaguaauguuaugguugggggucagcauagcaugcggaacuguagucaugaggaacuguuguaagggucacauuaggaagguggagaagcacugacugggauuaagguuggucuguagagguguggagaagcuagugcuagaagcuggccuuccauagcuuccucugaggccguaagagagccucuaugcucuuaacaguuaucgagaaguucugcuuacugucuggaauagucuaugcuguuuuccaucagaaucuuugaguugcuccugaguacagaaagauaaguaguaguagcugccuuaagagugaaugcuugacugcuuauucacuguggccccucaaucuccacaguuucccuuuuuuuaaaaguacuuucuuuucaauccaugcacaaaaauauaugaaaugaucauuugagcaacuaaugagaggauaaucuugagggugugcugugaaaguaucccugggcuuguaccaugcaugaggccuuuuguuugcaccaaucugaacauuuuaucaacaauagaggcagcugcagcccuggaaguagaagguggaggcagggcaaugagaacuuuaaagucauaaugggcuaccaugggucuuuuagacccuaucucaugagacaaaggaaaaccucaccugcuaaagaagcaguagaaugcaguuaaaagcuguugaaguggguuuuauugcucuuuuugucaauauguguaucuugguuauaagggguguauauaaaaauccauuagucuccgaggauuauugagugaauagaagaaucuucuguagaggcucugagcugagaucugcuauuagagaugccuuccucuaagcaccaauauuaaauuccaaaccagucuucucccuuuuuauuggaacguuccuuauguuugauaugagaucugauacaguggaauaguauaggacauagaaugcugggcaaauaaaggcccggaugcgugagcaacacugccuagaggaugcaggggcacauuugauuucuaagaaauucauucuuuugcugaaacuuugguucagguagaaaaucaaaacaaaaauuagacccuucagaagauccuuucaaaagucaaagucaaaacccuuguguuccguggcaccuuuuucucugggugauguuucucagguaggaagggcacuaagaugguguuuggaccacagccaguacaugaguaacaccacagggauguagaguugccaggaaagcccgaucucccaugaagcuuugcagugguggggagcaugcgggcuggagaaggcuagggucuugagcuugcuauguugacccagcuagucagaacccucgauccuucugccugaacaucucuagggugggaaucacacauaaaccccagcaugcacagguccaaagauaaaauuguaaaguuagaauuuaggacagaaacaggaagaagccuggcuccagagguggcucaucaguuaagagcacuuccugcucuccgagagggucugggcuggcuuccuagcaccuaaguaaaugggcucacaauuuccuguuaacuguaguucuaggggaaccaacaccccuuuuggccuuuguggcuacuugcacacacagaacauacauucauacacaugaacauauacauauacacacacauauaaaauaaaucuucaaagaaaucaugagguuaucaacuuguauuccgacuuuaaauguuuguauuauauaugaauauaaaauuaccaaugcauuaaauaauacauugguuuuuuuuuuuuuuuuuugguuugguguuuuucuucuuaguuuccaggcuaacauaucuucacuagacuaugcuaaccucaaacuaugcuauaacgguuccuuagccuuggccacauuauauauaauaaccuccaaccuuuaaaaagaaagacaugaaaaucauugugcagcauaauuaauuucaaugcucaguuaaucagugcuucauuaucuauaaugagcuaugagucuaguuagucauugggugaguuggagucaauguggagaauucaucacuguuacuacgaagucuaauggaagcguuuucuggauccugccuauggugaauaucuuacaucucaaugaggaaagauaacacacgaugcucaacugaaaaagaaugauggagaauaagauccccagugaaaccaggggaaccugcuggacuguugaaugugcucgaacacugaaaaugcucgggcucuugcagcauuaaucuucagcagucacagaucccguguuacagaccacggccugcuguccauacaugccuauuacauccaucacuauuuggaguaugaaagcuagggaacaaggaaucuggcugacauccuggcuuccuggcccacuuugcucuaauccagguacuggcuuagcuguauuuuuuuguuuccuaccuagaacuggaugcugagacaugcccccgcgaucccaagaccaccagguaccgugagcaaucacuggagcuggaacacugcugccugaggaagagaagaagugcaggcuugucauugucuaugcuguuacuugugguucccgggucuucagagaggaugcacaagaacgggaggugggugcuucagacacauuuucaguccccccugucucucugucuuuugcugcuugacuucugauacaggaccuuauccgacagaugugguguccauguaaaauuaaaauggaagcugaguguccagaucaguuuuccucacacaaaagaaaaacagccaucagagcugccauuuauuccaguuugcacaggcagggccagagagcuguagucagaacaccuuuaauucucuggggcaacacugcccgcaugaagaaaauguuuccuacagaaccacacacacacacacacacacacacacacacauacacacacacagacuucagccucagucuugcguuuccucagccauuuugaaacaggaugaggaggauucaugaauggcgaagcuugcccauuuuacuguauuucucuccuguaggcagacuggcaucacaggacccuuuagaguauuaacucagacccuggugacugagguccaguaccaagugcacagcugugcugaggugcagggacaggaagcagaagggcggguuccaccaucgcucagcuggccaugcuaaucuacuagcugguguccuaggguagcaaggcgccucccucuccagguucugaagagaaaacacugcagucccaguuucuguuggggccugaggagaagucaagaagcccagcuaggcacccacagcuucuccugcugucuguaaucggccgccaucuucugccauugcuaauaaucauggacaggaggagaguggcgcuguaaguuuugaaaccguguccacaugguggcaggagagcuccacacaagagcucaugagugccucucccccacccuuugugucugaaaaaacgccaaagauggcuguccuuauuuuuauuauuuuaauuuuaauuuuuaauuuuuuauuuuucgagacaggguuuugcuguauagcccuggcuguccuggaacucacuuuguagaccagacuggcuucaaacucagaaauccgccugccucugccuccccagugcugggauuaaagacaugcuccaccaggccuggcugucuguccuaacuuuuaaccaacuuuaaguaguuucaacuguauuuuauuuuuuugucacauguuccaugugaagccaaucugaggcccaagguggugggacucuuuucguucuguuauauaggguuuuucccuuuucuaucuuuauaacuguugauuuuuuucuuuuccagauacuuaaugguuuucauaaaauuuugauauguuuaauuuugugucaguuuuacaugauaaagauaugguagcagauuuagaagccaaggacuaugcugagcccugguccuagugaacuacaagaggcaggauggccugggccuuuccaguaggcuucugucuuuuccucugguaguuccagaauaaguccaugcuaccaugcccagaggacaggaguagguuuaacuuugucuuaaguaaaauaucaauaaacaaacacuugccaguugauaauuauaucucaaagaggauguccgugcuucccaguuguauugucaggguucucuagagucacagaauuuauggauagucucuauauaguaaaggaauuuauugaugacuuacagucugcagcccaauucccaacaaugguucaguaguggcugaaauggaaguccaagggucuaggaguuacucagucuuacacagcaaguaggcgaaggagcaagggcaagacucccuucuuccaauguccuuauauugucuccaucagaagaguucuaccacaccuuuaaucccggauggccuugaacuuggagauuuaaucuucuguaauccauagccacuauguuuuagaucuccauaccaagauccagaucagaaacuucuaccgacaaggcuccagauaaggguuacuggugagccuuccaaugcuggauuguaguucauuccaaauauagucagguugacaaccaggaauagccacuacaccaguuuucuccucuuucugccuucauccaccauguuuacccuuugaggacaaguuaguccaagggaaguauaacaggccugaauggagaggggacaguggagaauuacuucugaaaaauaguaacauaggcccagacauccacaauccugggccuuugucucuagauauugguuaugguauuuauuuucaggcuugagggugggagagggguacucaaggauggcguuuguggccguaugugguguccuccugcaauccugcaacagaccuacagugcacauucauuaagccucauucccaugaguccuggcagugggaaacaaugccaggcaggauacuuuggguuccacacugggacccacucccuuuccucuagagcaggagaagcgugggccccaguaaugucuugcagcugaaaaggaagacuaaagggcgaacagcagagcuguggggacaagcugacacaggaaguugugggccaggccuuugggucuuccuaucuggggcaugacaagaagacaccacagggaagaaaaugcaggcucuugauggagacuucugucucuaccucuuuguauuauguguaacaugcuacacauuuuaagcuaugucuucaugcuaagauagagacucucaauguagccaagcugcccugccacacauuauauagcccaggcuccucucagagauucuuguuuuguuugccaagggacaguuuaagacugaaaguauauaaaguguaaagacaagaacauguguauauaguuaaacuauggaaaacgguaauuggccuuuaagguaggacauucuugugucucugcuccagugugaacuaaugaaacccccauugaaaaucagugacagauccauuuggaaaucauagccuuuggagagaccuguguuucuccaaauaggcacguauuuagcauucaguguugacagcuaucugcaugcucuuuacagagccacuaaagugagccuucuagaggucacacaaggccuuuugucugggccucuuguguggaucucacacagagcaugauacccagggaaguguaagugugaucuggguaacaaggacaugaccugacgccuagguuugcuucucuugaggcacuguggugacaguguguucuuuuucucccuagaaccggccccugggauuugcugcucaggacccgaguucacugagacaucaggagcaagcacuggaggccggugcugcuggauccagaugggagccaugcaggacuugaccauggccugcacacacuucuucccaggagaaggggaaugaggaaggugggggccucaaagcuuccuuuccuuuuccuuuugcuugcuaaguuuuuauauuccucuuuauccauuugauuauuuuguacaaaaaucagguccagccuccuuacauauggcauugauauaaaaugcaaaacagaagguaaauucuaggaguacagcauugcaagcuucugacacagacaaggaaggcuagaacugcacaguuaguggacacuacgucugcauugauuuuucuuucagacugugaaggcggggacagagagcugcagucaagacaccuucccugcucuggggcaacacugccaucaugggaaaauguuuucuguagaccagcacaggcacacaccuccuccuccauccugcaucuccucagccauuuugaagcagggaggaugagggggauucaugaauggcgaagcuugcucauuuuacugcauuucucuccuucuguaggcagacuggcaucacaggacccuucagaguauuaaugcagaccuucgugacagagguccaguaccaagugcucagcggugcuaagguccagggacaggaggcagaagggcggguuccagcccgcucagcuggccaugguaaaauacuagcugguguccuagggcagcaaggcgccucccucuccagguuaugaaaacauugcagucugaguuucuguugggaccugagaagaagucaaggaagcccugcaaggcacucacagcugcuccugcugucuguaaucggccgccaucuuccuucauucucuggugacugagguccaggaacaggaagcagaggggcagguuccaccccgcucagcuggccaugguaaucuaucuacuagcugguguccuacucuccagcuucugaagagaaaacacugcaguugcaguuucuguuggggccugagaagaagucaaggaagcccugcaaggcacucacagcugcuccugcugucuaauuggucacuaucuuccgccauugcuaggaaucaugagcaggaggagaguggcgcugugaguuuugaaaccguguccucaugguggcaguagagcuccaaacaagagcuugugagugccucucccccgcccuuccugucugaaaaaacgccaaagaugguuguccuaacuuuuuauuuuuaauuuuucuuuauuuuucgagacaggguuuugcuguauagcccuggcuguccuagaacucacuuuguagaucagguuggcagcgaacucagaaauccaccugccucugccuccggagugcugggauuaauggugugcaccacuaugcccugcugucuguccuaacuuuuacccagcuuugaguaguuucaacuguauuuuauuuuuuugucacauguuccaugugaagccaaucugaggcccaagguggugggacucuuuucguucuguuauguaguguuuuucccuuuucuaucuuuauaacuguugauuuuuucuuuuccagauacuuaaugguuuucauaaaauuuugauauguuuaauuuugugucaguuuuacaugauaaagauaugguagcagauuuagaagccaaggacuaugcugagcccugguccuagugaacuacaagaggcaggauggccugggccuuuccaguagguuucugucuuuuccucugguaguuccagaauaaguccaugcuaccaugcccagaggacaggaguagguuuaacuuugucuuaaguaaaauaucaauaaacaaacacuugccaguugauaauuauaucucaaagaggauguccgugcuucccaguuguauugucaggguucucuagagucacagaauuuauggauagucucuauauaguaaaguaauuuauugaugacuuacagucugcagcccaauucccaacaauguuucaguaguagcugcgaauggaaguccaaggaucuaggaguuacucauucucacacagcaaguaggcgaaggagcaagagcuagacucccuucuuccaauguccuuauauugucuccaggagaagguguacccuagauuaaauguguucuaccaaaccuuucaucccagaagacguugaacuccgaaauuuuaucuucaguaauccauagucacugugccccaagaucuccauaccaagaucuagaucagaaauuucucuuucuaagccuguagauaagggucacuggugagccuuccaaugcuggauuguaguucauuucaaauauagucagguugacaaccaggaauagccacuacaccaguuuucuccucuuucugccuucauccaccauguuuacccuuugagggcaaguuaguccaagggaaguauaacaggccugaauggaagggacaguggagaauuccuucugagaaacaguaauauaggcccagacacccacgauccugugccuuugucucuagauauugguuaugguauuuauuuucaggcuugagggugggagagggguacucaaggauggccuuuguggccauaugugauauccuccuaccauccugcaacagagcuacagcgcauguucuuuaagccucauucccaugaguccuggcaguggggaaacaaugccaggcaggauacuuucgguuccacacugggacccagugccuuuccucuagagcaggagaagcgugggccccaguaaugucuugcagcugaaaaggaagacuaaagggcgaacagcagagcuguagggacaagcugacacaggaaguugugggccaggccuuugcgucuuccuaucuggugcaugacaagaagacaccacagggaagaaaaugcaggcucuuguuggaaacuucuguaucuaccucuuuguagcaugugcaacaugcuacacauuuuaagcuaugucuucaugcuaagauagagacucucgacauauccaagcugcccugccacacauuauauagcccaggcuccucucagagauucuuguuuuguuugccaagggacaguuuaagacugaaaguauauaaaguguaaagacaagaacauguguauauaguuaaauuauggaaaacgguaauuggccuuuaagguaggacauucuugugucucugcuccagugugaacuaaugaaacccaauuugaaaaucagugacagauccauuuggaaaucauagccuuuggagagaccuguguuucuccaaauaggcacguauuuagcauucaguguugacagcuaucugcaugcucuuuaccgagccacuaaagugagccuucuagaggucacacaaggccuuuugucugggccucuuguguggaucucacacagaacaugauacccagggaaguguaagugugaucuggguaacaaggacaugaccugacgccuagguuugcuucucuugaggcacugaggugacaguguguucuuuuucucccuagaaccggccccugggauuugcugcucaggacccgaguucagugagacaucaggagcaagcacuggaggccggugcugcuggacccagaugggagccaugcaggacuugaccauggccugcacacacuucuucccaggagaaggggaaugaggaaggugggggccucaaggcuuucuuuccucuacuuuuugccuugcuaaguuuuuauauuccucuuuauccauuugauuauuuuuuacaaaaaucagguccagccuccuuagauauggcauugauauaaaguguagaauggaagcuaaauucuaggaguacagcauugcaagcuucugacacagacaaggaaggcuagaacugcacaguuaguggauacugccucuguauugaccuuucuuucagacugugaaggcggggacagagagcugcagucaggauacuuucccugcucuggggcaacacugccaucauggcaaaauguuuccuguagaccagcacagacacacaccccuacuccauccugcaucuccucagccauuuugaagcagggaggaugagggggauucaugaauggcgaagcuugcccauuuuacuguauuucucuccuucugugggcagacuggcaucacaggaccuucagaguauuaaugcagaccuuugugacagagguccaauaccaaggacacagcugugcugaaguccagggacaggaagcagaugggcggguuccaacccgcucagcuggccaugguaaucuacuagcugauguccuagggcagcagggugccucccucuccagguucugaagagaaaacacugcagucccaguuucuguuggggcgugagaagaggucaaggaagcccaacuaggcacccuaagcugcuccugcugucuguaaucggccagcauauuccgccauuacuaggaauuaugggaaggaugacaguggcccuuuugaguuuuggaaccacguccuaaugggggcaguagagcuccacacaagaccuugugagugcuucucccccgcccuuccagucucaaaaaacgccaaagauggcuguccuaacuuuuauacagguuugagcgguuucagcuguauuuuauuuauuuuuuugccauauguuucaugugaagccaaucugaggcccuagguggugggagucuuuuccuucuguuacauaggauauuuccucuccauaaagaugcuauucauagacaaaugcacccaagaagauuguugcuccgguuuuguggaucuuggaauaauuuugucaguauuuuaguuuuguuucccuucuuauuugaaaauaugcuacauguauauaaaggcaucucggaagauuuuuugccuaugucugagugugugaaaaaguuuuguguguguacugauucccacauuucagccaaucugaagccuggauuagcagaaguccuaggguccucauuguguuguagaguguauucccaguuucgcucauuuucacuugugugagagacuggccucauuuaaacuguuuuugcuauuuauuucuuguaguuucuaugcaauacaaguuugcuaugaguuuaggaggagguaaaucugaaguggacacaucauauagcagagggguagaauguuaagguuauuauaugccccagguccuugguuugaucccuaauaacuugugugugcagcuaauucauggguagauauauaacugucaaguuuccaauuucaaaagcuuugagaaauaucugugacaguaaaucuuauuuguaauauuauugggguggauuuguagguaagaauuagugagauuaauaugagagcuaauuauuuaguugugauauuuucuuagucauuuuuagcgaauguuuucuaguugggugaaucuauuuugcaggcuaaggacauucacugagaauuaacguauuuucagugauuucauguuucccuucagcaccagauuucacaguaucucagauuaaauggacccuucaauauuccacgucuuauguaaaacaaacucauguauuacauuaccauaucauauguuaauaagccauauaugcuucugcaaguuuugauagcuuuauaauauguaugcguaauuaggaaauuguuuucaagugguauuuauucaaagacuuuccuguaguacgggucuguaauuuuguuuuuuaauauuucauuaauuccugauguaucucaugcaggaccuuauuuuaauauuuuuuucaaguagaauacaaaauacuagguuccaguaaggcacuuuuugaauccacguuuuucuugguuuuucucccucugagccugucucucucacccccugcuuacauuccuuuuaccccucucccugucucugcuccuuucucuuucaugucaugguauuccauugcucacuguccagccuccccucucucuacagcuuuucagcugcucucaugauccccuuuuuaauuccacgauccaguuacaccuccuuacacauagacaaauguguguacaugcucacguaaaugcaacuuuaauucugcauaugauggagaacaauuuguaucugucuugcugaaucugacauuuucuuuacauugugguuucuuguucuguacauguuccauguguuucuauuacuaaguuucacuuuccauauguauuuucauuuucuauaugucuauucucauccguacugcagcauuaagcaugcaaacaucuuuguaguagaaccuagaaaccuuggaagauacaagauaugguuccauuuuacuuuugucccuuaggucuggcauugauuuucaucuaaugguauuauuauuauacccagauauauaguguaaaaagcaggaaauacuugacagauaucaaaagguagaagaauauauuuuuaaaaucagucuuccgugccugaagagaucucuuauuggcuaaaugaacauuuuucucuuucagugcauucauauucuagucccagcacucacauggugacucacacccauguguaacuccaauuccagggauaaaauucguauuaacuuccugguggaauggcacccagugguguaccuucauucuugguggagaacgauguuacacauaaaaugugaaacuaaguuagcauucauugaugcuguuuuuguagcucagggugcuuuccuggcauacaggaagaacuagauuuuauacaaauguauaagaaaaucauuguaaagaaccaaaauccagccccuaauaauaugucagaauauccaggacaaccauugagaaugccuaaguagcguaugagguauuugagcuauaauagaugaaagaaaauugaaacauggguggguguacagaucaauggaaaguccaaguaagacauccuucucucuucucuccucuccucucccucucccucucccucccccucucccucuccucuccucuuuuccuuuccuagacaggguuucucuguguagcccuggauguccuagaagucacucuguagaccauacuggcucagaaaucugccugucucugccucccaaguucuuggauuaaaggcacacgccaccacuaccuggccaagcaagacaucuuaguggggaaauuauuaaaacagucucaauuuuacccacugcauucacuguguacugaauugccugaaauauagccuucauacucaaauauaucuacaugcauauggucuuguuucaauguuaaucaugguauaauauuuuguauuguacaaucacugccauauauuuguguauuuauuuaaaggaaaacacugaauccggugagaggauaaagguccuugcuucccagcauaugaauucaugaauuucauacccauaaaucuaauuguagcaguaagcagguucuugcagguugucuucugacauacacacaugcauucaaacaaauaaaagacacacacacacacacacacauacauauacacauauauaucaguuuuauaaaggcaaguagauauuaaugagauuuacagauuaaaguauugacuguuuaaauauauucaguacgaaauguugggaccaugugcacuugguauuauuuaaacuacagcauauauguauacauuguaugcugcaggauacuuuuagagacccuaaauauaaaaauauauauguacacuaaaagauccaaaaguuaucaguugucuaacaagcuguauggaaugcugauauuaaauuaaaacuuuguuuucagaacacacacaaacagucaaagaaauugaaaggacucccaguucaaguugucuguccuuccuuccuuccuucuauaauuccccucccucucgccucaaucgucuucuuccucuuccuucaaaauaaagggaugaggaauuauucauaauagauuacaguuuaaacacagauuuauugaauguucacuuuuguuuaaaggucaaacauacuccaugaucuaugugauugggaguuauagugauuuccauagcuuugucaccccaaaugcuauagagcauuaacuccugagaccuaccuagaucaucauuacaggcagguagucagauuggcuggacauccccccaaggccaguuguguaagaaaggaugggguaaggugaccagggagucugugaagggaaucaggcagagacccauguugccggguuccuagguuugaucuucuccagacccugacuuggcaacauuuucuuuccuaccuagaacuggaccagaagauuuaacuuccauaccacaagcacugggguagaagacugcugcugggugaagaagagacuagacuugaucauugagcagccacucacugauaucuucagugcugcaugaggaaggugggugccucaaagcuccuccauccuucucuuuccuuccugcuuagaucauaaauuccaggcaauuuccuucuuacagcagaguuuauucuucuggauuuggugguggauucuggugaagauacagauggaugcucuggcugagucgcuaccuugaaaugaaaaugggagguaaacucucccauagaugaaucuucuucauuuugaagguaaaggguaaggaaagcugccauaguuguuggacucuguccauuauuggaguuuuuuucagacugugaaggcggggacagagagcuguagucaggacaccuucccugcucuggggcagcacugccaucaugcggaaaauguuuccuguagagcagagcaggcacacgcaccuccgccauccugcuucuccucagccauuuugaagcagggaagaucugguggauucaaggauggcgaaaugugcccgauuuacugucuauuuucuccuuaaguacccagacuagaaucaccggacccuucagaguauuaacucacacccuggugacugagguccaauaccaaguacacagcugugcugagguccagggacaggaagcagaugggcggguuccaacccgcucagcuggcaaugauaaucuaguaccugguguccuagggcaacaaggugccuccaucuccagguucugaagagaaaacacugcagucccaguuucuguuggggccguagaagaagucaaggaagcucaacuagguacccacagcugcuccugcugucuguaaucuggcuccaacuucugccauuucugggaaucaugggaaggcggacaguggugcuaugaguuuugaaaugguguccucaugguggcaguagagcugcacacaagagcuugugagugcuuccccaccgcccuuugugucugaaaaaaccgccaaagauggcuguccuaacuuuuauccaacuuugaguauuuuauuuuuuuuuugucauguguucccugugaagccaaucugaggcccuagguggugggauucuuuuccuucaguuauguaggguuuuugccauuucugucuucauaacuguugauuuuuuacccuuuucagauacuuaauggucuucacauuugguaugauuaauuuuguguagguuuuacaggauuaaauuauccuagauuuagaagcaaaggaaugugcugagcccugguucuaguuaaguacaugaggcaggcuggccugggccuuuccaggaggcucuguuuuuuccccugggacuuccagaauaucuagguccauguuaccaugcccagcagacaggagcagguuuuaccuugucuuaaauaaugucagccaacaaacccugcucaguugauaauuauaucccaaugaugaaguccaugguucucaguuuucuccucuuuuugccuacauccacuauguuuacccauugaaggacaagucaguccaagggaaguauaccaggccugaauggagaggggacaguggagaauuacuucugaaaaacaguaacauaggcccagacauccacgauccuaggccuuugucucuagauauugguuaugauauucauuuuuuuucuuuuuuucuuuuuuuuuccauuuuuuaguagguauuuagcucauuuacauuuccaaugcuauaccaaaagucccccauacccacccacacccacucccccuuuuuggcacugucguuccccuguacuggggcauauaaaguuugcguguccaaugggccucucuuuccagugauggccgacuaagccaucuuuugauacauaugcagcuagaguccagagcuccgggguacugguuaguucauaauguuguuccaccuauaggguugcagaucccuuuagcuccuuggguacuuucucuagcuccuccauugggagcccugugauccauucaauagcugacugugagcauccacuucuguguuugcuagguuaugguauuuauuuucaggcuugagggugggagagcuuuggucaaggcuggccuuuguggccauauguggugucuuccaaccauccugcaggcagagcuacagugcagagccguuacagcuucauucccaugaguccuagcaguggggaaacaaugccaguugggauacuuuggguuccacacugggacccagugccuuuccuauagagcagaagugugggccccaguaaugucuuugagcugaaaaggaagacuaaaguccaacagcagagcuguggggacaagcugacacaggaaguugugggccaggccuuugguucuuccuaucuggggcaugacaagaagaaaccccagggaagaaaaugcaggcucuugcuggaaacuucugucuccaccuuuuuguagcauguuacacaugcuacacauuuuaagcuaugucuucuugcuaagaccagagacuccuaauuuacuccaaguugcccuggcacacauuaaguaguccaagcuccucucagugaugcaugucuuaguugccaagggaaaguacaagacuggaauuauaauaaaguauauggacaauaacauguauauguagugaagccacgggaaccggaaaucagacuguaauguaggacauucuugugucucuguuccagugugaacuaaugaaagccccauugaaaaucagugacagauccauuuggaaaucauagccuuuggagagaccuguguuucuccaaguaggcauguucauagcauucaguguugacagguaucagcaugcacuuuacagagccacuaagugagccugccacaggacacacagugucuuaugucuggggcucuuguguggaucucacacagagcaugauacccagggaaguguaagugugaucuggguaacaaggacaugaccugacgccuagguuugcuucuguugaugcacuguggugacaguguguucuuuuucucccuaggacuggccccugggauuuucugcucaggacccgaguucacugagacaucaggagcaagcacuggaggccggugcugcuggacccagaugggcgccaugcaggacuugaccauggccugcacacacuucuucccaggagaaggggaaugaggaaaguggggggccucaaagcuuccuuuccuuucuguuugucuugcuauguuuuuauauuccuuuuuauccauuuaauuauuuaguacaaaaucagguccagucuccuuagauauggcauugauauaaaguguaaaauggaagcuaaauucuaggaguacagcauugcaugcuucugacagagacaaggaaggcuagaaucacacaguuaguggacacugcaacuauauugacauuuuuuuuuuuuuagacugugaagguggggacagauugcugcacucagaacaccuucccugcucuggggaaacaaacacugucaucauggggaaaauguuuccuguagacccacacaagcacacaccccuccuccuacauccagcuucuccucagccauuuugaagcagggaagaucagggggauucaugaauggcgaaauuuggccuuuuuuaguguauuucucuccuucuguaggcagacuggcaucaccugacccuucagaguauuaacucagacccuggugacugagguccaguaccaagugcucagcugggcugcggugcagggacaggaagcagaagggcagauucaaccccccucagcuggccaugcuaaucuacuagcugguguccuagggcagcaaggcgccucccucuccaggaucugaugagaaaacacugcaguuccaguuucuuucggggcuugaagagaagucaaggaagcccugcaaggcacucacagcugaucaugcuuucuguaaucgcccuccaucuuccuucauugcuaggaaucauuggaaggacaacagcggagcugugaguuuugaaaccgcguccucaugggggcaguagagguccacacaagagcuugugagugcuucuccccugcccuucccuucugaaaaaacgccaaagauggcuguccuaacuuuuaugcagcuuugaguauuuuaaaugguauuuuuuuuuugucaucuacuccaugugaagccauucugaggcccuagaugguuggacccuuuuucuucaguuauguagguuaucuccuuuuucugucuuuauaauugugaauuuuuacccuuuccagauaguugucuucaaauuugguaugcuuaauuuuguguagguuuuucucaauaauguuaugcuaagagauuuauaagcaaaggacaaugcugagcccuggguauaguuaaguacaucaggcaggcuggcccuggccuuuucaggaggcuacugguccaugguagcaaacaaacacuucacauuugauaauuauaucacaaagaggauguccuuauuucccaguuuucucucucggccuccauccucccuguuuacccauugaaggacaagucaguccaagggaaguauaccaggccugaauggagaggggacagugaagaauuacuucugaaaaacaguaacaaaguccuagacauccucgauccugggccuuugucucuugaucuugguucuggcauuuuuuuucaggcuugagcuugggagaauguuaguuaaggcuggcacuauuggccacgugugguguccuuuugccauccugcaggcagagcuacagugcagagccauuacagcuucauuccccugaguccuagcauuggugaaacaaugccagguaggauacuuuggguuucacacugggacccagugcuuuuccuuuagagcaggcgaaguguuggcaccaguaauggcuuugagcugaaaaggaagacuaaaguccaacagcagagcuguagggacaagcugacacaggaaguuguuggccaggccuuugguucuucuaaucugggguuugacaggaaaaaaccccagggaagaaaaugcaggcucuugcuggaaacuucugucuccaccucuuuguagcauguguaacgucuacauauuuuaagauaugccuucuuauuaagaccuagagauucccaauguaaccaagcaguccugccacacauuauauagcccaugcuccucucaaggguccuugucuugguuuccaagggauaguauaauaagacugaaaguauauaaaguauaaagacaauaacguguguauaauuaagcuaugggaaacuguaaucggccuguaauguagaaaauucuuacguuguuguuccaguauguacuaaagaaacccugauugaaaaucagugagagauccuuuuggaaauuagucauuggagagaccugugugucuucaaguaggcauguauauagcauucaguguugacagguaucagcaugcucuuuacagagccacuaagugagccugccacaggacacacagugucuuaugucuggggcucuuguguggaucucacacagagcaugauacccagggaaguguaagugugaucuggguaacaaggccaugaccugacuccuagguuugcuucuguugaugcacugaggugacaguguguucuuuuucucccuagaacuggccccugggauuugcugcucagaaccugaguucacugagacaucaggagcaaguacuggaggccggugcugcuggacccagaugggagccaugcgggacuugaccauggccugcacacacuucuucccaggagaaggggagugaggaaggugggggucucaaagcuuccuuuccuuucuguuuggcuugauauguuuuauauuuuuuuauccauuuaauuauuaauugugcuggagagauggcucagugguuaagagcacugacugcuuuuccgaagguccugaguucaaaucccagcaaccacaugguggcucacaacuauauguaaugagaucugaugcccucuucaggagugucagaagacagcuacaguggacuuauauauaauaauuaaauaaauccuuaauuauuuauuuaguacaaaaucagguccagccuccuuacauauggcauugauauaaaguauaaaauagaagcuaaauucuaggaguacagcacugcaugcuucugacacagacaaggaaggcuagaacugcacaguuaguggacacuaccuguguaucgacauuucuuucagaccaugaaggaggggacagagagcugcaguuaggacaccuucccugcucuggggccauacugcgauuauguggaaaauguuuccuguagaccaacacaggcacacaccccuccuccuucauccugcuucuccucagccauuuugaagcagggaagauaagggggauucaugaauggcgaagcuugcccauuuuacuguauuucucuccuacugugggcagacuggcaucacccgacccuucagaguauuaaugcagaccuuggugacugagguccaguaccaagugcacagcugugcugagguccaggaacaggaagcagaggggcggguuccaccccgcucagcuggccaugguaaucuacuagcugguguccuacucuccagcuucugaagagaaaacacugcagucucaguuucuguugggucugaggacaagucaaggaagcccugcaaggcacucacagcugcuccugcugucuguauggccgccaucuuccgccauugcuaggaauccugggauggaggacaguggugcugugaguucugaaaccguguccucaugguggcaguagagcuccacacaauagcuugugagugcuucucccccgcccuuugugucugaaaaaacgccaaagauggcuguccuaacuuuuacccaacuuugaguaguuuaaaagguauuuuauuugucauccauuccuuguuaggccaaucugaggcccuaggugguggaacucuuuuacuucaguuaugaagguuauuuccuuuuucugucuuuauaaguggauuuuuacccuuuccagauaguuaauggucuucaaguuuagcaugauuaauuuuguauagguuuuacaugguaaaauuaugcuaggugauuucgaagcacaggacuaugcucagcucaccuccucgugaacuacaugaggcaggcuggccugggccuuuccuggaggcuucuguuuuuccccucagaguuccagaauaucuagguccauuuuaccaugcccagcagacaggagcagguuuuaccuugucuuaaauaaugucagcaaaaaaacccuggucaguugacaauuauaucccaaaggcgaugcccaugcuucucaguuuucuccucugucugccuucauccaccauguuugcccuuugaaggacaagucaguccaagggaaguauaccaggccugaauggagaggggacaguggagaauuacugcugaaaaacaguaacauaggccuagauauccaggauccugggccuuugucucuggauguugguuaugguauuuauuuucaggauugagcuugggagagcaguaguuaaggcuggcauuuguggccauccugcaggcagagcuacagugcagagccauuacagccucauucccaugaguccuagcauuggugaaacaaugccacauaggauaguuuggguuucacacugggacccaguguuuuuccuuuagagcagaagugugggcaccaguaauggcuuggagcugaaaaggaagaccaaaguccaacaguagaucuucuaaggacaagcugacacaucuugcacgcgcucaacuggccaggaagaacggugcugcaacgggacccuucugcacacguuuauugggagagcauugauugcauaggcaaaagaagaagaacaacaaacccgaacgaggaaaaugaugcugcuuauauaccccuccaugugacgugucagcuccugauuagcugcucacucaucaccccacuacuacgccccaggaugggcagugacuuggcacgaauuuacucuugcaccugugcauauuacuuguuuaccaguuaggcacaucggaggcucaugauggcaauugcucacggcuccccacagacacaggaaguugugggccaggccuuugguucuuucuaucuggggcaugacaaguagaaaccccagggaagaaaaugguaggcucuggauggagacuucugucuccaccucuuuguagcaugugcaacaugcuacacauuuuaagauaugucuucuuacuaagaccuagagaaucccaauguagccaagcugugaucuggguaacaaggccaugaccugacgccuagguuugcuucuguugaggcacuguggugacaguguguucuuuuucucccuagaaccggccccugggauuugcugcucaggacccgaguucacugagacaucaggagcaagcacuggaggccgggugcugcuggacccagaugggagccaugcaggacuugaccauggccugcacacacuucuucccaggagaaggggaaugaggaaggugggggccucaaggcuuccuuuccucucuuuuuggcuuguuaugcuuuuauauuucuuuuuauccauaugauuauuuaguacaaaagcagguccagccuccuuacauauggcauugauauaaaaugcaaaacagaagcuaaauucuaggaauacagcauugcaagcuucugacacagacaaggaaggcuagaacugcacaguuaguggacacuaccucuguauugacauuuuuuucagucugugaaggcggggacagagagcugcagccaggacaccuucccugcucuggggcaacacugccaucaugggaaaauguuuucuguagaccagcugaggcacacaccccuccuccauccugcuucuccucagccauuuugaagcagggaggaugagggggauucaugaauggcgaagcuugcccauuuuacuguauuucucuccuacugugggcagacuggcaucacccgacccuucagaguauuaaugcagaccuucgugacagagguccaguaccaagugcgcagcugugcugagguccagggacagaaagcagaugggcagauucaaccccccucagcuggccaugcuaaucuacuagcugguguccuagggcagcagggugccucccucuccagguucugaugagaaaacacugcagucccaguuucuuucggggcuugaagagaagucaaggaagcccugcaaggcacucacagcugaucaugcugucuguaauuggcugccaucuucugccauugcuaggaaucaugggaaggaggacauguggugcugugacuucugaaacuauuuuccucaugauggcaguugugcuccacaaaagaucuuuugauuguuuccccccccuccccgcuuccugugugaaaaauuaucaaggagaauauagguaccaaggaagauugguucggugaacuuugccuguccucgaaucgguucagggaugguuuguuuuguuuuuuguuuuuguuuuuuuguuuucuuguuuuccuucugaagucauucugaguccucauucuacccuagguuguaggccauuuccuuuucuacagcuguucauacucacccuuuuuagcuacuuaauuuugcucuugauugucuagucuuauucauugguuacaauuuucacacaggaaagguagucuaggagcuucgaaaggaaagcuuuuuucaugcagggugauugguauugcugagggcuaacaacccuugccuaccguauccuagagccuggguuugcuccccaggacugaaaugggcacuguuugucauacauaauuaugcagcagggaaauucucagugguaauauuguaaaaccaaccaaacaaaaaaacccccaaaaccagucauggcaguaagcugugaucaggauggaauuguagaaaagcauucaugggcuucucuccuuccuuuuaguguugcccccuccucucugucacuaaaccccacuccauguuccuagugucccucuuuucuccucuccuucuauguacacccaaaggcagaaauacaguucuacauuggcuagccuauauguccuuuaaaaguguucucucucaugaacaaucucugcuuuauuucauuuccaauuaaaugcacacauauaccaagcuguuaauggugcuugcuuuggguaaugauauuuacaauaaaguuuucauuuguucauccuugaugugaagauuggaaagguaauugaagaagcugagcuuugugguuuucgugauccaucccuguaaccccagcacucaguguaggaucacgguagccccgaggccucgaacaaccuggccagccuacacauuggccucugaugguuuuuuauuuuauucauucgcagaaaggcucauggcgucuaugucguaaaugagcuguggauuugcuaugccccuucucuucagcaacccuuauuuuucuugccuguacaucucuacugugggaaucacagggaagcugcugcagcacaacuugaaauagaaagcuggaugguaugaauuuaggacaagaacaugagaagaagggcuccagagaggauucauuaagagcauuuucugcucuuccagaagcauccgaguuuggugugggcacccaagucauuaggcucagagcugcuugguaaguuuagcaccagggguucagacacccccuuuuguccucuguggguaacauuagaagaaacaccaggacaaccaaacacccaauuuuccacuuuaauaguaucagaauauacagucuacauuuugucuguaauacagcugcuuccuuuucuuuggccaacaggucccaauguaauauuccaggcuugaacucuuggcuauccugugccccuuauuuuugccucuugaucaaaggaguagcagugagaugccacguuuggccuagaugauaaaaaacacugaagaaguuauaagaauuuguuaagauuagacucauguuaaugauauuuuaguccagauuuuuccuuccuuucuuuuuuucaccagauagucuuuuuggugcccaggcaguguugaauuugaggugaagcccaggucagucucagaagagcuuagauaagauguccuguuccuccagacucggcuuuacaguacagaccuuuggccuggauugugacuuuuuuaccucuguuaccauaaacacuucauuacauuaccaccuucuuggagcauauaaguugggguaacguagauauacaguccuaagugaaugucacucauguuuggcuucaguaucucuaaucccuuuggaggcagggguuguaguuuugugugaacagugagucuugagaugguaauacagaaacaaaauggcugccuuacaagcuggcucugaguuuaaauggcucuuaguugcuggcauuuuuagucauggaaaaugauuucuuucagaugaggugggugggagaggagggguacacaauggcuccucuacugcacugcuguccccaugaggacauaguuucaacagacuugguaccuccaguuuccuucccaucagggcccuggccauuaggcuucuggaaaaggauugggcauuacuuuuguucuacaaccugaggagagaacugaacccuaccuggacaucggugcagaacuagagggugacauggaccagcagcaaugaggcuauugaauaccauaggcuauugaauaccuguaggugcuuguguaucccggcagugugccugccaagguccaaggacaaucuagaggugguguuuauguccuucaaagagggugcuggagauggagcagagguacccaggcguacauguaaucccaguaccacaaagggugguugucaaccagaggacacugcauaaauucauacguaaagaaaugaguaaaaagcacuuggauuugugauucacgggcuugcuuucuacuuuucucuucaccuacugggcaaauaucacugagaacaucaagccugagcacacaggcuucagagggaauuuaucuagacaaaagagaggcauccugauggugaaggauagugguuugaggucuuugcuuugaauugcgaauauaaaaguaaaauggccuccuaguaaaacuaauugccugagucugcagaggagagaaggcaggcauuuuucuugucuuuuuuuuuuuuuuuccagaccaaaugggcaggggaauagguuguaagaaggcaguguagagcuugucuagagcucuacugcccccaagaggaauuaguuuccacaggacaccagcaguuucuuucccauaggcccuugcuaggaggagggcuggacuuugaccugaagcucauugucuucccaggcaccaggagaugucaggaagcugguauaaauccucaugggacuugaagggcgaguggccugaagugggucacaagugaucagggauucucaaacugcuguucccagcuugcauuuaaaaaugggaaauaacucaaaagacaauugcaaacucucugcagucaagauggcuccugcuuguaaucucaguguucagaagguaggaaaggacuacugugagcaccaggucagccuggacuagagagaagacuuugugucaaagaacgaaguuuuauaaagggcagucuugugggguagaggcauggcaguauacgaagcacgugugcguguuucuguguguuucuugcucuuguccaugcuagaagcagaacuucauuguaccgucacugcucccacaguacuauaccugcuggauccagaacugcggcaggguaagaccagccaggacaagccagugccagguggcacagguguuuggaaaaggccugacguguacccaacugugugaaggaaugggggacccaaaacacagggcaaagaauuaugcuuccauccacgagagcaaaggugugggggggggggcugggggggauagauuccauaugaacauuuugaagauguguaauuggaacaaaauugaauuucauauaagacauaguagcaagcuccauacaguuuacuuuaucguaucuuaaugucuucucaaguaaaauacagaaguccauaaauucaaaauauauacuaauaugaauauaugccacaguuuaaggugaugacaaagacuuuguguaaagcuaugucuguuaauguugacgacuguuagaauguuuuuuaugggcaacaugcauaucuauuuuauaauuuaauaacuaaagggguguucaugaaaaucuugaguguaugagaaugcuguagcuauguaccgaaagcucucagugagcacugcugggugagacuauauuugagaagccagguuuaaacaucuuuuguugagguuuucuuuuuccuaauggauuuugaagaugugguuugcuuuuucuauuuagaauagucauacuuauaaaguccaccuaggcuggccuauaacuggcaauucucucucagucugguauuauagauaugcaaaguuaagcauuaaacaacaaaaauuauguagagaucuucucucaaaaacacuaagaaaaucauaacuucugaguaguuaugauuuugagauuccucccuauacauuuuuauaugugauuccucauauuaauuuuauauguauuauacacaaaauacauucaaguacuuuuaucuauagaugaauaaauauaaauaaaaaccuuaauaauuugccauaaauaaacuacaagacgacuuuuauuggguccugaagagauauaggaguuaagagcacuggcugcucucacagagaacccucguucaauuuccagugcccauauggugauugaccaccaucuaucaugccaguuuccaaggauccagggcccucuucuaaccauuguaagcaccaagcaugggagugcuauacauacauacauacauacauacauacauacauacagggaaaauacaaagguaaaaaugaauaaaucuaauaaaaagagacuucuguguaugaacaaaaaaaaauuccuaagaagcagcuguaugugacugugaguaaaaaccuggaagugguggcgcaugccuuuaaucccagugcuugggaggcagaggcaggaggauuucugaguucagggccggccuaaucuccagagugaguuccaggauagccagggcuagcuacacagagaaacucucuuucgaaaaacaaaacaaaggcaaugaacaaaaggaagaugaaagaaggaauccuggaaggauucucugucuucagaggcugaugaaaucauaguccuguggagagauugggauuuuguggauucagaagaaaauuccuguaucuugggcuaguuuuaggacagccauucauucuuugucccacucacucuguaugugaacuaaugccucaugauaauacauaaaauccccuuaaaagcuauuaacuuagcagaccacuagcuuccaccuacucaagagcuaagaaugucaccagguagcaucuuggagcuacagaauagaguagcuuuccccaucaaguugcacccaccucucccauguguccaccaaugucuuuuaaaauugcccugauuuaugauuuuguuugauguauaaaaguauaaaaauccugugaaacugcuugcacguuggaacauggaauuugggguaaucuaaaccuguguucccaggacauggugacucaaaauggauccagaauaaacaauccuuauugccuuuaaguugagaacuguggucguuauaucaacauaugaauguuuuauuuucuacauucuagaccuugcuaguuuuuaaaagugucaagaaauguccagaaaguagggcuuguuagaaguaaaauacaauguaauuaaguuuauuuaaaaaguuaagucagcuugaucccuaggcacaaaaggccuaggucagaauguggagaauguuagaagucagugugaaugagaaccacuauuggcgcuucucaaaucuugauguuucugcauuuccuuuucuuuccuaggucuggauccccuaggguugccaccaggaucaccagaaaguuuguuaaauagagaagcacuugauagaaggcaccuggauaaggauggacagaaaucagaggccuuggcuaucuggauucugacuucuucaaaaagaugagaugauagaugagagugggugccuuagaucucacuuccuuuucuuuaacauauuuuuguugcugggaugagauucuagccauuccuaauauaaauacuauugaaagcaaagggaaaccgaaaauuuaguucuuguaucugcucacucuuaagacggaauaacaaaaagcugaagccugggucuauugcagauguuuuguuguuuccucagguuggaaugguaggagcagagcaagauccuugaugaugggccaauacuguucucuuauggcacaaguuccaguauauagauaauuucugccacacaaggcccuagaagccccuaaaacugagucuaugggugcucaagugguugcagacucugcuaaacauuacauuauuucuguggguacccugcagccauucauuaguauagucuugauacauaaccuaguaaacaggacccgaaccaaguguauaguuguccugagguacaugaagaauaaguggaggggcagaacuucacaguuugcuuuuuaaaagauuuuuaaaaauuacuuauugggguuggagaaauggcuuuucguuaagagcacugacugcucuuccagagguccugaguucaguucccagcaaccacaugguggcuuacaaccaucuguaaugggaucuagugugccugaagacagcuacaguauacucauauacauaaaaugaaucuuuuuuuaaaaaaacaguuacuuauuuuguacuuguuauuguuuuuaucauuuucuaaucauauguauauaucugugcaagcuuaaguaccuaccaaccccucuuggaugauaggaaccaucucuggccucaagagcagugcauaaagcuuacucauuccuccaaccccaagcacggucucauaacaauuauucccucuguagucucuuagcaagcucauccaugaccacugaauuuccauuggaaaugacugauuuacuaugacugaagaagcuaugaggaacuccaaacucccaaagcauaguaauuccaucggaaagcuuacaaaugucuuccaggggacuaaguaguagacaaaggcuccccaagagcacgaauuuaucuccaggaggagcucuguggccuuuucauacuugaggauuucagguugugguccuaaguaguauuaucuuugacagaggcuaauuuaggcuacuucuucagggucuagaagguucuaaaccuuuuaagcucuuguaacccuuuaauucaguucaucaugugguaagccccaaccauuaaauucuuuuccuugcuccuucauaagggcaauuuugcuauuauaaaucauaaccuaaauauuuuuugguguuuugcugucuguuaccuuucucuauaugguaccuauacucauacaaaaccaaaggcauagguauguuacaucauucucuggaccauauggaauauauauaaaaaaauccuuuguguuuccuaugagauuugccugggaguuuacaaggccucauuguuagcaauauacauacaguaaucuuaauuuauuauauuaugcuauucauauagcucagauucaacuauuuaauaagauguuaguuacuaugauaguaaggcaggaaauaaaggaacuuauaaguagagggaacucauaaauauuaaaaggauauagaaaccauccuauguuaagaucauuggauguuucaaaaaugggagaaaagauacuaaagagaaaagagucaaagggugcuuccaagccccaacggcuccugaggacaaaaacucaacuggccuugacaguaaaagaaaaauuuuaaaaaaagaaagaaaaaaaagaaauuuuggccagcugcauguacuuaagccagcaaaaaguauacucaaagguuaaaauagauguaacuuaacuauuguaaauauauaaauuuuuaccuuugauucuauaaacauaaauuguguauguauauacauauauguguguauauauauauauauauauauauauauauauauauauauauauauauauaucuuacuugccagacauuaggcuuaagucuaugugagauguguuuuaaaaagccauucuucuucuucuuauuauuauuauugauaaggagaaugcuggguagauacaguguuccaaaccuuaguucauucaagacuucagcacuugcaugggaaccuacagacacagucccacucuucuaacauaaaaaccacgugcuaguuaauuaucuucucuuccuguagacacccccugaggggggccucacauuaguauuugagccccuccaacaucucucaaaguacccuuuacugagauagugugcuuuuccuuccuagaaagcccguccgugguguuagagacuuuggccccacacccaugccgugcagcucugccagggccuaccugcuugacucaacccuuuuuguucccucacccucucuggguaacugagagauuuauaccuuggcuauccugggaaugucuuucuaaacuaauaaaauuguucuugaguuuccuucugag

SEQ ID NO: 9486 - RNA, 14227 nt, Mus musculus
auuuucuuaauuugauauaucaacauuuaauuaaauguuaauauuguccaaauuuauuauuacauaguuuccagucaacaaauuuguauuuuggccauuuucugcauauggacuaaguauaugcauuuuaaacuaauuaguauucauuucugaguuagucuaaucgacuaagcauuuuaauuuagggcauauuuuaguauuccucauacaaugucgaaauagcaacuaaggaaucaaguaaaugaaucuuuaauuucuguuuauguacuauaauauauaaucauguguuuaaugacuuccugcuuaaaaauuuaaguuagcaaaucuagaacaagauguaauaugccaauaaugaaauaauuaaagagacaagccuccauaauacagauaucuauuuuauuaaaaaaguuacaaacagguggacugcagggucgucuuacaaaaugacaagaaugaaaucuauuggaaaaaauuuacuuuuacaaaucuucauagguaauuguucaauguuuguacuuguuauucgagauuuuacuguucacugauaaaguuacaguacauuagauccaucauaauagguuacaugacuuuauuugcagagcccuacugcagugauuugaacaacuccuaaacagaugccauaauaaagacaagacauauauugcauuuaauauucauuucuuauccuaauaagcaacaugcaaucuauugaggaagcuaaaauaacuuuuggucccuuuucuuaaaaugugcuggagaaaccaccuuucaaaucccuuuccccugauuccugugauccuaagugaauccgagugaaauuugcugcugaggucaaugacaaugaacgcugugauagagagcgaggugacagaaggcgaagaagggaaggacagaaggauagccauggggaaaaaacuguauaaaaaucaaucugcagaaaauugaagccaucaugaauuauuugauuccuuuagaauuucacagggcuaauaaugaugagccacaagcacuuaagcuacucugaaggagcguuggguuuuaaagugcaaacucaaauuaaguauuuauuucacacaguuuguaaauaaggaacaaacauuucaguugccucucaccgucaaaucccaaauguaagaacacgagcucgcuuugagggaaucugaucaggaaucaaaugcaacacgauuuaaaaaaaggaaaucaaaguuuaaucaguuucuacucauuaauuaauggccaugcugaccaauaagucacaugaauguagauuucacuuuauuugaacaccacacacaauacaaauuuaaacuugccacacccuuccacaaaccaucacugcauauaauagagcuuuuuuugacaaaguuauugagcuauuauuauagaucaaaagcauaguuuugguuuuguuuuauuuagaagcauguucaaaugacuaaagcugggcuccuaaaaucgagagcuuuggugcaguaggugagcugcaguuacuaacuucugcaaauuaaaagcacacaaauaaaaccaaauaaaaccccaaacaaaauacugucaaacuuucacaauugaaaaauaauugcuagaaaaaaggauucgucaucaugauguuaaaagugaacaaaaagauuacucauuguaaguauuuuuucuuuuucuauaccugcguuauugguaaaauguucaaguauucagacaaaaugugcugauuagguaaacaacauggaaggcaauggcuauuagaaagcacauuugcaaaaauaaaacacagccagccagaggcucggcgcugcuuucccuccuguuacacagaucugucucuacuacgaacaugcuucuugaaaaagaacuaaaaagcaguugugauagugcaagaaaacauuaacaaauauugcuuuaaacuauuagucagaaagacaaauauuaagaacuagaaauuguacaugguuuuaucugaauucaguuuuacaugugcagaagucuaccagaugucaaugacaagccugaugggcaaagcugagcuaucucuguuuagguauacaauuaauuuaccauggacacaauaucccuuuucaaaggcauugcuaaguaggucauaacuaaguuuagaacuucacagaaagaaaaauguuacugcugcaauuuaaugcuguaaaugagauuaacacaugugaaggccuaauggaaucaaauacuuaacucuucaacuucaaguaaauguuguacagccaaccuccaauaucaccuguaacguucacaacucguuaauuaccaaaacugcacuugaagaaaagggauaguccaucgauacagguaaaaugugaucuuuaguuucuuuuuacaacacugccacacguaaacaaagucucaaaguauuaaccaaccauuuaaaggagaaagauuuuacaaauaggaugaagcauugguacgagguaauauacagaaguaaccauuuguuuaaggcucaauuuuuuuucuccauuauaucuuucuuuuaaaaggcauugaguagguaauacugaguuugaguaauaaauacaaguugagaaacugauuaacgaaaucaacuaacauuaaaauuaacccuuucauauuagccaucaauaagaacuuaaaaagcuauaaaaggacggauugauaaagaacagauuuaaauguaugguaaacgugcuaagcauuacugugaagguccguggaucuugagggccaaagaccuuaugcacuucauuagauguauggcaacaugcugugauagagacagguuuaccaaggcucaguucugcaacccagguuguaaaguucuccaaagcagcaucugugcaaauuuccucugaguuuguaaucugcaaguaagaccaaagacauuucaggaaaaccuacaaauauacaguagaacauuaacaaauaaccuuacaacaacaaacccaaaggaaugcauauauauauauuuacacacauaugcauauauauacauauacauacacacacacacacacacacacacacacacacacacacacacacacacggauggauggauggauagauagaugauagauggauggauauaaauagauagaugauggauauauggauguauggauggacagacagacagacagauaauagauggauggauaagugaauggaugcauacugcaggucacuagugugugaucaugggaucucgguggaauuucacuguguucucgccaucagcuuaaguaacaaaguaaauuacugcacagguccagaaaagucaucagaagcagaacuguaguaagacugaaccagagagaauacacugucucuguuaccacgugugcuauaauauuaugacacuugccauuuacacauaugugguauucaaaacagucauacugauugaaaugaucuuaccauagagaagcuggggcaaauggcgcuucacucugaacuggaucugucccuaugguaacuggaaauggugguagucuucaauggucacuaugaguuaccuuguuaguauacuacauuuuccagagcuuaguuuugugggaaugcagaauuauucagaguguagacacugcacaugcccuaugcuaaucugcucuuuuuuaugggcacccuugcaaucacaagaacuucuccuguuauagacgccucaguuucuguccuuaaagcugacagauuucugccuuccaucuaauaauggaggagaaaaaucuaucauucagacaaacauuauguccuucagcugugcugagucacaaauuggcuucuagaggaaugaaauuguguuuguuuaauguagaagauaaaaaauguuaucauauagccagaaacuaaagaaaagcaacuaugaaagcaugccaagugaagucagucuaagaucucaacaggcucuagcaaugucuauaaacacgucauuuuaauuucauuugacagcuacacuuguauuaguguucaaagagccugagagaauguguucccauuagcugcaacauagccaucauuacucugaaagaacuucccacucaucauuauugaaauccugccaccuaaacauauuacaaaaaucuucaucuuuaaaaacuaucauaaaagcuuugucuaguuaaaacuaagucuuaaugcggaaagcuaaguauuagacuaagguugaccaaguccaguuuccuuaucauuaaaacagcaagaaaaaugcuucccucacugacuugcuaucucuagucuauaagacagugugugaaaguacuucauaaaugaguauauaaugucagcaauugcuuucauuuccuuacuuauugauuuuuaggccacuaggaucauaucaucaauucuuuaauauccacacuaaggacacuccauauguagagacuuuucaagcuuagaauguauauaccuuuuuuuaaaaacuuauuuauuuacuauauguaaguacacuguagcugucuucagacacaccagaagagggcaucagaucucguuacggaugguugugagccaccaugugguugcugagauuuaaacucaagaccuuuggaagaacagucggagcucuuaaccacugagccaucucuccagcccuguauuuaccuuuuaaaccaaaacaguauuauguuauuuauaucuauaauacuagaauuuucacuagcuccuauuagacuuuccccaauuaauuuuaaacagccugcuauaaauucuaauuaauaauuuccaaaauaaauauacaagagcuugaauuuuucauauaugacuauaauauccuauugaauuuauaaaaugugacggcuuucuguaacauuaaagugauaaaguacuuacuuacuacaaaccggcuuucuaaucacagucuauaguaaauaaacuuacauauccaucacuuuuacccaaaagcccugaguaccauuuccucuauccacaugccugacgaugguacgccaguaaauucugagucacacuccacaauauuaacauugaacauacuuuuaaacaaaauaauaagggccacuuuuuaagacagcaauaaauuauuauucucugcagcaauggauccugaagcaaccucuuucauuaagcgaaaaggacagugucucauauuaguaauauucgagauggaacguguacaugucuugcucuccagugauaggaaaauguucaauuucuuaacacccucauucauuugcgagaaacccacuggcgaauccuugaaggcaggccgucagcugagcacguuuuccuucucaggccaccacacugagccaugcuugcugcaaagcugggaccugcugcuuuccugccauacacaucauaagguaaugcuuacacugucagccagccaacaaaucguacuucugccagcuuguacucacauuugcacuaaacuauuugguuuuuaauauuuuucuaacaaaauuaugagacuaaaaauuagaaacaaacaauaguucaaacuuucucucaguaaaugaaaauggaucucccaagagagccagcuaguacaccaaaguaccaaacacagaccugaaagaacaaagaucauuauuuaugccagccugcagaaaaugggagauucuugauucaggacaaaacacaucauuucaugaggcagcagacugccugggaaguuaacaaagaacugugaggggcuuagcaguuugugaaugucuuuuuagaguuaauagcuuuuacaauuuuaaacacuaccauaauuucuaucuuuuuagcaaauauagaugugcaaccagcuccuuccuuccuuccuuucuuccuuccuuucucucucucucuuucuuucuuucucucucucucuuucuuucucuuucucucucucucucucucucucucucucucucucuuucuuucuuucuuucuuucuuucuuucuuucuuucuuucuaguuugaaacagaugaaauucuggagauuuaagcaaggagcguuccuaaaagaugaacuucuccuuauauuuguacuuggcauuuccauauuugagcucaguauuagugcuauugacgcgcugcuaugugaagaggcaagguauuuuguuggugcugcuguuaccuauguugcuucauuuaucuuaauuuguaugaagcuuauuaaaggcacuggaauaggaugacuaaaucauuaaaaguacucauucucucccauuaaacacagagagcaaaagaugaauccaugucagagaugucuugaauggagguagaaccauucuggaagagaagcaaacaugcucgauguauacgaugaacccagagucaaagggaaggacuuauauuuuucuuauggccuagagcuagacugucaaguguuuaacaugaugaauucaauucuaacaucucaaauacugucaccauguccagugacaugguaauaguguguggccaacgaugugauucuaauugcuaacuuugaaucagaccaaguaaaacacuguuccccacaacugaaaguaguacuuucugaaacugauauucccaauacuguggcuaauccaaggcauuugugcauaugguuuugauuggaugcauuuuccaacaacugacagaacuucaauuucucuuaguuacauuaucuucugacuuguccaacuccaacgagaagcaaucccaggaggcgaacuguuccaguaggaagacuagaaugcuuccucaguggcccuucuccaacuccaugaugcaauuuuuguuaauucuacugaugguucauucuaagccagagagguaauggaguaaaacugaucaucgcacaugcaauucauucuacaauaaaagccuacucuugagguuggaggaagcaauuaaagagggaaaagauacacggagggagucuuucuacugagacacauccacacccagugcaggucuaauuggugccccaauuuacccugaagugucaaacugauaaccuugugggagucagagaagggcugguaagaaucaaggguguuaggaaaggcaagcagcugucugucacuugcacuucaggucugcuauagacccucagguccucugcuccaaugcaugcuucucccuaggucacauccuccucuccucucuggcacccaaggauaaauaggggacugucucuccacuuaaagugcauacuaauaaggcaggacgaaagacagaugcaccuaagggcacuccacuuucuacaacacacauccagcccaggcuucuacucacacaguacugucuaacuuggauaugaaaaugccagcauuuuaugguacauaaugugauuucaucuugaggauuuucauugcacauuugcugaacuaucauaucuaguggggaaaaaacaggaaaaaaaauucagaaacuguucucgguccacauuuuguauuaagagagagagagagagagagccagccagccuugaaaauucuaauccauccuacuccaucuaagaaauaauaaguccagcuagaauaaaaucccauucauagaugucuuagccuuccaggagccuuuguuaccaucccgggcauucugcugccacaugaaaugacgugcuagucuugaaucaagaaucucuccuuuuucuucaggcugacauauauaaugaacuggggcugacauaaauaaugaccuuuguucuuucauuuugcuuccugguguuugguacccauaugaaccauuuacucuacuugggagaaccuauuccauccauaacaugcugaggaaaacauuagaaaaauuuacagaccuucaggccauagcaaaggacaccauucucucuuuuguaaauuuuuucccuuguaacauucauuaauacuggacugaaacauaggacugccucaaacaucauuuuuaaaaacuccauuugugaaaagguuagacccaauuaucacauaagggauaacuuuaaugcauaucuuccuucuuugggggaaauggauagaacauuuaacgguuuuauuaugacucaucuucaaauucuuucuguuuagaaaaaaacaaaaacaaaaauacccccuaccuucccugccucagcaccacacccauguuucaaggcuugacucaaaugguacccaguucccaggcuacuuaacucacugguucuuaaccaggggccauuccaaucccaugcccauggggacuucugucgaucucuagagaaaauaaauuuuaucauaaguggaggaucggaacauaauaucagaccuacuggguagcuaccacguauguugcucaacauuuauaguccuaaacagaggacagcucucaacaacaaaagcccagaguacugagaauuucuguucuuuccuuccucucaauucccacacugcucugaucuucuucuuuuauaguugguuauuaaggaaacagccauucuucucaauagcauuacacucaaacaguacacugucgauugaaauaacagccgccagauauaggagcuacugacuugggaacuaaaacaaggggaagaacacagagcuagauuuuuaugaaacuauggcugcccagucacaguucuacaaagcacuugcaagaaagaagccacuucuggccacuaaggaaaucaggaugguggcuggcucuaaaaaaucugccacacuuccuaauuuacaguaaaaugacugccaguaggaggguaaaaggggaagaaacaaucccaagccaggcccugaagcagguguugggcaacagaguagugacccaaauuaaagaguguuaggaaagaaacgugaggaauucccaggagccauucucagaacacuaauaaaugucccccucacuuaaacacagccaaugaucagcagcaaccauggucuuucugucuuaaguacuauuauuucaaacuucauacaaaguccuuuucuaagacgccagacaaacccuucucaagucaccuuuacuagucgaaguuugaucgucaguuuagaucuggaacugacagccuucagggcuccaugacucauagagacucacaaucuaucacauacuguucaggugacagugaggaaggacgagcacaaacuccacuagccucagguuacagacccacauaccuauaacuucuaucugauuugggcuuagaaaaaaaaaaaucuguauauggugcacacuguucuaaaagauccuucagaaaucugacugauuaaguauuuuauuucaggugcuacaccuucagccugaugcuuuguuuacaagaacaacaacaaaaauaucaagcaaaagcuacacguucuacaaagucaccuaauaaaauauguaauuucuggcauuaauuauaucuaaguuuaguauguuaaucaacaagaagcaugaauacaguugucuugauauauuuaauccaucccaugcacacauauaucccuguaaguaauggaaaaacugaaaucaugagaguauacaaggagaaacaagcucaagaccucauugauaaugaaaacuacuuguaaaaaagcuguagaaacaauccaauucccaacaggaggaaaagccuacucucuggguguaggagacuaaguuugcuuuuauccuccuuuccuauauuaaugucaagaagaaacauuuuaugggauuugguuaauuuguauaaggaugauaaaacucaaaguacauauauuuaugucaucugcucaauuaucagugugagagaagcagaauuuaaugguaaagauacuaucagcauacaaaacuuguucaaaccugaaauugguuuaugauuuaaaagacagauuaugggaucaagaauguaggacucaauugucaucuacauaucacauaaaccugcuccuaccucaaaaacuacacugcaugggugacacuaucagcaauauauaagcuaaacuacagucccagcauuggcuuuauaaaacaacagauguagguagacagaguaaaugaguuugcaucaauguucucagaugguaaaggaugaugagcaaaaccauuuugaauaaagcacuguugucauccuucauuuucaaagaugacacuaccugacaagaguccuugucuagaaagauaaauuagggacccugcguccuuucucuaggcagcacaaauaaagccagaccuuugguuaggaaucaugucuaugaucugaaaugccuguugccauuggcaaagcugcuucuagucuggaggucagcccuggcucaaagaggucacuuucauccugauacugucuuccuacucuggcauucacugugguuuucuuaaucuuccacaguauugguuguuuauauuauuaucuaaguguuagucucugagacuauuaucggauuacauuccagcugaaaagaucaagauaugcauacaaucaucucaugcuaaaugcucaauagcucaaaguuuuacagacccuuauuuucuugaaaucucauuuuaaaaacauacuaucauuugauggaaggugugaaggcucgugguuguucucaauuccauuauuuauuaagccaaggagaaaugaucucugugcucccgauggggucuucagacccaucgcagaggguuuaaccagcuuuucacgucaucagaaggaagugaagguacuugguuauuaccagaggucacuucaguuccccgagggcaagguacagaugaacuugauuaaauaaucauucuguucaaccaaauacuugagugauuagaaaauuggucauuucaauuauaguggcucucuugcccagaauauaaaaauacuaagccguaccauaaaaucauucaucauccugugaaauuauuauugaaugcucgccugugcaucuuggacauuaagagggcuaaccaggggaaagauguacuguggauugaagcaucccuccaaauguuaucaaguaaggcugagaagaaaaacuacaaagucgcuccuucaaaauguaagucucaucaauggcaauacacaccauuucuuaccuuuguucugcuuaucugcauauuaaaaacuuuucugcacugaauugagaugguuuuaugcugagaaaaaaaauguuauuuuaaaaauacagaaauuuaaggugguaucaaauguaugaguguauuaccaucaaccagcuuuuuaauuuuauacuugaucaaaaccaaaagagcccuugguccauagagucccaccacuaaccugcucgguauggccauggcugagguuuucuuuuuuacuggacaacacaaguuguacaacacugaucuugcuucucgggcagggaugaauaguucauuugccugacgaucucagcaaaaaguucauccaccauugauuuacuuuuugcugacguuuccaugaaaggacagccccauucuugagccagagcucugccuucggaagacauaaccucucucucugguuccagauccacuuuguuucccacuaggaugagugggacuuucucguaucucuucacucucacaaucugaucucucauuggcuugauauccuagugaagcaaucacaaagggaaagaacacaauuagacuuuugcauuaccacagcugacaccuuucaaaaucagaaaaaucacuacuuggugacucuacaaagcuaaagucacaucuggaaauaaagacaacaguagcauuuuccccuggugacaugggaacgagauggguugcacuagcugugccuuuugcaucagaaauauaaaacucaagcugugcaccaaccuuaagacuccucuaaccccacccccaccuucagucuacuucgauuaaagaaucauguccccaaauaugaacauacacauguuuggccagcccccuaaaccugccuguugucaccauuccuuguaccaccuguuaucccagcacaggacugcagcauggauggaacuccuagucauuuaacaagagggcuuaagggaaagugguuuaaagacaaggggaaaaggagagagggagagggagagagagagagagaggcagaaagagacagagacagacaccacucgaugcuuagaaauccaguuuuaagauucauagacauaaauaucucauuuuacauugguuacuaagugcuuagcguuguaauagcaaacaacugugguaacagugaacucagcccaagaaggucaaggcaucaggggucugggugagaagucagacauggcuucuuccauguuugcuugccuucugauuuguccacacauauauugcaugggaauaacuguaguucauuacuaaagaucacagcauuagcuauguuucaguaacaucaauuuccgcagagaaugguuuugauauaggaauuuuauaggguuagccagcauugcuuuuuuuuuuccuguauguguccuguaacuuaaagaguugccuuauauauaaauauauauauauuugacuaauuacaguaaacaaaacauucauacacaggucaaauauaccaauucaaucuugucugaacuguuaagcugcuuuucuggguuuccuuauggaacaacaaguguaccuaagcacaccaacuuuugccucaaaggaacccgagucucugcugaaauaaugucagaguuccauacuccguacuuauggcuauaacagaagaggauacaguggaaaugguaugaaacaccuuugaaaagaccagaagagucugcugaaugaaaaacaaaucuuucgaggaucccuuagaaggaaaauaccugucaaauaauacccucagcacuucugggggaaaugcuuuaugcuacuuuuguuuggaaugugagucuaccuagcauguucuuuggagucauuugcccagaacuuauacucuuuacaaagaaguucuugaaguuguuguauaagguuaccagaaaaauucauacauagcacuuuaacuucaacucccaaagaaugugaaacuagcacauuacucuggcuaaggcacuuaauauuucuuaaguaagcaacauuaagugcauaccuuuaaaugcagaaaaaaaauccguuuccuaaaucaauggaggucaauauaacgggucaauauaaggucauuuauuuucaaggaauaaauagcaacaauuagugcaucucuuaaaauaacguuaacuucagucuaguucccggugagggauggagggauuuucugaagcaacuggaccagauccagguuggcuaccccacugggcuaagaaaucugcguucccagucccacauauuuuucuguaaguauaggcuacgauggcagaaacgauauggcucgacgggagaaaaggagagucauccuugcuuucuguggguuaggaauccuagguacuagucuuuuagagcagcaacuuccccuuucggcugcauuccccuaagaaaaaugccaagaaagcaggccuagcccgcauuuugcaccacugagauuuaggcuucaagcugaggaccuuaggagcuaggagagcagggggaaggaaaagcaggcacacagguuuuagcucaguguacgagagaauggacuucaaacaauuucgcccagcccaccgugcuccgcacuugagguuaucuacggaagguuuugugaacacguuaaucgauacuuguugaagugaauaaacaacuucagguuguaccguagggcuaaaaauacucaggcugaccuauuuccuuuucacuuuucuuuuccuuaaaaauaacuuuaaaauauuugucgaugucuguuacuuuagcacucucuacagaaacaauccagggcuuuuccauaccaugccaaacuuucaaaagccaaacacgcucauuaacgcacagcucaagcaaaugagaaguacauguaggauuaccacacccccuucaaagaaauuacaagacuugguuugauuaccugaaaagacuguugauuaaccaaacuauacaccaggaugaaaccuuggccguucuugauguacagaucucucauggaggcaaacugcucgguuccugcgguguccaggauuuccaguacugacggggaagaguccacuucgaucucuuugcgguagaaaucuucaaugguggggucauauuucucaaugaaagucccggugacaaacugcacggugagggcagauuugccaaccccuccgcucccuaacaccacuaccuuguauucccucaugagucucaccuucaccaacuccuuacccaagggggggaaaaaauaacaccccgcuagcugcgcugcggcaaggccaggcggaaggugggcggaaaugugcgaacuggggaggagagugcggagagaggcggagggcccgaccggggacgaggaggaaguuccaggagggggaggggaaaagagccaagugucgucggguggguggggaugggaugcugaugcccuuccuauaggaaccc

SEQ ID NO: 9487 - RNA, 487 nt, Mus musculus
ccaccccucccccccgcccugcgcgcacacacacacaaaggggcccgggguccccgcuuccugccggcgccgcugccugccgagccggcccgaagccuccgggccccgccgcgcgcgcgcgcgcgcucgcucgcucgcuaucgcuggggcggggucucugggcccccagggucccgcggagcucgugugaccuguaacggggggggggggggaggggaacggggaagagggaagaaggggacgcgcguuagguguugccugaccuccacgcuggcgcccgcagccgccaccucugccgccgcuuacccugcuguccuggccacacgcucccagccgcccgggaggcuaagucaagccaaggccauggccaccgggccgcccgggcccugcugcuagcggaaggacggggaaggggcgggggcggaccggcggcggcgguggcggcggcgguggccgcagggacuccgguugaacccaccucuuuuuu

SEQ ID NO: 9488 - RNA, 1165 nt, Mus musculus
uucagaaccagcccaugcagcagaugccuggcaccuguucaguccaucuagaagcauuuucaguggacgaugaggggcccaauucaugguacuccugcuugcugauccacaucugcuggaagguagacagugaagccaggauggagccaccaauccagacugaguacuugugcucaaggggagcaaugaucuuaaugcuggcuguuagagcugugaucuccuuaugcauccagucagccaugccuggguacauggugguaccaccagacagcacuguauuggcauacauguccuugcgauguccacaucacacuucaugauggaguugaagguggucucauggaugccacaggacuccaugcccaggaaggaaggcugggaaagugccucuggacaccagaaccgcucauugccgauggugaucaccugcccauugggcagcucauaacucuucuccaacgaggacgaugaugcagcacuagcuauuucuugcucaaaauccaggacaacauagcacaucuucuccuuuaugucucgaacaauuucccucuuagcaguggugguaaagcuguagccuuauuccgucaggauauucaugagguagucugucaggucugggccagccagguccagacacaagauggcguggggaagggcguagcccucauagaugggcacugugugugugaccccgucaacagaguccaugacaaugccaguggugugcccagaugcauacaaggacagcaccgccugaauggccauguacauggcugggggauugaagguuucaaacauuaucugcgucaucuucucucuguuagcuuugggguucaggggggccucggucagaagcaccgggugcuccucaggggccacacgaagcucauuguagaagguguggugccagaucuucuccaugucgucccaguuggugacaaugcagugcucgauaggauacuucagggucaggauaccccucuugcucugggccucgucauccagguaggagucuuucugguccaugcccaccaugacgcccugguguugggggcgcccuacgauggaugggaacacggcccugggggcaucaucgccagcaaagccagcuuugcauaucccggagccauugucaauggugaguguggagauuucuucuuccauu

SEQ ID NO: 9489 - RNA, 76446 nt, Mus musculus
uaugguugaagaugcauuuacgcaucccuuugaggugagguucagggacacaauccucuuuuaguuagucuugguaacuagcaaaguuagcccuggagauaugguaccauguuuugucuuuuuggaauaaugcuuguuuuaucacauaacauuuucacaugagaauaucccagagauguuauuuuuuauuuucucaugauuuccuucugagacaagauugucacauauccucagcugaccuugagcucucuguguggcugagcaugacuuugaauuccuguuccuccugcuuccgucuccugggugccaggguuccaggcauaugccaccgugcucuguuugugacuugcuaagaagaacucacggcuucaugcguacuagagaaguaaucuacuagucaguauuugcaccccacgcccugacuuuuacauucagugugcacgcggcaggguggggggaguguggaggaaaauccucaugcccaggagaaccagaaguuuuaaguaauaaaagaaauucuagccuaguaugaugauuaaguaacauuguaguugcaagugaacacuuucaggcuugacugccuagauucaaguuuuguuuugauuuuuacuuuuaaugcagacaaguagauuagcaaccugauaaaaaaaugaaaucaaaaccaaacauuuucaagaccauagauccagauaucaagaaucauacuaaacgccgggcagugguggcgcaaaccuuuaaucccagcacuugggaggcagaggcaggcggauuucugaguucgaagucagccuggucuacagagugaguuccaggacagccaugauuacacagagaaacccugucuggaaaaauccaaaaaaaaaaaaaaaagaaagaaagaaagaaagaaagaaagaaagaaagaaagaaagaaagaaagaaagaaaggaagaaaaaaaagaaucauacuaaacaaauucgacaaaauuguaaaggaagaaaaucgaaagccuauugaucagugaaauuauauaaacaaucacucucaaucgggcaucugaauauugacagaguccuaagcuaauacaguugauagaagaugaugaaauucacuccugguggggcuaaaacaacuggaauuucauaaaaauaaauaaaaaagcuucuacacauguucaaaacacauaaaaggaaucauugaguaagucauauugaaguguaaaauauauauucuuagaccuucuagaagaaaauacagaauaggauuuugacuucuggccaggagaaguugccuauaaacuaagaagaacaaaucauuuguaaagauuauuuaauaagaguacaucacauuaagauugcauaucccaaggacaauaaagagcuuaggauguggcucaaugguagaacacauacuuagcaugccugaauuacaucuuuaaugucauaacacgauggccaccaccacccucucacacacacagagagacaaaacuaagaaaauuuaaaaagggaggcuagagagauggcucauuaagaaaauuuacuggucuuuaacagggucagaguuugauucccagcacccauaucagguggcucccuacugccuguaaacuugagauucauggaaucugaaaaccucuucuagauucugacaucacaugcacacacaugauauucacuacacagcaugagugaaugaaugaauaauccguuaauuaaaagaacaauauuuaaaaauuaauuauuuuauguguauaggagcuuuaucuacauguuuaucuuuguaccaugugagugccacuauauuuagaggccaaaagagggcaucagguucccuggggcuaaaguuauaggagguuauaagccacuauauggauucugggaaucuaaaucgggaccucugcaagagcagcaagugcuccuuuuccagaacuauauaaaaugaaucuaaaaaggaaauucaaagacacccauaacacuaagaaaaacuaagaaugcuacuuauaaccauagaauuauuaugacgauuaaguaaguuaaacuuuguaaaaugcuuaggagagauggcuuggugguuaagagcuggcagcucuuuaagagaaccuggguuuaauuccuagcaccuacaggacuccucacaacuauauauaauucgaguuccagggaauucaguucccucucuugacuucugugggcaccaugcacagacauggcauacauacauacaucaggaaaagccaauuguacauaggaaauaaaacuaaggcuuuaaaaauucuuagaauaauacuuaucaucugauaaacauaugcaaauauaaaauaaacauuuguucauugccugcuaugucuuaaauuuuuugaggcagggucuuguauagcccugacuagccuugaaccuacuauuaccuaaggauggccuugaucuucugauguaauuaggguuaggacuaggggucaggacugagcuacaccuccgggccuacaugcugucuucaaauacagaugucccuuuauuacaacuguccuggaaaggaaguacuauuauuauuucccucuugugaaaauaugguauuuuauuaauucuuugagacuuuuauacacgcauagaaucuauuuuaaucacuuuuaccaccaccauuccuccuaaauucucccagauccaccucauuuuccaucuccacuuuuauuuuguuuuuaagauacuaucuauaucucuacccauauccauauguauuauauuauucaggguugucuaaagaacagaacuuguagaauaaauguauauaaaggagauuuauuagaagaaguuacaagcugugguucagcuagcccaacaauggcugucugcuaacagaagauccaagaauccaguucaggugacaaggcuagaugucucagcugcucuuuaguguaugccagaauaaugaagauguaggcucuaaugccagugaaggaauggacuugcccgugaggaggauagcaaacaggcaaauagagcaagcuuccuccuacuguguccauucuuuaagcuaccagcagaagguauggcucagauuaaagguggaucaucccgguucaaaagaucuggauuaaaaaauggguuuuucuacuacaaaugauuuaauuaagaaaaaaaaucccucacagauguacauagccgcuugggcuuuacuuaauuuagcuaauuacucgaguugacaaucaagaauagacaaaacacacacacacacacacacacacacacacacacacacacacauacacauaccaugucugauucaaaagcaaggccccaucuuauugaaaccaacuagcuuuccauuugcaguuacaugggacuuugcucuuugccuucuggacaaaauggauuuuuaauaaacuucugaaacaguuguccuaugagcaaugucugcaggaaucugccucugccacaugccucaguacaggcaaucuuugguuuuguauuuuucauuuucacaauaugcuucaggaaagcucuaaguucccauaauagacauauaucaucagugaauugaauacauauccuagcuuuaaucuuucuguauuuauuuguguguuugggaauggugagcauguaccacaaugugugugaaggucacaggauaacuuaugagaguugguucucuccuuccaacacauaagcucaggaguuaaucucucaucaucaggcuugguaggaagguuagucucacaucaucaggcuugguaggaagugccuuuaacuccacaccucuacugucccauauaaccacuugggucuuugagucugauuucuuuuuagauaaucgacacaaucuucuauagcuaguuuauguuugacuauagacucaucaaagcucuuuugacuguuuucugauaagccugguauccguaggaucccugcugauacuccguacucugggucucacuuuagaauacaaaucuugacugcacauagacacuaacaagcacuacccuggaggcuccuuuucuggcuuccugguagggcugguucuauggagauacccuuuaaaguaacaagggcacaguagccauagcagagguuugagaauuggauauaccugaauuuaagaccaaaucugacuguuuaauagcuaucauugagcaaauuaaccuuucuggaccccaguuuucucacuguaaaaugaagacaauaaaauagaucucuguccauugugauaauuaagugaaguaaugaauguaagauauucagaauggugccuggccuacagacacuaugaaauuugagcucugguuuaugaaauaaccuggaacgauaggcuauuuuaauaaauagcauugcaauuucuccuugaauucccuaaaauucucagguggauauuguuugcuccuauucccaugaaugauuucacuggcauaguuucugaauuaacaucagaacauguuaugcauuuaaaacacugccauccauucugucuauguggcuugacuauaaaucauuacuuaagcaugcuggcucacucugguaaaucucagcucuagggacgcuaaggccagaggaccacccauaaaauucaaggccagccuaggcuacauaguaaguuccaggugagcuaugcuguacagucacauccugucuuaacucuaacccuaauaacaacaacaaaacaccuccauuauaagaaguugaaaaaucugaaugagaaagagugcagcaaagggaaacugggaaagauggguuauugucuuucauauauauauauauauauauauauauauauauauauauauauauauaucuuagcauaauuauuuaauaaauuuaauaaagggucucauguagcccaugcuggccuuucacucaguauuauagcuaaggauaaccuuguacguaaaugcuggguuacuggugugcaauaccaccauagacucugugaggugcuggggucaaacccagggcuuuuguaugcuauauaaguacucuuccaacucaguugcauuguccgauauaagaaauauuugaaaagcaaagcuggcuaaaacaguauuucccaguucaccuacucuuuuauaauaugggauuacucuuuucuacaaagaacuaaauuuauauggcuuuguucuauuuugacuaauauaauauaacaggaaugaaaacauaucuucugaaguugaauuugagggaucuacaauuuggcuuaguuguuuuucuauugcugggaagaacgacaucaugaccaugguaacuuauaaauggaaguaucuauuuggggucuuucuuauaguuuuagggggugaguccaugaccaucauggcagggaacauggcaacagacaggcagcaucauguuggaucaguaacuaagagcuuacauccacaagcaagagguuuuggugguggcuggcauggacuuuugaaaccucugagccuacccccaguaacacacuuccuccaacaaagucgugcuuuguaacccuucucaaugcaauuccaccagcuagugacuaagcauuaaaauguaggagccuaugggggcauucucucugaauccauuaccccaucacauuaugggaaagcuagagaagacacuuguagaguucugcaugcaggaaagcugagacuuugccugagcucuccaacaggaacaagaccaucacuacuucugugaaugaggccauuucauugacccggccaacacaaaaugaaguugaaaaaucugaaaguaaucuaccaguaaguuauuauaaaauugauguaugaaggcauggauauuaguguuguuguuguuguuguuuuacacagcaauauacaauuggcacagaaacauuuaauaaauauguuaagauauuuuaauggaguuuaucuuguuuuugaugacuauguaucaacaauucauauuaacagaggacagugugaucuugaaagccaugugcacaggauacacugauugaaugcagcuugcccuuauguaacuuuauacccauuccaguuuguaguaaacacuauuguaccuuuaggucacuguuuuccuuccucuaauuuccacauauaacagagaacccaaagaccuugucuauucaugccugucuucuuuuacuuagcacaauguucuccaguuccauccauuuuccaucauauuauuacaucuagaagauauagacaacuuccaaaacacaacaucaauaaauaauaauccaaugaaacuaagcaaaucauccaaauauacaccucuuaaaagaaauaugaacgacaaacugguaacugaaagguagucaauaucaacuagauugaccacuaaaaacaaaaugaaacaaaauaaaagcaggagaacacuguguuacuuucuaacagauuugagaggaaaugcucuuccggauggaugcuauuucaggauuaguagcauauagauucauucauguuuguagaacugaccuuucugcuauuuuguuuuaauaauggcucaugugaauugcuaaccauuaaaaacaaauaagcaaaacauuugcugcugguagaggugggaggggugaguuuucucagugacuuucagagagacugagaauugcugaaagaauguaugcuuuugguuuuguguuaugauuuuagcuugugucauugauuuuccuuaccuuugcaucaaaauguuauugccuauuauguuucagguauuaguaagaauaugagaucuaccaaagaaacauacauguaagaacccuaacauguuuuuaauagcugaauggcauuccauuguguaaauguaccauauuuucuguauccauuucucuguugagggacaucugggcucuuuccagcuucuggcuauuauaaauaaggcugcuaugaacauaguggagcauguguccuuauuacauguuagaucaucuucuagguauaugcccaggagggguauugcuagguccucaguuaguacuauguuuaauuuucugaggaacugccagacugauuuccagagugguucuaccagcuugcaaucccaccggcaauggaggaguguuccucuuccuccauauccuugccagcaucugaugucaucugaguuuuugaucuaagccauucugacuggugugagguagaaucucaggguuguuuugauuugcauuucccugaugauuaaagauguugaacauuuuuuaggugcuucucagccauuaaggacccaaggagaugaagggguuugcagccccauaugaggaacaaauaauaagaacuaaccaguacaccuagagcucccagggacuaaaccaccaaacaaagaaugcacauggugaaaaucaugguuccagcugcauauguagcaguggauggccuaguuggucaucagugggaggagaggcccuagguccuguaaagguucuaugccccaauguaggggacugccagugccaggaaugggaguggguggguuggggagcagagggacaggaggggauaggggguuuucagaggggacaccaggaaaagggauaacauuugaaauauaaauaaagaaaauaucuaauaaaaaaaggauaggcauggaugagugcccaaaagaauuucuuauaaaagcaaaauaccaaguguaguccaagcaugccaauuuacugaccccuuucuagaauuuucacuaugacuuuauacaccacugaucaaggggaaacuaacccugugaucucuucuuuauuuacuaguuaaauacauuuauaaagagauaauuugcuuauaccaaaaaaaagaacccuaacaugaauguuguguguauaauaaacucuccguuuauccaccaaaaaagucauugcuuauaacuggugccagccauugucuuccagugucaaagaucuucuccacgauagaucaaggaccuauuuggugugaaggcucaaaaauauacuauaguaaugcugacuguuucuuucuugauuauuaugagggaagccucaggaagugguagcacuguauucagcagaaguuggcccucauauccauggguucugaaucugugauuucagcaacuaacuacaggacaaaagcauuuuuaagaacauauauccccaggcuggagagauggaucagcaguuaaaagccuauacugcucuuccagagggucugaguucaguuucuagcacucuuguuaguaagcucacaaauacagauaacucuagcucccagagguuggauccaacaaccucuucuggcuuucaugggaacuuucacucaugugcacauuccuauacacagucucaugcacaguugaguaaauaaaauauuguaucuguacuucgcauguaaaggcauuuauuuugucuuguuccaggaagucuauuuucaguuauauuaguuugaauucauccaagcaaacaaugccagacaaacacacaaacaaacaacaacacagccucacagccuuuucuaguugagagcuacuuccuuuccuugguaaugcacucauauaauuaucucauggaauaguagcauuccacacagcuagcagaguaauagcuacauauuuaaugcuuuucaacucacacaguaaguugaugaaucagaaauguacuauaauaggauaacuaagaacaagccuuagugaaggacacaccuugcugggaauaugauuuuuuguuuaugauuagcacaggaaaaugugggaauuugggggugucagcacugcugcuuguagucauuugucagaauauuucugaagacccuugacuaauuuugaaauuuaaaauuauuuugagcaccuacaaaguaacucuaaguuccaugaggauacaggcccauuuucccaucaaaugucaacuaucauaacucugguacuuacuggggcaugugguccaaagcaaucaugaguagaauacaugcauaguuuaguguggcuccaguauaggauagaaugggagaaugacaagagauaggacucuuucagauggcagggaaaguucauuauuuauuuguugugcuaugcuaagggauuuugauuuuauauuagcugaugaagcuccugaauaguuuucauauaaccugguaaaguagccauuuuagaaagaguauuaggcauucaaagaggaagcaugcccagguaaaagcuggugauaccagaauagaaauaccacauacacuguggagaagauaaagauggauguaagacccauccuuggaggguagagcuaaccaaguuucauguaagagaucuuuuguuuuucauuacuuauucacuuuacauccugaucacaucuacugcuaguccuuacaaguccuuccaccuauuacucuacucucccugcuucucagagaaggggaagcuccucuuggguaccacccuacuggcccuggacauccagucucagcaggacuaagcacauccucucccacugaggcccaaccaggcaguccaguuaggggaaagggauacaauugcaggcaacugagucagaaauaggccccacucaaaguguuaggggacccacaugaaggccaagcugcacaccugguccaaauauguaggaugccuggggcaugcaagagaucuuugcagggagaagugguuuaauagugauucaccaugaaugagucuaggccaguaggcuaacucucauguuuuagaauagauuuuaaaaugucaugaaugaaugaaugaaugaaugaaugaauugauaaauaaauagaagcaguaaguaaguaagcgacgugguucaaugccuaaaggugcuugcugccaaaucugacauccugaguuugaccccugggacacacaaaguggaaggaaagaaucaauuccucaagguguccucuuaccucucaugugcuaugggaugugugugccccacaaacauacacuaaccagauagacagacagauagauagauggauagauagauagauagauagauagauaacagcagugagguaaaugugugcacaugcaaugugcuaucccaucccagacuccaugaucuccagaguuaaucucacuuuccuccaucgagccuaaguucuuuauuuuaguaugaaacaagcaucauggagucauuuucccaguaauuuggaggauguguuggcuuauaugcaaauguuaaaccauuuuauaugagacguaaucauuugcauauuuaauuguccaagcuggauccuggaauugcucccucacagagacugagggaugacuguacacaacugugaaaauguaaucuaacaucuuguuccacuaagggcuggaaauauagcuuaauuuauagaauguuuaucuaauguacauuuggccauggagucaagacccaguaaagucuaagucugguaugguggcacaugccuauaaucccagcacucaguaggguaaggcaggagauccagaaauucaaggccauguuuuaguacauagugauuuugaggccagccuaaugagcuacaugaauaguuguuuuaguguucuuuucuauacccagcaacuugagcugcaugaaaugcauugaaaagcacuacauuguugaccuguccuggauaaaacccugcccuuggaaagcacaguccuggcuauuaauuauguuucagaucauuguguuugcgugcagaagcuauuugaucauacguagcuaggauuuucaauuacucucagcugaauucugaguaaggacaauuuugccuucaagguaaaagaggaaauauucacaugauucauuuucacaaauaguuagcugucucuggaaaguaacagacccacagucaaaggaagucaaauacuccauagaagcuccagcuucacggugccuucccuugacccaccuuacuauuuuuuucucuaaugguuauuuucuaaaugacgguuuuccaggaauagaugaagcaagccugugaugcaggccauugcauccuggcuucauuuaaacugugcuucacuauuuucuuccugcauuuaguuaggaccccauuguucauuacucuuucaucacucuguaauuagaucaauuugucugugucccuuguauauuggccagauauugaaaucauaaucugagcaucaacggaguguuuuacuuuugguguucacaggcuaauucauuuuacaaugucacuugaucauuuuauaacaugacaggcaaaccuuuaagacaccuggucaaggcaaacaaauauuuacugagcagccacaacaugacaggcacuuggaaaaacaagcaagugcccccaucacugggauacuuauacaugggagaaagaaacuagcaacagauaagugaaauaaucuguauguguauggauaacagguguguaacagaucaauaaaugaagaaaagccuuguuuaucuaaagguauguguucuuucaaauaugauuuuaaaaguuucuauucaguggaugaggacagagugagaacucugguuuggaugaaauauaugaaagaauaaaacaaaauaaaaacuaaugcaauggaugaggggguuacuaccuuucacugaaaucuguaccucauaaauaugaaugauaccaguagcagaauuuagggccuucccaauuaaauuccuuaaggaaaugccuuaagaaauuaaugacccucaaccaaaaaugauacagaaaaugaagacuaccaaccagaaugggcacaagacucagucuaucauagaaccccacugcuggaaccuacauagaccagugcacauuccagcagggagagcuugguucccagagcuagugcugggaugggggcgguguagaaccacuucucaccauccugugugcuugcuggccuccacucuacucuauuacucuggugauucagcugcccagagugcagucuugcuaauauguagccuuuauaguacucagaacuguacuagaugccuguaucuuuaaaugguauuuuguuugaguuuguaguaauuacugaguuugggcuuucuaucaaguccugggauuacuauacaauauagaaaaaauucauuuacaauuuuaguuucuugucauuuuuagcuaaugguaauaaauaucucaucaagucagugugucuccucagcaauggauuauccacuggauaaauaugaauauuuaagaaggccucaggcaaugcuuuuuaacuaggaccucaaggaggugauaaaguccauuuucauguagauauccaaagaaaauugcaguuuguauagggagaauaggcuaugcaccuuuacugagcuguguuaacuuagcuguguuuaagaaucagcaaaggcgccacuuaaauggaguuaguuaagaaaacaggggccacacucagaacguugauuuuuagccaaguaucuacaggauuaauuucuauuaauggauaaguuuguuugcuaccuugaggacuaacuguggggcucaaguaagauggaaguagcaaaugagcaaugcaguacucuaugugagagaugcugguagaucucucuaguuacaguagauacugugaucaguaaaggcacucugaauaauauuuucuaggcugaaauuguaauauuugccaaaggacagaaaaaaaauagacgugagagaaugagaagucaaggaugaaaccaagauuugggucuucucuaggacuugcuuccccuaaguacugucugugaacccauauuaccccacacaaagauacauacagcaucaaauggcccagagaaguaguagaccuggcuugccagaggcagaaggguguuaauggaggagacucaguagcugucuuaaagaggcugcagccaguuuuacuucacuaaaagguccaguagaaaagauagacaggggcagagggggcagggguagcagcaucuagggcagcuauagaaaagacugcuacaugucuucuuugucccccaaccauccaggucaucauuuggccugggaagugaugccucuugugaugcaagcuuugcagaaaguggaaggagcuaagugacaacauuauguuucugaacaagcugauuucauaacauuaaauauuggaugauuuauauaagagaucuauggaaaaaagggggcaugaaaguuaaagggaucuaggauuuggaaggggagagagaaaucgggguauaaaauagcaauagauggagugaguaugauuagauugcuuuauaugcacuuaugggaguaccaauaccacacuguuuugauugcuagaauuuugcaaugugguuuaaaauuauacaugauaucuccaauuugccaagcagaauuuuuucuugugcuauuuggggucuuuuaugguuucauauaaacauuagaauuauuucuauuucugugauaagugucauuaaaauuguucuagagauuguguugaacucauauauugcuuuggguaaguuagagguuucaacaauauuaauuuugccacuauauuagcaaaggauagcuuucuguuuugucucuuauaucaugcucuauaguuuucaguguacagauauuucaguauuuugauuccugggcauuuuguuuaucuuuaauaaguaugauuguuuccuugauuucuuuuucagauaggcagguaauucuguaaaacauaaaacugauuuuuauauguucgcuuuauaucauuuuuggugauuuuaugcaguagaucugacauguuuuucagugugaagagucuaggauuuuuuuuucuuccagcuuauucaauuccuggauauacaauuauucauaauuaucucuuauagucuucuuuuguuucugcuuuuacuguaauucucucuuuuucucugucauuaaucuaagauucguccuucauuuauuuuggcuuugauccuuauuucuucuaauucucuguuuacauuugcuccuuuguacccuaguucugugagguacaaaguucuguccuugugauauuuuccuuuuaauuauuucuuuuaauuuuugaaauuauaauuacaacuuaucauucuaucuuuauuuuauuuuccuuuuuguauuuugagacaaggcaugcaggaagucagacuggcuuuaaaugugcucuguagucgagaaugaccuugaacgccugcuccuccagcucccccuuccuguugcuauauuuacaacauguaugaccaugcccagcucaaucauuauaacuuuccuuguuuuaaagaugcauuuuauuuuauauauacauauauaugcauguagcuauguacacaugaguguaggugccuacagaagcaucaaauuuccugaagcuggaguuaaaaguucuaggaguuggaccuagugguggcgcaugccuuuaaucccagcacucaggaggcagaggcaggcggauuucugaguucaaggccagccuggucuacaaagugaguuccaggacagucagggcuauacagagaaacccugucucgaaaaaccaaaaaaaaaaaaaaaaagguucuaggaguuggaacuuccaucuucugcaagagcaauaugcacucaaaguauuacuuucgucccccaacuguaguuaaguguucauguuucuuucauugaaauuuaauuuuaauccaguuuuaauuucuucuuguugaaucacacaauauuuaguuucuguguauuuguaccuuuugguugauauauuuuuguggauucaauauuugucucauccucuccuuuucuucaagccuaaaaaguuuccuucugucuuuacauccuguaguauacacgagggaccacuauaaucuuuagguuuaugucacaauauuuauucaguuuuaaagaauauuuuccuuggaaaacuuuaggauucguugcacagagauauauuuucuuuacaacuuaaaauuuuaaucaauuaucagggucauauuaacagaagcauggaagacagcgcggcugagaguaaugaaaauuaugacagccuggcucaagaaguuucauaagguaagaauauuaguauauuuugggaagaauauggcugauuuugccauuguccuuagagucugccugagucuaaauugaaguguaauggauuaaugauguugguagaagauauucaaaauagccuaggauuaacuaugucuugugguuacuaaugaucacuccuuaugcagguauauaauuaaaagaagcuagcugaguuggaaaaaauacaaaauguacaguuugagaagaaaaggagcaccaggaaauuuaauggagcucaagagcuuuuuuuuuuuuuugucucuaaaaaguuuaaagaaaagccugaagcuaaaugaaauaaaggcacaagaucccacucagcuaaccuuccaacuuguguaaaggaauuaaggaaaaacuggagcaggcaaguaauccaucaaaaauagaaaacugaugcaaauguaaucaaacaagggggccaaguucuagcagaacucggcaguuucagccacaggauucuggcuuuagagcccccugagggcuaaggaaacacacugaagccaggcaugugucaggggucucucuaaauggaggcccagaguggccauugcacgaaucuguaaagauaaagccuggauugccuugaagaccacuagauacuggagaugccaggaugugggauaucugccaaggagaacugcagaccagagguaaaaccaggccaagagaaagaaguguguugcaguuaagaaaacuaaaaggagguggagauauuuuuauggaguuugaauccaccaaaaaaccugaaaccugaaaccuggaaagauuaaaaaaccugauuuaaauuauaauuagccaaauuuuuauuuaagcugcagcugaccagucucccugguaggauuuuggacuguggcccagcuuaaagucuaugugugcaggggacuuuuaugggccgguuacaauuacuucauuccuguggaauuuacagcuauguaaggaaccacaaagaacaaggacccaccuuacucauagcuauaugagcaauugccucacucacccugaacauagcaaauaguggaauucacagaaaucagcccaagugguuaaucaucucacaacaguuuuacaauucugggaauagggggcaaguagucagaauugcuagcagcuuaucuuuuauguauuuagaaugggugccuagcacaaauuagaguuuucuuuaaccaucacagucugaagagcacuuugagaucagacaugaagaugcagaauuuggagguuucccugauaguuuuugaacuugcuuugguccaguauuuccucuuugcucucuuuuggaaaaauaaugugaaucuugugcuacuguauauugaaaguauuugauauucuuuuugauuuugauuuuacaggggguuacaguuaaagauugcaugagucucagaagagacuuugaauuuuggacuuuuaaauagugccgagacugugauagacuauggggacuuuugaaguguaacuaaaugcauuuuguguuaugaucuggcuacaagccuauggggggcauaaaggggaauauguaguaguuugaauaauaauggccaccaaagugucauauauuugaaugcuuaguaaccaugaguugcauuauuugaaaggguuaagaaguguagccuuguuggaggagggguguuacuagggguagguuuugaaguuucuauagcccauaccaaguccaguucucccccucuguuuauggaucaggauguagcuuucagcuacugcuccaguaaccugccugcauacugccaugcuccgggccaugaugauaauggacuaaaccucugaaacuguaagcaaucacccaguuaaaugcugucuuacauuagaguugcauuggucaugguaucuuuucacagcaaugggaccagugacuaagacaaauaauauuaaaaauuaaauuacauuuauuuauuuuggauaugugcaugugccacagaguaggugugguaguagaagacaacuugcaggaguugauucucacuuuccauuguguugguccuggcggucuaguccaaguugucaggcugguggcaagccaucucacuggccauuauaauagccuuuuaaauuuguuuuucuacucuuuaaguuucuggaucaucuuaaggucaugacauguuaauuaucauccccuucacaauaauggguuacauuuucuugauucuucacaauaguaacuuuggauuguacugugccuucuuuuccagcaauacuuggaucaaauguaggcuuuucaauuacuagucaaguacuccaacacugagcuuaaugcccagcccuggauuauauccugaauggaugguauauuaugagaaucuccauuuuuaauaauuccuugaagaagccagguggugguggcacacaccuuuaaucccagcacuugggaggcagaggcagguggauuucugaguucgaggccagccuggucuacaaagugaguuccaggacagccagggcuauacagagaaacccugucucgaaaaaaaaaaaccaauaaugauaauaauaauaauaauuccuugaagaauguuaggcauuugguuauaauagguucagaccaaaacgucugcccuauuuuuuacugcaugugauucaaaucucauuucaguuacuuaaaacaacgacauacucauuuagauuuaucuuucccacaagucuacgagaggugagucuaagauaucaugguucacauugcaaauugaagaauacauuccuuuucugaugcccauguggcuucaacaaucaccuauucgcauuggcuucuuuaucuguuuuuccccuucagggcagagguggauaauuuauaacccccaacauaucacuccacaacuguggcccaguauuaaaaaaaucaaugagaaguaaaaguagaaaagcagaugccugugaacguugcucuuccauguuaugcucccugcuauaaucgacuucuuuuauuuuuuuucacuuuuuuuaaaaauuuauuuaauuauuuuuauuacauauuuuccucaauuacauuuccuuuuuuuuuuaaauuagguauuuuccucauuuacauuuucaaugcuaucccaaaggucccccauacccacccccccaauccccuacccacccacucccccuuuuuggcacugguguuccccuguacuggggcauauaaaguuugcaaguccaaugggccucuuuuugcagugauggccgacuaggccaucuuuugauacauaugcagcuaaagacaagagcucccggguacugguuaguucauauuguuauuccaccuauaggguugcaguucccuauagcuccuuggguaauuucucuagcuccuccauuaggggccgugugacccauccaauugcugacugugaucauccacuucuguguuugcuaggccccagcauagucucacaagagacagcuauaacuggguccuuucagcgaaaucuugcuacuguaugcaauggugucagcauuuggaagcugauuaugggauggacuucuuuuauuuuugaauaguuaucaggugguugaaauacacaucuuuagaaugauauaaucuacauaugauagaauucauuauuuuaaacugggcaguuuaacauuaagugggcuuccugaugauccucagagauauuuacaacagaaagcacaauuaaauuuaggacacuuuggucaccuuaaaaggaaaucuuuuauaauacauacauacauacauacauacauacauacauacauauaauauauaaguauuuauaaaauauacauauauacauauuuguuacauccugaccaugguuucccuucccuccucuucucucagucccuccuccaucucccacuauccaugcuuccucuuuuucucuuccgaaaaaggucaggccuuucugggauaucaauuaaccaugcauaucaagcugcaguaagacucgguaccuccucuucuauuaaggcuagacaaggcagcccaguaggaggaaagggguuccaaaagcaggaaaaagaggcagagacagccccuguucccacuguuaggaguaccauaagaagaccaagcuacacaacuauagcauauaugcagaaggccuaggucaggcccaugcaggcucccugacugucagugcagucuuuguuguuucuguggguuuucuuuccuguucugggcuuugauaugagugaaauuguauuuugugugguguuggcacucauuuccauccauauuguagugccuuccuccuuuuauggcuugaauaauaaucuauuguuuugcuauagugcauuauuuaggaaggauaaagaccucacuauuuagaccuagauggccugggacuugcuacauagauuaugcugaacuuauacuauaguauauuccuuuuuguuuauucuuuaauaggauagacagacaucugcaauuguuugccacuuugauuugaugaaacauguugcuaugagcagucaugugaaacuuucuagguacauauguuuuuuuuuuccccagucuggacuuagcaauguaguuagugguccaaguaucaacucucuguuaaguuauuugaggacauacaggacuguuuuccaaaccugagagcuaacuuuggauuucuaauuauauaagaauuuagauuuuucugcauccucaacaacacauguuaguaccugauauuuuuguuuagccauccuaggauauuuuuaguggcacuucagugugguuuuauuuucuauuuguucuacugauaacuauugauuuugaauaucuuuuuaugacuuacucaucauugguauaucuucauauuaauuauuuauuuaaauacuuaagcuguuucaaacaguucuuucuacauguuuggaauguuucccccccuuuuuuuuuaaauuagguauuuucuuuauuuacauuucaaauguuauucccuuuccugguuucccuucugaaaacccccaucccaucuucccucccccugcuccccaaccuacccacucccauccuccugcccuggcauucccccacacuguggcacugagccuucucaggaccaaaguaaguuuuuuccucauauaauauauauccucucuuuauccuuccacuucuuacccaucuccccucccauccagauccacccacauucugucucuccuuagaaaacaaacaggccuccauggaauagaacuaaaauguaacaagauaaaacaaaaccaaacauauuaauaagacaaaacaaacaaacugaagaggaagagcacaaggaaagguacagagaucucauuugcauacucaagcuuacacacacacacacacaggaaucccacccauaaaaacacuaaccuggaagccaugauauaacacaaaagaccuacaggguaaaaagagagaaaaauauauaaacaaaauaaaauaaaaauuuaaaaagauaauaauuuaaaaaagaaagagaggacuugacaugacauaaugagauauggaaccuccaaagaugccauugaauucauuuucucuuggccacuauugcugggacugccacccacccuuaagaguaguuuguuucccuugugagacuucuacaagugguuauccacuggaaacagcuucuguguuaggaaugggguauauguccacaucuucuuuuggcucuaggaccccaucuugugcauauccaugccgucccuguucauggugucucagucucugaguuccugugugcauugauccugaugacuuagcagggccuguucuuuuugugcucuccauccccucuggcucuuauaugucucagccuccucuuccacaagauucuaucacauuuacauauauuugacuuucauauuuuuuggauguuaucagaguauaaacucugaauuuuauuuuuuucuccuaagaaucuuggucuuuuauucuuuuagauucauugugugaauauaauugcuuucuuacuuuuauuuuucuguauaugaauguauuguagguacacauguauauguauauacccacaugguuaccagaagucagcuuuaggugucauucccuuaaauccauccauccaccuuuuuccuucccauaauuuuucauuagccuggagaucucuaggucaggcuagcugaccagacaaucucaaaagauccaccagucuuugccucccaaauguugagguuucaaguguacuccaccauuuguuguuauguuaguacuggggaaucaaacucaaauccuuaugcugcauuuuuaaauuuaaauuauuuuaucuuaucuguauagguuuuuuuuuuugccuugauguauaccuaccuguauaugguaccugcaaaggccaaaagagagcauuuauuggaucaccugaaacuagaguuauagaugguugguucuggauauuguacugguguccucuagaaaacagcuagugcucuuaccugcugaaccauuucuccagccucaguucccuuuguuuuguaugacugagaaucucuguaggcauacuuuuauuuuuuggugaucauuauuuucauugaucuauguguguauguguguaugcauguagacauguaugugccugcacacauacauagauacacauauguacaugcaugcauacacauuugcacacacauacacaugagugaaaauaaguggaaacacaccuuagcuuggaguccuuacuauguauaccuuuuuucccuccugcccuaauucuuguguuuaauccuuacacuuaacuuuuccucuucccaaugcacccugauuaaaaccuuccuucauuuuguuaaucauugucucuuuaauuaaucuauugggaugagugccugagccaguacuguuaugagggcuauacccaggucauuuguaccaauacaugcaacucuaguuauaucauuuaggaggcuuuugcaaaauauggauuucugguacuaaccauaguguuguuccuaaggaaggcucagacacuugcauaauuaauuaucccuuuaaguucauauucaugaauguuaauagcagugcuguucaaaauuacuaaaacucugucauuuuucauguugucucauguuaaaugcuucuaaugggguaagaaauaagaaaugaaguagcugggugguggugguacacaccuucaaucucagcacuugagagacagaggcaggcagaucuuugaguuugaggucaaccuugucuacugagcaaguucuagagcauccagagcuauuacacagagaaacugucuugaaaaacaaacugaaacaaaacaaaauaauaauaauaacaaaaccccaaaaaccuaaaguagcaaaacuuagugauuguaccaugcccucugugcauguuguucauaugcaauccucugguuuuccuacuucaucucccacucuccaggccuugugguaguuucuuccagucucuuuugaaagguuaucuuauagguuaaauuucugguucugaccaguccaugcaagcuuuuuugaaugguuuuccaaacuuguuuucaaaagcuugcaguuuaguguuaaaccccuagggacugguuauguguuuuuucuccccuuggacuuuacagaguuuugucaauauccacacaaguucaaaccuccacaaguugcaugugguuuuaugcuagcaucuuugcucagggauuggccacacuaccagccccuucccaacuucccaacuuucugccaguaaaagacacacacacacacacacacacacacacacacacacacacacacacacacacucacacacacgcacacacucauacacacacacacucacacacaaacacauacaguuuguucuuuuacaacuugccuucuuggcacaguugcugagcauuacuguauccugccuggaaaaaugugcucuuauuaauauuuuaucucugucucucuaccugaccuaaacuucaguggcuagucccaccuagccccugucaaacaucccuggccauccaccuauaguaguggccacagaccccagcucccccugagaccuucacaugguugcugcauucuucuuccuccaaagcaugucauaaaaacuccucucuccuucccugcauugcuuuuuucuccuggaaaauggaaaucucacacgcaccuuugacccagaaauuggccccuggcuuucuuuacugacaaaccaagaaccaacuggggagcaggaccuuagcaucauuacuuuccccuucauccacaugcaaagcuuucagcuucccaucucaucuagcugcugcucauuguugugauggcuaugaaaacuccaacuucugaccuaaauuccugaaaacugcaucuucugaccuaaauuccuguaaacucugaccuggcucaguccucagaaguguguaacuauggugaaaugaccaacuuuuuuguuuguuugucuguuuuugguuuucauuuauuauuauuuuuuuuagacaugaauucucuguguagcccugguugugcuggaacuuacucuguagacaaaggcuggccucugauucagagauccaccugccucugccucuccauugcuauaccaccaugccuggcuaacucagacccagaagaagugaggcaguuccucacauagcuggcagcagugaggcaaguuuucagcuagguagaaguuucucacauugcuguaaauuccaccauguugaaauaauuucacauuuaaaaacauuucuuccaccuacauugcuaaggcauuucucuaauuuggcuuagagacugugacucugcuagcaguuuuaacaaauuuggcuaauuauaaucuguauugaaucuaguggacuugaauuuuauuacacuguccccucaguacuguggccccuucccacacuaaaaccaaccaguauucaggcaucuggcaaguuucaaacagcuaagacagaaaaggcaggaaagaacucucaguaaaagggaauaaccauuucugaaggcuaauauagacauggcuggggaaaaaccucugcauaaaagugaaaaaccauuucuaacugcuaaggcagaaauggcagaaaagaacucucaaaaaugggaauaaccacuucagccaaauaagguagaaauggcuggggaaaacucuccauaaaaaugaaaagccauuucuaauggcuaaguuagaagugauggggggugggggggggcacucuccaaaaaagugaacaacuauuucuaccgcuaagguagaaaugguggaaagaacucucaaaaaagaauaacuguuuaaugauaaaagcaaucuacagcaaaccaauagccaacaucaaaguaaauggugagaagcuggaagcaaucccacuaaaaucagggacuagacaaggcuguccauucucgcccuaccuauucaacauuguacuugaaguccuagccagagcaauuagacaacaaaaggagaucaaggggauacaaauuggaaaggaagaagucaaaauaccacuuuuugcagaugauaugauaguauauauaagugacccuaaaaauuccaccagagaacuccuaagccugauaaacagcuucaaugaaguagcuggauauaaaauuaaacaagucaauggccuuucuguacacaaaggauaaacaggcugagaaagaaauuagggaaacaacacccuucucaauagucacaaauaauauaaaauaccuuggcgugacucuaacuaaggaagugaaagaucuguaugauaagaacuucaagucucuaaagaaagaaauuaaagaagaucucagaagauggaaagaucucccaugcucauggauuggcaggaucaacauuguaaaaauggccaucuugccaaaagcaaucuacagauucaaugcaauccccaucaaaauuccaacucaauucuucaucgaauuagaaagggcaaucugcagauucaucuggaauaacaaaaaaccgaggauagcaaaaacucuucucaaggauaaaagaaccucugguggaaucaccaugccggaccuaaaacuguacuacagagcaauugugaucaaaacugcaugguacugguauagugacagacaaguagaccaauggaacagaauugaagacccagagaugaaucuacacaccuauggucaccugaucuuugacaagggagcuaaaaccauccaguggaaaaaagacagcauuuucgacaaauggugcuggcacgacuggcaauuaucauguagaagaaugcgauuugauccauuucuaucuccuuguacuaaggucaaaucuaaguggauuaaggaacuccacauaaaaccagagacacugaaacuuauagaggagaaaguagggaaaagccucgaagauauggguucagggggaaaauuccugaauagaacagcaauggcuuaugcuguaagaucaagaaucgauaaaugggaccucauaaaauugcaaagcuucugcaaagcaaaagacaccgucaauaagacaaaaagaccaccaacagauugggaaaggaucuuuaccuaucccaaaccggauaggagacuaauauccaauauauauaaagaacucaagaagguggacuccagaaaaucaaauaaccccggaguacuacucagcuauuaaaaacaaugaauuuaugaaauucguaggugaguggaagaaacuagaaaguaucauccugagugagguaacccagucacaaaagaacacacaugguaugcacugacugauaaaaggauauuagcccagauguuuggaauaaccaagauacaauuugcagaccacaugaagcacaagaagaaggaagaucaaaguguggauacuuugguccuccuugaaaggggaccaaaauacccauggaaggagauacagagacaaacuguggagcagaaacugaagcaaaggccauccagagaaugucccaccugggguuccaucccuuauacaguuaccaaacccagacacuauuguggaugccaacaauuauuugcugacaugagccugauauaguuguauccugagaugcuuugccagugccuuacaaauacagaagugaaugcccacagccauccauuggacugagcccaggguucccauuggaggagcuauagaaaggacccaaagagcuaaaaugcuuugcagcccaauaggcggaggaacaacaauauguaccaaccaggacccgaagugcucccagggacuaaaccaccaaucuaagaguacacaaggaggacccaugccuccagcugcaaguagcauaggauauucuugugagacaucaaugacuagagaggcuuuugauccuguaaaggcucuaugccccaggguagcagaacaccaguacagggaagcaggagcggguggaauagugagcagggggagcaaaggugggacaggggaguugggggggggaccaugaaaggggauaauauuugaagucuaaauaaagaaaauaucuaauaaaaaaaauggagcucagagcugaacaaagaguucucaccugaggaauaccgaauggcagagaaacaccugaaaaaauguucaacauccuuaaucaucagggaaaugcaaaucaaaacaacccugagauuccacuuuacuccagucagaauggcuaagaucaaaaacucaggugacagcagaugcuggcgaggauguggagaaaggggaacacuccuccauuguuggugggauugcaggcuuguacaaccacucuggaaaucagucuggcaguuccucagaaaauuggacauaguacuacuggaggaucccgcaauaccucuccugggcauauauccagaagaugucccaaccgguaagaaggacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggaggguaucauccugagugagguaacccaaucacaaaggaacucgcacaauauguacucacugauaaguggauauuagcccagaaacuuaagauacccaagauauaagauacaacuugccaaacgcaugaaauucaagaagaacgaagaccaaaguguggacacuuuacccuuucuuagaaaugggaacaaaacacccauagaaggaguuacagagacaaaauuuggagcugugaugaaaggauggaccaucuagugauugccauaugcagggauccauccgauaaucagcuuccaaaugcugacaccauugcauagacuagcaagauuuugcugaaaggacccaauuauagcucucucuugugagacuaugccggggccuagcaaacacagaaguggaugaucacagucagcuauuggaugggucacacggcccccaauggaugagcuagagaaauuacccaaggagcuaaugggaacugcaacccuauagguggaacaacaauaugaacuaaccaguacccgggagcucuugucucuagcugcauauguaucaaaagauggccuagucggccaucacuggaaagagaggcccauuggagacgcaaacuuuauaugccccaguacagaggaacgccagggccaaaaagggggaguggguggguaggggauugggggggguggguaugggggaccuuugggauagcauugaaaauguaaacgaggaaaauaccuaauaaaaaaaaacccuuaaguuauauccuauuaguuaggccuccuaagugugauuaaaggcuuggauagguuugacuauccacaauaagaaaggaaaauuaaguagcucuccauuugaagcaauauuaucuguuugaaguguaaagcucaaagcuuguuuuuccuuuaacuaugaccuacuuaauaaauauucauuagaauaaaaaaaagaauaacuguuuaacugcuaagauagaaauagcugaggaaaaacucuugauaaaaggcauaacaauuucuuucuuucuuuuuuuucccuugguuuuuguuguuguuguucuuguuuuuugagacaggguuucucuguguagcccuagcuguccuggaacucauucuguagaccaggcuggccuagaacucagaaauccaccugccucugccucccgggugcugggauuaaaggugugcagccaccauuauacugcgaaaaaccguuucuagaacucucaauacaaggggauaaccauuucuuaacugcuaauguagaauugguaggaaagaacucucaauaaagggggauaaccuuuucuaaacggcuaagguagagacggcuagggaaaaaccucucaguaaaagugaaaaacccuuccuuucuuucuuucuuucuuucuuucuuucuuucuuucuuucuuucuuucuuuccuuccuuccuuccuuccuuccuucuuucuguuuuguuuuguuuuguuuugcuuuucgagacaggguuucucuguguaguccuagcuauccuggaacucacuuuguagaccagguuggccucgaacucagaaauucaccugccucugccucccgagugcugggauuaaaggcgugccgccaccauuaucuggcgaaaaaccauuucuaacagcugccugagacagcgugaaagaacuaucauuggaaauguaauugaggaaaaaaauauuuaaaaaauauuuuuaaaaaagugaaagaacucucaauacaagggaauaaccauuucuuaacugcuaagguagaauugguaggaaagaacucucaauaaagggggauaaccuuuucuaaacggcuaagguagagacggcuggggaaaaccucucaguaaaagugaaaaacccuuucuuuccuucuuucuuucuuucuuucuuucuuucuuucuuucuuucuuucuuucuuucuuucuuucuuucuuucgguuuuucaagacaggguuucucuguguaucucuggcuguccuggaacucacucuguagaccagcccggccucgaacucagaaauucaccugccucugccucccgagugcugggacuaaaggcgugcagccaccauuauccggcgaaaagccguuucuaacagcugccggagacagcgugaaagaacucucaauacaagggaauaaccauuucuuaacugcuaagguagaauugguaggaaagaacucucaauaaagggggauaaccuuuucuaaacggcuaagguagagacggcuggggaaaaaacucucaguaaaagugaaaaacauuuucuaacggcugagucagaaauggcgcuaaaauucuccauauaaugguugcaucuugagcgcgggcauucuuuuuuugaauuuggcacugaaccaaucagaguguggauuuugaguuacaucacaguggguuuuauuuuguacuucccacaguucuuagaacccccaacagucagaaggaugacacugcaaacacuuuucaccaaugaggaguaaguaucuaggguagggagggucucuaauuaaagagaagaugagaguaaauauuaucccugucaaucuucuuagccacaaccaaucuagauccgugggggucugccuauaaaaggaggcucaccggggugcccagccuccauuuugucucagcuuuuggaguguacagugcuagacacuuuacacucugguaaacaggacagcaaggagacaaaaagguaaagacgguucgggagugguaaaggggagcuucgacugggaggguccacauugacugguaguuuugaacaggggugugaaccagagugaggaccggaccagcucagaccagcgcagacaggaccagaccggaaguaccacagacggcgcagcagcggcagcuguggccucgaccgggaacuuuagcgguaagcauguauggggagugcuuuuuuuuaggagccuagacagguuguguggacugauggagagccuugacugggagagacagggagccgcagcuucucgaagcugucuuaagauuuguuuugaagccgggcguugguggcgcacgcuuauuaaucccagcacuuggggggaggcagaggcaggcggauuucugaguucgacaccagccuggucuacaaagugaguuccaggacagccagggcuacucagagaaacccugucucgaaagaaaaaaaaaaaaaagauuuguuuugaguuuuuuaauuucauacacaaacuauauguaauauauaguucuuaauuacauguaguaugcucuguaucaauauauacagacuaauauacuuccauaaugguacaaauuuauguaggggaacaguaauguguauacauacacacacauacacauuaccuaagagucuauaugugagaaaauauaaugaagcccacuuauuaaaaugguuuuaaaaauagcuagguugaacucuuagugguuaaagugggaauaugugaaaucccagcacuccggaggugggcacaaguauggagcaaugucucugguuaagagcaccaagugcucuucaguucccagcaccgacagacaaggugguuaacgggcuggaaugucagucucaagggaucuguugcccucuucuggcuucuuuggguacugaaugcauagcauauaacaggcauauaugcagguaaaacauccauacauguaaaaucaaagaaauauauuuuuaaacaaugagguccguaagccuuauaagguuagaguuugcuuuggggcucaacuaaguuacauucucaucuuaaaaccugauuuucuugauuuuauuugguuaauuauugcuuuuggaaacucuuguguaugguuuuauaguuuggugguguuuucaaaagugaggaaauucagugauauauuuauauuccuaguuacuaaggaagaguauaugcagaggcuaaacugggaacagugugauagcacaaguuugagcauaaccugacuucaauagccaggcaucucaaaaaacagggagggggagauagagaaccaggguuagaaauagcacaguggcuucuauaagugugauauauuucuuauuccacauuuucagaugguuuuuuaauugugugcuuguuuaaaucuuaaauuguuucuguuauuuucugaccaggaaaaaaaaaucauauccuaagugauugaaucuauaacuuagcugauagcuacuugucuuucugugaauuuuucaggcccccccucauuuguuaauguuauuuguaugguuaaauuuugccaucagucuucuuauacgguaauuuaaaaagaaaaguuucugguuuauggguuuuuuugagugguagcauccuauaguucaauuguaugucuagucaguuaguuguuuaaauugaaaagugugagucauuuacgugaguauggaaauuauauuuuuguuguuuauaugauguguguguucauguguguguaugugugcaugugcacaugugugacacagagcaugcauggaaaucaggauaauuugcaggguucaccuaacauccccugaaauuaaguucaauggaaauugaacuuagguugauaaguuugcagggcaagugcuuuuacugucugguaaaagcuaucucaaugucucagaaagcaaaugugugaacauuuaauaguuugggucaguagaaugcacuuggaaguuguguuuuguaaugggucuuuuugcuugguuaguuuuuagcuuucuguuuauuugagaacaggguuucaugaaggcuuaucugccccuaaccucacuguguagcugaggcuggccuugaauucccuauucugcuucugcaucuuagcugcuggaauuuuagguauguacuaccucucccagccuuuucugugugauguuaaaguuagauauuuuauaguaaaguuguauagaaauuuagaaauucugaugaaaugcccacaagggucuugaugaaauagacuugacauaacccugcuagaaaaauaaugggcauucauugcucacuauacaauauuuaaucauuucuuuuugaucaauucaauaugaauuauaguucauuuagaagggaguguuaaaauuuugaauaguaauuuugauucgguagucagcaauaggacggugcugcuuaccuuauguuaucuuuuucucugcaugccugccuccugccucccaauccauuuucaguucuucugagcaagaacaccuguguuccagccagggagugcuuuacugccuccucacagguaaauguucucaccgaguucugcagaaccuccuuuagagaaucaugcaaaacuacuuuuaugaccugcuuauaguuguuuaaaaugaaaugaagaagguggcauggguacccauuuuaaaaaugacuuagagaaauucagagcauauguaugcugugagaugugauagauauuuuauagaggaccagccauucccuccccuguguuaucacuaaaauagauauucaaacucuuucccugagucucuagagcuccaaacuacaaacagcgauagagucacuucuggggaguugcugaccuaaguuagagacauuauuucuacaacuuauccccucccaaauuuauuuuuuguuuaugugcuugggcacauauauggaggucagaagaguaguuagaucccauggaacuggaguuccagguggcugugagccccaccugaugugagugcugggaacuaaauucugguccucucuaagaacaguauuuacugugaacugcaggcugcccucuagucccacaacuucuuccccagaggcauccuuuuccagcugcugcuuccugucuuucgugcuguggcugugacugagaaacauuaacauuccuaugcucuucucauaucacaagaaugaagucugagcuuuaaguuauuuuuuuuuuuuuaauuuuagaaaaucuaguugacgguggaagaauuaccuggaguggacugcaaaaaaaaaaaaaaaaaaaaaaaacagaacugcaagagucaagagaguguugguguguucagguaccuuuuauggauauaacagugugauuuuugaagagaaugugaaagccagcucuuucugagaugguaguggguaggaauauaagaccuaugcaacaaaugggugauaguaaaugugggagcuuaugggcuuaucccacucauagcauauauuugguacagagguccagaaaacaugcauacgccauauaaguaacaaauaggccacuucugcaaaccuugacccuuccauaucuuuucaaaauguugcugagacuccuuuuuuccucuuuauuuuuuuauuuauuauuuucuuuauauacauuucaaaugcuauccggaaaguuccguauacccuccccccgcccugcuccccuacccacccacucccacuucuuggcccugguguuccccuguacuggggcauauagaguuguugcugagacucuuaaggcauucugggagucgaaaacucacuuagcuuauuuucacuauagguuuuugaauagucugucuacucagcugguuucuaacauacauuucuauauuuuaaacuccuguuuaaauugugaaugaauuugggcaucagaaucugggaaggauuuguguucuacuugcuaaggcaccuugacaccugugucucccauuucauguaaaauggauggaugaauggauuugauuaaguugggugugacaaaaagaaucaauuucaagugaacuucacugaauguuugcucuauauaauaugcauucuuucuuguuacucuuuaggccagagucucuguucuauacagcagcaaauccuaggacuugauugguaagcacauuguauuuguuguauuuuaacucagauuauugucugaguuuuuccccagguguauagagguccuguaccugaacuugaguuuaucuuuacuguuaguuuucuggcuaagaauauaacuucaucaagauuccuuuuuaaaauuuuauuugauauuuaugcaugguuuuccuauauauguauauauaugugccauauauaugccuagugccugcaucugaucacuuagaaaugaagauacaaaugguuguaaacuaccaugugagugcuaagaaccgaaucuggguccuuuggaagaagaacaagcucuuaacuguugaaggaucucccggagacccaggauuuuuuuuucuuuuuuuuaauuagguauuuucuuuauuuacauuucaaauguuauccccuuuccugguuucccuuccaaaaacccccucccccuccuccucuccccuuccccugguccccaacccaccgacucccacauccuggcccuggcauuccccuacacuggggcauagagccuucacaggaccucuccucccauugauguccaacuaggccacugggauuucuuucuaauguguuauagaauugccugucaauuuaagauugaagcauucaguauauuagaauaccaaauuucagacuagagauacuucuaaagaaagauuauauuuuagaaugggggaaaaacaagucaaacaaaccccuaaauauuuaaaauagaaacuaaaacuuuuauacagcauacugacauuucaaagcugauuuauccugaaauuaguuacucuaaagcucuagaaaguagaggucauuguuacuucucuucaagcaguaggccgaggccagaaguauuuagagaaagcguuaucuagaaucagcuaguggagcuugccagccuugggccuaccugaagugguaugauguagauccggaauucuucccggugguaguuuccuuuugaauggaauucuaccuacugcacaguaauauucaaucucuucauuugggaguuuuuggaggaaaaccuaaaaguacuuuaguguguacuuuuguuaaguguuagcuucacauucuaaaguaguuaugaggcugaagaauaugaauuggaaaaucucuacuuggguggauagccuuagaauuuggacacuguaggaauagugaaaauaaccuuauuuggaacucaggcuaaaguguggcuucuagguaccaaggcaguucagauguuucccuucuaccuuaacugugauccacuuugauauccagguauuuuacguuuuaaugugcuaauccauggugugguuuuacucucuuaaaccuuuacuuagauuaaauguguuuucaugcugcuuauuuuauaugaguaccagagagaguuuagauugcaaaggucauuuuagguuaagcuuaugggauaauggcuguuuuauggaggaaaggggcuuuuugcauaguacuucaugaaaaggcacuauuuacacagaagguuuuuuuuauauuuuuuaaauuagguauuuuacucauuuacauuuccaaugcuaucccaaaaguccccauacccuccuccccacuccucuacccacccacucccacuuuuuggcccuggcguuccccuguacuggggcauauaaaguuugcaaguccaaugggccucucuuuccagugauggccgacuaggccaucuuuuuuuuuuuuuuuuuuuuaauuagguauuuaacucauuuacauuuccaaugcuauaccaaaagucccccauauccacccacccccacuccccugcccacccacucccccuuuuuggcccuggaauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucuggguccuuucagcaaaaucuugcuagucuaugcaauggugucaguguuuggaggcugauuaugggauggauccccggauauggcagucucuagaugguccauccuuuugucucagcuccaaacuuugucucuguaacuccuuccauggguguuuuguucccaauucuaagaaggggcaaagugucuacacuuuggucuucguucuucuugaguuucauuacacagaaguuaauauaggcucaauguugacuuccaaauuauuauugcaauaugugcuuauaaggaaagucuagagacuacaaaaagugguguuuaaaaacaauugguuuuccacaggaaaagaaaaaucagguaugugggauuuuuccaguuucucagauguaaaugcuuucacauggaguaguuuuaaacaauuauaaugacauaggugaauacaaauuuaggagaagauacacaauuaguucaucuggguaaguucuaagcagcauugaguagaucuaaaauuacucacuguccagguaucuagucaggaccccucugaacauuuuaauguuacuccaacuaauguuuuugugaaaauauccauauuaauucugagaagauaucuuuauauaaagugucauucucauucaagugucuucauuucuuauuucuaaacuuuaauauucuauauguagggaaagguauaggaacuaauucaauuuaaagaauguauuuuguuaaaccagauaaucuagacagcuuuguaauguguggaauuguaaaagcuguguaggucaugcagauguaugugccguuucaguaacagcauguguagaagcaguaaaaaugaucuacauaguaacuuuggcacuuggugaagcuugaugcagucacugaagguccuaugaaaacaugugaaaagaauucucuuuuguccaguucauaguaagguuuaguguucgaauuggacuauggggauuuauugccucuuauguuagggacaggccuacuugaggauccaaaaggaacuguggaacauauaauuuuaaaagcugugcccgaggccuagaaggagcugaugagguugucccaucagggcuaagucugccagauucuugagguuguacaagugaaauagggaaauccagauagccacaagugccccccauaaaccccaugcagacuuccuaaaaacuugagacuugcgagguuuugugugugugugugugugggggggucuuucauaguuagcauagaggcuuugcuccccuuacucuggucuugauagcugggcaagaacuucacuagacaaugaagggcaaaaaauaaccacugauaacaccaaaggggaaaguggcaggaguuucaauucacaaggaguauagggagccugcuacucagggauuuuuuuucuuacccaaauuuggucucuuucaacagcucuccauucacuguuucuaccugugcugagugccuguccuaagauucugauagagguaagacugagagauacacacaguuuuuuaauuauaaagcagaacaguuacagguaaagauuugaaagcuucugugaauauuuauuaaaauaaucuaaagucuagauuguaagagguacuuguauaauaaacauauccauaacaaagcugcauuuuuuuacuuaaaaccaugcaggcuaugaagauaucucauggaaaucccauuucggugagaucaaguuuucucaggguuccuacauaagcaucuccauagauccgugguuaauauuaaugcagaucauuugaauuaaucaaucuaauuccuccaaauguuuugucuuaggaguuugguuuuggcuuauccuauuuauucuuccuggaauuucagucaucccuaacaugcugauugaagggauugguaucagcuuaggacccccaagaccauuucucagcacaaaggggauuuauuugccccauagggacaaagggcagggaauaucaacaaagacaggagacagaagaugagggagaaggggaagggaacaaagagggaaggaagaaguauuuguccuaagaguagggacaguaacaaaagacugcuuuuggauagaggagauguggcacaguaaaauugcaguuaaaaaggugaaaggggaaaucccauguuaaaaugagguguuuaguuuuaguuuuggcacguuaauuuggugagccaaaggagggguuugauuguuggacuucaauaccuggaucuugguagucagccucaggaggaggaaguggccaaauaagggaauagaucuugggggcuagcuuuaguaauguacuucaacaauuuuuagccaagcugagguuauaggggagaagggaaaggcccgucagaggcauauuugccaugcuuaggcuugauaccuauccauccuuuaacucauuggaguguguuguguuaauuguuuauuguuguauaacucuuauaaucaugaaaugggaaaacuuauaugguauaaggauagguaagaauuagguuuguacaaagacauaaaagaugagaauuuaaaugaaggcagugagcuugaacauguuuuauaaaauccagagagauggcaucuugagcuuugaccccagugccuucagagcacaggacccagucacuagguaacuucaaguggagauuuuguagcuuaggaucuggaaggggaagagaagguaaauuggggacaaaguggggauauuaguuaucuguuuuugaaacugcaggguuuguugucccuuuuuguagccacuugguaucugggguuagagugagcugccugcugacagcuuagacaagugaagacuuuuuuauuuuugcuggggggagagauacaaauaauuacugaagccuuuaaaacacaaauuuaccuaaaccgagucauguccuaaaaacaacucugggagucagcaagggaaguagcuaugucaauuccucccugccaccaagauaauagugccaguuaagggccuucucccucucccucucccucucccucucccucucccucucccucucccuuucccucucccucucccucucccucucccucucccucucucccuguuccucccucccuccuucccucucccucucucucucuuccuccuucacuccuucccucucuuuucuuucuuucuuccuuuccuucuuucuuucuuucuuuuuuuuuaaagauuuauuuauuuauuauauguaaguacauuguagcugucuucagacacaccagaagagggagucagaucuuguuacggaugguugugagccaccaugugguugcugggauuugaacucuggaccuuuggaagagcagucgggugcucuuacccaaugagccaucucaccagcccucccuuccuuccuuccuuccuuccuuccuuccuuccuuccuuccuuccuuccuuucuuucuuucuuucuuucuuucuuucuuucuuucucucucucucucuuuuucucucucucucucucucucucucucucuuucuuucuuucuuucuuucuuucuuucucuuuuugauuaguccugguuuaacauucauugguugaaauuacucuaauacaacaguuucuugaaccaaaaaggaugucaaauacccaauaauccaacauaaaauuccaguagcuugauuuaugucuccucacuaguaucuaacuacguauaaauaacagugagcucuagcucacugccuucauuuaaauucucaucuuuuauuucuuuguacaaaccuaauucuuaccuauccuuacacuauauaaguucucccauuuuaugauuauaacaaugaacaaguaaauaaucuuguaagcucuaaagaaaaagcucaucauaauuaacauagauaugugaauuuguguugaucuugacauuuaaaaaaauuauuuauuuacauuguagacauugccccccuuccaucccccucacacaguuuuucaucccauuccugcuccccuuugccucugagagggugcccucccuccaccaucccccauccccagacauccccuuuuccugggcccucaagucucucugcauccucucaaacugaggucagacaaggcaguccucugccacauauggcuuaguuccugggagcucucaggucuggguuaguugagacugucggucuuccuaugggguugccauccccuucagcuccuuuaguccugccccuaacucuuccauaggggucccugacuucuguccaacgguuggauguaucugugucugucuugguuagcugcugguagggccucucaggacagccauauuaggcugcaguauguaagcacaacauagcaguaauagugucaggccuugauguccccuucccauuggauggaucccaaguugggcaggucacuggauggacuuuccuucagucucugcuccauuuuuguuccugcaguucuuuuagacaggaacaauuuugggucagaaauuuugacgguggguugguaacucugucccucuacuuggagcccugucuaucuacuggaggugggcucuucagguuuccucuccccacugcuaggcauuuugguuagggucaccuccauugaguucugggagccucucauaucccagaucucuaggacuuccuagagaguuccccaacucuccacccccagaagugcauguuuccauucauucuccuguccccugggcuucucuccuguuuuacuccccauaccuaaccaugccccucauuuccccuccccucccccacccaguucuaucaucccucuaccuccugugauuauuuuguucccucuucuaagugggauggaaguauccucacuugagccuucuuucuuguuaaacuuguuauggucuguggguuguauccuagguauucuguacuuuuuggcuaauacccuucugcaagacccaaauagcuagcuuccuagaaauuugaccuuagcuuaggacguuggcuuuuggugaaagaauccuuuauaaaguucaucaaggucuguacagaucuuuauuauuauuauuaucaucauauauuuucuuuauuuacauuucaaaugcuaucccgaaaguccccuauacucuuucccccacccugcuccccuacccacccacucuugcuuccuggcccuggcguucuccuguacuggagcauauaaaguuugcaagaccaaggggccucucuucccaaugauggccgacuaggccaucuucugcuacauaugcagcuagagacacaagcucuggggguacucgauaguucauauuguuguuccaccuauaggguugcagacccuuucagcuccuuggguacuuucucuagcuccuauauugggggcccuguguuccauccaauagcugacugugagcacccacuucuguauuugccaggcacuggcauagccucacuugagacagcuauaucaggguccuuucagcaaaaucuugcuggcauaugcaauaguguugcacagaucuuuuaaaaaguacauugcaccuuuguauguuuauguuugaaccguucauuguuuuuagcauauucuuuuugcagcauacucugaaaaauaaagaaaagaagccuacuucaaagauaaauguguauuccuauaaagaugcacugucuaauguuuagaaaugaacacucauguuuucuuuuauauaaaaugcuuuacaucaccaguuaggaccacauucagggguuucccaguacucuucccuaaucccuauuaguccucauucucacccccuuaagacugacaagguccuuguagaucaguucccacacugugagaagagaaauggaaauuuugggaacaaaggugacacauugugauugaauugacaguggucuuaucuccugcuaguuaucaugauuuucauucugccauucauauuuucuucuccagagaaugaaacuuaagaauagucuaacaaagacaggaaaguaaaaguugaguaugagaugacagaauggaaagaaucauagugacuuuauuauuauuucauagucaacaggucaagaaucugcccacaacuuacaucagaacuaggacaguguuuggggaacaauguuauggauuaggugucuaaugcuuucauuucuuaggcuaguugguaugugcugcauuggcuauuuaucuguuaaacauaugucuagaauuaaaagucuuguagcccucuaaguggcuguuuucagagaugggucaggguuaggcuugagguauaagagguagagaguggagucaugugaguaugcauaguugaaucuaguuuggguuuagccaucuagaaauuucugggugcauuuauuagucacauuuuauaaucauguaaucagaagguauagaagaguaaccacuacucuugggcuggaucuggaccuacuguuuuuauaucaacacucuggaguguuaauauuaggcauagauacaaaacaaggcucucaaacaaauuuccuguagaguuuggggacugauugucugagacaggaaagaaauuuaaccauuagauguuauuagaggaaaguacauuauuuuuaaggauuccaugaagaagguuuggauggacauguuauuuuauuaacucacaaauaagcauuuguucuaguauauuuauagaacaguuugugggccuuuaguaacucguuauuuagccuauauaguauaaggagagugaauuguaaaaucaguguuaacuuugugaauggacuaucauauuucuacuuaaaaaucauuucccaucuuagauuuuugacuaaaagcuguaauuaguuuaaauauuauuauacacugauugcuauacugcuugcaauaaaauaacacccuugcuaauuacaacuucuuuggagucuuuccauuugaauuuuuaauucuaguuuugaaagaauucugugaaaaucaacaacguaaauguuuaaaguuaucuuuccaaaggauuuauucacaaucauuuuguaaagcaaugugcgaauacuuauaaaccaaguaggcuguuuauucuaauuguccaauucaggcccauuuguguucauggacucgucaacaugcugugagagggaaucuuuucgagaagauaugagguuaaccagaugugccuggaagguuccuucauuuuuuuuuuuuggaauauuuauuuauuucauuuauaugaguacacuguagcugucuucagaaacaccagagagggcaucagaucccuuuacagaugguugugagccaccaugugguugcugagaauugugcucaggaccucugaaagaacagucagugcucuuaacugcugagccaucucuccagcccaguuccuucaaauuuuuuucuuuuuccaauuuuuuauuagguauuuucuucauuuacauuucaaaugcuauccugaaagucccccaugcccuccccuccccgcuccccuacccacccauucccaauucuuggcccugguguuccacuguacuggggcauauaaaguuugcaagacgcgggggucucucuucccaaugauggcagacuaggccaucuucuccuacauauacggcuagagacacaagcucuaggguacugguuaguucauauuguuguuucaccuauaggauugcagaccccuuuagcuccuuggguacuuucucuagcuccuccauuggggcccuguguuccauccaauagcugacugugagcaucuacuuuuguauuugccaggcacuggcauagccucacaggagacagcuauaucaggguccuuucagcaaaaucuugcuggcauaugcaauagugucugcguuugguggcugauuaugggauggauccccagguguggcagucucuggaugguccauucuuucaccucagcuccaaacuuugucucuguaacuccuuccaugaguguuuuguucugaauucuaagaagggacaaucuauccacauuuuggucuucguucuugauuuucaaguuuuuugaaaauuguauccuagguauucuaacuuuuuggguuaauauccacuuaucagugaguacauaucaagggaguucuuuugugacuggguuaccucacucaggaugauacccuccagauccauccauuugccuaggaauuucaugaauucauuguuuuuaauagcugagucguacuccauuguauacauguaccacauuuucuguauccauuccucuguugagugacaucuaaguucuuuccagcuucugguuauuauaaauaaggcugcuaugaauauaguggagcauguguccuuauuaccaguuggaacaucuucuggauauaugcccaggaauguuauugugggauccucugguaggacuauguccaauuuucugaggaaccaccagacugauuucuagagugguuauacaagcuugcaaucccaccaacaauggaggaguguuccucuuucuccauauccucggcagcaucuguugucaccugaauuuuugaucuuagccauucugacuggugugagguugaaucucaggguuguuuugauuugcauuucccugaugauuaaggauguugaacaucuuuucaggugauucucagccauucgauauuccucaguugagaauucuuuguuuaucucugugcaccauuuuuuaaugggguuauuugacuuucuggaguccaccuucuugaguucuuuauacauauuggauauuaguccccuaucugauuuaggauugguaaagauccuuuuccaaucuguugguggccuuuuugucuuauugacagugucuuuugucuuacagaagcuuugcaauuuuaugaggucccauuugucgauucucgaucuuacagcacaaaccauugcuguucuauucaggaauuuuuccucugugcccauaucuucgagguuuuccccccacuuucuccucuauaaauuucagugucucugguuuuauguggaguuccuugauccacuuagauuugaccuuaguacaaggagauaagauuggaucaauuugcauucuucuacaugauaaccaccaguugugccagcaccauuuguugaaaaugcuguccucuuuccacuggaugguuuuagcucccuugucaaagaucaagugaccauagguguguggguucauuucugggacuucaauucuauuccauuuaucuaccugucugucacuguaccaguaccaugcaguuuuuaaucacaauugcucuauaguauaguuuaaggucagcauuggugauuccaccaaagguucuuuuauuguuggguauaguuuuugcuauccuagguuuuuuguuauuccagaugaauuuguaaauugcccuuucuaauucauugaagaauugaguuggaauuuugauggggauugcauugaaucuguagauugcuuucggcaagauagccauuuuuacuauauugauccugccaauccaugagcaugggagaucuuuccaucuucugagaucuucuuugauuucuuucuucagagacucgaaguucuuaucauacaggucuaucacuuccuuaguuagagucauaccaagguauuuuauauuauuugugacuauugugaaggguguuguuucccuaguuucuuucucauccuguuuauccuuuguguagagaaaggcuauugauuuguuugaguuaauuuuauaucuagcuacuucacuuaagcuguuuaugagguuuaagaguucucuccugaggaauaccgaauggcagagaaacaccugaaaaaauguucaacauccuuaaucaccagggaaaugcaaaucaaaacaacacugacauuccaucucacuccagucagaauggcuaagaucaaaaacucaggugacagcagaugcuggcgaggauguggagaaagaggaacacuccuccauuguuggugggagugcaggcuuguacaaucacucuggaaaucagucuggugguuccucagaaaauuggacauaguacuaccggaggaucccacaauaccucuccuaggcauauauccagaagaugucccaaccgguaagaaggacacaugcuccacuauguucauagcagccuuauuuauaauagccagaagcuggaaagaacccagaugcccuucaacagaggaauggauacagaaaaugugguacauuuacacaauggaauacuacucagcuauuaaaagugaauuuaugaaauuccuaggcaaauggauggaccuggaggguaucauccugagugaaguaacccaaucacaaaggaacucgcacaauauguacucacugauaaguggauaauagcccagaaacuuaggauacccaagauauaagauacaacuugccaaacgcaugaaauucaagaagaacgaagaccacuuuaaaguguggacacuuuacccuuucuuagaaaugggaacaaaacacccaaagaaggaguuacagagacaaaauuuggagcugugacgaaaggauggaccaucuagugacugccauaugcagggauccaucccauaaucagcuuccaaaugcugacaccauugcauacacuagcaagauuucgcugaaaggacccaguuauagcucucucuugugagacuaugccggggccuagcaaacacagaaguggaugaucacagacagcuauuggaugggucacacggccccuaauggaggagcuagagaaauuacccaaggagcuauagggaaaugcaacccuauagguggaacaacaauaugaacuaaccaguaccccggagcucuugacucuagcugcauauguaucaaaagauggccuagucggccaucacuggaaagagaggcccauuggacuugcaaacuuuauaugccccaguacaggggaacaccagggucaaaaagggggaguggguggguaggggauugggggggguggguaugggggaccuuugggauagcauugaaaauguaaaugaggaaaauaccuaauuaaaaaaaaaagaguucucugguguaauuuuuaauuuuuaggguuacuuauauauacuaucauaucaucugcaaacagugauauguugacuuuuuuuuuuuuuugguuuuuugguuuuuugguuuuuucugagacuggguuuuucucugaagcccugguuguccuggaacucagucuguagaacaggcuagccuagaaucagaaauucaccugccucugccucccaagugcugggauuaaaggcgugugccaucacgccugcuugacuucuuucacucugagguagugucuugucuguuucccugagauggguuuccuguaaacagcaaaauauuggguccuguuuauguagccagucuguuaguuuaugucuuuuuauuggagaaucgaguccauugauauuagagauauuaaggaaaaguaauucuugcuuccuguuauuuuuguuguuagaguuuagauucuguucuuguggcugucuuguuuuagguuuauugaaggauuacuuucuugcuuuuucuagugcauaguuuccauccuuguauugguguuuuccccuugucauccuuugaagggcuggauucguggaaagauauugugugaauuuaguuuugucauggaauacuuugguuucuccaucuaugguaauugaaaauuuggcugggcauaguagccugggcuggcauuuguguucucuuagugucuguauaacaucuguccaggcucuucuggcuuucauagucucuggugaaaagucugguguaauucugauaggcuugccuuuauauguuacuugaccuuuuucccuuacugcuuuuaauauucugucuucauuuagugcauuuguuguucugauuauuaugugucgggaggaauuucuuuucugguccagucuauuuggaguucuuuaggcuucuuguuuguucaugggcaucucuuuauuuagguauggaaaguuuucuucuauaauuuuguugaagauuuuuacuggcccuuuaaguugaaaaucuucauucucauuuacuccuauuaucuguggguuuggucuuuucauuguguucuggauuuauuuucuuugauuguugugugauguucccuauggaaucuucugcaccugagauucucucuucugucucuuguauucuguugcugaugcucguaucuaugguuccugauuucuuuccuagguuuucugucuccagaguuuucucccuuuguguuuucuuuauuguuucuacuuccauuuuuagauccuggaugguuuuguucaauuucaucaccuguuugguaguguuuuccuguaacucucuaagaaauuuuuguguuuccuccuuaaaggcuucuagcuguuuaccuguguuuuccuguauuuccuucuuaaaguccuccuucaucaucaugagaagugacuuuagaaccaugucuugcuuuuuagugugaugguguauccaggacuugcuauggugggagaguuugguucugaugaugccaaguaaccuugguuucuguugcuucuguucuuuuuuuuuuuguuguuuuguuuuguuuuuguuuuguuuuguuuuguuuuuguuuuguuuuguuuuguuuuuuggguuuuuuuuuuuuuugagacaggguuucucuguauagccauggcuguccuggaacucacucuguagaccaggcuggccucgaacucugaaauccaucugccucugcuugccuccugccaucugauuaucugaaguacuuguugcccucacuauaucugauuggaaccuguccuuccuauaaucccaguugauucaggacuccucagaguccagcuuucucugugauccuuugauuuugggcuccugugaaccugagauucuggguaugucagaguucuuggcagucaaguuccccugagacccugaaauacugaugugaccuagcucuuguuauccugggaucuuguuguucuaagauccuaggccuguuacagugccuagaaguggugucuccuuugaggaucguggagcugucugaucagugguccuaagauugcauggagaguccucuagggaccuugggggucuccaccgacucugcauacaaggugaucuggugcuggcgccgaccagaagggacuugugcccuggucaggccgguuuucugcuuccuaauucugucucaggucccgagugauuggauuggaacagaaguuguguuccacucaccagugguccuaagaucauguagagaguccucuagggaccgugggugacucugcacaaggugacccgucacguuccuucaaauuuuucacauguaauuugguaaaaaaugguacauaggacaaaaacuuucuagaaauuauacuuaaagccucccucccauaguuagaucugauaaaauugagaguuacugguuucuuuucuuuucuuuuucaaucuucucuaaaagaagagaaacaggaaggaugguuucacaguuaagagcauauaauagucuugcagaggacccaagauuggugcccagcauccauguuaaguggauuacaaucaucuguaucuucaguuccagaaauaucugauguaucuuuccucuguaggcucuugaacaucuauggguauuccauuagaaauaauaaauauuuuucuuuaagcuaauucuuuuuauuuuugagauucuauuuuaauuacacuauuuuuaucccccuuucaaauucauggccucuuuaaauuuaauacaauuuuuuuaaggucuguuaagacccgaaguuccaaagaacagaacuugaacuucacauguguuaguaguaaaagcuauuucccuauuaggucacuuguauccugcucucccucccucuuuccucuacuuucacuuccuucugucuuacuuccccucccuguucucauucuccaagucagauuacuuucaaaguuguauuugcuuuucuauugcauacccugaacauagccccauuuuacuuuccugguuucuguaguuacuacaggcuauguccucuaagcuaaagauuuggagcuaggagccuuuaauaagagagaacacacauuuuucuuucugggucuggguuacuucauugaauuuuuuuaguuccauauauuuaccuauaaucuaaugauuucauuuuuauuuacaauagauauuauuccauagugugguugugccacaucuucauuacccgcuugucaguugaggacauuucgguuguucccauuugcugccucuugugauuagagcugagggagcgcguauggaggaacaugucaaguuccuuugcgaacaugccagggaauaucugggucauaugagagacuuucagcuuuuuagggauuucccaugcugacuuuuaaaguaucugaaucugucuguaauucuaccagcagugagugagugaggguuuccuuuucccagcauccuugccaguauuuguuguuaccuguuuuguuuaucuuugcuguccugauggggcaaaaugaaaucucaaaaguugucuugauuugcauuucuauaauuguuaggggcaaugaauguuuuugauauauugaccauuuuuaauuauuuggagaacaauucaagucucagaccauuucauuuauuuauuuucuuuuuguuuucuaguucuguauauauuacauauauuaauccuaugucagauguauaccaguaguaguaguuuuguuuguuuuuugcuguuuuacuaagcagacugguaacuuugaggccguuaauucugacucaggucuaguuauaacacaagauaaaaguguucaugcuuuuguuuuuuuguuuuuguuuuuuucugagauggaguugcacuguauuaccuagucugaucuccacuuucugaccccaaguaauccacccaugacaucccauuaugaacugcaauugcauacacuuccaacuuacccaguuaaaauuugaguauucuaguaacacaaccucaaaagacccuucuauucuucaagucauguucuaagcaaugaagaugcuacacaggucagacagauaauaagguagauuggugaucugaaacagaaaguaauauuacaaagagaaaagugcgucuagcaggcauggaaaggcagggagcaaacagcuaauugcauugaggacauugucacaccaauucccuguguucuguuucauacuggaaaaauugucaguagccuuuggggcuacugcauauuguuuuaaauuauuauuaggcuacauuuaaacuuuuaaaaaauucaaaucauugaaaucaaguguuucuugggucaaguuacuauugcuagacuacaggagcuaguaaagauauuacuauauuagggaagcucugagaaaagaaccacauacaaauccucccaaauaaaucauauuugaaguauuuguuauaagucuccauggaaaacauuuuagaagcucuuagaaaaauauuccuuaggcuacaaugucuauuuggauauuccuuugcucauguugaggugugugguuuaguuuuauccacaaugauuuaauuuuauagugaaaauuaguauaaccaaggccucaagcuuauaccagacuauccaaaugaguauauuaauucugcaggcuuuucuucuaacgaggagaauuuuaucagcauggaguagagacauuuuaaaauuauuagacugaaaauagcuuuauaggcacccugaagcuuaaauaugucaguugauaauaauuaaauaacaccaaaauacaauuuucaauaaaggaaaaugagcugguuuuagaaagucugaaagauaaaucagaucaucaacauucuaacauucauaugagaaacuuauauaauucacaucaagcaugucagaucaacuggaaaauuagaguaauuaaauguucaaggggaaggaauuuuauuauacaagcuauaaaaacuugacauggcaaaagcacuugcagagaccacauuuucaaggcacccaggaaaaugcagcaacacugggcuagagccagugagaaauaaucgguuuccuggagaccuuaauaggaaagaaauggaauccuaguuagacacucucagugaacauagguggaccuagaauuucuuaacauaguagaaaaaaacacaaauuccauaaaguuauaguaaaaaugcuuugaaguauacgguggauuaguaaugaagaucaacaaccacuucucuccgggaucucuauccccucuaccuuccucugaccuuuuuuuuuuuaagugcuuguuacuucccuaucaauguauauugucuuaauaacuacuaucuagcguuuauuuaggauaucuacuauuuucucugauaauaguacauuaaugugauuucuccugccaaaauuuguuaauucugcuauuugacuuagcgacuugagccacuguguuccagccuauuaucuggccuuaggucaggaccgcaugugugcaaaaggcagucauuuugcauuuccuucuuauuguuuuuuucuaguucuaacuguagaauaugcuuuugauuuuucauuuuugaaggucauccaguacaguuuuaauucuuacaguaaucacaguaaauugcaguagaguaauuucuuuuuuuggaguaaaauuuuagguacauguguaagaccugguuugagaauuguuuaguaaguauauuucuaaucuauugggccucauauuuaguugacauuugauauagaacucuauauuccaaaaacuguauacuuucauuuucuucugucauuuagggucuuuuuuuuuuuuuuuuuuuuuuuguagucgcaugcuggcccuccuagaccuagcaucuguaauaucuaaguugcuuucuacaugucucugagguuuuugccuaacauucaggggauauaguccuaagauggugaagcuuguuuuacugaacaccauuuugggccacagucgaugcccuagcugugcuauguuucaucuuucuuagguuccauuccuggugauuucuauuagguuccuuacauccaaugaugauacuagcugugcugguaggcaggcaaagaacccauugauucuagucuucagauuuugucucuaauaaguaagaaauagucuucauuucuucugucuuucucuuucauaacaaugccauuucucucccuuaaaacauuauaauguagaguaagauaccagaucuaaguuucuuugucaaaacauccugaaauuugccuuugauaaugccagaccaugaauuuuaauuuacuuuauuuucaugaacuuguaccauuacugauuuuauacuauucccucuagaauugugauaaauaaaaauagcacaaaguuauauguuauauaaaccacucaacauauaaauuaacaaguagaggaaggcaggcuacuuauaggagguuuccugucaagaauuuaaaaucucugacauucuguuuacauauaguuuuuagauagcauguaguugauuaauaaaaagccucaaaauauugccuugguaauccaggugcagugugcuuuaacauauaucaagucauugaaguucugcaguuuacugcaguuuacucuucuaaauguaaaacauuccuucgcucaugccaguucuagagagcuuugcuucagggaugcuauuuuaugcugaaugaaaucuuuucagauucagaacugaucucccacuuacugcaggauuccuuuuacuugguucucuaccugcuucucuugccuauuaauggaccaaauccuucuaccugaauaggguguucaaauuguuaguacaugcaguuagauaaaugagaaaagugugcgcgcacacacauguacacacacaaacacacacacauacacgggcacagauaugagaaauaaucacaaggaaaagagacuaaaagcaaguacaaaccaaacauuaaaguaaaagccugucucaguauugccuuccucugaggaaguggauguggggacccuucaaauugaguuuugcauagaguggguccguaguagauucaaacagguuaggccagcaugggcuuauuugcaagugggggccuucugccuuuccuauuagauuaugcuagcaaacuauggcugcugcuguuuguauuccugcugauguuccagggaagugaauaggaucccucuguuucugaaagcuaagccugaaaacuccccuuggaugaguaccauuuuguugugcccaaauguuaggaucuuuuccuaaauaugaaacccaauauuuaaagauuuuucccuggucuuucucuucaguuuacuguuauucccagucccugcagcuuuguaccuuauguuuuguuuuaggcuuuguaaggugcaggaagguacccaguguuucagggcugccuuucuaccuuuuuguuuguuuguuuguuuguuuguuuuuguuuuuugagacaggguuucucuguguagcccuggcuguccuggaacucacucuguagaccaggcuggccucaaacuuggaaauccaccugccucugccuuccgagugcuggaauuaaaggcgugugcuaccacugcccagcgccuuucuaccuucuuaaaguaaugucuuuagauagggccuccuguaucccagccugaacuuagacucaccauguuacaaaggauagcauuggauuucugauacuucuaccuaccaagucuugggauuaaagaugucuacuaccaugcccaaccagauuaauaguuuacuuuaaaaauuauguauuugugggaggaggaccaugggcagauagcuaaaagguagcuuacagauaacuagcuauaagacuccaguuauaguccuuuuugauaauuacauccuugguauuguuuuauggagagauagccaaugucuucuggaaugacguaauguugauacagccccaaagcccguuacuuguaugugcacuaaacugucauauccgauauuuauguacugaagcccuaaccucccaaugugaguacuaagagaugauuuuaaacuuaauuaugguuaaaugaagucauaaugcugaguuuauaauucuuuaagaucgguggccuuauagaagagaaacagcccagucuuuccuuucuccacccucuccaucugcuuuucuccuuuccccucccugccuucuuucugccaccacacacuugcauacacagaggggcugugugaggauaaagggacaagguaaccauggcugucaggacgaaaggucucacaggaaguaaaaugguagaggaccuugaucuucaguucccagcaugagaagugugagaaaaugcauugaguguugccuaaggcacauguucagucuugaggauuauggcacucugagcacagucagcagccucucacaucuugagagagggaagcacuccaggguauuggccgaaugcacaauaacagauaaggacacucgccauguggaaguugcauguuuacaauuguuuaaagggcaauuggcugucuuuugggguuucaauaggauggcauuucacauaauaacucaauucugaagcugagucuaaucuugauguggaaggggaguuuacauucuuugcuugugauuuccgucaccugacaccuacuguaaugacuuccacugcaagggccauugcuacggcuaugcagcuucaauccaucacuggcaaccuucugagagcuggguaucccauucaaucagcaaccuagugcugugcauaauuaauuacauccguuuucccaaaccccaccgaccgcuacacaucaauucucugaaaaacuaagugaaagcaguauuuuucucaugccuuccuccucaguaagugcagauuuagaggcauguacaaucaaucacugagacuuucagcuuuuuucuuuuuaauuucaaguauucaugaccaugucuguguugaaaauugcaaauggauucauuugaggaugccauuaguaccugagcuccauaaguagcugcuggacuccaggucagucuuugaagcugcauggaguucagccaucugcgugugagcagaagcaaucucugugauugucuuuuaggacuauaacagauguuuuagcugauaaauaacaccuauaauuuagugucaacauuguucaaugaugguaucuaaaagccaguaauucugucggcuaggcuggauugauaagcauauaggguaauagaaugugggacugugguuucaagggcaagguuugcuaugauuauguaggauguaucauuaggcauuauuacaccaaguaauuuauucaaguggauggucuucaauuuucaagucacucagacucuaugugacugauaaguuaagagaaagguucauuaugugcagagaagaagcaagguacauggaaagcuuuaaaaaggacagaaucuuaaaaccaaacaagccccuaaugcauucccccaaauguuaagacacuaguauguuaagacguucucugcuuuccuuauaaaggucucugagcauauuuucuguuggccauuaaggcagagcaaggcaagacagcaauuuugacuugaaugcucagugcuguaaaacuauuaugugaaucuauuuuaguuuggaauagauggaauaauaaauaauaauaaauggaagaugauggugccucaaugcuguuuguaucauuaaaacucaggagggaaacgguaaagggaaugggaaagaagaaaguaaaaaaaaaaaaaauuaauuggagcugugaaaccagagauacuccuacccagucagccauaucuguacuugaaaaauuaaaggcugucuagaggacguggaaugagucacuucuugaaucucuagaaggcuguuaaccuuuugcccacuuguaggaagcacagucccugggauuuagcuuaauucucugcacuggaaaguagagaucagggucaggcaggcauucuuggauuuuauccaggugaguuuaguuacugaaauaaagauccucaucacccaaacucuuccccaggcuaacacaguuccaguacuugcugccauuugugcugcuuccuguaaacagaaucaaaacuccaaagguagcuugggaauaaaagagacucuguacuuagauaggaggcuugaguucagucuagggaacucaaggacuggggaagacuugcagucuuggcucaaaugcugauguccucucugaccucaauguccuuaucuggcaaacuuggcagugaugcuaaagaucuuucauugccuaucaacaccaagcauuucuaaguccuucuguuuacuguccucagagcucccugcucuauggcccaacuguggagagagguggauuuacuuagaucuauggaaaacacugacuaggcuucugaauuuccacaugaaaaauuaaucuguauuuuaaacuugccucagguaugaaucugucucauaucugccauaggaaaaauuagccuucugcuuuaagaauauuuucagaaaaugugcucauaguauuauucaugguuaauuuaauaucuuuaucuuauuuaauccuguuuaaugucauuggcugauuuaaauauauuuuuauauuauuuguguaugucuguguguauacauacgcacaugcaugcauauacaugcuaccacaaacauguagagaucagaggacaauuuaggagaguaguucuaaguuccaaggagucaaaucauaaacugucaggcuuggcagcaggaacuuuucugcugaucuaucuugcuaacucaucuuaccaguuuguauuugcucucucucucacuuuuuugcucucauucuugcucucuuuccccucuaaauucuuacugccuuucuucuuuuuugggguguguguuauccuagagauugagccuaggguauugcagauguuagccaaaugaccuaccacugagcuacauccuuugcuuucacacuuuuugucuugaagagacaggaucucacuaaauugcuugaucagccuuguauucauuccauacccaaugugggcaucaaacuugcaauucauuugucucagguucccaauuagcuggcauuauaggacaggacugagauaccaagauugucaguaugggucacucucagcagaugucagaaaggaaaacaauucaaauuagguguaaggaaguaaaggaauuuguaucauauaacuaagaaacucucagguggcacuuaguauuauauggaguauuaucuuugugucacagcuguacuucuuuucugagucauggcucuuuuaugacagaguucccauaugagcaauuaaagacaguuuuuuuuugugccucuccuauugaagacaccccagauuuagaggaguucuggcucuccuagaaugacuguauguccuauuuuuccacuaauuuugguagauuggaguucccacagugauaaugcaguauucugccuauagauuaaaagaaauaauaacacuucagucaguuuagaccucuaauacucuaacuaaaugucuuccaaguucuuauuuuccugggacuguguucaaaccacuuuagaccucagccugaaaucacaaacauacucauucuccuacuuaaaauaagcaaaaaacaaacaaagaaucagguugaaguuucuuauaauaucuguaguggcauuucuugccuaaauuguaaaacaagacauauaaguagucuuuaagaggagcaucgaucuuuuuuauccgaaaucacuuuuuuugguagacacaaauguauuuacucucuuuccugaaauuucaugugguucggaagcucucuaaacauggagacucacuguguucagugggucacacauaugacaacugaugauacuuacagauugugaucugagugacaaauuuccuuucccagucaggcaugcugccugaaugccaccuuguguguaacugacuguaacugucuucuaaccuuuguugaauucaaacaccacugacaugaaauauaguuuuuucccaucucuggcacucacuaaauuccacaguguagaggcacguuuugccaaauucuauacugaaagggguguuaccugaucuugcaagauguuucauguuuuccaacugccuuguucuuuuuuuuuuugucuuuuuuuucccauuuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcucugggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauauucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcauccucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuuaacugccuuguucuugaugaugcagaucacucuucuuuaacuucaucuauaucccuuugucacccccauccuuacauacuaaagcaaucaacagugugaaaaagagaauuaaauaguggaaugauaggaagaugaaauuauugcaaagagcucuagaaacuuaaauaaguggggucucaauuauuugauuuauguuuuauagaauucuaucuuaggcuguuaaacuuucuguuuaaggguuuuuuucccaacacgagucugggugguuugcaauauuauuuacucacguuugacuucauauaaguaaaaaacauuuauuucauagauuuccagcuucagggucauauauauaagaguuuugcuaguugucacaccacagagaauguguugguaguaaauuuguuccuuacauaguaguucaagauuauugcaaaaggcugcugcccuugugaucaugcaguuuccccuuccauucuaaagguguuagcuuuccaguucaguugauguaaaauaacuuuuacacucucacccuuuggacuuaaaugucaugcuccugcauaguccauggucaacuucaugcaacaaaugcucuggcaguuguuauaguuggcccagugacaucuucugggaaccauauauauaaguaguaguuuuacugauuuaauuucaucuuuguucaaaucuccugaggggauagauaacuuauuucggcuauucgcuauauguuuaauugucuucuguuucacauacuugccuauuccagugucauggcuauacuuagcuggugaaaaaggaaaaagcaaaugguaaauagcaaaauaaguccuuccggucaugucuucuuuauccaauaaacucaguagauuagugcugucugucgacugcuguguuccauguacucugcaccauggaagagguguuagacaugugggagaucggaguuaggucacugagacuucaguagcugucccuugaaaguacauacauuuucuaaaacuggcaguguauuaaacuaugccuacucuaaucuuuuauagaucauauauguauccaguagaauaacuauuuacaguuacuugucaguuauuuagguuguuucacaaauaauaaaugguauaucaacuguuuuauuauuugcauacauggauacauguagcuccugcuacucuuaauuucuuaaaauaaguuaguuugaugcuuccucagauguuauuaaucacauuguggcuguagcuagaggugaagauaucuccggagaguaaacauuacucuuucuccccuagauugcaaugcuaacugcgcucuucuaauaaaagaaccuuaauauggaaaaccgcaugcuugacagcaacccaccacuucagcacccuaauuagaacauguugaaaauccugaguauuuguggcacuuuuuuuucccccaccuaaaaauugauccuuaccaguaaaucauuccccuagggucuaucuagcuucucuguaugguuuuauccccucaacagagaaguaaguagccaagcagcauaagcaucuauacauugaaaauauccuggacccucuccgagauccacuuucuuuguuuacacauagccauccagaagacagaaguauacaagggauuagugaguucugaacgcagaccuuugcuaugaugacagacauauugacuguauguacuugauagcaaaagaauacaagggaauuugaucaaaucagucauuuauucaugagccuauuuucaucuuuugggaaugaagaacuuggacaaauuuuuacagcauaaauuuuaugcuuccauaaagggcauagcccugcuucaguguuugaaacuuauaaaaucaacacucucaaaugaaaaaggacacgagaaauuucugaagacaacuacaguaaaaacuaucuagcacaacucacugucacuuccagugagaaaauugcaaguucucaaagaaguuuucauuaauucugacccuugucaagagucacugagcaaaucgauacauuauugauuaaccuacucuugugaacguauuuuucuuccuuuuucauuuguauaucuauaugauuaagugacauaucccauacaagccuguguaauuacugagaaacuucuugggggcaagcauaugugggucacauuuguguuuugaagagacaaauaggcuauaaaagaaagaaucuguauuucuugauacuguuggcuuuaaauuggcaccagguauaauaugucaauauuaaauauuauuuguuauaccauuugcauagucacagucaugaaaacccaugggcauguaauacagaaaaguuccaauccaaauauuuuugaauggauucaagaacuuguuaguuaccccaugccuccuaaaugcaagccaaucccaucauuuugcccuauaaauaaaugauauuuucuuuuugaguuauugcucuuuucucauuuauuauaucuuuaccacaguuuccccucccucuuccccuuagaaaagagcaggccucuaagggacaucaaccaaacccagcauaacaagcuacaauaggaccaggcauauacuaccacaucaaggcuggacaaggcaauccaaaagugggaaaacugucguacaaguauaccaaaagagucagggacaaucccaagucccacuuugaggacuuccacaagaaccccaagucacuuagccauaacauauauguagaggaccuaggucaggacccacccccaccccccuuacaggcucccugaucucaaguuuccaugagucccagucaguugauucucuaggcuauguucuugugcuaugucccugaucccucugguuccuccaucucuuccuccucuuuagcaguacuaauuguauuuaaagauaguaaauauuaagacuauuucaagauauuuuuaaaauagaaugaauaaagucaacuugagauuuuuuuuccuauucaaaauuuggaagucauucugauagauuuuuguuugagcccugguggcacuuacuacauuuuccagguucuuuuugcaaacaguggcuauuuaaaauucucuuaccaaguuuuaaaccuggaauguguuuauucuuaagucagaugaagauugacuucccugcccucuuugccuugguaaggaaaaugcuguagugcccccuugugucguguggagucuaaaacaccccugauugaaccccaaagcugaaucuacuccacuaauauccuuaaagugucuccuugcagcuuuggggguaagguauggcauugcuauaaagucaaguauaaaggaauccuuguaagauguuauguucugcuagauaaaaacuugaacuugcucacuacucauuuggaaugagauguuaacucuucaaaauuguucuagcggucauaaauguuccaaggaugacguugacccaagggagauuauuagaauaauggaugggcuuaacucuuauuaccacaggcugucuuugccuguuucucauuuguuuuccuuacuuagacuucaacauccuacuuucaccgaggcauauaguacaaaaaaaaucuuauaauuuaucuuagauuuucccucacaagaggagaugcucaaguuucgggcauaaauccaaagucaguaucuauacauauaucaccaucuucuuacuugugauacuuguuucuuuuagaagaacugugcuuuguggaacaggaaccuagauuuaccugggcuuugaaguuguugcuaugggauagagccuaaaccuauuuauguuggguaguagcucucuuuagucacaugucagggguauauauuagcaaauguagcaaagaaugguuuggacaagagaauacauggauuguuggacgcagacugauaguucugggcaaagagcaucagcaugggacaucauauaaaacugugcuuaaaggucauccugggaagacaauuguaguucgguaaguuuguacacaaagugugagaugggcaacuguauauaggaguuuuggggaacccaaggaauccucuugcaguggcaguuaauauuuaguuggucuaccuugaacuggcuacagcccuaccuuuugguucaucuugaugaauauuagaaccagugaauccccauauaagaugguucuaaagcuuuuucuuuuucuuuucuuuucuuuuuuuuuuuuuuuuuuuuuuuuuuuuuuuugagacaggguuucucuguguagcccuggcuguccuggaacucacucuguagaccaggcuggccucaaacucagaucagaaauccaccagccucugccucccaagggcugggaucaaaggcgagcgccaccacuggccggccuaaagcuuuuucaauucaauauuaauuucaacuccuaaucuuauuucagaugccccugaaacuugauuaccuucacuauuguucagaucauaugcuuacuguuauguuuuuaauaccaaacuaacugcccacaagacugacuagcagccuuggauucucuguaucucugaaagaauucaaacagaugacauuuucuuuauucucuccaacuuuagucuagacugugaucucuuuaaguuuaauguugccuuguuguuaaauuugguccuagaccuaccuucucauuuuguuuuuagccuuugguaauuagagaauguggauccacaguagugacaggcacauagaaacggcuugagaucauuaauacugugucuuaacuaggguacaacauacuugcuagggaaggaguaaauuauuuucuggacaaacuuuugcagugauauuuugcucauguuauuugaugguuacugcuccauugugguucuccuguacuuugggacagaacaaguucccuuguugcugugguuuuuccccauuuuuucuauugucucuauguucaucuaaugacugggucuuuguucaaaaugucuaugagauuagaauguaucauauggcagagacaggggagagaaaagaaaugagaugaaaaguccaugaaaacaaguugaguucuaaugcuaggcuagaugccuaagaucaagaggaaaacaacaacaaagguuggcuguuagcugcauacauaaggaaaacgagcaagacccuuuuuuguuuagccuucuguauauuagacuuuuuguuuuuaagcugucagagugaucuagugaccaacauguuguguuuaagaaacaauggucagcagucugcagagucaaauguauauaccaccacauugguaauuugugcauauguguaguaaaaugauuggaagagaggauuagcaguaaaugggauauaaguuuccgacaauaaaauauuuagacauaaaggcagaagccccacccaugccuguucucaaacguugacaacuaccacaggcaaaagcugucacuucugcaagugagaagggaaguaagcagucaccacuguuagugaaauucucuucuugggaugcaaaccuaccaugugaaaucacaaacuuucuuauucauugugaagaacaagucaauuccugcccuuuguaauacuuaaaaccccacggguaugcauguuuccaagacuuuuuagacucacaauccgguuuucuguccuaauagguuguuuucccuuggcauauacacacacugcugaguugggaagcugcuucauuugcauuuagcauccagugccagucucugguaaguugcguucucuuacaauuuucuguaccccuauaaugggucgaaaaaggcaucucucucagguagucaccuuuuccugaaacuuccguuggcaugauugcuucaugggauuguuuucucguuuucuugagacauugccuauauaacccagacugguuaugaaugcccuguuuagcugaaggugaccuugaauuuuuuuuuuaauucuccugccgcuacuucccaaggguugggauuaaaggcauguacuuaccacaucauacacuuugaaaacuaaugugacuuagauuugauucaauaaacuauaugguaccucaaaacuaagcacaacuucgguuauaggggaauaccuauaccuauaccucuuuuucugcccucuggauacuaggcucacaugaugaauaaacaugcaugcaggcaaaacacaaaauaauaaaaauuuaagaacacaguggagguugguggcuccugauccccccccaaaaaaaaccacucaauguugaccuuugaccucuacacccacucauacacaaauagcaacaaucucccuuacacaauacaaaaagagaaaauacuaugagaaguugagggggcagaugauaacacauagacuuugguaacacauggauuggcuuuuaauuaauacauuuuuccuuguacugcuauuguuuguauuauuugucugauaacuucucugagagcaggaauuuuuuacugccuuauauuuuucuuugucccauagucaacuaaauaugaaaagauauuuugguuaguaggugaauaaagaaacaauaguuagaaauaaggccuauaaaauacuaagaugauagguuacaguagagaaagaauuaaugccaagaauuucucucaugcuguauauagcaaauacaugcuuuuucaugagagaacauucuuuagugaaauaauauuuaucuuuugaaaauuaucuaugcauuguucucagcuaugucuuauuaggagcacuaacauaaucauuuuuaaagaauaaaaaacaugcucugccaaaucucucucagacagaauacaaagcuugaauaguucaugggaacaauuugcuagucuagagaauucuuccuauuuuggucaggaccuccuauagagugauuuaugugcaguuuaugucaagaggcgaaguaauggcauuucucugcuauacaaugauuuggaugugugcugaguguggaaaugcaccuuuaagccagacaggcaaggagaaaaucugucuugauccaaucguuuugaaaagccaggcacacugauacuggaaacgaacagaaugacuggauuuaauugcuaaugcucuagaggcagugcaguguugaccuuuaacccaaacuugaaggguagaaaaaaggagagggugguuucuucuuuccuuucaucagaucucaacuugccuaccccuuauaccugauccugccugcuuucaacccaauccacauacacguaacauucagcuuuguccuccuuucuuauugcuugcuuccagcuuaggggcaaguugagaaugaauagaaaacagaaaaacaaaaaggaagaggaaaggacaauaggagaaggaacuauuuuaacuuguugacagcugcuuagacgcaggagacagaauuacagcuacuaaaauaagagcgacucugucaacugauguuacaacuauagccucggaauuauggagcauaucccuauauguauuuuaauauuuuauuauguuucauguguuuuguguauaugugaucaugugagcacauggaugucauugcacauaugguggucaggacaauucuagguaaucagugcucuccuuacaccauuuggguugggagacugaacucagauuguaaagcauggcagcaaguccccauggacucguuagcaacugagccaugccccaggcucacauuuuccucuauuuuaauccucuguccucguguuacuuuucucuucaaagauuuauuuuauuuuuguuuuuguguauguguauguaucuagguuuauguacauuaagugcaguuauccacaguggccaggacauaauagcaucuuaucccuggagcuaccugauaugaggucugagaaccaaacuggguccuuuuuccaaaagcaguaagcauucugaacugcugagacauuucaucaauuuuaaaggccauguuuaugagcauacccuucuuuauuccuacagcucugcuauuucuuuuuucuuguaugguuacguuggaaugaguggaauccaccaacaagucaaaaaucagaguuccuauuuuuauauguugccccaggacaacuaaguggcuacauggcacuggagaaagcaaacugaugauugaucccaucguacauccgugccugugagucuaaggcagcccugugccauggagcugcuuaguaagguuaugaagccauuugcuuuccugcucuucuauagugccuucaguacugucuuucacugcagaugccuuuacauuuuucccugaaagggaaucauguuuagucuuucucccaucuagaacacagacucuacuauauuauugccagguguacacaagucugaagaaugccuacccccauuaccaauaguauaguguuuauuuuccuuuacucuccuuuucuuugaggagguugcucucucuauuuucugucuccccauuuaucccuccucucuccuaccucuccucucucuaaccccuucucacucucucucucuuucucucucucucucucucucucucuguguggugugugugugugugugugugugugugugugugugugugugugugcacguacauacguguacaggcacuuguuuaugcauguaugccugcuguguauuugcaaauguagguuaaccucagguauugcucuucaaaugccuaccuucuauuuuugacagcaucucccaggagcauaggacuuacugauuagacuagucuuucugguaaggaaaccccaggaauucugucuuuccuucacugcugaaaguauaaguaggcaccaucauuguuuauagguuuuggagauuaaaucagguccuuguguuuguguagcauguaauuaacauguaagcuuauccaccccuccaccaacacccuuucuuugauaauugcuacaauauguccuauuuauuuuaugcauauauauuuuuuguuuucuuggauauuuuuaggugauuaguacugaacacagggccucacauacuagacaaguaaucuacuauugagcuauaugccuagcccuauguguaaguuuuucaacucugcuacagagaguuugguaaaagucuggauuuuguauuucuuuacaauauuguauccccacaaauuuauagugguuuucagcauuccaugucuauuuuuuaaugaaguaauggaugaauuaauguagaguugcuuuugauaaugcuccuggcuuucagagugccccuuuucauuuaccaaauucagcauauucacauacuuuucaaguucagauguaaggaacacuaagccauuguuggaggaagccuuuuagauucucuugggaaauccaguguucuuuauuaauuauauaugcuuguuaaugauauuguaucuagaaucaaacuuccauagaacaaguccuccaagacagcuuugaggcuaacuucaguccauugaauggaaucugauagugccacugaccuugccuaaaaccucguagauacucauaauuucacagaaauguaaauugaagguuucauuuucagagguuuugcuugggcucauuagagguaggcagaacuuuauuaugagccccaguggcaaauauaugauauuuuauuauuuccacucccuacauacauggacuaggucacuaccuuuuagaaccuuuauuguuucuauucagugagguaacuaagcaggacuuguuagcauauacuaguuauaucuuuccccuacuaucucaaauguuuucugaguguucugagagcugagaguauauacuucagugauugaucauaugcuuggcaugugugaggacuuaaguacaauucccagcauaguuaaaacaagggugaaacaugauaauuaaaacuuaacacugcuauuucagcaccuucuacauguuaaccuuaaucuacucaauugagauaaacaaguacuugauuuuauuucagaugaacacagcuuacucaugucagugaaggagaacagacaaauaauuuuuuuauagucauugcuuagaaacaaccuucuagaguuuguguaccuaucuccagacuaugacucuuuaauuuuggaauuuuugagacagaaucugacuauguaucucagacaauccugaaacuauguaggaaaagauagcuugaacauguagaaauccuccugccucagucuccaaagugcuguguuuauaggcauaagccaccauaccugccuuguagaucacuucuuguauaagauauaacuauugguuaucuuuuuauuauuauucuuuaauauuauuuuauaguccaguuguuaccuccuccuggucuguccucugacuguucuucaucccauaccuucucacacaccauucccugucuccaagaagaugucuccacccuucuaccccaacucccacaccaccaacccuccccacucccucucccuggggccucaagucucagggguuaggcacaucuucucucacugaggccagaucaggcaguccacugauguauaugaguuggcggccucuuaucaugugguguaugcugccugguugguggcucagugucugaaagaucuaaggggcccagguuaguuaagacaacuggucuuccuaugggguugaucuccuccucagcuucuuccugccuuuuccuaauucaaccacuucaggggucccuggcuucaguccaaugguuggguguaaguaucuacaucugagccucucagaaggcagucauguaggcacauuauagcaucaauaauagugucaggccuuagggccuccccuuaagcuggauccaaauuuggaccugccaccagaccuccuuccccucaggcucuucuccauuuuugucccugacauuauuucagacaggaagaauucugggucagaguuuuuuuugauuguccgaugucaaccacaucccucuacuugaugcccugucuuucuacuggagguggacuuuacaaauucccucuccccacuguagggcauuucaucuaaggucccucccuuugaguccugagagucucucaccucccaggucucuggugcauucuggaggguccccuaccuccuaucucccgagguuacuuguuuccauucuuucugcuggcucuuagggcuucagaccuguucucuccaccuucccccuuuuccccucccuguccccuuucucacucagguccccccccccauccugugauugcuuucuucucccucccaaguaggacugaggcaucgucacuuggguccuucagcuuguuaaccuucuugaguucuguggauuuuauccuggguauucuguacuuuuuuuggcuaauauccacuuuuagugaguacaugccauguaugucccuuugggucugaguuaccucacucaggaugauauuuucuaguuccauacauuugcuuuucacacucagugaggcuaaaguaauuuucuuuauucagaaaugaaauguaugucaaacuuuaaggaaauauugaaaaauacagauacaguuucaugagcgcaucuccugucuuuuguuuuguuuuguaugagauaggucucuaugcaguacuggcuauccuagagcucauuaaguagacugggccaaccucaaacuccuggagagccaccugcuucugcuuccaaagugcucuggcuaaagacuugugacauuaugccuagcuccuaauuguuuuuuugaauaucgagaguagaaaugccaagaggauuuaaauuauuaugaguaucauuagaaagaaaggacauuacauuuuugggaggauaguguacagauugauuggggauuguagaaacucugaaaguagaucugaaugcuaagguguagguuuuguugaauauuuaaacaagcuaaaacuguuguggagagaaaaauguuuaaacccgugcuuagcauccacagaagaacagugaacuguacauaaucuagacaauuugaagucagaugucguguugcauacuuuugaucccagcacucaagaagcagaaagguggggcuagugagauggcucagugguuaagagcacugacugcucuucugaagguccugaguucaaaucccagcaaccacaugguggcucacaaccauccguaacgagauaugacucccucuucuggugugucuuuagacagcuacagggcacuuauauauaauaaauaaauaaaucuuuuaaaaaaaaaaagaaaggugggaacuuuuuguucaaggccagccugccuacagagugauuuacaggacagccagagcuacacagguguauugaaccuccccauaucuuccucaaauguagaaagcuuaaauuugcugcuaugccuaaauguuuauauggaaaguuuucacuaugauaaagauaaucauuauuuaacucgggagcaugugcacuuuuauauaugggugaucacaacuacugcauagaacaaaaacuucaccauagacuaccaguuuucaauuuuuggucauuuaaguacagauuaagcagaaguuuuuccugauacugacaguuuacugaguuagguaacagcacaggcaagacuaagggagacuauuaacuaguuaggagaacacauaacuuccaaugaaucacugagcaugauuucugauguaaauccccccgaguacucuggaaaguuuacauuucaguaauuaaauauaucugauccuucuucacuaguuuuguaaaauuuauuuuggguucucagaauugacacuggauuuuuuuuuuuuuccauucggagcaugcacuauaacauauaacuaagagcuuccccacucaguuuggucaaauugcagagcuggcuaccaaaaucaucuuaguuagaaagcuauuuauuuuuuaacuuuugcaaugaaggguaaaauguauggaauuuccucagugccaaauaaaagaaggugauguaacuggcauuagaaggagguagauacauguacucaguauccaaugucugaauuucucuacucaucaggagauauccauccauccgcaguugagguaagggcuauguagugcuucuaauuaauugcuucaacauuuauuuugguuucccugugaggucauucugugucaggaagauuagcacauuauaugucuauacagaacauacuguucaguaugcuuuuuaauugugccuuaaaagucauugaaaguuuuagaauuucuauuggaaaggugaaauuuaauuagaauggaaaacaagacugcagaggaaaagagauucagugcuuaagaauggaguuuggguuuucuauaaguauuucucucagaaaugaaagaacuguuuuuuggauuuuuuaaaaucauguucuuggguugauaaucaagauuuuugucaucuuacaaccauggauuuuucuuaaaugguguugaguuaguaacuaaaggguuacagacccacgauuuuuguauaaagccaacauuagaaauagucaugguauguaaaaaguuauaugcugucucuuuguugucuccuuagguaaacuugggaaacaaauagaaacuccgagauuguuaaucaguauacgugaguuuacuugcaaagaaaaaagaaguauggagcccauauugauaaaugcucaaguccagauguggagugcaaaggcaggaauguccaagucaagaaaugcacucauugaaacauguguaggaaaacgagaaguuaaacuuauucucuauuucagcacuggaaagauuaagacuuugcaacuacacgauaauauuaaaagugugguccuucaaaccuauggcgaagaccagaauuaccuacauuugacuuuuaaaaauaaugauuucuuguuuguugagaaacucaccaccacagaugccagaagacugaagagauuucuagacaaaaccucucaagguaguauucggccagccagaagugaugagagauguggugagccuagcacaagugcacaggaguugaauggcucuggaaguucaugugaaacaaauagugagugcuuugaaucacccaaagaaagugaaaugugcauguuucgugaguugucuuugcuuccauccucaucaaccuuucuucacaauguaggauuauuagaaaaccaauucauaaagaggaaaagauuuuucucugauuuagcaaaaaaugaaaaacagagcaaccugaaggacaguaucagggacuuugaggcaaauuuagugguguguaucucuaaugaaaagggaaaagaaaggaauguaagagaaguagacaucaguaagccaggguuuggauuuccauuugagaccaacuauccugaagauagugguguggauguucgugaucuuaaugaucucauuacaaaauuauuuucuccaguucuguuggaaacacacuguauugagaacggccuagaguggcaugaauauaugaagacauacuugcuuuacccagagaaauuguggcaaggccugccuaaugugggaaacaccugcuauauaaauguuguauuacagucucuaugcucaauaccacuguuuauuaaugauuuauucaaccaggguuucccauggauuaaagcucccaaagaugauuuuaacaugcucuugaugcaacugcuuguuuugaaagauauuuacaacgcaagauuuagacagaaguuacuuauagguauuacaaaagcccuccccauauuuggagagauauuugcuguugacaggcagaaugaugcucaugaguuuuuaagucucuguuuaguucaguugaaggagacuuuccaaagaguaaccaugauguggcagucugaaaaugauucgggggauuuuuacuuacuuaaagacauuuuugcugauuaugcuacuaucaacaaaaugcccguuuguccuguuaccaauaauuuugaauuugaguugcuaagcuccauuuuuuguaaagcuuguggccugacucuuuuuaagggagaaccaaguagauaccuuucuaucaacauuccccaaggagggaaagacauguccauccaguccacuuuagaucuuuucuuuagugcagaggagcuugagcauaggugugaaaaguguuuguacaacaaaucuguuucauuucacagguuuggccggcuacccaggguaauuauuguucaucugaaacgcuaucacuuuaaugagucauggguaaugaagaaggaugagcggcccauccuuguuuccaaauacuuaaggcugucuugucacuguagcaaaagcacaaaaccgcccccaccccuucgcccaggugaacauguuaagaaucuugacuuauuaaaaccccuugaaguguuggguuccgaaauacucaaauugccuuuuaauucagugaggaccucuagauccaaggguuucgaaacuauaaacaucacaucaaacagggagucagaagcacaaagugggaaaagagucucugaaguguugaguggaaaagugcagcaggaaaauucagggaaaggugacacagcacauauaguugggucagaacuuacaaaggagacugagaaacucaagaaacaugaggaagagcauagacccagugauuuagauucugguaguaucagggaggcccaaaaguaccaacaggcugagaaauguaacgaagggagaagugauaagcagauuucccuagaggcacuuacucaaagccguccaaaaccaaucucccaggaacagacagaaaaccuugggaaaacuacacugucacauacccaggauaguagucagaguucacagagcucaucagauuccaguaagagcucccgaugcagugaugaucucgauaagaaggcaaagccuacacgcaagguggauccaacaaaguuaaauaaaaaagaagauaauguuuacaggcuuguuaauauuaucaaccauauugggaacagucccaauggaggccacuacaucaaugaugccuuugacuucaagaggcagaguugguucacuuauagugaucuacauguaacaagaacccaagaggacuuuguauauaggggucggaguucuacuggguaugucuucuuuuacaugcauaaugauauauuugaagagcucuuggcaaaggaaacucagucuaccagcacauccaaggguuaguaagaggaguguaugcuucacaguacaugucuauccaaaugccucacuuaucuaaauuggauagagaaggacagauaauuagcccaggaccaacagcucaacgaacauuuauagagaaacguuuguuccaacccugaccacaucagucuuauaauuacagcucaugcuaaugaguguucucuuauacaaguuuggaacuguaacuuuuguauaguauuuugucauaaauuuuauuauugacaguaagguuuuucaguauuuugguggaaguuauauaauccaaaguugccuuuauaccgauuaaaaugacuuauuuugcuuccaguaaaagguauguuuucucucauuucugcuuucuuucuugcauggcagcauaauaaguucuaaugaaaaagcuuuuauauaucagaaggaaaaccacacaugcccagacacagcacaguucagacgagucuauccagcgcuguuaccccagccugcugcucucuugcucuuucuacauuuggaaugguucggugucauccuccccuccuggcuuucucacaguggaugccaauuaauggugaugcuuaagugaagagagaagagaacauuuuauggcugcacauguuggaaaaaauacaaaaauggggagagggcugcauuuagcuuuuguugauuuuuaggaguuuucauuaacacugaacaauguucuuacuguucucugauuuaggccuugguuuuauaaacuguuuucaaaauaguuugauuuuguuaagucuguuuuccagugucugucuuuaguugucuugucuuuaaugggguuauuuucuuauuaggaaaaaaacaauuuccacuucuagaauuaacguugaaggagcucugcaugugcucgggaccuacugugugcuccuuucuccagaauucucuguuugggaugguugacaccgua
